United States Patent 10,696,975 (GENES AND USES FOR PLANT ENHANCEMENT) - sequence listing, part 8

SEQ ID NO: 32145 - protein, 447 aa, Dechloromonas aromatica RCB
MTFSSLGLAAPLLQALETLGYETPTPIQAQAIPAVLAGRDLMAAAQTGTGKTAGFALPILQRLSESEDKVASNSIRVLVLVPTRELAEQVHASFRQYGEHLAVSTYAAYGGVSINPQMMRLRRGVDVLVATPGRLIDLFTQNAIKFKQVQTLVLDEADRMLDLGFAHELDTLFAALPRKRQTLLFSATFSDEIRSLAKGRLRDPLSIEVAPRNSTVKAIKQWVVPVDKKRKTELFLFMRKDRKWGQVLVFVKTRRGVDELVATLLAKKIKADAIHGDKPQPARLRALESFKAGEVQILVATDVAARGLDIDDLPQVVNYDLPIVAEDYIHRIGRTGRAGATGQAISLVCADEAPLLAAIETLIKQTLSREEEPGFEPDHRVPLTGASAIAAKKPKKPKVAGGRGGKGVPGNWVGFDEGGGKRSGARSTGGPRSAAKGSPKAGKARGR

SEQ ID NO: 32146 - protein, 306 aa, Aeropyrum pernix K1
MQTHIAVGNINLDISLSVDRLPGPEEVVFARDAWIGVGGAATNYAIAVAQLGQKPVLVAVAGREMERLGVVDTLRRRGVDVSRVKTVDRPSGVVVVMVVASDSHRSMVSMRGANEELLKYIEEEPLDGVSGECHVHMASVPPQALDFAPGGCTLSYDPGGEAFKRPKSLWSRLPRVDWMFINTPELKGMSGSGDLAAAYRLLESGLKRLVLKHGRGGATVVERGFCVTLDRTPVLEPVDVTGAGDAFDAAFNIAVKAGWSVEEALRLAVAAGSAKVLRRGSSNMPTASEVLAMLPRVAYPRDCSLT

SEQ ID NO: 32147 - protein, 202 aa, Oryza sativa
EFKEINLKDFENKYLVLLFYPLDFTFVCPTEIIAFSDRIQEFKSINTEVVAISVDSQFTHLAWINTPREQGGLGKIQIPLLADLTHQISKDYGVYLQDVGHALRGLFIIDGRGILRQITMNDLPVGRSTDETLRLLQAFQYTDKHGEVCPAGWRPGSDTIIPNPEEKLKYFSKNYETKNLDQLPITLVFSSFLGWVGLYLGK

SEQ ID NO: 32148 - protein, 159 aa, Streptococcus pneumoniae TIGR4
MKIKVVTVGKLKEKYLKDGIAEYSKRISRFAKFEMIELSDEKTPDKASESENQKILEIEGQRILSKIADRDFVIVLAIEGKTFFSEEFSKQLEETSIKGFSTLTFIIGGSLGLSSSVKNRANLSVSFGRLTLPHQLMRLVLVEQIYRAFTIQQGFPYHK

SEQ ID NO: 32149 - protein, 249 aa, Clostridium tetani E88
MIIIKNKQEIEYMRLAGKVVAETLAKVEEAVKPGITTMELDRIAEDYITRCGAKPSFKGYYGFPASVCASVNNEVVHGIPSDKVVLEEGDIISIDCGAILNGYHGDAARTLPVGRISEGTQKLIDVTKEGFFKGAEKAIVGNRLTDISFAVQQYVEQLGYSVVRDYVGHGIGRDMHEDPEVPNFGRPGRGPKLVEGMVLAIEPMVNIGSYHVDVEENQWTVVTRDNSLSAHYENTVAILENGPEILTLI

SEQ ID NO: 32150 - protein, 327 aa, Anaplasma marginale str. St. Maries
MERMSKAVVIDRNGDAGVLKYVDVDVGEPGKGEVLIEHTAIGLNRYDVEYRTGTRKVPSFPAVLGVEAVGVVRQLGPGVEALNVGDRVGYCTAPGGAYSETRLINQKYLFKIADDISDEVAAAVMLKAMAAHYLTHRIYDIRPGTFALVHGVSGGVGQILCQWARYKGGKVIGVVESGARLGVAKEVGCAYVVNLKDDDITKEVMTITGDRGVNVVYDPIGAAVSKMSFGVLGHFGLYISYGSISGRMPSVSMSMLSARSWFITSPTIQHYKRSRLELGLTAMEIFEMLRRGHIRAEINKTYKFKDIAKAHKDLEDRKLSGLGVITM

SEQ ID NO: 32151 - protein, 172 aa, Triticum aestivum
  misc_feature (107)..(107): Xaa can be any naturally occurring amino acid
  misc_feature (115)..(115): Xaa can be any naturally occurring amino acid
  misc_feature (125)..(125): Xaa can be any naturally occurring amino acid
  misc_feature (142)..(142): Xaa can be any naturally occurring amino acid
  misc_feature (153)..(153): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGXYYDGRYWXTMWKLPMFGXAPNATQVINEVEEVRRXPDAYVRIIGFXNMRQVQCVSFIAFKPPGCE

SEQ ID NO: 32152 - protein, 371 aa, Streptococcus pneumoniae R6
MALTAGIVGLPNVGKSTLFNAITKAGAEAANYPFATIDPNVGMVEVPDERLQKLTEMITPKKTVPTTFEFTDIAGIVKGASKGEGLGNKFLANIREVDAIVHVVRAFDDENVMREQGREDAFVDPLADIDTINLELILADLESVNKRYARVEKMARTQKDKESVAEFNVLQKIKPVLEDGKSARTIEFTDEEQKVVKGLFLLTTKPVLYVANVDEDVVSEPDSIDYVKQIREFAATENAEVVVISARAEEEISELDDEDKKEFLEAIGLTESGVDKLTRAAYHLLGLGTYFTAGEKEVRAWTFKRGMKAPQAAGIIHSDFEKGFIRAVTMSYEDLVKYGSEKAVKEAGRLREEGKEYIVQDGDIMEFRFNV

SEQ ID NO: 32153 - protein, 281 aa, Picea sitchensis
MGMESELLGVLNVKVIGSGHRILVLAHGFGADQSVWQYILPYLVGHYKVIVFDMVFSGHVDPKHFDFDRYTSLSAYAADLLGILDELKVDKCLYVGHSVSGMVGCLASIERPELFERLILLCASPRYLNDESYHGGFERGEIDRLYCAMKSDYAAWVSGFAPLAVGVDEPSVVKEFSRTMMNMRPEIALAVARTIFESDMRSILSDVKTPCSIIQTAKDIVVPMAVPYHMQGSLGGKMNSVDLLDEDGHLPQLTHPGLLLQAFKRVLEGSEIELERTPNVN

SEQ ID NO: 32154 - protein, 343 aa, Chlamydomonas reinhardtii
MAASLPAVPAWLGTASFAVLGAALGYLAYKLVRLALADADLHLLGLGKHRANAFEGKVIWITGASQGLGAVLAKYFAGFGAKLILSSRDAAKLQRVKDSLGLGAAANDRVTILPFDLLADYSELEKAAAAADAAFGGKGIDYLIHNAGASQHALASETSAQVTDELMALNAVGPIKLTRAVLPHMLRRDHGRIVVVGSMSSKLPSPGQAVYAAAKMALYGYFSTLATEVSDTGVGVTMCCPGPVATGSEETPRVVYGANGRIVQNNTGASNRLDPARAAQLIASAAAHGVDEAWIAKHPVLAVGYIWQLLPALGWRLLKKVGPKRARAIKEGRNGYDVSKLIK

SEQ ID NO: 32155 - protein, 254 aa, Brassica napus
  misc_feature (243)..(243): Xaa can be any naturally occurring amino acid
MASMGRALYSVGFWIRETGQALDRLGCRLQGKNHFREQLSRHRTLMNVFDKAPIVDKDAFVAPSASIIGNVHLGPGSSIWYGCVLRGDANTITVGAGTNIQDNSLVHVAKSNLNGKVLPTLIGDNVTIGNSAVLHGCTLEDESYIGASATVLDGAHVEKQAMVESGALVRQNTRIPSGEVWGGNPARFLRKVTEEEKAFFSSSAVDYSNLAQVHTAENTKNLDETDFKKLLYKKNARDAEYDXLSLSENVPKSA

SEQ ID NO: 32156 - protein, 520 aa, Chlamydomonas reinhardtii
MCSHQKHAMKSRSALLLLGLGLLAGHACALRSLQQVSDAAAAQASQPQPQLLMPGLPVREICTNTCSKAKNGVCEEGRAGKVHVIAPYLMAYCDLGTDCDDCGPWKTTASKVPWEDPAVAGPVRFLQSKDVQIRVKAAAVPSAINFTFAYTDPKADYDVSYHMDVSGGVEAGITAISYKILSGRCKKADGSPALFVDVGANFGWFAILAARLGCKVIAYEPVPMFRAFFEYSVHLNDLTSLIDVRAVVVSHETGKSMKMVVPARGIWGTAGIDGLNIDRAIASSKDEIEVPSVRLEDEVKQDALLLKIDVEGWEWAVVKGAEQLLKNFYVENIVMEYSPGVPERHFRWDDMAATPAMLVDLIQKYGYRIGHIGDAGKHHSGGWDAPLPALREVALDNLKYDVNDIKLWREGKMACPSPLELTKYPMWVLCGGVPEGLNPRSLRAEIGHNTNVWAAKGTALSGGDLLKLEGLSGILDPKDPVNKYFQTNKDNFGMGSRPCYHLDPVVQVKHRCKCNKQEAC

SEQ ID NO: 32157 - protein, 189 aa, Zea mays
  misc_feature (177)..(177): Xaa can be any naturally occurring amino acid
MAVSNALVGCPKLETLLNLSSTSTLQTPLGLIGVPRNNRTRRGLIHRARCELSPSDSATISALEQLKNSAPDRYTKERSSIVVIGLSIHTAPVEMREKLAIPEAEWPRAIGELCALNHIEEAAVLSTCNRMEIYVLALSQHRGVKEVTEWMSKTSGIPVSEICQHRFLLFNGGATQXIFKVSGGFDSPA

SEQ ID NO: 32158 - protein, 646 aa, Arabidopsis thaliana
MISLTPSLFLNKTVVPGCSTRLSLRQPRTIITPPASLRVFSSLGSNQDPTGSVLIETTATSSSSLETSAADIVPKSTVSGGVQDVYGEDAATEDMPITPWSLSVASGYTLLRDPHHNKGLAFSHRERDAHYLRGLLPPTVISQDLQVKKIMHTLRQYQVPLQKYMAMMDLQETNERLFYKLLIDHVEELLPVIYTPTVGEACQKYGSIFLRPQGLFISLKEKGKIHEVLRNWPEKNIQVIVVTDGERILGLGDLGCQGMGIPVGKLSLYTALGGVRPSACLPVTIDVGTNNEKLLNDEFYIGLRQRRATGEEYSELMHEFMTAVKQNYGEKVVIQFEDFANHNAFDLLAKYGTTHLVFNDDIQGTASVVLAGLIAALRFVGGSLSDHRFLFLGAGEAGTGIAELIALEISKKSHIPLEEARKNIWLVDSKGLIVSSRKESIQHFKKPWAHDHEPIRELVDAVKAIKPTVLIGTSGVGQTFTQDVVETMAKLNEKPIILSLSNPTSQSECTAEEAYTWSQGRAIFASGSPFAPVEYEGKTFVPGQANNAYIFPGFGLGLIMSGTIRVHDDMLLAASEALAEELMEEHYEKGMIYPPFRNIRKISARIAAKVAAKAYELGLATRLPQPKELEQCAESSMYSPSYRSYR

SEQ ID NO: 32159 - protein, 249 aa, Ralstonia eutropha JMP134
MKTRIAFAALGTLFCTTLASAAEAPHWTYQGKTGASHWAGLESDYAVCGTGQRQSPINIETRKVTGTTAQPVSLAYAPASAEVINNGHTIQVEPANGGALTIDGVEYKLAQFHFHTPSEERIDGKSYPLVAHLVHKSADGKLAVIAVLFRTGKTNAALQPVFAALPGKAGAKHAVDGTIDVGALLPANRDNYTFIGSLTTPPCSEDVRWVVMKTPVSISQKQLAAFRKLYSMNARPVQAVNGREIQAGK

SEQ ID NO: 32160 - protein, 431 aa, Mycoplasma genitalium G37
MSDKLLTIDLSHVYGFDKEIIFKKYQKKVDQIHQDFLAHKLADGHMTGWYDQPDQNHQFLLKTINQIDKKFKSLKVTDIVYVGIGGSFTGIKTVLDFLKPKQRTGLKIHFVPDLSAFQAASVIKEIKNKSWALITTSKSGRTLEPALNFRIFRNLLNKRYGNKHYQRVVVITDEKKGLLTKMASNHGYQKLVIDSNIGGRFSTLSPAGLLLAKLFGHDPKAILKGTLQAKKDLQTTSLENNSAYLYAVVRHWLYTTKKFKIEVCIAYHSLYEYLLLQHRQLFGESEGKNDKSLFPTFSIFTVDLHSMGQLYQEGEKVFFETVIDVKNPLVNINLPPSDFDNDDELDFLLDKSLNEISDVAIDSVIKAHYQANVSIIKLTLKEQSAFMFGYFYFWLSVATVMSGSLLGHNVFNQPGVEVYKKLMFEKLRSGH

SEQ ID NO: 32161 - protein, 345 aa, Plesiomonas shigelloides
MDIYMSRYEEITQQLIFSPKTWLITGVAGFIGSNLLEKLLKLNQVVIGLDNFSTGHQYNLDEVKTLVSTEQWSRFCFIEGDIRDLTTCEQVMKGVDHVLHQAALGSVPRSIVDPITTNATNITGFLNILHAAKNAQVQSFTYAASSSTYGDHPALPKVEENIGNPLSPYAVTKYVNEIYAQVYARTYGFKTIGLRYFNVFGRRQDPNGAYAAVIPKWTAAMLKGDDVYINGDGETSRDFCYIDNVIQMNILSALAKDSAKDNIYNVAVGDRTTLNELSGYIYDELNLIHHIDKLSIKYREFRSGDVRHSQADVTKAIDLLQYRPNIKIREGLRLSMPWYVRFLKG

SEQ ID NO: 32162 - protein, 357 aa, Fusarium proliferatum
MAEFVRAQIFGTTFEITSRYSDLQPVGMGAFGLVCSARDQLTNQNVAVKKIMKPFSTPVLAKRTYRELKLLKHLKHENVISLSDIFISPLEDIYFVTELLGTDLHRLLTSRPLEKQFIQYFLYQIMRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVINTIASENTLRFVKSLPKRERQPLRNKFKNADDSAIDLLERMLVFDPKKRITATEALSHDYLSPYHDPTDEPVAEEKLDWSFNDADLPVDTWKIMMYSEILDYHNVEAGVTNMEEPFNGQ

SEQ ID NO: 32163 - protein, 147 aa, Glomerella cingulata
MAFKRINKELTDLGRDPPSSCSAGPVGEDLFHWQATIMGPGDSPYSGGVFFLAIHFPTDYPFKPPKVNFTTRIYHPNINSNGSICLDILRDQWSPALTISKVLLSICSMLTDPNPDEPLVPEIAHVYKTDRARYEATAREWTRKYAI

SEQ ID NO: 32164 - protein, 459 aa, Cucurbita maxima
QIEQQSPWEFQGSEVWQQHRYQSPRACRLENLRAQDPVRRAEAEAGFTEVWDQDNDEFQCAGVNMIRHTIRPKGLLLPGFSNAPKLIFVAQGFGIRGIAIPGCAETYQTDLRRSQSAGSAFKDQHQKIRPFREGDLLVVPAGVSHWMYNRGQSDLVLIVFADTRNVANQIDPYLRKFYLAGRPEQVERGVEEWERSSRKGSSGEKSGNIFSGFADEFLEEAFQIDGGLVRKLKGEDDERDRIVQVDEDFEVLLPEKDEEERSRGRYIESESESENGLEETICTLRLKQNIGRSERADVFNPRGGRISTANYHTLPILRQVRLSAERGVLYSNAMVAPHYTVNSHSVMYATRGNARVQVVDNFGQSVFDGEVREGQVLMIPQNFVVIKRASDRGFEWIAFKTNDNAITNLLAGRVSQMRMLPLGVLSNMYRISREEAQRLKYGQQEMRVLSPGRSQGRRE

SEQ ID NO: 32165 - protein, 650 aa, Zymomonas mobilis
MFPNKKTPLLDKIKTPAELRQLDRNSLRQLADELRKETISAVGVTGGHLGSGLGVIELTVALHYVFNTPKDALVWDVGHQTYPHKILTGRRDRIRTLRQRDGLSGFTQRAESEYDAFGAAHSSTSISAALGFAMASKLSDSDDKAVAIIGDGSMTAGMAYEAMNNAKAAGKRLIVILNDNEMSISPPVGALSSYLSRLISSRPFMNLRDIMRGVVNRMPKGLATAARKADEYARGMATGGTFFEELGFYYVGPVDGHNLDQLIPVLENVRDAKDGPILVHVVTRKGQGYAPAEAAKDKYHAVQRLDVVSGKQAKAPPGPPSYTSVFSEQLIKEAKQDDKIVTITAAMPTGTGLDRFQQYFPERMFDVGIAEQHAVTFAAGLAAAGYKPFCCLYSTFLQRGYDQLVHDVAIQNLPVRFAVDRAGLVGADGATHAGSFDLAFMVNLPNMVVMAPSDERELANMVHSMAHYDQGPISVRYPRGNGVGVSLEGEKEILPIGKGRLIRRGKKVAILSLGTRLEESLKAADRLDAQGLSTSVADMRFAKPLDEALTRQLLKSHQVIITIEEGALGGFATQVLTMASDEGLMDDGLKIRTLRLPDRFQPQDKQERQYAEAGLDADGIVAAVTAALQRNSKPVEVVELTTKVTEDMTL

SEQ ID NO: 32166 - protein, 250 aa, Oryza sativa Indica Group
MAWKDSYLDLVLIPAGIVFPIVYHVWLWHVVRRRPLSSTVGINTATRRLWVLGMMKDNEKKAVLVVQSMRNVIMGSTLMATTAILFCTGVAAILCSTYTVKKPLSDAVFGAHGEYMMALKYVTLLLAFLLSFLSHTTAICTLNQATFLLNTLSSSSSFAADIAGLPVTKDYVADVLERGFLLNLVGNRLFYAGVPLLLWIFGPVLACLCSVVMIPILHSIDVVYVDGSSKGEANARVEMVYESDESVMQV

SEQ ID NO: 32167 - protein, 516 aa, Candida albicans
MFTNSIISKSTTRLTQLSRQLSTTTMAPTSTKNSIKHFDYLVIGGGSGGVASARRAAKYGAKVLLIESNFKKFGGTCVNVGCVPKKVMWYTADLAHKKHDLYAYGLDKEPDSIKYGDFDWAKLKHKRDAYVTRLNGIYENNLKREKVDYAYGFAKFINSEGEVEVTLSGDQELPFLDEGKTYKKGEKLVFSADKNFDCHWWYSNCSSSVPGAELGTTSDGFFALEKQHKKVAIVGAGYIGVELSGVFSSLGSETHFFIRGDTVLRSFDEVIQNTVTDYYIDNLGINIHKQSTITKIEGSKDGKKVVHLKDGTSVEVDELIWTVGRKSLIDIGLDKVGVKINDKQQIVADEYQVTNNPKIFSLGDVVGKVELTPVAIAAGRRLSNRLFGGPEFAKDKLDYNNIPSVIFSHPEAGSIGLSTKEASEKYGEENLKIYQSKFTAMYYAMMDDQKDKSPTVYKIICAGPEEKVVGLHIVGDSSAEILQGFGVAIKMGATKKDFDNCVAIHPTSAEELVTMT

SEQ ID NO: 32168 - protein, 326 aa, Thiobacillus denitrificans ATCC 25259
MSRQHPIVAVTGSSGAGLSTIRHAFKFIFERLNIKPALVHGDGFRRYTDRQFTALLDEARRSGRKISWFGPECNHFQELESFFRTYGECGSGVYRQYAHNAEHGGELGVPAGEFTPWAPLPQGSDLLFYEGQHGGLVANTWTRRKVDARHFPPGIDRRVGRPGIDVARHVDLLIGVVPAINLEWIQKIHRDCKNGCTPEEAVETILRRMDDYIHYIVPQFGLTDINIQRMPLVDTSDPFIARDVPLPDESLCVIHFRDRERHDFRALLKRIPDAYMSRPTTMVVSSNNLRLALAAICSPILAGFMEARGPAAAGSRAPDPCVPSEL

SEQ ID NO: 32169 - protein, 232 aa, Zea mays
MAGKELTLLGLWASPFVLRARIALSLKGLTYAYSEENLDDKSELLLSSNPVLKKVPVLIHHGKPVCESQIIVQYVDEAFPAAAPNFLPSDPYDRAIARFWASYVDDKFYSAWIPVFRGRTAEEMAEAARQAVAALETLEQAFRECSKGKAFFGGDSVGLVDVVLGGLVGWLYATEAICGVKALDAGRTPLLAAWAERFCALEGVKGLIPDVDRLLEYTKARRAVFGLPPLRP

SEQ ID NO: 32170 - protein, 218 aa, Vibrio vulnificus CMCP6
MNQSSLLAEFGDPITRVENALLALKEGRGVLLLDDEDRENEGDIIYSVEHLTNAQMALMIRECSGIVCLCLTDEHANKLELPPMVVNNNSANQTAFTVSIEAKQGVTTGVSAQDRVTTIKTAANPSAKADDLARPGHVFPLRARPGGVLARRGHTEGTVDLMQMAGLQPAGVLCELTNPDGTMAKTPEIIAFGKQHNMPVLTIEDMVMYRNQYDLKLA

SEQ ID NO: 32171 - protein, 110 aa, Bacillus cereus G9241
MESRGFIFGCPVSYALGIGFIPVRKLGTLVGFDNENVKDILTINNDAIKPGQRVLITDDVLTTGRTIEAIIKLVEEAGGIISGIVFLVELTDLDGRKMLDGYDVLVLGID

SEQ ID NO: 32172 - protein, 456 aa, Gibberella zeae PH-1
MSSKHANHTAADETSPLINGGASSAHDTTSRRNGNGNGHATLSRDSSTMTFLFDSKHTPGIHNQNIAIRSLAYSWHIAKVTLLSNYVNFLLVMVPLGIIAGKMGWSSTAVFTINFFAIIPLAAVLSFATEEFSLKLGDTLGGLLNATFGNAVELIVSIVALQRNEIELVQASMLGSILSNLLLVMGMCFLFGGIVHRGESGNGREQVFSSATAQTTCSLMTLSSASLVIPAALYAVLDQSGSKEKAQSILTLSRGTAIILLLLYVLYLVFQLRTHSNLFDAENPQEDEDGEPEEPTIGPVAAIAVLVVTTVLVTVCADYLVDSIDDLVTTSGISRGFIGLILIPIVGNAAEHVTAVVVAVRDKMDLAMGVAIGSSIQIALLVTPFLVIVGWIIGAEMTLHFETFQTVAFAVSVLVVTYTVQDGKSNYLEGAMLMGLYIIIALAFYATPTDVMDPSN

SEQ ID NO: 32173 - protein, 338 aa, Haemophilus ducreyi 35000HP
MAILVTGGAGYIGTHTVVELLNANKEIVILDNLSNSNQIALERIHTITGKHAKFYLGNILDRAILRKIFAENQIDAVIHFAGSKAVGESVSEPLRYYQNNVTGSIVLLEEMLTAGINTIVFSSSATVYGDPKTIPIVESCPVGQTTNPYGTSKYMVERILEDTVNANPQFSAVVLRYFNPIGAHPSGLIGEDPNGIPNNLLPYISQVAIGKLPQLSIFGNDYDTADGTGIRDYIHVVDVAIGHLKALDKHHLESGFHVYNLGTGTGYSVLDMVRAFETANHLQIPYQVVDRRPGDIAVCYSEPSKARQMLGWKTERNLEQMMKDTWHWQKNNPNGYHD

SEQ ID NO: 32174 - protein, 177 aa, Caulobacter crescentus CB15
MDLSKIAVGVNPPYDLNAIIEIPQGGEPVKYEIDKESGALMVDRFLHTAMFYPANYGFIPHTLADDGDPADIMVVGPTPVVPGAIIRCRPIGTLMMVDEAGSDEKILAVPVDKLHPFYTGVTSWRDLPTILTEQIAHFFQHYKDLEKGKSTKISGWADPDETAEIIRTAIKRYNESY

SEQ ID NO: 32175 - protein, 803 aa, Yarrowia lipolytica CLIB122
MADKARINNAKAQLSESYNALLDHFHATELKVIGNYNVVRLIGQGSFGKVYLATHKFTNTKVVLKSSAKSAPNLVREIHHHRQFKHPHITRLHEIIVTETVVWMVLEYCPGDELYTYLVENGRLSVDETRKIFAQLCGAVTYVHNTKNCVHRDLKLENILLDRHHNVKLCDFGFTHGYESRVMLETICGTSAYMAPEMLLGKKYSGEAVDVWSLGVILYALVCGEMPFDEEDEEDTKNRIMNAEPDYAKHQLPADMLALLKGMLCKNPHQRPKLAEVLNNGFLGLEGMRQAEMLAAKEPKLFSTKMEKHVLKRMKALNISIENLYESVSKMKCDSLAGFWAASLEKAYKKERRKQSRRRSRSAFSYSFDIARKRPSEENIGDSMQMTAPHSPSSPLSKVRHFDGLGIRNRLSGDFRRPSSEQVSTPRQSLDFRPPHRSTTTGEAMTSPPAPDSPRSPRDTATNTPDTSVTLERPHTVGESPRLQASPFDNRSVTSDGSSLKKKGNFGKSLKNVMLKMVFIGKKKPTTEGNTQSEPSQSSGTGRSLPSSLHSYSIKNKSNTSLEEGIAPTETVPDVPPLPQSAPGLTSLNSQDNIEPMTSFRRTTRRERPISQISSFSGISQISGISAISSAPSVSSSLERSGSGSRRIVMRRPYFGRRSTSSSFSSIQSHRKTHSKASSTSSTDEYLGDDTTDPGSPGPSETPTTSYGRHSTSNKKAHSKQHDYNETAQFNTYKPPSRRRKSATKVSSPNMALFPSRSRPTNSKRPDRKGSVIEEEVEDEYVEESFDGDDGDGLDFDTRGRSF

SEQ ID NO: 32176 - protein, 454 aa, Saccharomyces bayanus
MSEPEFQQAYDEVVSSLEDSTLFEQHPKYRKVLPIVSVPERIIQFRVTWENDKGEQEVAQGYRVQYNSAKGPYKGGLRFHPSVNLSILKFLGFEQIFKNSLTGLDMGGGKGGLCVDLKGRSNNEIRRICYAFMRELSRHIGQDTDVPAGDIGVGGREIGYLFGAYRSYKNSWEGVLTGKGLNWGGSLIRPEATGYGLVYYTQAMIDYATNGKESFEGKRVTISGSGNVAQFAALKVIELGGTVVSLSDSKGCIISETGITSEQIADISSAKVNFKSLEQIVGEYSTFTENKVQYISGARPWTHVQKVDIALPCATQNEVSGDEAKALVAQGVKFVAEGSNMGSTPEAIAVFETARATASTLKESVWYGPPKAANLGGVAVSGLEMAQNSQRITWSSERVDQELKKIMVNCFNECIDSAKKYTKEGNALPSLVKGANIASFIKVSDAMFDQGDVF

SEQ ID NO: 32177 - protein, 474 aa, Ralstonia eutropha JMP134
MNTSSLPPQAGAAAPAADFSTLPLAPATLATLAQLGYDEMTPIQAASLPLTLAGHDLIAQAKTGSGKTAAFALALLHRLDARRFDVQAMVLCPTRELADQVTQEIRRLARAEENVKVLTLCGGSPMRPQVDSLVHGAHVVVGTPGRILDHIDRGSLELSAINTLVLDEADRMLDMGFFDDISYVASRCPRERQTMLFSATYPAGIDKLSQKFLRKPQEVKLAEKHDSSSIRQYFYEVDESERLSAVGRLLDHFRPASTLAFCNTKARCRDLVDLLRGQGFQALALHGDLEQRDRDQVLVQFANGSCSVLVATDVAARGLDIAQLEAVINVEITPDPEVHIHRIGRTGRAGEEGHAFSLVSMDEMGRVGNLEQHHGGEFEWHPLAELRAASTERLLPPMVTLQMLGGRKEKIRPGDILGALTGEAGFTKEQIGKINVMEMSTYIAVDRAIGREAVRRLNAGKVKGKKVKVRMLTE

SEQ ID NO: 32178 - protein, 484 aa, Haemophilus ducreyi 35000HP
MSIKGDIGVIGLAVMGQNLILNMNDNGFKVVAYNRTASKVDEFLAGEAKDTNIIGAYSLEDLAAKLEKPRKIMLMVRAGEVVDQFIDALLPHLEAGDIIIDGGNSNYPDTNRRTITLAEKGIRFIGTGVSGGEEGARHGPSIMPGGNEEAWPFVKPILQAISAKTDKDEPCCDWVGKEGAGHFVKMVHNGIEYGDMQLICEAYQFLKDGLGLNYEEMHAIFADWKNTELDSYLIDITADILAYKDADGEPLVEKILDTAGQKGTGKWTGINALDFGIPLTLITEAVFARCVSAFKDQRVAVSQLFNKTITPISDDKKEWIEAVRKALLASKIISYAQGFMLIREASENFEWNINYGATALLWREGCIIRSAFLGNIRDAYEANPGLVFLGSDPYFQNILQSAMADWRKVVAKSIEIGIPMPCMAAAITFLDGYSSEHLPANLLQAQRDYFGAHTYERTDKPRCSFFHTNWTGRGGNTASTTYDV

SEQ ID NO: 32179 - protein, 146 aa, Ralstonia eutropha JMP134
MKTARQVVESKPTQAIFSIPPTATVYAALQLMAEKGIGAVLVMEHGKIVGILSERDYARKVILMQRSSRDTLVRDIMTSSVIYVSGDQSTDECMALMTKHRMRHLPVMNGEDLIGMLSIGDLVKDIISEQQFIIEQLEHYIHGGSR

SEQ ID NO: 32180 - protein, 455 aa, Plesiomonas shigelloides
MASSDDNKMGLMGLTVLVTVNMMGSGIIMLPANLAGTGGITMLSWLVTTVGALCIAYTYAKCGMFCHRDGGMSAYSQEAHGKSSFFIASYTYYICLVISAVAIAVSAVGYMKPFFPWLSESAVHAFWGVVGVLVLTMVANFWGPKYTGGISSVTVWGIIIPVVGLSIIGWFWFKPELFAAGWNPHHVGTMDGISSGIALTLWAFLGIETAGANSGAVRNPEKTVPLAVMLATVSVAIVYIASTTVIQGIVPNAELAKSSAPFGLVFSMMFTPFVGQVICALAIIACIGSLLAWQFTNAQVSWAAAQMKLFPSIFGKMNKYNAPIAGMLIMLVLELLLATMSISPNTVQQFNTLLNLSVFINMVPYVLSQTGLFVMLRKNHVSASQWKIGAVVGAFAAIYSIYGVYACGQTAVFYGSILTLLGYIFYGFIAANDVPSDYDVKQEKMERGYITYPFK

SEQ ID NO: 32181 - protein, 495 aa, Haemophilus ducreyi 35000HP
MNIENSCIVIFGASGDLTFRKLIPALYNLFKVGRLGEHFSVLGVSRSDLTHDSFRQKMREALIKYEQASGQFLDDFCNHLYYQAINTADPDDYAKLLPCLDELHNKYGSCGNTLYYLSTPPSLYGIIPECLAAHGLTTEEYGWKRIIIEKPFGYDIKTAKQLDEKIHHYFEEHQIYRIDHYLGKETVQNLLVLRFSNGLFEPLWNRNFIEYVEITGAESLGVEDRGGYYDGSGAMRDMFQNHLLQVLAMVAMEPPAIINANSMRNEVAKVLYSLRPLSTEDVKNNVVLGQYTSGEIDDLVVPGYTEENGVPNDSNTETYLAVKCEIDNWRWAGVPFYVRTGKRLPTRVTEIVIHFKTTPHPVFSQNAPENKLIIRVQPDEGISMRFGLKKPGAGFEAKEVSMDFRYSDLSSASSLLTAYERLLLDALKGDATLFARTDAVHACWHFVQPILDYKAERGRVYEYEASSWGPKEADKLIARNGKVWRKPSGMMKKKI

SEQ ID NO: 32182 - protein, 491 aa, Alteromonadales bacterium TW-7
MEPSVSTPVYQNFINGHFLANQSGETFDVTNPATGEVIYSVEVADEFVQSAAIESAKQGFAQWSKMTPIERSRILLNAVAILRERNDELALIEVLDTGKPMQEANCVDIETGADVIEYFAGLAPAQVGQQQMVGEDFYYTRKEPLGICAGIGAWNYPLQIACWKSGPALAAGNAFIFKPSEETPLGAIKLAEIFVEAGVPAGVFNVVQGAGDVGQWLTAHSEIDKVSFTGEVGTGKKVVASASGTLKDVTMELGGKSPLVVFDDANIEQAVSAAMLGNFYTQGEICTNCTRIYVHKNIYQQFIDELKTRTEKNIIAGDPQDLNTNFGALISKKHQDLVMSYVNKGIEEGATLLTGGSTLSPESAPNGYFVAPTVFIDCNDEMTIVKEEIFGPVMSVLVFEDEDDVIARANGTHLGLAAGVFTSDIKRAHRVIHQLEAGICWINAYGNSPAEMPVGGYKQSGIGRENGIETLDHYTQTKSIYVGMADIESPF

SEQ ID NO: 32183 - protein, 423 aa, Vitis vinifera
MAFRTGISRRMMIRSGFGLRSMSSWWGSVEPAAKDPILGVTEAFLADPSPDKVNVGVGAYRDDNGKPVVLECVREAERRIAGKLNMEYLPMGGSVNMVEETLKLAYGENSEFIKDKRIAAVQALSGTGACRLFADFQKRFRPDSQIYIPVPTWANHHNIWRDAQVPQRTFHYYHPETKGLDFASLMDDVKNAPNGSFFLLHACAHNPTGVDPSEEQWKEISYQFKVKGHFAFFDMAYQGFASGDPERDAKSIKIFLEDGHLIGIAQSYAKNMGLYGQRVGCLSLLCEDEKQAVAVKSQLQQIARPMYSNPPVQGALIVSTILGDPELKKLWLKEVKVMADRIIGMRTALRENLEKLGSPLSWEHITNQIGMFCYSGLTPEQVDRMTNEFHIYMTRNGRISMAGITTGNVSYLANAIHEVSKSA

SEQ ID NO: 32184 - protein, 366 aa, Roseovarius nubinhibens ISM
MDVMEAARRAEAEGRHIIHMEVGQPGTPAPEGARAALAQAMEGDAMGYTVALGLPALRERIAGLYKSWYGLDISPERVVVTSGSSGAFILAFTALFDAGDRVGIGMPGYPSYRQILKALDLVPVEIETKAENRLQPVAQDLEGHDLQGLMVASPANPSGTMLDHAALAELIEAARAQGASFISDEIYHGIEYDSKAVSALEISDEVYVINSFSKYFSMTGWRVGWMVVPQDHVRTVERLAQNLFICPPHASQVAALAAMGCDEELQANLEVYKVNRQLMIDGLPKAGFDRIAPPDGAFYVYADVSHLTEDSRAFAAEILEKAGVAVTPGLDFDPKRGHGTIRFSYARATEDIREGLRRLAEFMAAR

SEQ ID NO: 32185 - protein, 267 aa, Alteromonadales bacterium TW-7
MHTNVNTLFENLWDNYLAVTPSADKIHDLLGSTQKDDIINDHIALRTFNIEKVGLEKLAAHFLALGYTECGEYHFEAKKLYAKHYEHSDPQQPKVFISELLVEKCSPELQAIVTDMVNQIDESAVTADNFLYSGTHWQVSGETYKQLLAESEYAAWMSAWGYRANHFTVNINMLAKFDNIHDVNQALKDAGFALNTSGGEVKGSPEVLLEQSSTLADEYAVSFSDGDMRIPSCFYEFAIRYPKADGELYTGFVAASADKIFESTNAR

SEQ ID NO: 32186 - protein, 366 aa, Acidovorax sp. JS42
MSLVAAAITVAGFVGAPTLAHAQDTRATAATQAQPAAAKPRVVVLATGGTIAGAGASAMNSATYTAAKVPVDKLLAGLPELSNVAQVSGEQVFQIASESFTNEHLLKLAQRVSQLAKQGDVDGIVITHGTDTLAETAYFLSLTVRTDKPIALVGSMRPGTALSADGALNLVNAVSVAASKDARGKGVLVTMNDEINTARDVNKDINIQTSAFKSQWGPLGMVVEGKNYWFRAPVKRHTTQSEFDIDSITSLPQVDIVYAYGNVQPTAVNALVAGGAKAIIHAGTGNGSVADRMVKPLQDARAKGVVIVRSARVPYGFVLRNAEQPDDKHDWVVAHDLRPEKARILTMLALAKGASTQELQRMFWEY

SEQ ID NO: 32187 - protein, 401 aa, Alteromonadales bacterium TW-7
MQVTRDLFNDVMVPNYNPSAVIPVRGEGSRVWDQNDNEFIDFAGGIAVNCLGHCHPALVNALKEQGEKIWHLSNVMTNEPALRLAQKMVEATFADKVYFANSGAEANEAALKLARRFALDKFGAEKSQIIAFNKGFHGRTFFTVTVGGQAAYSDGFGPKPGDIMHCDYNDIEAFEALISDKTCAVMMEPLQGEGGIISPTDEFAKKVRELCTKHNALLIFDEVQTGVGRTGDLYAYEGLGVVPDILTTAKALGGGFPIGAMITRTAIAEHLKIGTHGSTYGGNPLACAVAEAAFDTVNTPDVLNGVKEREQLFRDGLNAINEKYNVFSEVRGKGLLIGAVLNEKFEGRARDFLVASANNGLMNLVAGMNVIRFTPSLVIPFEDIKEGLARFEKAVSDVVNG

SEQ ID NO: 32188 - protein, 264 aa, Roseovarius nubinhibens ISM
MRDLTPLALVGASGWLGRFMGPALLRAGVVGPGDFIGLNRSGASEAYAQWPGLRWSTDPEKGLEGAGMVILSLRPDEFRAAPLRCPGALVLSVMAGVSMAEIRERTGARAVVRSMPNAAMEIGQSFSPWVAEAEADDADRAMVRAVLGASGREEAFAREADIDVYAAICGAGPAWAALLLEALAAAGRAEGLSPEQALAAAEGAVVGAGAMLAGQGAQAGAMVDEFIAYAGTTAAGLEAARAAGFAEAVAAGIAAGTQKARALG

SEQ ID NO: 32189 - protein, 521 aa, Pseudomonas putida GB-1
MHRIIHLLPFLSWLPRQSGHSLRQDLLVGLSGAILALPQSIAYALIAGLPAEYGLYAAIVPVLVACLWGSSWHLICGPTAAISIVLYASISPLAVAGSADYITLVLLLTFLGGIFQLLLGLLRFGALVNFVSHSVVLGFTLGAAIVIALGQLPNLLGMDLPSQATALKTMQDLASHAGEVDLPSLVLGLATVMIGVAFKLWRPRWPSLLISLMLVSLLAWLLPGYFGHVPRVTAFTGQLPPFSPLPLLDVELMLRLLPSAVAVGMLGLVTSLSIARSLSARSEQLIDPDQEIRAQGLSNIAGAFFSGYLSAGSFTRSGLSYEAGARSPMAGVFSALWVALFAVTGAGLIAHLPIPAMAGSILLICWGLVDHRGIRALFRVSRSEFLVMALTAAATLLLELQTAIYAGVLASLFFYLKRTSRPRVQQSREGDADVLRVGGSIFFGAAHYLQVRLQRCQGPHVVIDARQVNFIDYSGVDMLHREARRLRRLGGSLTLHRARPQVIEELQKLEGVALCPIRFEE

SEQ ID NO: 32190 - protein, 378 aa, Physcomitrella patens subsp. patens
MFPVQLFDFICCGEFESDLDWKRLSVAGECDLALGKWIPYSRPPQYNSSTCKTIQGHQNCEKNGRPDTGYLYWKWKPDLCELPRIDPAKFLNAMRNRSIVFAGDSIARNQFQSLLCVLSQVEDPRRTFHTQDDKNNAYLFQSFNVSLGIYWSPYLVRMEDKSITWSDNSTDTVTHIYFDELDKNWLNAAVGADILHLSTGQWWYKRAMYFEGGKAIGCHAWPACFKQIGFAMPYEKALAYILKGSLSIPGYHGTTVYRSFGPEHFEHGDWNHGGKCNRTAPGGVPTSFLTGWMYNIQVKQFKKLDEAAKGRLRVLRITGLAQIRADGHPNKYRSKDDKKFDSQNLNVVRNDCLHWCLPGPIDTWNDLLVESLRDIIFK

SEQ ID NO: 32191 - protein, 1521 aa, Issatchenkia orientalis
METISVGKESDVSSDGNVAYGGFNEGTNKQIRDLAREFTRQTSVDDGVQDSGDATDSNEVEKFGVDHASPNSPPKSNQYDLLRTLTSMSQVPGVNPVDQNIDPRLDPNSDEFESKFWVKNMRKLLDSDPDYYRPTSLGFAAKNLIAKGISSDADYQANFLNYPFKVVRDTYMDLFRGNDESRYFEILKSMDVLIKPGTLTVVLGRPGAGCSTFLKTVAAQTYGFKVDDSSIISYDGLTPKEINKNYRGEVIFSAEMDNHFPHLSVGQTLEFAAKMRTPQNRFPGVSRNEYAKHMSEVYMATYGLSHTVNTKVGDNFIRGVSGGERKRVSIAEASLCGANLQCWDNATRGLDAATALEFVRALKTSAHILDTTPLIAIYQCSQDAYDLFDNVVLLYEGYQIYFGPGDRAKDFFERMGYECPDRQTTADFLTSITSPAERVAKKGWENKVPQTPKEFNDYWRASAEYKELVVDIDEYLSHCHNNNTREEFAEAHAIKQANHARPSSSFRVSYWMQIKLIAQRNIWRTKGDPSIMMFSVIANIIMGLIISSLFYNLSATTGTFYYRSAAMFFAVLFNAFSSLLEVMSLFESRPIVEKHKMFALYHPSADAFASIFTELPAKIATSLGFNLMFYFMVNFRRNPGRFFFYLLMNFMATLVMSHIFRSIGSCFKTLSESMPPATVFLTAMVIYTGFALPTPSMHGWSRWINYLDPVAYVFEALMANEFDGRRFECSQFIPSYPNADLANQVCSVVASVPGFSYVNGTDYIYESYRYKITHKWRNFGIVVGFIIFFLFVYVTLVELNKGAMQKGEIILFQQSKLREMRKEKKSKQISDIEGGSEKPAGVYDHGNEDSEDGVNNLTVGSDIFHWRDVCYEVQIKDETRRILNHVDGWVKPGTLTALMGASGAGKTTLLDVLANRVTMGVVSGSMFVNGRLRDQSFQRSTGYVQQQDLHLQTSTVREALRFSAYLRQSRTISKKEKDEYVESIIDILEMRSYADAVVGVAGEGLNVEQRKRLTIGVELAAKPKLLLFLDEPTSGLDSQTAWSVCQLMRKLADHGQAILCTIHQPSALLLKEFDRLLFLAKGGRTVYFGDLGENCQTLINYFESHGAHPCPAEANPAEWMLEVIGAAPGSHANQDYHEVWMSSDERRAVQEELHRMETELLQIPVDDSAEAKRSFASSYLIQYICVTKRVLQQYYRTPQYIWSKLFLAGANSIFNGFSFYRAGTSLQGLQNQMLSIFMLSVMLNTLVQQMLPLYITQRSIYEVRERPSKTFSWWVFLAAQVTAEFPWNLICGTISYFCWYYPIGLQNNASVTHTTAERGALTWLLIVGFFNYASSLGLMCIAGVEQEQNGANISNLLFTMCLNFCGILKYPTGFWKFMYRANPFTFWIASVLGAGVGDTPLVCSSKEIVYFAPPKGETCTTYIQPYIDEAGGYLVDSEREGYCGFCTASNTNAYLKSVHVEYSKRWQNWGIFICFIAINNIFMFLFYWLARVPKKDNRVKDASALKSDEKATLGPQTTSEA

SEQ ID NO: 32192 - protein, 325 aa, Pseudomonas putida GB-1
MAKRIQFSQHGGPEVLQFVEFEPAPPAPQQVRVRNHAIGLNFIDTYFRSGLYAPPSLPSGLGTEAAGVVEAVGEGVTRLKVGDRVAHAGGPLGAYSEVHTLPEANLVKLPDNISFEQAAAVMLKGLTVQYLLKQTYEVKPGDVILFHAAAGGVGSLACQWAKALGAKLIGTVSSAEKAERAKALGAWETIDYSHEDVAKRVLELTDGKKCPVVYDGVGADTWLTSLDCLQPRGLMVSFGNASGAVSGVNLGILAQKGSLYVTRPTLATYANNAENTQAMADDLFAMIGSGKLVVDIQQRYPLSEAAKAQAELSARRTVGSTVLIP

SEQ ID NO: 32193 - protein, 736 aa, Arabidopsis thaliana
MADEVVVISKSIVRPESYNEESDRVKIHLTPWDLFFLRSEYPQRGLLFPQPDPETHIISQLKSSLSVALKIFYPFAGRLVKVENEDAGTASFYVDCDGSGVKFIHASAKSVSVSDVLEPVDSNVPEFLNRFFPANGVRSCEGISESLIAFQVTELKDGVFIGFGYNHIVADGSSFWSFFNTWSEICFNGFDADHRRKFPPLLLRGWFLDGIEYPIRIPLPETETPNRVVVTSSLLQEKIFRVTSRNISELKAKANGEVDSDDRKISSLQAVSAYMWRSIIRNSGLNPEEVIHCKLLVDMRGRLNPPLEKECFGNVVGFATVTTTVAEMLHNGLGWAALQINKTVGSQTNEEFREFAENWVKKPSILNAKAFSNSITIASSPRFNVYGNDFGWGKPIAVRAGPGNTTDGKLIAYPGIEEGNIEFQTCLSSSVLEKLSTDEEFLKHAVACATWRTEEKRRSPRVMDEEAAIDRLPLDLLAYIFSLATSFTVLAQASGVCKKWRKAVNQSMARRETLSFAGWKMDDDSTSRLVHLAFNLKELDISRSRWGCHITDNGLYQIASARCVSNLNSVSLWGMTAITDSGVVQLISRTSSLQHLNIGGTFITDESLFAIAERCHQLKTIGMWCCRHVTERGLLVLVNKCRKLESINLWGTRVPVDCFIALLTISPALQIKPMELLLNAQNPPPLLHAKLKTHIHKISAYSSAVYNTRIKSETLSKAIHVNLGSLIRSKEVIKIL

SEQ ID NO: 32194 - protein, 580 aa, Oceanobacter sp. RED65
MIKTSVISLFILALMACSDAPQSDLTKQQQDTGQGHKQAAIASAHPLATQAGLDILEKGGNAYDAAIATAAVLAVVEPYSAGMGGGGFWLLHDEATQQTRFIDAREKAPLAAHRDMYLDEDGNVIEDLSINGPMAAGIPGQAAAFAHIAKEYGNLPLSTSLAAAIQHAQNGFQIDRKYQILARWRLDALRDYPSAAEIFLQDNDVPNENHVLVQKDLAKTLTALANNGKAGFYEGPVAKQMVDSVQAAGGIWTLEDLKKYEVVEREPVTSEYRLANRQYKVTSAPPPSSGGIAIAQMFNMLEALEQHHEISWSELDGADEIHLLSEVMRRAYYDRAHYLGDSDFVQVPTDTLLDKQYAKKISKNIKLGKATKSADLGTQQQIYEGFHTTHLSVIDQDGNRVSATLSINLPFGSAYLAEGTGLLLNNEMDDFSVKPGVPNAYGLVGNEANAIAAEKRPLSSMSPSFIETEDKIAIIGTPGGSRIITMVFLGMLEYVRGNPVEDWVSRPRFHHQYLPDVIQYEKDSLTLVEIASLKMKGHELKEIQRQYGNMQAILWDKKNNKITAAADPRGVGSAEVRHIK

SEQ ID NO: 32195 - protein, 266 aa, Nostoc punctiforme PCC 73102
MQKLLFNDTDRFRAQALFLGKDINLQTLENYVSLATMPLMVTVGEQGCAVLLDYGAVVLFNLKPVEKVAFLTKLSSQISGSFAEPETEEVEIHLNIAESERVKEGKISLHEFSVERLQIVADILAKSVVLSHYETSLATVFDQIEPFAASLQREHRERRQSRELLRQLGTALLVQHKIVGRVEIIDKPELLWESPQLENLYLRLEDEYEIRERHTALERKLELITQTAQTVLEFMQHSSSQRVEWYVVILIVVEILLSLYDIIFKG

SEQ ID NO: 32196 - protein, 259 aa, Neisseria gonorrhoeae FA 1090
MNGIIIKTPEEIEKMRELGKLVAEALDYIGQFVKPGITTDEIDKLVYDYHVNVQGGYPAPLHYGNPPYPKSCCTSVNHVICHGIPDDKPLKEGDIINIDLTIKKDGFHGDSSRMFTVGKVSPIAQRLIDVTHASMMAGIEAVKPGATLGGVGYACQQVAENAGYSVVQEFCGHGIGRGFHEAPQVLHYGKKGQGPVLKPGMIFTVEPMINQGKRHLRILNDGWTVVTKDRSLSAQWEHEVLVTETGYEILTVSPATGKP

SEQ ID NO: 32197 - protein, 560 aa, Chlamydomonas reinhardtii
MGNRISIIHSLQQLAERFRHRRAAGRAAAAAAAAPATAPGAPEDTIDTTIPGWQERAVAAAATETAEAALSAAGPAPLDKYLWLRQLRAAAPRVYYGLLVNGPEAVLPYIYTPTVGQACQEYHTLGIATRGLYLRIDQDKGRVLERLRAWPQPQVRVVVVTDGERILGLGDLGANGMGISEGKIELYTAAAGVDPAVCLPVCLDVGINNTQLREHPDYKGVRSARPPQEEYDEFVQEFMEAVKVGDLCPHTLIQFEDFGNTNAFRLLRRYGGSACCFNDDIQGTAAITLAALLAALRVTGQRLADQRILFMGAGEASTGIAQLLARSMHIRDGLEEQAARQRCHLMDSKGLVLASRTDLQPHKRPFAHSDVPPCATLIEAVRAIKPTVLIGASAVPNSFTQEVVAAMAELNDRTIIFPLSNPTSLAECTFEQAWKWTQGRVLFASGSPFDPITDAQGAVHHPPQANNAYIFPAVGYAAVLTKSKCIPEEVFLVAAERLSVMATAEELQVGALFPPFARIRDISAHVMAAAAAHLSLRLPRMLQPPTPPVAALAMVLVLQP

SEQ ID NO: 32198 - protein, 266 aa, Nostoc punctiforme PCC 73102
MSLELKLLGKTAIVTGGSAGIGLATAKALYSEGVNVAIAARNQERLENAVAAIQSLPTSGAKVIAISADLTKAEDVEKVVSTTLAQFNQIDILINNAGSARAGSFLESTDDLFLDAWNLKLLGYIRLVRAVVPHQKSRGDGRIVNIVGGAGRTPRPNFLAGGTSNAALLNFTKGISKELAEYKIRINAISPGATATERAETLALQNAQAQGITVEQVKAQNIQSIPLKRIAQPEEIAALALFLVSDLAASITGTEIIVDGGSTPGI

SEQ ID NO: 32199 - protein, 455 aa, Myxococcus xanthus DK 1622
MDIHENILTAIGNTPLVKLNKLVGPNDATVLVKCEFMNPGASIKDRMALYILEKAEREGKLKPGGTIVENTSGNTGMGVALAAAVKGYKCIFTMPDKMSLEKINRLKALGAQVVVTPTNVPAEDPRSYYETAKRLHRETPGAFMLNQYHNPDNIEAHYNTTGPEIYKQTEGKFDYFVAGLGTGGTMSGAGKFLKEKIPGLKNVGVDPEGSVYEGYFKTGKLTEPHVYKVEGIGEDMLCGAMDFTHLDDVRQVDDRQCFIAARRLAREEGIFAGGSSGAAIHVAVQLAKEVGKGKTIVVVLPDSGSSYISKFHSDEWMRDNGFLEEKGAGTIRDILGDKRKDVKTARRGDKVDQVVETMRGHGISQMPVVGDDGRTVGMVHEYDLLNALVAGKAKFSDTIDSIIAPLQGALSLDTSIARLREVFAQDNVAVVKDGEKVVGIVTKIDLIDYLHRTAA

SEQ ID NO: 32200 - protein, 454 aa, Saccharomyces monacensis
MSEPEFQQAYDEVVSSLEDSTLFEQHPKYKKVLPIVSVPERIIQFRVTWENDKGEQEVAQGYRVQYNSAKGPYKGGLRFHPSVNLSILKFLGFEQIFKNSLTGLDMGGGKGGLCVDLKGRSNNEIRRICYAFMRELSRHIGQDTDVPAGDIGVGGREIGYLFGAYRSYKNSWEGVLTGKGLNWGGSLIRPEATGYGLVYYTQAMIDYATNGKESFEGKRVTISGSGNVAQFAALKVIELGGTVVSLSDSKGCIISETGITSEQIADISSAKVNFKSLEQIVGEYSTFTENKVQYISGARPWTHVQKVDIALPCATQNEVSGDEAKALVAQGVKFVAEGSNMGSTPEAIAVFETARATASTLKESVWYGPPKAANLGGVAVSGLEMAQNSQRITWSSERVDQELKKIMVNCFNECIDSAKKYTKEGNALPSLVKGANIASFIKVSDAMFDQGDVF

SEQ ID NO: 32201 - protein, 270 aa, Haemophilus ducreyi 35000HP
MLILNSSLLNAVKDIAHQAGEHLKRFYAHSVEIKIKADNTPVTEADLFLSQFIIQQLQQLTPTIPVLSEENCAIPLTERANWQEYWIIDPLDGTQQFINRTDQFSIAISLVQHNQPVIGIIYAPILAKTYFAMRTSGAFLQENGIIRPLTPHKIMANNERLRIAMGATNRTTVAQCLQQPLQADIFQYGSSSLKAGLVAEGKADCYIRLGDTGEWDTAAAEVLLNEIGGKIFDLNFQPLSYNQRQHFINPHFVMVADKQADWQKIFQFNE

SEQ ID NO: 32202 - protein, 496 aa, Nicotiana tabacum
MVLSKTASESDVSIHSTFASRYVRTSLPRFKMPENSIPKEAAYQIINDELMLDGNPRLNLASFVTTWMEPECNKLMMDSINKNYVDMDEYPVTTELQNRCVNMIAHLFNAPLGDGETAVGVGTVGSSEAIMLAGLAFKRKWQNKMKAQGKPCDKPNIVTGANVQVCWEKFARYFEVELKEVKLSDGYYVMDPEKAVEMVDENTICVAAILGSTLNGEFEDVKRLNDLLIEKNKETGWDTPIHVDAASGEFIAPFLYPELEWDFRLPLVKSINVSGHKYGLVYAGIGWAIWRNKEDLPDELIFHINYLGADQPTFTLNFSKGSSQVIAQYYQLIRLGFEGYKNVMENCQENARVLREGLEKSGRFNIISKEIGVPLVAFSLKDNSQHNEFEISETLRRFGWIIPAYTMPPNAQHVTVLRVVIREDFSRTLAERLVIDIEKVLHELDTLPARVNAKLAVAEANGSGVHKKTDREVQLEITTAWKKFVADKKKKTNGVC

SEQ ID NO: 32203 - protein, 427 aa, Methanocaldococcus jannaschii DSM 2661
MTKVEKNGIGKRICVIGLGYIGLPTASMLAIQGFDVIGVDINEKRVKEIKELSFKTTEKDLMTLVKGAINSGNLKVQTKPEKADVFIICVPTPCIECDGEKKCDLTYLNKAIESIKPYLENGNLIIIESTIPPGTTDDIYKKLSKDKKIYVAHCPERVLPGSILKELVENDRVIGGVDEKSAEMAKEIYETFVTGKIYLTDAKTAEMVKLMENTYRDVNIALANEFAKIAEEIGINVWEAIELANKHPRVNILKPGPGVGGHCISIDPWFIVEKSKNAKLIRTARELNDSMPLFVVEKIKKIIKKDIGKVAIFGVTYKGNVDDTRESPAEKVVSKLIDEGFEVKCYDKYARDFIYPLNSLDEAVEGADIIVILAEHDEYKNFDKEDIKNIASKVKNKIILDTKNILNRELWEKEGFKVYVLGDGKNA

SEQ ID NO: 32204 - protein, 1163 aa, Gibberella zeae PH-1
MSKQAGTEDAAAPQSVTNPTSQNELYPMVNWKYDMFLYTVGNIVDMFFREVVPRGAWRVPQTGPVLFVAAPHANQFVDAIILQRTLRNEAKRRASLLIAQKSVHGFIGWGSRQVGSVPVGRAQDAAKPATGTIYLPDPINDPTLIRGVGTKFGQGEGEVQGMLFLPSVKGQSGASVDILEIISPEEIRVKRPFKGKLALSQLTGRDDIDNNGNFTIKEVKGPAPGFQGTKFKMAPHIDQTKVYDAVFSRLCNGGCVGIFPEGGSHDRTELLPLKAGVAIMALGTLAQDPDCGLKIVPVGMNYFHAHKFRSRAVVEFGAPFEIPRHLVELYCNKQRREAIGQVLDTVYQALNSVTVSAPDYDTLMVIQAARRLYNPTGKKLPLPVVIELNRRLCMGYERYKNDERITSLTAAVKEYNSQLRYLNLKDHQVQYAKMNMVKVIFLFIYRSIKLLLLFICTLPGLILFAPVFVATRIISRRKAKTALAGSTVKIRGRDVMATWKILVAIGLAPTLYHIYSAIVTFKVWQDRLWGRVPEGVPLWVIYFAMWPFMVGITFASLRFGEVGVDIFKSLRPLLLCLTPTSNYNIHRFRIRRAELSAQVTDVINTLGPEMFDDFEKARLVPDLYKVEGGAATSPMSHRRRDSDQSSTGLEPETPPALSRRSTTQSSRALPRNDSFSNIGHVGIFSTRPPSRARSRSRSSSSGGGFGSGGFPLSGFTTLDSSGGFDEATRKIREAMKHRRHKTDQERTDGDEEDDDSEEEGYDEARKKNATWIDTSNEEWLCSVIGVRRGQPHNPSSSTTAATPSWLPRPPAKQRMALSFKNLVSSVLGSGAAKDDKPPSASELFVKTDPKVDGEECLHDCDNCSARYPRGFKIEEEDVLYGLVAAWSTHVLVGTGKTDWVRDVEEEEGSVMQAFSKAVEPSNGKLKLSASNMPTPHDTDDYSEPTTLLLLPAFKLLRNVHPLSVPQIITEVINQAPTNTSPLTPTPLPASLPSPDPAAGIPDVSLANCPHNAVILMCSHRTRDVRCAQSAPVLRKEFERQLRPLGLYRDLHDERPGGVGIYYISHVGGHKYSANVMIYRRPNAFGLDDTTEQQNGTSNGEKNGDSVNDSGEGSVGAAQGIWLARVMPEDCENLIRYTVLRGKVVKPERQLRGGFDRGRGVMSW

SEQ ID NO: 32205 - protein, 609 aa, Saccharomyces uvarum
MPLSEDFGSSGKKEASPDSISIRSFSAVNNLQSSSSEKNYSGQTTRNNKLIHRFVDSFKRAEGSTTHTKQINENTSDLEGDVNSFTSDSKLKKSMKSRHVVMMTLGTGIGTGLLVANAKGLHYGGPAALVIGYFLVSFVTYFMIQAAGEMAVTYPTLPANFNAYSSIFISKPFGFATVWVYCFQWLTVLPLELITAAMTIKFWNDTINPDIFILIFFVFLLFIHFFGVKGYGETEFIFNCCKILMIAGFIILSVVINCGGAGNDGYIGGKYWRNPGAFAGDTSAGRFKNVCYILVTAYFSFGGMELFALSVQEQANPRKTTPVAAKRSIYRILVIYLLTMILIGFNVPYNDDQLMGAGGSATHASPYVLAASIHGVKVVPHIINAVILISVISVANSSLYAGPRLMCSLAQQGYGPKFLDYVDREGRPLIALIVCSVFGVIGFVAASSKEEVVFAWLAAIAGLSELFTWTSIMLSHLRFRQAMKVQGRSLDELGYKATTGIWGSAYGVFFNILVFIAQFWVALAPLNNGGKCSAESFFQSYLAFPIWIAFYLGYMIYNRDFTFLNPLDKIDLDFHRHIYDPELMRQEDLENEERKRDMSLMRKTYLFWC

SEQ ID NO: 32206 - protein, 224 aa, Caulobacter crescentus CB15
MFCDITPENDACVTFKMRAFGALASRRREVHFRRMFIQTETTPNPEVLKFLPGREVLGDGAREFRTPEEGDASPLAKALFELGDVSRVFFGPDFLTVTKGEDAQWPHLKAPILAAIMDHFTSGRPLLLDQTAESGGHDEGDYDEETSQIVAEIKELLDTRIRPAVAQDGGDIVFSRFEPQTGVVWLHMRGACSGCPSSSATLKSGVENMLKHYVPEVTRVEQTL

SEQ ID NO: 32207 - protein, 573 aa, Arabidopsis thaliana
MAVIVWWLLTVVVVAFHSASAAVVESTWEVEYKYWWPDCKEGIVMAINGQFPGPTIDAVAGDTVIIHVVNKLSTEGVVIHWHGIRQKGTPWADGAAGVTQCPINPGETFTYKFIVDKAGTHFYHGHYGMQRSSGLYGMLIVRSPKERLIYDGEFNLLLSDWWHQSIHAQELALSSRPMRWIGEPQSLLINGRGQFNCSQAAYFNKGGEKDVCTFKENDQCAPQTLRVEPNRVYRLRIASTTALASLNLAVQGHQLVVVEADGNYVAPFTVNDIDVYSGETYSVLLKTNALPSKKYWISVGVRGREPKTPQALTVINYVDATESRPSHPPPVTPIWNDTDRSKSFSKKIFAAKGYPKPPEKSHDQLILLNTQNLYEDYTKWSINNVSLSVPVTPYLGSIRYGLKSAYDLKSPAKKLIMDNYDIMKPPPNPNTTKGSGIYNFAFGIVVDVILQNANVLKGVISEIHPWHIHGHDFWVLGYGEGKFKPGIDEKTFNLKNPPLRNTVVLYPFGWTAIRFVTDNPGVWFFHCHIEPHLHMGMGVVFVEGVDRIGKMEIPDEALGCGLTRKWLMNRGRP

SEQ ID NO: 32208 - protein, 273 aa, Datura stramonium
MEESKVSMMNCNNEGRWSLKGTTALVTGGSKGIGYAIVEELAGLGARVYTCSRNEKELDECLEIWREKGLNVEGSVCDLLSRTERDKLMQTVAHVFDGKLNILVNNAGVVIHKEAKDFTEKDYNIIMGTNFEAAYHLSQIAYPLLKASQNGNVIFLSSIAGFSALPSVSLYSASKGAINQMTKSLACEWAKDNIRVNSVAPGVILTPLVETAIKKNPHQKEEIDNFIVKTPMGRAGKPQEVSALIAFLCFPAASYITGQIIWADGGFTANGGF

SEQ ID NO: 32209 - protein, 360 aa, Mycobacterium tuberculosis H37Rv
MTVPPTATHQPWPGVIAAYRDRLPVGDDWTPVTLLEGGTPLIAATNLSKQTGCTIHLKVEGLNPTGSFKDRGMTMAVTDALAHGQRAVLCASTGNTSASAAAYAARAGITCAVLIPQGKIAMGKLAQAVMHGAKIIQIDGNFDDCLELARKMAADFPTISLVNSVNPVRIEGQKTAAFEIVDVLGTAPDVHALPVGNAGNITAYWKGYTEYHQLGLIDKLPRMLGTQAAGAAPLVLGEPVSHPETIATAIRIGSPASWTSAVEAQQQSKGRFLAASDEEILAAYHLVARVEGVFVEPASAASIAGLLKAIDDGWVARGSTVVCTVTGNGLKDPDTALKDMPSVSPVPVDPVAVVEKLGLA

SEQ ID NO: 32210 - protein, 260 aa, Datura stramonium
MAGRWNLEGCTALVTGGSRGIGYGIVEELASLGASVYTCSRNQKELNDCLTQWRSKGFKVEASVCDLSSRSERQELMNTVANHFHGKLNILVNNAGIVIYKEAKDYTVEDYSLIMSINFEAAYHLSVLAHPFLKASERGNVVFISSVSGALAVPYEAVYGATKGAMDQLTRCLAFEWAKDNIRVNGVGPGVIATSLVEMTIQDPEQKENLNKLIDRCALRRMGEPKELAAMVAFLCFPAASYVTGQIIYVDGGLMANCGF

SEQ ID NO: 32211 - protein, 260 aa, Hyoscyamus niger
MAGRWNLEGCTALVTGGSRGIGYGIVEELANLGASVYTCSRNQKELDECLTQWRSKGFNVEASVCDLSSRSEREEFMKTVSNHFHGKLNILVNNAGIVIYKEAKDYTMEDYSHIMSINFEAAYHLSVLAHPFLKASERGNVVFISSISGASALPYEAVYGATKGAMDQLTRCLAFEWAKDNIRVNGVGPGVIATSMVEMTIQDPEQKENLDKLIDRCALRRMGEPKELAAVVAFLCFPAASYVTGQIIYVDGGFMANGGF

SEQ ID NO: 32212 - protein, 268 aa, Datura stramonium
MAGREIGGGDRRWSLRGMTALVTGGTRGIGYAIVEELANFGAEVYTCSRSQNDLDECLEKWRRKGFKVSGPVCDVSSISQRQTLMESVTSSFNGKLNILINNAGTTIPKEATNFTAEDYSIIMGTNFEASYNLCQLAHPLLKASGNASIVFNSSAAGVIAVPLSSIYAASKGAINQVTKSLACEWAKDSIRVNAVAPWIINTPIIEAACQVPSQKKNIESLIGRAPMKRAGEPSEVSSLVTYLCLPTASYITGQIICVDGGYTVNGFI

SEQ ID NO: 32213 - protein, 122 aa, Brassica napus
  misc_feature (37)..(37): Xaa can be any naturally occurring amino acid
DCTRKAWKIWCQLIGAPIMKWDPNTCTFGASEEDWRXYLEENPRATQFRRKQVPCADKLAIIFKGVIEPGKADFRPYRRKLRDHSESPQLLHDPTPLSTLYINEPVTGSEHGDDDDDEYADD

SEQ ID NO: 32214 - protein, 463 aa, Pseudomonas fluorescens PfO-1
MSSTQSSNGLEQGLKPRHVTMLSIAGVIGAGLFVGSGHAIAAAGPAVLLAYAAAGALVVLVMRMLGEMAVASPDTGSFSTYADRAIGHWAGFTIGWLYWWFWVLVIPLEANAAATILHAWFPGVDIWAFALIITMLLTVTNLFSVKNYGEFEFWFALLKVVAIIGFIILGVAAIFGFLPNSQVSGVSHIFDTQGFLPNGMGAVLGAILTTMFSFMGTEIVTIAAAESKNPGKQISKATNSVIWRIGLFYLVSIFIVVALVPWNDPVLASVGSYQTVLERMGIPNAKMIVDIVVLVAVTSCLNSALYTSSRMLFSLGKRGDAPVMSTRTNKSGTPYWAVMLSTGAAFLCTFANYVAPAAVFEFLLASSGAIALLVYLVIAISQLRMRKQRMARGEKIVFSMWLFPGLTYAVIAFIVAALTIMLFQDAHRVEILATGLLSLVVVATGLLVARRRKMENRGAAVLN

SEQ ID NO: 32215 - protein, 414 aa, Idiomarina loihiensis L2TR
MTDFRQQALDYHEYPTPGKISVELTTPAETSKDLALAYSPGVAEPVREIAQDPDAAYRYTAKGNMVAVITNGTAILGLGNLGPLASKPVMEGKALLFKRFAGLDSIDIEVNHRTTQDFINTVANIADTFGGINLEDIKAPECFEIEQALIERCNVPVFHDDQHGTAIVTAAGMLNALEIQGKNLAESRIVCLGAGAAAIACMELLIKCGAQREHIYMLDSKGVIHTRRDDLNEYKQLFANNTDKRTLKDVIEGADIFVGVSGPNLLSAEELKLMAPNPVLFACSNPDPEIKPETAMAARDDLIMGTGRSDYPNQVNNVLCFPFMFRGALDVRATAINDEMKVAAVEAIRQLAKEPVPESVLKAAGVKELTFGRDYIIPKPIDPRLCPRVSRAVAEAAVKSGAAKIDLPKNYMQD

SEQ ID NO: 32216 - protein, 427 aa, Coprinopsis cinerea okayama7#130
MDVPSSYQEDNHLTPRPDMLGFKLEAPRREGSATTPVDPRVLDAMLPYLTDQYGNPHSRTHAYGWEAEQGVDEARKHMADIIGADMKDIIFTSGATESNNLAIKGVARFHKEKKKHIITTQTEHKCVLDSCRNLGEEGFDITYLPVQRNGVISLEELENAIRPDTSLVSIMAVNNETGVIQPLKEIGAIVRKYRGVYFHTDAAQAVGKIPLDVNEMNIDLMSISGHKMYGPKGVGAAYIRRRPRVRLEPIFSGGGQERGLRSGTLPASLVIGLGEAARIAKLEMERDHARVKELSDRLLNSIYSRVEHVVRNGDVNGYPGCVNLSFSYVEGESLLMALKEIALSSGSACTSASLEPSYVLRALGAAEDMAHSSLRFGIGRFTTEAEIDFVVEKIVATVERLRDMSPLWEMVQEGIDINSIDWSQSQH

SEQ ID NO: 32217 - protein, 330 aa, Gloeobacter violaceus PCC 7421
MKAAVVPNLHGRWEIRDLPIPEPGINQVLIRIKASGLCYTDIHITEGAWPADSFPRTLGHEPVGEIVALGAGVRTRRLGDRVGVPWLQLACGRCEWCRRGKALFCKDQQGTGVQTQGGHAEYMLAQAEATVLLPDALAYEQAASLFCAGYTVWAGLRFADPKPHERVAVLGIGGLGHLAVQYGKAAGFETFAITHSPSKEKLVRSLGADGVFPSGAALREAGGADVILACSNSYRATGEALQGLRPDGRLVLMGLPSDNQTLAVSGDLLVNRWRIIGSQQNGPEHLFEALDYAAKGKVKVVAETYSLDEINLAFDRVFSGDVRFRAVIIP

SEQ ID NO: 32218 - protein, 296 aa, Coccidioides immitis RS
MAEFQKYVDAGFTAYDMADHYGDAEILFGRFRYSYTGPKTIFCSTKYCVFQPTPQTEAVVHEAISRRLKNIKSDKVDLLQYHWQDYGDPQYIPALQIMEADSRVSNLGLCNFDTKRMKEVIDAGIKFATNQVQFSLIDTRPRYEMEAVCIQHDIKLLTYGTLCGGFLSEKWLGKPAPEAFSEGMTPSLRKYLEMITIWGGWSLFQTLLTTLSTIAAKHSVSISAVAARWVLDFPYVGAVLVGARMGVSEHIDENLAIYGLSLDDEDRDKIEDILKMSKRDQVFADMGDCGSEYRSA

SEQ ID NO: 32219 - protein, 249 aa, Gloeobacter violaceus PCC 7421
MARFAGKVAVITGGSVGIGRATAVAFAREGAAVVVASRRADESEKTVQLVKDAGSDSFFVQTDVTQAAQIEAMVEKTMAVYGRLDFAFNNAGVEQQPSALPDQSEALFDWISDINYKGTWLCMKYEIPQMLKNGGGAIVNMSSIAGEIGFPGVPIYTASKHAVLGLTKAVALEYAKSNIRVNAVSPGAIHTDMYERFEPEVRETLINLHPLGRPGKPEEVAQTVLFLCSEGAGYITGHSLMIDGGYVAQ

SEQ ID NO: 32220 - protein, 1080 aa, Zea mays
MEGDADGVKSGRRGGGQVCQICGDGVGTTAEGDVFTACDVCGFPVCRPCYEYERKDGTQACPQCKNKYKRHKGSPAIRGEEGDDTDADDASDFNYPASGNDDQKQKIADRMRSWRMNAGGSGDVGRPKYDSGEIGLTKYDSGEIPRGYIPSVTNSQISGEIPGASPDHHMMSPTGNIGRRAPFPYMNHSSNPSREFSGSVGNVAWKERVDGWKMKQDKGTIPMTNGTSIAPSEGRGVGDIDASTDYNMEDALLNDETRQPLSRKVPLPSSRINPYRMVIVLRLIVLSIFLHYRITNPVRNAYPLWLLSVICEIWFALSWILDQFPKWFPINRETYLDRLALRYDREGEPSQLAAVDIFVSTVDPMKEPPLVTANTVLSILAVDYPVDKVSCYVSDDGAAMLTFDALAETSEFARKWVPFVKKYNIEPRAPEWYFSQKIDYLKDKVHPSFVKDRRAMKREYEEFKIRVNGLVAKAQKVPEEGWIMQDGTPWPGNNTRDHPGMIQVFLGHSGGLDTEGNELPRLVYVSREKRPGFQHHKKAGAMNALVRVSAVLTNGQYMLNLDCDHYINNSKALREAMCFLMDPNLGRSVCYVQFPQRFDGIDRNDRYANRNTVFFDINLRGLDGIQGPVYVGTGCVFNRTALYGYEPPIKQKKGGFLSSLCGGRKKGSKSKKKGSDKKKSQKHVDSSVPVFNLEDIEEGVEGAGFDDEKSLLMSQISLEKRFGQSAAFVASTLMEYGGVPQSATPESLLKEAIHVISCGYEDKTEWGTEIGWIYGSVTEDILTGFKMHARGWRSIYCMPKRPAFKGSAPINLSDRLNQVLRWALGSVEILFSRHCPLWYGYGGRLKFLERFAYINTTIYPLTSLPLLIYCILPAICLLTGKFIIPEISNFASIWFISLFISIFATGILEMRWSGVGIDEWWRNEQFWVIGGISAHLFAVFQGLLKVLAGIDTNFTVTSKASDEDGDFAELYMFKWTTLLIPPTTILIINLVGVVAGISYAINSGYQSWGPLFGKLFFAFWVIVHLYPFLKGLMGRQNRTPTIVVVWAILLASIFSLLWVRIDPFTTRVTGPDTRTCGINC

SEQ ID NO: 32221 - protein, 185 aa, Roseovarius nubinhibens ISM
MSALKIKKGSNKHSAYNLRPTFSDVVESHTLAVLVDNEPGVLARVIGLFSGRGYNIDSLTVAEVDHTGHTSRITIVTKGTPQIIEQIKAQLGRIVPVHAVHDLTVEGPVVERELALMKVEGEGEKRVEALRLADIFRANVVDSTLGSFVFEITGPSDKIDAFADLMRPLGLIDIARTGVAALPRG

SEQ ID NO: 32222 - protein, 433 aa, Alteromonadales bacterium TW-7
MPNYANRYISSLTRETYALILAGGRGSRLHELTDWRAKPAVYFGGKHRIIDFPLSNCINSGVRRVGIATQYKSHSLIRHVNRAWGHFKKELGESVEILPASQRHGDEWYCGTADAVFQNMDIIRHELPKYVMILSGDHVYRMDYGALLAEHVQKGADMTVCCIEVPVEEAADTFGVMTVDEESRVCRFDEKPAMPSSVPGKPGTCLASMGNYIFNTEFLFEQLKKDAENEGSGRDFGHDIIPAIIEEHNVFAFPFRDPQQEGQPYWRDVGTLDSFWEANMELVMPEPQLDLYDPAWPIWTYQEQLPPAKFIFDDDDRRGMALDSTVSGGCIISGSAVRKSLLFSNVHVRSFCEIEQSVILPGAIINRGCKIKRAIIDRSCEIPAGLEIGFDRKTDEENGFRVSKKGIVLVTRDMLSELAKKLERQTQENKKLA

SEQ ID NO: 32223 - protein, 545 aa, Azoarcus sp. EbN1
MTEPFTPPHRLSAWSTLENHAARLRTMRIAELFEHDAARFATLSFGHRGLLLDLSKQSIDAPALAALVDLAGQARLPDGIEALFAGEHLNFTEDRAVLHMALRGACAAPLEDAATLAQSQQRMRAFTVALRSGTMTGATGKPIRLVVNLGIGGSDLGPRMAAQALVPTGLRATPEVRFVANIDRRELDEALADADPASTLFVVSSKSFATAETLANAQAARAWLQAGLGAGCDPALHFTAVSNATDAAAAFGIPAERVFPLPEWVGGRYSVWSTIGLPLMIAIGASEFDAFLAGARAMDEHFRTAPPGENLPVLMGLAGLWNTDFLGIESLALLPYAHGLRSFAAWLQQLEMESNGKRCLRDGSGSVIHTSPIVWGGVGTVGQHAFHQLFYQGTRRVALDFIVPVAAADDVSQRSLVENAFAQSAALMSGRDLDTALASLRAKGLAESEAAVLAPHLVCPGNQPSTTVLLPALDAFSLGQLMALYEHKVFVQGWIWGINSFDQYGVELGKEMARSLSAGSGENHDASTAGLMAAAEAMRRTPDRS

SEQ ID NO: 32224 - protein, 356 aa, Acidovorax sp. JS42
MRGFPTMQGTFPIDRNTAMNLQKFPRHPLTFGPTPIQPLKRLSQHLGGKVELYAKREDCNSGLAFGGNKTRKLEYLIPEAIAGGYDTLVSIGGIQSNQTRQVAAVAAHLGLKCVLVQENWVNYSDAVYDRVGNIEMSRILGADVRLDAAGFDIGIRPSWEQAMADVKRAGGKPFPIPAGCSEHPYGGLGFVGFAEEVRQQEKELGFRFDYIVVCSVTGSTQAGMVVGFAADGRARRVIGIDASATPEKTHAQILRIAQSTADLVELGQDITAEDVVLDTRYGGPEYGLPNEGTLEAIRLCARQEGMLTDPVYEGKSMHGMIERVRNGEFPAGSKVLYAHLGGVPALNAYSFLFRNG

SEQ ID NO: 32225 - protein, 140 aa, Glycine max
CCTCEAVEMVRTLAMIKPDGLSGKYTEAIKEVILDSGFHIVKETEVQLDAERASVFYAEHSQRSFFDSLVKYITSGPVLAMVLERPDAVAQWRTVIGPTDAKKANTSHPNSIRAMCGLDSEKNCVHGSDSPESADREISF

SEQ ID NO: 32226 - protein, 490 aa, Azoarcus sp. EbN1
MKSKPAYQNLELQPIAGQWRAGSAERNLDVTDPFTGKTLLSLPMASCEDLDQAYHAAQKAQSEWATMGPTVRGDVMRRAVEIFDERKEEILHWLIRESGSTHIKAEIEWASARAITLESASLPSRVHGRILPSDVPGKESRVYRAPLGVVGVISPWNFPLHLSARSVSPALALGNAVVIKPASDTPITGGLLLARIFEEAGLPAGVLSVLVGAGSDIGDAFVEHPVPSFISFTGSTPVGRNIGRLASGGTHLKHVALELGGNSPFVVLADADVDAAVNAAVVGKFLHQGQICMAINRIIVEAPLLEGFTRRFVERVKALPYGDPSKPETIVGPVINAKQLAGLTAKISKAQQEGAVVLVGGDPQGNVMPPHVFGNVTADMEIAREEIFGPLVGIQSARDAEHALTLANSSEYGLSSAVFTGDTSRGVQFAQRIRAGMTHINDMPVNDEPNAPFGGEKNSGLGRFNGDWAIEEFTTDHWVTVQHAPRRYPF

SEQ ID NO: 32227 - protein, 362 aa, Azoarcus sp. EbN1
MKIQAAVTPAQGEDFTIEKVTLAPPKLNEVLVRVVATGVCHTDAVARDLGISPYPIVLGHEGSGIVEQIGENVTSLEVGDHVVMSFAHCGQCENCLTGHPTVCSRFNELNFGGRMEDGTCRLHQGDTELSTFFGQSSFGTHVVAHERNVVKVDKDVDLALLGPLGCGIQTGAGTVLNRLKPAFGTSIAVYGCGAVGLSAIMAAKIAGCQQIFAIDVHESRLQLAGELGATHVLNGKEVDVVKEIKEASMGGTHYAVESTGVPPVVRQCLHALRPLGQAAIVGVTPEMNIDVHNDLMAEGKSMIGVIEGDSVPRVFIPKLVEFFKAGKFPFDKLVKFYRFDQINQAFEDSANGIAVKPVLRLA

SEQ ID NO: 32228 - protein, 420 aa, Chromobacterium violaceum ATCC 12472
MPFASLGLQPDLVQSALEQDYVRPTAIQSAAIPAILQGGDVLATAQTGSGKTAAFCLPLLQQWLDSPRAILRQPRALILLPTRELAAQVGDILRDLAQSLPRKLKVAVVYGGVSINPQMMALRGGADIVVATPGRLLDLLDHNALRLSAVKTLVLDEADRLLDLGFADELGSVLDRLPPARQNLLFSATFPPAVRALAEKLLKQPLRIDIEHAAATAPDIRQRAIEVDAGKRTLLLRHLLATRDWDKALVFVASRQAADRVADKLRRNGVPAAALHGDCSQGQRGQALADLKSGRLRVLVATDVAARGIDIARLPLVVNYDLPRSPVDYTHRIGRTGRAGARGEAISFVSADCAAHFRLIEKRQQLRLPRERIAGFEPTETAIAAASLTDPDGNGGIKGKRKSKKDKLREAAAMQEAGGN

SEQ ID NO: 32229 - protein, 339 aa, Streptococcus pneumoniae R6
MENLVKSTSDTYIPEEIMSFSDLKLFALSSNKELAERVAQEIGIELGKSSVRQFSDGEIQVNIEESIRGKHVFILQSTSSPVNDNLLEILIMVDALKRASAESVNVVMPYYGYARQDRKARAREPITSKLVANMLEVAGVDRLLTIDLHAAQIQGFFDIPVDHLMGAPLIADYFERRGMVGSDYVVVSPDHGGVTRARKLAEFLKTSIAIIDKRRSVDKMNTSEVMNIIGKVEGKTCILIDDMIDTAGTICHAADALAEAGAVEVYASCTHPVLSGPATDNIQKSAIKKLVVLDTIYLPEERLIDKIEQISIAHLLGDAIVRIHEKRPLSPLFDIEKKI

SEQ ID NO: 32230 - protein, 313 aa, Zea mays
MDPPPPLALFASSSSSSSPSPPTSSSSGASITMVIITVVGILAAFALLASYYAFVTKCQLLRAVWSRQPPWHRRVRGAGGGGLTGRRDEPSSVVRGDGRRGLGLPLIRMLPVVKFTAASCDAGAGAGGVAPRISVSECAVCLSEFVERERVRLLPNCSHAFHIDCIDTWLQGSARCPFCRSDVTLPAIPSARRAPAAAAAVLPTSRRRDDALASESIVIEVRGERERWFSSSHGTTTTTPRRQPPKQPAPRCSKAAESVGDEAIDTRKTDAEFAVQPLRRSVSLDSSCGKHLYVSIQELLATQRWDDGDVGRP

SEQ ID NO: 32231 - protein, 395 aa, Staphylococcus xylosus
ANQVQPLNKYPVVFVHGFLGLVGDNAPALYPNYWGGNKFKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHKAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMDTTSRIIGHDAREEWRKNDGVGPVISSLHPSNQPFVNVTNDEPATRRGIWQVKPIIQGWDHVDFIGVDFLDFKRKGAELANFYTGIINDLLRVEATESKGTQLKAS

SEQ ID NO: 32232 - protein, 310 aa, Vitis vinifera
MASQLIREWTGIQQFPPITQTKLIELLGKLKQENVSTLTILVMGKGGVGKSSTVNSIIGERAVAVSAFQSEGPRPVMVSRSRAGFTLNIIDTPGLVEGGYVNDQALEIIKRFLLNKTIDVLLYVDRLDAYRVDNLDRQVVKAITDSFGKEIWRRGVVVLTHAQLSPPDGLNYEDFFSKRSEALMKVVRSGARLRKQDIQDSGIPVVLVENSGRCHKNESDEKILPNGTAWIPNLVKTITDAVSNGSKGILVDKKLIEGPNPNERGKLLIPFILAFQYFFIVKRIQRAIKSDMAKERKAPWESREANRYEP

SEQ ID NO: 32233 - protein, 320 aa, Burkholderia xenovorans LB400
MNTARQANGRVVVLGIYVTDLTFRAQRMPLIGETIAGSAFAMGPGGKGSNQAVAAARAGADVVFCTRLGNDAFGEIARATWAAEGITARAPVADGHATGAAHIFVDDTSGMNAIIVAAGAAGTLSAADVDAIEADIAAARVFVTQLEQPLAAARRGLEVARRHGVVTVFNPAPALPLDDGIFPLCDYLTPNETEATALTGVPIANPDDARRAADALLAKGVGTVIVTLGEGGALLHSATQSVLVPAYHCGRVVETAGAGDGFTGGFAAALARGDDALAAMHFGCALAGISVTRAGTAPSMPTLAEVNRVLNAAARTAHAS

SEQ ID NO: 32234 - protein, 389 aa, Streptococcus pneumoniae R6
MDLTKRFNKQLDKIQVSLIRQFDQVISEIPGVLRLTLGEPDFTTPDHVKEAAKRAIDQNQSYYTGMSGLLTLRQAASDFVKEKYQLDYAPENEILVTIGATEALSATLTAILEEGDKVLLPAPAYPGYEPIVNLVGAEIVEIDTTENGFVLTPEMLEKAILEQGDKLKAVILNYPANPTGITYSREQLEALAAVLRKYEIFVVCDEVYSELTYTGEAHVSLGTMLRDQAIIINGLSKSHAMTGWRLGLIFAPATFTAQLIKSHQYLVTAANTMAQHAAVEALTAGKNDAEPMKKEYIQRRDYIIEKMTALGFEIIKPDGAFYIFAKIPAGYNQDSFAFLKDFAQKKAVAFIPGAAFGRYGEGYVRLSYAASMETIKEAMKRLEEYMREA

SEQ ID NO: 32235 - protein, 798 aa, Burkholderia xenovorans LB400
MSVAEYFSSMEYGPAPESDQAARAWLAQHEARFGHFIGGAWREPGAGERFASHAPASGEPLAQIAHGDAGDIDAAVCAARAAQPAWLALGGAGRARHLYALARMVQRHSRLFAVLEALDNGKPIRETRDIDVPLVARHFLHHAGWAQLQESEFAAYAPLGVIGQIVPWNFPLLMLAWKIAPAIAMGNCVVLKPAEYTPLTALLFAELAHRAGLPAGVLNVVTGDGRTGAALVEHPQIDKIAFTGSTEVGKAIRAVTAGSGKSLTLELGGKSPFIVFDDADLDGAVEGVVDAIWFNQGQVCCAGSRLLVQEGIEARFIARLKRRMETLRIGSSLDKSIDIGAIVDPVQLERIRSLVETGRREGCAVWQSPGTVLPAQGCFYPPTLVTGVAPASTLAQQEIFGPVLVAMSFRTPDEAIALANNSRYGLAASVWSETIGRALDIAPRLACGVVWINATNLFDAAVGFGGYRESGYGREGGREGIYEYLKPRAWLNLGWRQPRNAETVADQPERSLNVMAIDRVDRTAKLFIGGKQVRPDSGYSLPVYAPDGTPVGEVGEGNRKDIRNAVEAARAAHKWSQASAHNRAQVLFYLAENLSVRADEFARQLMQRNGATEAVARAEVEASVTRLFTYAAWADKFDGAVHTPPLRGVALAMHEPLGVIGIACPDEAPLLGFVSLMAPALAMGNRVIVLPGQACPLAVTDFYQVAETSDVPGGVLNVITGERGALLPALARHNDVDALWCFGSAADSTLVERESAGNLKRTFTDYGRQFDWFDPSSEGLPFLREAVQVKNIWVPYGD

SEQ ID NO: 32236 - protein, 162 aa, Zea mays
MAPIAVGSVLPDGKIFLFDENDQLQTVTVHSLLAGKKVILFGVPGAFTSACSLQHVPSFIEKADQLKAKGVNEIICYGMNDPYVMKAWGKTFPENKHVKFVSDGSGEYTKLLGLELDLKDKGLGIRTRRFAMLLDNLKVTVANIETGGEFTVSSAEDILKAL

SEQ ID NO: 32237 - protein, 1049 aa, Burkholderia xenovorans LB400
MLHKGRLSTKLKPHYVVEGSLMMPGKTASKVDGYLFQQGVVCALRTLAGAWFVMAVSVSPAQAACAPDGQGGITNSGGTCSVAPPVNRITATGSGTTTAPGVTLAVPYGIAVTASGGASVSLGRSDAGGAPAISALNGGGLTGLFATGVSSTITADSLAIGLPSGGGNAAARATAGGHITFLNSANITFVPGGGGGTGLLADGAGSQITGTNVTVAGAGGGGDYVAHSNNGGDIALTGGALSLNSPGGGGVAVLSENGSTFTGDGVAISVSASGGDAAVKSVGNSHVSLSGGSVTLNGTSGETGLLAQGATLTAVGVPVSVTASQSSAGTVQGGGTLAITGGSVTASGSGTVGMLVNGAAGAANTLALNDTTVTSTADSLHVVGANANITAAGSTITDNNGVLLSTTGSPSTTTFDAGASTLGGAITTGAGTTTTVTLHDDTDWTVTGNSTATNLTNSASNIHFTAPADPSQAASYKTLQVQNYTGADGNLHLNTFLGSDDAPSDKLIVSGGTATGTTNLTIHNTTGPGDMTVADGIQVVQTLNGGTTASDAFTLTGRLRAGAFDYLLFHGGIGGSRPNDWFLRSSFVVPESITPTVPLSPATPSSPPGEPGTPSSPPGEPGTPSSPPGQPGTPSSPPGQPGTPSSPPGQPGTPSSPPGQPGTPSSPPGQPGAPSSPPGQPETPSSPGQPGGQTTLDVSRPFPADPPASPLQPGVTYPVIGPELATYGVVQPVARQMGFTMLGTLHERIGDTLTADNAGPDSEGWGHSGWARFFGQQIDNRYQAFASPRATGQLLGVQAGVDVWRGSLMPGHRDVAGVYFAYGNSNLDVDGLVTNATATAYLLGRTGKLNLDAYSGGAYWTHYGPGGWYLDLVLQGTSYQGEATTQSARLPTTGDGFVTSLEAGYPVPLPLGPRFVLEPQIQVLWQRVSFDQENDGLGPVDLGSTTGTTGRLGLRGQWTIDGDHGQVWQPYGRVNLWHDWGGRATTLFGVDQVPLRDAATRLEFAAGVTAKATLRLSLYAQAGYQFAVGAGENSRRQGVQGNLGLRYTW

SEQ ID NO: 32238 - protein, 201 aa, Triticum aestivum
  misc_feature (34)..(34): Xaa can be any naturally occurring amino acid
ERERRGEIIAEAEEFKKSFLERRKLNCQRRRTHXRDREKVFMANQEKFHKEAGQQYWRAIAELVPHEIPGLEKRGAAGRKKELEKKPNIVVVQGPKRGKPTDLSRMRQALARLKQNPPAHMVPTPPPAAKEEKKDGDKDGKKDGGKGPKQAEEKKDGKRAAGEGEKKAAAGDGGKAATGGGNAAAAAPPADKAPKQPATKK

SEQ ID NO: 32239 - protein, 331 aa, Caulobacter crescentus CB15
MTFEKVGVIGAGAWGTALAQVAARAGLAVTLQAREPEIVAAINDTHENAVFLPGIALEPGIKAVADLADLADCDLILAVAPAQHLRAALTAFAPHRKAGAPVVLCSKGVEQGSLKLMTDVAAEALPGAPIAVLSGPSFAGEVARNLPAAVTLACEDEALGRAIAEAIAIPTFRPYTANDLIGAEAGGAVKNVLAIACGIVEGKGLGRNAHATVITRGFAELTRLAVALGARPETVAGLCGLGDLVLTCSSPQSRNMSVGLALGQGLTLEQALAGKVSVAEGVASAPAVRALARKVGVEAPICEAVAAILAGEVAVDAAIAGLLSRPLKPEA

SEQ ID NO: 32240 - protein, 318 aa, Synechococcus sp. WH 7803
MASASTSVAAALTALGGCDFLSSADVSAEQTAALLQLAVQLKNGDRRIDLGNRVLGLIFTKASTRTRVSFQVAMARLGGQTVDLNPQVTQLGRGEPLEDTARVLSRFCDVLAIRTFAQQELADYAHWASIPVINALTDLEHPCQALADFLTMQEAFGDLQGQTLAYVGDGNNVAHSLMLCGALLGVNVRIGCPQGFEPLPGVVDQARALSVGGAQISVITDPVEAVRGAQALYTDVWASMGQEQEQAEREQAFQGFCLNEDLLAEADPRAIVLHCLPAHRGEEISAGVMEGPSSRIFDQAENRLHAQQALLAAVLGGL

SEQ ID NO: 32241 - protein, 357 aa, Solanum lycopersicum
MKKGSFAPNLKLSLPPPDEVALSKFLTESGTFKDGDLLVNRDGVRIVSQSEVAAPSVIQPSDNQLCLADFEAVKVIGKGNGGIVRLVQHKWTGQFFALKVIQMNIDESMRKHIAQELRINQSSQCPYVVICYQSFFDNGAISLILEYMDGGSLADFLKKVKTIPERFLAVICKQVLKGLWYLHHEKHIIHRDLKPSNLLINHRGDVKITDFGVSAVLASTSGLANTFVGTYNYMSPERISGGAYDYKSDIWSLGLVLLECATGHFPYKPPEGDEGWVNVYELMETIVDQPEPCAPPDQFSPQFCSFISACVQKHQKDRLSANDLMSHPFITMYDDQDIDLGSYFTSAGPPLATLTEL

SEQ ID NO: 32242 - protein, 358 aa, Picea sitchensis
MVLCHEIAESRCRDSHGASDLKLFAMAAVLVTSAGGVCLPVLFSRYSRGLKFYGTLLILVKCFAAGVILSTGFVHVMPEAFRALESDCLPARPWRQFPFAGFVAMAAAILTLLVDVLAAKHGETRPYVPLKSSEAVEDSAKCRDVEMGSPATVFPVESYRVIGQDSCAARAGSHSGIESAKSMMTQEENSEELGDQRQKLVSKVLEIGIIFHSIIIGITLGISENRCTITPLVGALAFHQFFEGMGLGGCLAQANLGTRVTALMCCLFSVTTPVGIATGMTVKSIMGFNESRPEAVIIAEGLLGSASSGILVYMALVDLIAVEFLNTEKMKANPGLMAAAYCLLILGAGSMSLLALWA

SEQ ID NO: 32243 - protein, 307 aa, Porphyra yezoensis
MAFITSGAAAVSGASLTARRAFTGAAVCPVPSGRTSPAAATWSMSAGGLRTFLVGGNWKCNLSKDAITSLCKELAAAPDLETDKVEVVLAPPTPYLDHTRSVLRQDFEVAAQNIWVGGPGAYTGETAAEMIKDVGCTWVILGHSERRNLLQIRESDDFIAQKTKTALSHGLKVMFCIGETLEEREEGRTLDVCVRQLHALAETIGADDWKDVVIAYEPVWAIGTGKIATPDQVEEVHEKIRHYLAGDVNDKVAQETRILYGGSVSPGNCNELAQLPDVDGFLVGGASLKASFLEVIESFKSDLAATV

SEQ ID NO: 32244 - protein, 207 aa, Oryza sativa
MARLAGVAALSLVLVLLGAGVPRPAAAAAAKTQVFLSKLPKALVVGVSPKHGEAVVHAGENTVTVTWSLNTSEPAGADAAFKSVKVKLCYAPASRTDRGWRKASDDLHKDKACQFKVTVQPYAAGAGRFDYVVARDIPTASYFVRAYAVDASGTEVAYGQSSPDAAFDVAGITGIHASLKVAAGVFSTFSIAALAFFFVVEKRKKDK

SEQ ID NO: 32245 - protein, 255 aa, Euglena longa
MPRKFFVGGNWKRNGTRDTISKIVEEFNKGPSVADADVEVVIGVPFVYADFTQEKLRKDWKLSVQNCWIGKGGAFTGEVSAEMIKDAGIPWVILGHSERRHLPELKESDETVAIKVAYALANGLKVMACIGELLEEREKGQTQAVNERQLKAIAAKLKEEDWKNVVIAYEPVWAIGTGKVATPEQAQEVHEQVRAWVASNVSPSVAAEVRILYGGSVTAKNSVELAGKPDVDGFLVGGASLKPEFLDIVAAYKHK

SEQ ID NO: 32246 - protein, 401 aa, Kluyvera ascorbata
MADSSPERRFTRIDRLPPYVFNITAELKMAARRRGEDIIDFSMGNPDGATPPHIVEKLCTVAQRPDTHGYSTSRGIPRLRRAISRWYQERYDVEIDPEDEAIVTIGSKEGLAHLMLATLDHGDTVLVPNPSYPIHIYGAVIAGAQVRSVPLVEGVDFFNELERAIRESYPKPKMMILGFPSNPTAQCVELEFFEKVVALAKRYDVLVVHDLAYADIVFDGWKAPSIMQVPGARDVAVEFFTLSKSYNMAGWRIGFMVGNKTLVNALARIKSYHDYGTFTPLQVAAIAALEGDQQCVLDIAAQYKRRRDVLVKGLHEAGWMVDMPKASMYVWAKIPEQYAHMGSLEFAKKMLQDAKVCVSPGIGFGDYGDTHVRFALIENRDRIRQAIRGIKAMFRADGLLP

SEQ ID NO: 32247 - protein, 309 aa, Thermus thermophilus HB27
MLEVVTAGEPLVALVPQEPGHLRGKRLLEVYVGGAEVNVAVALARLGVKVGFVGRVGEDELGAMVEERLRAEGVDLTHFRRAPGFTGLYLREYLPLGQGRVFYYRKGSAGSALAPGAFDPDYLEGVRFLHLSGITPALSPEARAFSLWAMEEAKRRGVRVSLDVNYRQTLWPPEEARGFLERALPGVDLLFLSEEEAELLFGRVEEALRALSAPEVVLKRGAKGAWAFVDGRRAEGSAFVVEAVDPVGAGDAFAAGYLAGAVWGLPVEERLRLANLLGASVAASRGDHEGAPYREDLEVLLKATQTFMR

SEQ ID NO: 32248 - protein, 391 aa, Arabidopsis thaliana
MTMMFDLTQDLVKEILSRVPITSLGAVRSTCKGWNALSKDRILCKAKPKQQFHQGFMLSDYRLRSMRFNISGTFKENGEEFVNLSVKEIGNFLNKVEISHMYYCGGILLCVTTDTRLVIWNPYLGQIRWIQLKTETMYSTFCLRYDNNKNHKILRFLDNKQGSYEIYDLKSYSWRAFDVIPKWDIDDDGQSASVKGNTYFRTIDETPNLLICFDFTAERFGKLLDPPFQHGWMSLSWVREEKLVALYQHLDTSMIEIWITTKIEPNALSWTSFLKCYIEQLIALDFWFDIDYNNFFIDEEKKLAVVIDKVESEDCKRSNSHINSYIIGDDGYLKKMNSLGNTARSYTAIMLSSCYVSSLVQIDDPIARRRRRERNSKRKEKKRKGTTNNKV

SEQ ID NO: 32249 - protein, 356 aa, Euglena longa
MGYYTVTTQVQENYVQSWYKGKLAPFVGGCLLATCLSLSFSGETAQQNYAVSAKPAVHAIPLTAMGVGTRSGVPQTAAQKRFPSRSSALQMAAAVWAPSAKMPRKFIVGGNWKCNGDRPSINALVQALNTGESAIGSGVEVVVAPPMLYGDYARGLLRPDFGVAFQNCWTGGNGAFTGEVSANMIKDAGFDWVILGHSERRSLPEIMETDATVATKTAYALKAGLKVILCIGETLDARQSGKTDEVNARQLAAVAEKVSDWSNIVIAYEPVWAIGTGVVATPEQAQETHAQIRKWLAENLSPQVAQQMRIMYGGSANAANADSLAKQPDVDGFLVGGASLKPEFLKIAESWKSKVE

SEQ ID NO: 32250 - protein, 239 aa, Thermus thermophilus HB27
MERKALVTGGSRGIGRAIAEALVARGYRVAIASRNPEEAAQSLGAVPLPTDLEKDDPKGLVKRALEALGGLHVLVHAAAVNVRKPALELSYEEWRRVLYLHLDVAFLLAQAAAPHMAEAGWGRVLFIGSVTTFTAGGPVPIPAYTTAKTALLGLTRALAKEWARLGIRVNLLCPGYVETEFTLPLRQNPELYEPITARIPMGRWARPEEIARVAAVLCGDEAEYLTGQAVAVDGGFLAY

SEQ ID NO: 32251 - protein, 530 aa, Chlamydophila abortus
MDRKGFLDSPSTKILQDLAVAPVDLTTPGIISQERVERFSLSIGGFTLSYATERVDEGVVSALTDLASERGLVSSMQAMQSGEVVNYIDNFPSESRPALHTATRAWVKEIPLTGNAEDIALRSKIEAQRLKDFLHQYRDAFTTIVQIGIGGSELGPKALHRALKGCCPSDKKVYFVSNIDPDNAAEVLQEIDCSKTLVVTVSKSGTTLETAVNEEFIADHFLKQGLHFRDHFIAVTCEGSPMDDRSKYLEVFHIWDSIGGRYSSTSMVGGVVLGFAYGFDVFFQLLEGAAAMDLAALAPQMSENLPMLAAMLGIWNRNFLGYPTSVIVPYSAGLEYFPAHLQQCGMESNGKSIAQTGEIIGFATSPILWGEVGTNSQHSFFQCLHQGSDVIPIEFIGFLDNQRGRDIVISGSTSSQKLFANMVAQSIALAKGRENTNPNKSFRGNRPSSLLVAERLTPYTMGALLAFYEHKIVFQGFCWGINSFDQEGVTLGKDLANQVLGIMQGQAKEGACLEAEALLKLFNSTQKKKS

SEQ ID NO: 32252 - protein, 163 aa, Idiomarina loihiensis L2TR
MSQQIKEGDKVPSGSLTSKGDLGIQNYDPAEIFAKGTHVLFSVPGAFTPTCSEKHLPGYVEHAEALKEAGVLSINCVAVNDAFVMKAWGESLGIGEKVRLLSDGNGAYNQIMGLSMDTGNFGGIRSKRYAMIITDGQVKGLFVEEDKSFEVSKAEYILEQLQK

SEQ ID NO: 32253 - protein, 436 aa, Haloarcula marismortui
MHVDIGAALASAADPGVERATLDDLDEQVAVAHERIEQGRNKGEFGYASLNLLEATDAETIHDAVAPVADAESVITVGIGGSALGAKTITEALAEDPGSHVVLDNVDPEHVRRTLDGLSLADTAINVVSRSGTTAETLANFLVVREAYEDRGVDWTERIVVTTGESGPLRALADQHDLPTLPVPEGVPGRFSALSAVGLVPPAILGIDIEGLLAGGQQAADDLAPSLYDSPAYAYGAMAYALEEAGATVNAVMPYAERLESFGEWFAQLWAESLGKDGRGQTPARALGATDQHSQLQLYRAGHRDKVVTFVRPRERADVSIPDPDHEDLSYLAGTDLGGLIDAEYEATVASLPAADRPALEVEIDRLDAESVGELLYAMEAACVLVGELADVETFTQPAVEWGKNATRALIRGEATDETAVIDERERLRIGETESL

SEQ ID NO: 32254 - protein, 582 aa, Oryza sativa Indica Group
MAARDRLMPRSLAACALLLHRCPYQEKIGWSPASAHRQLCIAGRPSSWASTLLVRNLRGEGWEEEEEEAECAGGCSDARSGVGKVGLGKIRVSVSDREVDRSLFSPFIHARGYIDRIGEKTMSLFIKPIRSRSEIASQLLSASSHLLFRATILATLCLVCLFTVHYPSLLSHSFHLSSAAAAANGKHRAASRSSHRSLLGSSAAVAYGGAAWEKEVRRSAAPRRDGGLSVLVTGAAGFVGAHCSLALRARGDGVVGLDNFNSYYDPSLKRARQRLLASRGVAVLDADINDAALLERLFDAARFTHVLHLAAQAGVRYAMRAPQTYVASNVAGLVSVFEVAAKHADPQPAIVWASSSSVYGLNTDAPFSEEHRTDRPASLYAATKKAGEAIAHAYNHIYGLSITGLRFFTVYGPWGRPDMAYFSFARSIVAGEPITLFRTADGADARRDFTYIDDVVKGCLGALDTAGESTGTKSGKKRGPAPLRVYNLGNTSPVPVTRMVAILEKLLGRKANKRVVTMPSNGDVPFTHANVSHAARDFGYRPATPLDAGLRRFVDWFVHYYKLDTAKIAKGKRKSMAMSAAS

SEQ ID NO: 32255 - protein, 384 aa, Mycobacterium sp. JLS
MVGALIGGDRVESRPDPGHAPLTKPVRLPPARLARVVETLRTALHRVRFKVVPPFAGILDLTMGFAVAQTIYAAARLGVADVLCDGPMTAADIADRVHADPTAVHRLMRVLAAHQIFRERRDGRFEMTALSQALRSDAAVSIRPLLLMLSHPFYWEHFGRLTDVVRTGRTSLETEYGKGLFECLDEDPEVARVFNDAMTCVTAMSIPPVLAVYDFSRFRTIIDVGGGDGRMLTAILEAATASRGVLLELPALAEQARKTVRSAGLTDRATIESGSFFDHVPRGGDLYVLKHVIHDWRDDRAREILRQVRDAMPPRAVLLLVETVIPPGNGMHFGKLLDLDMLIFAGGRERTRAEFSSLLFETGFHLDRIVPTVTHLSLIEATAC

SEQ ID NO: 32256 - protein, 174 aa, Thermobifida fusca YX
MSLHTLSVLVEDTPGVLARVASLFSRRGFNIHSLTVGPTEYEGLSRMTIVVNCDRHPLEQVTKQLNKLVNVIKIVEMDPEASVRRELLLIKVKADSSNRSHVLETAQLFRANVVDVNPDVVVIEATGQPEKLQALIRNLEPFGIKELVKSGVVALGRGPRSITDRSLRVVERSA

SEQ ID NO: 32257 - protein, 337 aa, Pseudomonas
KEVENQQKLANVVILATGGTIAGSGASAANSATYQAAKVGVDKLIAGVPELADLANVRGEQVMQIASESITNDDLLKLGKRVAELADSNDVDGIVITHGTDTLEETAYFLDLTLNTDKPIVVVGSMRPGTAMSADGMLNLYSAVAVASNKDSRGKGVLVTMNDEIQSGRDVSKSINIKTEAFLSAWGPLGMVVEGKSYWFRLPALRHTVNSEFDIKQISSLPGVDIAYSYGNVTDTAYKALAQNGALAIIHAGTGNGSVSSRLTPRLQTLRKTGTQIIRSSHVNQGGFVLRNAEQPDDKNDWVVAHDLNPQKARILVELAMVKTNDSKEIQRIFWEY

SEQ ID NO: 32258 - protein, 285 aa, Oceanobacter sp. RED65
MARFLIVGSGDIGGGLARSLKQQGHDVWGMRRSEKSIGEGIHTISADVSDMETLIGILPERIDYVVYCVASPEFSEEGYDKYYVMGLRHILALLKQNHESPKRIFFVSSTSVYPHHDGAVVNEETELEPTAFAGRKMLEAESTLLHSDFTGTVVRFSGIYGPGRTRLINQAKKGAHCDPEPDVWTNRIHRDDCIGVLSFLIEQDEKGTALDSVYLASDPTPTPIFEVFEWLKDRIGDVEPDHDVPEVTRRGSKRCDSSRLVKLGYRFKYKDYQQGYDEILTEMGY

SEQ ID NO: 32259 - protein, 354 aa, Thermobifida fusca YX
MSARTVKLAVIPGDGIGPEVVAEGLKVLSAVAPRHGLTLDTTEYELGAQRWHATGEVLPDAVEEELRQHDAILLGAVGDPTVPSGVLERGLLLRLRFNFSHYVNLRPVRLYPGVTTPLAGVAPEDIDMLVVREGTEGPYAGMGGVLRKGTPHEIATQDSVNTRLGVERVVRYAFAKAAERPCHKLTLVHKDNVLTYAGELWQRVVREVGAEYPQVEVDYLHVDAATMFFVTQPRRFDVVVTDNLFGDIITDLGAAVAGGIGLAASGNINPEGDFPSMFEPVHGSAPDIAGQGKADPTATILSVSLMLEHLGYADAAAQIDQAVAEDLQERAKNGGVRSTTQIGDDIAQRVAEQG

SEQ ID NO: 32260 - protein, 178 aa, Chlamydomonas reinhardtii
NLVMLCGWLLHYLYRGFITPFIMPYSSRTVALGIPLAGIVPNCIFGYLVATQLACTRYPSDWAGRPRYIIGVVLYALGTAINRWADLKLRAGRSSPASLSRYFIPQGGLYDYIACPNYLGELIEWAGFAVGTWSWPALSWLLFCTSTFVPRALTHLRWYRDTFPEYPRSRKALIPFVL

SEQ ID NO: 32261 - protein, 253 aa, Staphylococcus aureus subsp. aureus NCTC 8325
MRTPIIAGNWKMNKTVQEAKDFVNTLPTLPDSKEVESVICAPAIQLDALTTAVKEGKAQGLEIGAQNTYFEDNGAFTGETSPVALADLGVKYVVIGHSERRELFHETDEEINKKAHAIFKHGMTPIICVGETDEERESGKANDVVGEQVKKAVAGLSEDQLKSVVIAYEPIWAIGTGKSSTSEDANEMCAFVRQTIADLSSKEVSEATRIQYGGSVKPNNIKEYMAQTDIDGALVGGASLKVEDFVQLLEGAK

SEQ ID NO: 32262 - protein, 691 aa, Chlamydomonas reinhardtii
MQQQLRCSRVASSRITPRTRTSMVVMASAKPKLQLMVNSCTGKMGQAVAEAALRAGVELVPYTLCGPADVATNATVNVAGHALTLVPPSTRDAVVEELKGRYPHLLMVDYTLPDAIHSMVDFYVKHRTPFVMGTTGGDRAKIAAQLFEHISAALLSAAAAIATGALTNMDANWGSLLTCASIVGSCINLLIQGMAEEEDYKKQETPQWQPETVGGGAPAPRQFLIQVIELEMNTHPYIAPAAVALAISARDCPLRLALTPQLRCGAATAVAAGGVSAREHHGCITSISVPSSIRSTGYRGGSATSGGARVDSQLQPADEKATTSMRQPVTLLVRLLCKLRPRQAAARLAGLWRVLLCELEVARFMYVVAAEVGLLLRLQLEEDPRGSTTAVALVSVSSAAYAAPAAVAVAPHSAEHAFTPSFSLRPPVYCCSQALDMDDNDVGLEGVSTDLEDAFGAAASFLGAAVISKDARFDDKLKLQFYGLYKQATAGKCASGRPAFWDLAGRAKWDAWAALGDLGKDDAMQRYVELLCTVAPDWDAAASGSKPGKSRGGGGAMGPVFSSLAAGEEAEAGGEGDEGYCMLTSRKYAACVGMWAGAALRGVAARTCHEMMKWNWSARDCRTSGFQVLVCSMSKHGGKKHNWGRGRGRGRGQPAANKDAAAPAPLYMSAAIFARGVLVAPLYIWNATVNW

SEQ ID NO: 32263 - protein, 389 aa, Anaplasma marginale str. St. Maries
MHHNFYRRAIEWFLLARSVLLMPQTPIYPPPHVFYVDKWHAKLYHAGRVFLKVEVQVTILGAGAFGTALSIALCNTGKKVRIWSRNGQVVESLRTHGENSVYLPGFKVPREVLVHSDMGLATDGPAAILMCVPAQELRSLCNTITAASALEAGVPLLVCSKGIENSSLKFPSEVVAEMFPQNPVFVLSGPALARELASGLPCAMVLAGDEITTAETLASQLSGPALAIVHSGDLMGVQVGAVMKNIIAIASGIIAGMGLGHNASAIVMVQGMSEIKAVCEAKVGVAATETLIGLSCLGDLVLTCTAPGSRNMSFGSSVGKAGRAGASGQQKPMLVEGVESVTAMVNMGKALNLELPICSAIARMLHGQLGVRQAAAEILSAPVKSRLNV

SEQ ID NO: 32264 - protein, 345 aa, Burkholderia xenovorans LB400
MLSPVGGHRSRVLPASGTIGPSTFHALCMGTIVSIGSINLDLQMRVDHPVGSAETQRAHDFSRLAGGKAANVAYLARRFGHDAQLLGMVGDDRFADEAVAPLRDLGIDVSRVRTAAGQPTAVSMIFVPDNGKKTIVLASNANDAWQRADIDAALEAIDAAPAHSVLAVDCEMSVDACAAVLAAAQRRALCVVLDPAPPQRAQSGALRALWRAVHALTPNEEEAAALTGIEIADQAGAVRAARALHREGFELVCVKRSDGGCIAVSRDGVLAVQVKPVEALDTTGAGDAFTGALAVSLVERRAFADAVRLATAAANLTVMAWGSQTALPDRARADAFAAGLQCEWL

SEQ ID NO: 32265 - protein, 709 aa, Caulobacter crescentus CB15
MNTLTASVIKEIGEIVERIKSDAEIKGVVITSGKTTGFCAGADLGELGGGGGMAGGAAGGEAALKAAFDAGFALNKAFRGLETCGKPVAAAINGLAMGGGLEIALACHYRVVADHPKIQLALPEAKVGLLPGAGGTQRLPRLMGVMAAAPYLLEGKSMKPAEALANKVVHEVVPVDQVVEAAKTWVKTKGDPVAPWDKKDFKLPGGGPYTPTGGQVFIMGNAMLRKQTYGNYPAQLNILKAVYEGTQVPFDAAIRIETRYFLKTMMSPQAKGMIRTLFLSLQELGKGSGRPADVPPSEAKKVAVLGAGMMGAGIAYVQAMAGIETVLIDQSQEAAEKGKGYAENLLKKAVSRGKMTQDKADAVLALITPTTDYAHVKGSDLVIEAVFESREIKADVTQKAEAQLAEDAIFGSNTSTLPITGLAKASVRPKNFIGIHFFSPVDKMGLVEIIMGEETSDEALAKSIDYVLKIKKTPIVVNDSRGFYTSRCFGTFVQEGLEMLADGIAPAIIDNVGRATGMPRGPLEMNDDVALDLGYKVTQQTKKDLGDKFEDRPFAPIIEKMVVELQRFGRKNGKGFYDYPETGPKTLWKGLSELAPVTIAEADQALIQEIRTRLLYRQAVEAARCFEEGVITDPREADVGAILGWGFAPWTGGPISLIDGVGAKAFVETCDQLAQKYGKRFAPPALLREMAEKGETFYGRFGAKAKAAA

SEQ ID NO: 32266 - protein, 361 aa, unidentified eubacterium SCB49
MDTNNYAVIMAGGIGSRFWPMSTTDFPKQFIDMLGTGKSLLQQTFSRIAQFIPDENILILTNDRYKDLVLEQLPSLTEKQLVLEPVMRNTAPCILLAALKIAKWNPEAKMLVAPSDHWIEDEVSFANDVLTSFKAIGDTGKLVTLGINPTFPNTGYGYIEEGAVVSSETGLHKVTQFREKPDYETAKEFIAQGNFLWNAGIFSWSVSGIINAFEAYLPEMLELFNKGIAQFNTENEAVFVSENYGNATNISIDFGILEKSELVFVIKANFDWNDLGTWGSLHDKITTSESENAVVRAVPHLREATGNMILTDKEKLVVVDGLKDYIVVDKEESLLIFPKKKEQEIKQLLAELKDKFGEKYT

SEQ ID NO: 32267 - protein, 523 aa, unidentified eubacterium SCB49
MEEGTVATWLKKVGDKVEEGDILAEIETDKATMEFESFYEGTLLHIGVQEGDTAVVDTLLAIIGEEGEDISAHLNGGGNTNDSNSAKENEAKATTDADAEATDDTDEATSEANVPEGVQVITMPRLSDTMEEGTVATWLKKEGDLIEEGDILAEIETDKATMEFESFYNGTLLKIGIQEGETAKVDALLAIVGPEGTDVSGITVSKPKTAPKKEAPKQAKQTQAKKPVVAKTAPKKTNTGATSEKRIFASPLAKKMAEDLGIRLNVVQGSGENGRIIKTDIENYQPSGATAYTPAGVESFEEIKNSQMRKTIAKRLGESKFTAPHYYLTVELDMDNAIASRTAINSQPDVKISFNDMVVKACAMALRKHPQVNSQWTGDATRIAKHIHVGVAVAVDEGLLVPVLKFADQMTFSQIGANVRELAGKARNKKITPAEMEGSTFTVSNLGMFGIKEFTSIINAPNSAILSVGAIVQKPVVKNGAIVVGNTMTVTLACDHRTVDGATGAQFLQTLRNYIENPVTMFV

SEQ ID NO: 32268 - protein, 388 aa, Geobacillus stearothermophilus
ASLRANDAPIVLLHGFTGWGREEMFGFKYWGGVRGDIEQWLNDNGYRTYTLAVGPLSSNWDRVCEAYVQLVGGTVDYGAAHAAKHGHARFGRTYPGLLPELKRGGRIHIIAHSQGGQTARMLVSLLENGSQEEREYAKAHNVSLSPLFEGGHHFVLSVTTIATPHDGTTLVNMVDFTDRFFDLQKAVLEAAAVASNVPYTSQVYDFKLDQWGLRRQPGESFDHYFERLKRSPVWTSTDTARYDLSVSGAEKLNQWVQASPNTYYLSFSTERTYRGALTGNHYPELGMNAFSAVVCAPFLGSYRNPTLGIDSHWLENDGIVNTISMNGPKRGSNDRIVPYDGTLKKGVWNDMGTYNVDHLEIIGVDPNPSFDIRAFYLRLAEQLASLQP

SEQ ID NO: 32269 - protein, 508 aa, Pseudomonas fluorescens PfO-1
MTTTPKPLVLMILDGFGHSDSPESNAVYAAKKPVLDRLWATVPNGLISGSGMDVGLPDGQMGNSEVGHMNLGAGRVVYQDFTRVTKAIRDGEFFENPTICAAVDKAVAAGKAVHFMGLLSDGGVHSHQDHLIAMAELAFKRGAEKIYLHAFLDGRDTPPKSAASSIELLDATFQALGKGRIASLIGRYYAMDRDNRWDRVAQAYNLIVDGKGEINAATAQEGLEAAYARGESDEFVKATSIGEPVKVEDGDAVVFMNFRADRARELSRVFVEDGFKEFERARQPKVQYVGLTQYAESIPAPAAFAPGSLENVLGDYLAKNGKTQLRIAETEKYAHVTFFFSGGREEPFPGEERILIPSPKVATYDLQPEMSAPEVTDRIVEAIENQRYDVIVVNYANGDMVGHSGVFEAAVKAVECLDTCVGRIVEALEKVGGEALITADHGNVEQMADESTGQAHTAHTTEPVPFIYVGKRDLKVREGGVLADVAPTMLKLLGLEKPAEMTGTSILV

SEQ ID NO: 32270 - protein, 268 aa, Gloeobacter violaceus PCC 7421
MNRIANTAQIQSAPPVFARPLENKVAIVTGASSGIGRATALELARRGAKVVASARRVGPTLELVEAIRAEGHEATFVQADVTDEAYVERLVAEAIATYGKLDIAFNNAGTEGVFAPLLEQTKETYDLVFDANVRSVFYSMKHQAQAMLCAGGGVIVNNASMGGVIGFENAALYIATKHAVLGMTKSAALEWYRRGVRVNAICPGIIDTPFQDRIWPSTEAKNSFANATVAGRAGTAEEMAKVVAFLVSEDASFVSGHGLLADGGYSIA

SEQ ID NO: 32271 - protein, 333 aa, Gloeobacter violaceus PCC 7421
MRVVQFRVFGGSEVLEVADAVLPQPHRGEIAVDVRYAGVNFADIMLRRGALAGTPLPTVPGLEVAGTVAEIGPGVSGFAYGEPVAAFSWTPGKAMGGYAQRVVLDSRLAVPLRRAERELRYEEGAGFACAAVTAYQLLADVARLRPGETVLVQSAAGGVGSLAVQFARALGAARIFGVVGSASKTEAALAAGCDRVVLREGWIEAVRSFTGGRGVDIALESVGGDSLAACLQVLAPFGRVAYFGDASGSGPISLPAFDLWFGTKGVLGYNIGGLAAASPESWNGAANRAIELIANGAVRLAPTRIYPLERAAEAQHALETRASTGKMLLQVTS

SEQ ID NO: 32272 - protein, 379 aa, Zea mays
MATAGKVIKCKAAVAWEAGKPLSIEEVEVAPPQAMEVRVKILFTSLCHTDVYFWEAKGQTPVFPRIFGHEAGGIIESVGEGVTDVAPGDHVLPVFTGECKECAHCKSAESNMCDLLRINTDRGVMIADGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFDLMAKGEGIRCIIRMEN

SEQ ID NO: 32273 - protein, 488 aa, Klebsiella pneumoniae subsp. pneumoniae MGH 78578
MKKINHWINGKNVAGADYFHTTNPATGEVLAEVASGGEAEINQAVAAAKEAFPKWANLPMKERARLMRRLGDLIDQNVPEIAAMETADTGLPIHQTKNVLIPRASHNFEFFAEVCQQMNGKTYPVDDKMLNYTLVQPVGVCALVSPWNVPFMTATWKVAPCLALGNTAVLKMSELSPLTADRLGELALEAGIPAGVLNVVQGYGATAGDALVRHHDVRAVSFTGGTATGRNIMKNAGLKKYSMELGGKSPVLIFEDADIERALDAALFTIFSINGERCTAGSRIFIQQSIYPEFVKRFAERANRLRVGDPTDPNTQIGALISQQHWEKVSGYIRLGIEEGATLLAGGADKPSDLPAHLKAGNFLRPTVLADVDNRMRVAQEEIFGPVACLLPFKDEAEGLRLANDVEYGLASYIWTQDVSKVLRLARGIEAGMVFVNTQNVRDLRQPFGGVKASGTGREGGEYSFEVFAEMKNVCISMGDHPIPKWGV

SEQ ID NO: 32274 - protein, 213 aa, Coprinopsis cinerea okayama7#130
MSDPTIKGITPSDVQYDGSSLRIGIVHARWNKVVIDALLQGTIDKLKELGVKENNIVVQSVPGSFELPLACSRMIAGSHVQEAASIPDLLGGLTFGSSTPNAQRSGTPAPPGAAPASKAPFDAVIAIGVLIKGATMHFEYICDSVSHALMKLQMDTGTPVIFGVLTALTEDQALERAGIGRGENKGHNHGEDWAAAAVEMSSHVRRWNQGKFT

SEQ ID NO: 32275 - protein, 692 aa, Botryotinia fuckeliana
LYQHSHSHSQTTSPSTPNFKQQPFTNSQLIIEEENNKHDSFSTSADFPTPNTDIPRVLEEENEDEEVEAKDEIQDEPHPEPKDVKLGNSIPQSPISSNNTTHQPTPRKPELSRRQSLLPHQQTKLIKTLLEAELPAPPQVNNIPTGGILGADYFSNHGALTISAAMVTRKIWVKRPGASATLVTIHEDDLVDDVRDMILKKYANSLGRSFDAPDVTLRIIPREQQRQERILGPEEPMSRTLDAYFPGGQTVDEALVIDVPVRRTPKPSPRPNGHPVYYEEGRPTEAGSDYFPPMPLPVPSPGLSHSVPVPNGNQNTAPLIAHAMSVLTTGHVPALPSPSAQRRHHSSRPRIGRTHTSSPTVISGHSQPPVTNNGTQFQRGPRSRTHSSASEKSSIPPPPPLPTPPAPNQELAPQRVATPPPRVSSPRPQKRTRKKAGVDHPSLPAGMLNGAVPPINVLIVEDNIINLKLLEAFMKRLKVRWQTAMNGREAVNKWRGGGFHLVLMDIQLPIMSGLEATKEIRRLERLNSIGVFSSSASSSAPSEKMLAEEEPEEDDKLPSTVLFKSPVIIVALTASSLQSDRHEALAAGCNDFLTKPVNFVWLERKVMEWGCMQALIDFDGWRKWKDFSSQQAAEKETADSKKKDAQSVVKTKKKNRNSMGSLGALGGQGGSSSKLSLLGQGGGRVEGEAVGG

SEQ ID NO: 32276 - protein, 293 aa, Triticum aestivum
MDQYEKVEKIGEGTYGVVYKAKDRYTNETIALKKIRLEQEDEGVPSTAIREISLLKEMQHRNIVRLQDVVHNEKCIYLVFEYLDLDLKKHMDSSADFKNHHIVKSFLYQILHGIAYCHSHRVLHRDLKPQNLLIDRRTNSLKLADFGLARAFGIPVRTFTHEVVTLWYRAPEILLGARQYSTPVDVWSVGCIFAEMVNQKPLFPGDSEIDELFKIFRIMGTPNEETWPGVSSLPDYKSAFPKWPSVDLATVVPTLEPLGLDLLSKMLCLDPTRRINARTALEHEYFKDLDVSS

SEQ ID NO: 32277 - protein, 247 aa, Anaplasma marginale str. St. Maries
MPLQLEVNEIFSSVAPRYDLMNDLMSFGLHRLWKRELCSKITHKSGTLLDVAGGTGDVAMRALARRSGLHVTVCDINPDMLGVGRDRAINSGYANISWVCASAEDLPFASNSFDYYTIAFGIRNIPNREKALQEAHRVLKLQGRLLCLEFSPIQKQGLFRTLYDLYSAYVIPNMGRCVAGNAEAYTYLTDSIRAFPPPEEFAQEIAGAGFFNVAHQNICNGVTSLYSAWKVELKLGARPHHNSEFGL

SEQ ID NO: 32278 - protein, 283 aa, Listeria monocytogenes str. 4b H7858
MKTVKLNNGVEVPILGFGTYQITDAAEAEQAVKDAIETGYRHIDTAQSYMNEEAVGRGIVASGVDRKELFITTKIWVENVSYKGVMSSFDRSLKRLGLDYIDLLLIHQPFNDVYGAWIAMEELQASGKIRAIGVSNFSPDRVIDLAAFNEVTPQVNQIEVNPFQQQAANLAVLRKEGVAIEAWAPFAEGKNDIFNNPVLTKIGAKYGKSAAQVILRWLVEQDIIVLAKSVKPERMAQNLAIFDFELTEADKGEIASLDQGESQFFSHADPEMVKWMASRKLNV

SEQ ID NO: 32279 - protein, 412 aa, Anaplasma marginale str. St. Maries
MGRILVKKFGGTSLKDVECILRVANIVRQSVERGHKLVVVVSAMGRFTDEAVTTAQEVSELASEAQLSEYDVVVSSGEQVSCGLLALALQRIDIKATSIMGWQIPINTTGEHSRARIIEIKPDRILSLLNEHDVVIVAGFQGIHNARITTLGRGGSDISAVAIAAALRLDACYMYTDVAGVYTANPCLVPSARKLDHVTYNDMVEISASGRAILNVRSVEMAMRCGVRIHVMSSSQEAKGTLVSFGCEREMESRIITGIAISKKIASVSLGGVPAVPGIAAALLPIAEGNIDVDMIMQTVDGELRNITFTVQEEDLQKTQDILLQHKHNILYESLAVTDSLAKVSLVGACMISRPGVASRVFSALASGGIAVLAVSTSEIKITVLMHEQSAAPALSLLHEEFALDRESVLCT

SEQ ID NO: 32280 - protein, 344 aa, Aeropyrum pernix K1
MKAARLHEYNKPLRIEDVDYPRLEGRFDVIVRIAGAGVCHTDLHLVQGMWHELLQPKLPYTLGHENVGYIEEVAEGVEGLEKGDPVILHPAVTDGTCLACRAGEDMHCENLEFPGLNIDGGFAEFMRTSHRSVIKLPKDISREKLVEMAPLADAGITAYRAVKKAARTLYPGAYVAIVGVGGLGHIAVQLLKVMTPATVIALDVKEEKLKLAERLGADHVVDARRDPVKQVMELTRGRGVNVAMDFVGSQATVDYTPYLLGRMGRLIIVGYGGELRFPTIRVISSEVSFEGSLVGNYVELHELVTLALQGKVRVEVDIHKLDEINDVLERLEKGEVLGRAVLIP

SEQ ID NO: 32281 - protein, 1814 aa, Ustilago maydis 521
MNTKSNASFGLPPVALNTASPSQTTNPTTSDRPTLITSQFPGQALYLTHPQRLSLLSIKIDATTSITTTRAAVLAQQQLSPSLPPPSPPPPPPSAVYRHASTSKLHSHQPPPSSFHTNASHKSSRSRPLSHDFTQKARDALNDFGRLANRRQSAIERANGAETLARVADGLGSKRASSHDDRARPTSSHPLILQQDSNHQPPSFAPPKLPLDPTSQQHLTSQDAQVVRSHATRSFTLLPQSDLRFLSHSIPLSIHASITTSSDPSTIIPSPLEFTTASHNGSSPYSTSALDPSQLLLKVEPPAELARQSWSRSTSFLTPQNASQYHTSEHHSVKFRYRLRLCAKTASPTSYLFPHTERNDAPPPSTPLALALGQVLFLSAASPEKLIEAIESPSSSIASSELAALEGISRVQLTPSSYPLSSTVTRGASEFDFEWTWKSLARSSSSNASRCCCAFVEISPDGKSATLLAAISLFIQLPPSVPLLSNMLSSTQADTIPHQRLSSSDSLAIIAALNLDQEPSLRTDTAPALSSFHQDSHPTSFIAPSSTQHGSTRLLIDRTELALEDLVNDSPIFRAALVNLERRTASIKKASKAVLRASQEARLRIFRLIEAEQAVDTALQALVGMAPETIGRLQDQLLRQARIATMQHQREQASVIESCLERPLAQIVELCRLAQDGFKLFENESKTYYSQTQKWLANRSSNADPSNTPAIGNDAHRQDRADQKQKLRELRFEQARLDLFAMLQRLHGGRAEAHLARSILQLTQWLVDFPNKPHWPSHTQTSSLSALDASLLDALDHQALQLQEVESRSRQVADRARMLEHALGKIGDADIDILGAHRFEIDQTSPAPSNFNGAVSSKTRKFKSFLGVFAAGIQSSPLTLSKNASPNTESAVKQVELVAPVDGAQLPYQHPRRRHSMKEKFNHVRQPDVGNTSPFKSHAPSSWVYNNLPAAPRRGSELHESSRLRDDAASDQLSLHASQDASEGASSMAGAHELSRTSTAEQGLGIFEPASANTVQEYGLSPAPGQCSGPIAPSLTTGSDRKKEGVLWVSTKSVTGPVGADAPRGINRSNHWRECWVVLSGSGQISEFADWKNAKALEPTNPLIDLRFATVREARGVDRRFAFEIVTRDSRRLFQAPDEEAMRDWMRAISKAIESLLNGTSSVRKLDRAVRASPFRSSDSVQQRPADFDEDEEVPGVGEGNDFAVRKLLDRTTRSSTQSMNDLAASAKAQDSDRKDRAKLGAHLAGLSESHAESSVQSSRRRSQHQRGISNKTPISGYLGAGKLGLTASDVAALHRRDGTQLSDDASISSKSTSGEQDAEFDRQIEAVVHKSYGSRDDTGTSHSGFSFNSAVSGVDEMGKFKANASARATSSSSPSKATSAANASVTSTATSTKMSRSAEIAAISRRPENRHCADCQESDPRWASWMLANQPCCIFICIRCSGVHRSLGVHISKVKSVDLDDWTEEQLQAARDWGNVRANALWEHSKPAGLLPLPSDRKEFWRRKYTDQEWKDPNPKILRDARPCYNSITDAPDNNHDATPTRRSALITEASPDVVTPQSKSQSHAQELGLRIMPSDQTASSNGSAKFPDVPGSPRPNGPRPLPQQRSVTMQASAISSLSSPTAGKLAGVKPNLTSPDSPNKQDRADWTARQTSFASDDEALTGLVASMMTEYASLRQDFPKESYPSCAPSIPTSTSAPPMSSLTSTNPHVSKAMLAARADRRLFPCLASTEAVETLPSNNAKVQVSSPPSTFFVSDMGAHTSSRMLFDGPGRGEAAWDATSEIGTDHHEGRSTESLPAITNPPARFDAFASHA

SEQ ID NO: 32282 - protein, 273 aa, Myxococcus xanthus DK 1622
MSQDSPDSLRRTAEEGARLAGRILADRFLGERTIEFKGGIDLVTDADKASEEALLAFIRERHPDHAILAEESGATQGTDSLRWLVDPLDGTTNYSHRVPHFCVSVAVEGPGGVLAGVVYDPMLNELFSAARGQGATLNGRPLRASTVSSLDRALLCTGFPYDVRERPEGPVGLFTRLILHAQGMRRTGSAAMDLAYVAAGRFDGFFEFGLKPWDIAAGSLLVEEAGGVIRHISGEPFDVLRGDVIASAPALAPALLSEAKRFVDGLREQPPRG

SEQ ID NO: 32283 - protein, 196 aa, Arabidopsis thaliana
MPTLYKKAGCLGIREFAMFKKALELSTLCDIEVCVIYYGRDGELIKTWPEDQSKVRDMAERFSKLHERERRKKRTNLSLFLRKKILDDNKLSEKVLEMKDSLESGLRVLQDKLLLLQPENQTELGQSRAVSSTTNPLSSPEDHHHQQWTEPLVTGVSNTEQDLSTSPLSNHQSKYSVFVYNHDSGSFYQVPDSICF

SEQ ID NO: 32284 - protein, 488 aa, Myxococcus xanthus DK 1622
MATLEQLRFDNTYARLPAGFGARVHPSPFPDAKLVSVNPAALKLLDLTPEEAQRPEFVAAMGGAKPLPGMEPFAMVYAGHQFGVYVPRLGDGRALLLGEVRDAAGAKWDLHLKGGGPTPFSRGGDGRAVLRSTIREYLCGEAMHGLGIPTTRGLGILGSQAPVYREAVETGAMLVRMAPSHVRFGTFEFFHYTEQTEHVATLADHVITEHFPQLAGQEGRYARFYTEVVERTARLIAQWQAVGFAHGVMNTDNMSILGLTLDYGPFGFLDDFEPGFICNHSDDRGRYAFDQQPRIGLWNLACLGEALLTLISEDEARAALATYQPAYNAHFMDRMRAKLGLRETRDEDRELVSDLFARMAEAHVDYTRFFRALGHFASADGADTRPVRDMFPAPEGFDAWAGRYRARLAAEGSVDAERHARMTRVNPKYVLRNWVAQEAISRAEAGDFSLVDRLLGVLSDPFAEHPDAEPYAAAPPTWGRHLAVSCSS

SEQ ID NO: 32285 - protein, 327 aa, Caulobacter crescentus CB15
MQTVLVTGGAGYVGSHCCLALAEAGFRPVVFDDLSNGHREHVQWGPLEVGDIRDAARLDAVFAAYAPVAVLHFAARIEVGESVKNPGAFFDTNVGGTITLIEAARRAGVKVVVFSSTCATFGDPVDLPMKETHPQAPLNPYGRSKLMVEQALADYDRYVGLKSAVMRYFNAAGADPQGRIGEWHEPETHAVPLAIQVALGQRPRFTIFGDDYDTRDGTAVRDYVHVLDLADAHVAALKRLLVGGSSETYNLGTGTGTTVRELVDGVGKVAGAPLPVEIASRRPGDAPVLVGDHAKARAELGWKASRSLDEILSTAWRWHRGRLEQEP

SEQ ID NO: 32286 - protein, 254 aa, Vitis vinifera
  misc_feature (223)..(223): Xaa can be any naturally occurring amino acid
MGRKFFVGGNWKCNGTGEEVKKIVSTLNAGEVPSGDVVEVVVSPPFVFLPLVKSTLRPDFHVAAQNCWVKKGGAFTGEISAEMLVNLGIPWVIIGHSERRLLLNESNEFVGEKVAYALSKGLKVIACVGETLEQRESGSTMEVVAAQTKAIADKVSNWANVVLAYEPVWAIGTGKVATPAQAQEVHSELRNWFQANTSPEVAATIRIIYGGSVSGANCKELAXKPDVDGFLVGGASLKPEFIDIIKSAEVKKNC

SEQ ID NO: 32287 - protein, 296 aa, Caulobacter crescentus CB15
MVGRLNGKVAVITGGCSGIGLGTVELFVAEGACVVAADLQDEKGRMLEQRFPDQVRFARCDVTADDDLAKTMALAESSFGGLDILFNNAGHGGTPASVPELTAEAWDKTFALLVRGPAMGMTHALPLMQKRGGGSIINTASIAGLQAGFGPLAYSSAKAAVIHMSRCAAAELSPQKIRVNAICPGLIATSIFGASMGLPREVADQMAAQIASIGPKIQPIPKSGLPEDIAAAALYLASDDSRFVTGTHIVVDGGITVGPRSAWDINTPSPILAAMGITPEQAEQMRAQLLAAGGTG

SEQ ID NO: 32288 - protein, 432 aa, Aspergillus nidulans FGSC A4
MDTSQVRILPKLDISAGHNFTKPSKRINESQDVAEFLSSKAYVDLMTFLLQLNRSLFPTKLPDGRVLTWELNSEAVEYSAPVRQLQQLLSKLEAILDEAPPDTGPRRFGNISFRRWYEMVESRAASLLEECLSKEILQMPSSDPGAPTAEVELLAYFLGSWGSPQRLDYGTGHELSFLAFLAGIWKLHGFPENSPGVEERAIVLGVIQPYLELVRTIIKRYTLEPAGSHGVWGLDDHSFIPYIFGSAQLAPAISESDRIPEEGSLSDAPAPGGVTKANVVERERKHNLYFSAIGFIYDVKRGPFWEHSPMLYDISGIQAGWAKINKGMIKMYNAEVLSKFPVVQHFPFGSLFSWERDPNAPSPAADAHIAATTRRTDEASTSSYLYSPKYIKATSWSYGSYKGALGNISTRWTGSPWRFYVCRPYANESSVG

SEQ ID NO: 32289 - protein, 830 aa, Coprinopsis cinerea okayama7#130
MSQNQPQIQQDPASPAGGSVRRHHTITAASRTARAQARDIISEETANDQGLGNDDGPVEDDWVTNVGAVGEKTSLHRQSSLPTRYHHRFNASKSANITPKAPVNSLAAIAGHEGDEEPWNLAEYHVQDEEVSRDHFSVFPIVAHFPDPPSFSQHPSVEQQLESQAANTTSPLSPHFNQQPPQVPSPPPAGSGVRRHVSLTYGAGVGQRKINNAGLKRSGTLQATVPTHSQGPSTPDPSEYSQEVEYPYEPEDLSTNAATVPSAEDEYYYRQQQQQQNTGGAIGRQSPWSQSNDWRAPGNPNFSSGGNATIDDVQRALSTLEIASGAGNNTYNANAYAATQPNYPPRFSGTPRAGGNGGNVIGGGNNYDGGRRTPNRVQNNQNWDQGQQHHLQHRQSNTNMQYGYQQGNGHGKSPSGSSGSGAIPAVPAIPQQYLQQQGQHQGRPGLGVATNVTTPHNNGSSGQTPIQPFISTPIDVPSLIATKGYNPATFDIKPPFARYFVIKSYTEDDVHKSLKYEIWSSTDPGNKRLDKAFKESASRGPIYLFFSVNASGHFCGMAEMMTPVDYTRSSTVWASDKWKGVFKVKWIFVRDIPNAALRHIKLNNTQERKPVTNSRDTQELLPDAGQEMLRIFHTHPARTSLLQDFAFYELQAMQKMQAQAATGNPPPPIIPTIPTNNQNSGASSPPTQPSSVVHSPQPSHSSVTSSTSSSPHSNQTSNTSNSNNLAFQSNAYMTPMMQMQLQMGMGMGGVGGMGITAPMNGMGMGMGMGSMGMGNMPLNMGLSGMGMGGMNHMGGMSSNAYQAVMRHTSPAPSQGNNQGHNANQGQGYNY

SEQ ID NO: 32290 - protein, 347 aa, Triticum aestivum
MRAMDPAPAASKMRFDSPAFRVHEDGRVERFFGTDTTEPGFDAATGVTSKDVVLDGATGVFSRLYLPALPDGPDRGRRLPILVYFHGGGLVLGSAASQMYHGYLNSVVSRAGVLAVSVDYRLAPEHPIPAAYEDSWMALSWAASRADPWLSEHGDAGRIFLAGDSGGANIVHNMAIMAGSADDDNGLPVGAVVERVILLHPMFGGKEPVDGEAADTRYHMEKLWALICPDGDGLGVDDPRLNPMAPAAPRLRALAGRRLLVCSAERDFARARAAAYYQAVKEIGFVHTLPPPPPPRTGERGRHRRRDEGQVEEEEDEEAQEEAPKDEAAIQVGGKHHLASRQRNSEG

SEQ ID NO: 32291 - protein, 415 aa, Roseovarius nubinhibens ISM
MTILQISSLLIVLAGVFGAINYLFLKLPSAIGILVVALVASFGMMGVDWMLPHLGISDEIRRLVTGLHFSDALLEGMLGLLLFAGALHVKISDLRAQWRAVFLMATLGVGLSTLVIGTGFSWLTGAPFLIALVFGSVVSPTDPVAVLGVLREANLSKALETKIAGESLFNDGVGYVVFLVLVGLAFPTGDAHGSGLAGAAKLFIQEALGGAALGLALGWLTFRVMRHIDDYSLEVLLTLGLAFGGYELAVYLHVSAPIMAVCAGLLIGEVGAKHGMSETTRQYVDGFWKLIDEILNAVLFLMIGFEVFAVAFETDYLLIGAASIALALFGRLAAVLVPIYILRPFRTFENGVIPIMTWGGLKGGISVALALSLPDSEWKPVILTATYLVVIFSIIVQGLTVARLANRFGREPDLV

SEQ ID NO: 32292 - protein, 488 aa, Escherichia coli
MKKVNHWINGKNVAGNDYFQTTNPATGEVLADVASGGEAEINQAVAAAKEAFPKWANLPMKERARLMRRLGDLIDQNVPEIAAMETADTGLPIHQTKNVLIPRASHNFEFFAEVCQQMNGKTYPVVDKMLNYTLVQPVGVCALVSPWNVPFMTATWKVAPCLALGNTAVLKMSELSPLTADRLGELALEAGIPAGVLNVVQGYGATAGDALVRHHDVRAVSFTGGTATGRNIMKNAGLKKYSMELGGKSPVLIFEDADIERALDAALFTIFSINGERCTAGSRIFIQQSIYPEFVKRFAERANRLRVGDPNDPNTQVGALISQQHWEKVSGYIRLGIEEGATLLAGGPDKPSDLPAHLKGGNFLRPTVLADVDNRMRVAQEEIFGPVACLLPFKDEAEGLRLANDVEYGLASYIWTQDVSKVLRLARGIEAGMVFVNTQNVRDLRQPFGGVKASGTGREGGEYSFEVFAEMKNVCISMGDHPIPKWGV

SEQ ID NO: 32293 - protein, 474 aa, Roseovarius nubinhibens ISM
MTLQIPFDNSYAALPEGFFTRINPKPVAAPRLIRFNDGLARDLGIEADASDPALADMLAGNRIPDGADPLAQAYAGHQFGGFSPQLGDGRANLLGEVIDSAGRRRDIQLKGSGPTPYSRMGDGRAWLGPVLREYVVSEAMHALGVPTTRALAAVETGEKVFRESGALPGAVLTRVADSHIRVGTFQFFLARRDLDRLRALFDYTRARHYPQAETPGEMLAGVIGRQARLIALWEGLGFIHGVMNTDNTTLSGETIDYGPCAYMDRYHPQTVFSSIDAQGRYSYSNQAHVIVWNIAQLATCLVPLTPDQDVAVEEFTKLVHDMPALIAKYRSEVFARKIGLSAAQDGDDALVDDLLTLMQQDGADFTNTFRSLSDGAPRDQFTDRDAFDGWHARWQARLKYETDPEAVMRAANPYVIPRNHRIEQMIAAAREGDYAPFDRLLTALSSPYETREEFADLTRPPLPEERVQQTFCGT

SEQ ID NO: 32294 - protein, 336 aa, Thermobifida fusca YX
MTKVAVLGSGSWGTAFANVVADAGIAETVLWGRRPEIVEAINTKHENPDYLPGITLNPRLTATTDVAEAMAGADFTVIAVPAQTLRTNLAAWSEALDPGTVVVSLMKGIEVGTCLRMSEVIAEVLELPDHRIAVLSGPNLAREIAERQPATAVVACTDEQTAVRLQHLCKSPYFRPYTNTDVIGVELGGAVKNVIALAVGVAVGMGFGDNAKAALITRGLAETVRLAVALGADEHTLAGLAGLGDLVATCSSPLSRNRTFGEKLGSGMTVDEVIAETKQTAEGVKSSTSILELARAHGVEMPITEAVVAMMYHGLPPAEALLAFMSRSAKPERYGV

SEQ ID NO: 32295 - protein, 1503 aa, Gibberella moniliformis
MQRLPSFNSPSSPSASASLNCPVADSTDQEKEGRKKHPPPPPPTSTSTPGSVPTFTTPSNTTATSTTNPELDTDVSVLAAAAAKAAGEAYNRVTITGRKAYDSRRISEAPAWRHDLSIPNLASIAPFSDFTTSFSPASTTGAIHQSSLSTAGSPRGLSASTRGLPQTPIPAKRPSAPSRSEPVMHPSPIKKARTGASPPRKVELPNQSANLDPSARGRQQGPLSPLFFSHTPARHVHRPASFPATDPAASMLSRMREDPAGGVTTLKLPRASVSSISPGRSESTPGSWGSSMDAPAHTTTPDSRSLPPGLQMLQGVGVIEFLEQDERPTFLIDLDNSANASRAGLHILYYNASLRGAHEVLQYLSVDQEDASADTDFGRFKSWIMTQSKARVSADTHKYAGITWTLSTLRRRFRFVSAQTCVATPRPSTALPLIDETTASETRSSGHSPQMPVTPDAELVDAPDYFGDAEPVDANFDREDVDAIMEGGDTRLHPDEFTNQVFQSQPARSIFDWTRIPVSDALPPHIKFARSVDWAATPLGPIEDWPADLRSMSNLIMGSPHPAAMYWGPQCVIIYNEAYLDLAGQKHPKLMGSCYMDAWPEIWDEIKPVFKSALESGQATMKHENQLFINRHGFLEEAFFSWSIVPLVGGEGEVVGLYNPAFENTRRRVNERRMLMLREIGERTAAATTVAGFWPQVQKGLEFNEHDVPFALIYSAREDTRERGFIITFLVLEGSLGAPENHQAALPQLDMRQSEDGFAPYMRQSMAAGGIPIVLSEENGNLPTHLIDGLHWRGFGDPSKTLVVFPVIPTTTGESVIGFIVMGVNPRRPYDDDYKLFIHLLSRQLATSMASVVLFEEEIKRGQRAARLAALDRQELSMQLYLRTQEAVESEYRFTRMAEFAPVGMFIANFAGKINYCNDMWWQISRHSRSEDSVDTWMDSVRDEDRPALEDAWDKLLREKVTISVEFRFKCSQQSDGNTIDTWVLMSAYPERNQEGNLKLIFGCITDISSQKWAEKVQNERREEAVEMKRQQENFIDITSHEMRNPLSAILQCADQIANNITIFDSHSVKSEVENLLDGCLDAANTINLCASHQKRIVDDILTLSKLDSNLLAVTPIDEQPVRVVQRALKMFESELVAHDIEFDFNVDQSFEQYGIKWVKLDPSRLRQVLINLMTNAIKFTQGREKRAITVSLSASKHVSEVTRKGTSYFDRVDHQRTAVMDINNTNEWGHGEEINIHCTVEDTGPGLIEEEMKLLFQRFQQATPRTHVQYGGSGLGLFISRILTEMQGGQIGVTSRRGIGSSFSFYIKCRRSLTPPQDYEQITPFKIARKSHAPAIPQKPELNRQPSRTTTTSEDTTQLFDVLIVEDNIVNQKVLQRQLRNCGNNTFVANHGKEALQTLERSRFWAGKEAEGVDISVILMDLEMPVMDGMTCARKIRELEREGIIVQHIPIIAVTAYARPEQIESAKAAGIDDVISKPFRIPELLPKIEELVGKYKNLSVSA

SEQ ID NO: 32296 - protein, 619 aa, Arabidopsis thaliana
MGASHSTNVNNHPHSRNASNHPLTNSNSTSSRHSASSSDRLSVSNLRSQLTTIYRNQEEEEEEEEEEEEEEEGGKEKRAEEEAKSFSLVRDFDLSGLNCIRVSRRNYILMDPHKKVALETEFFTEYGEASRYQIQEVIGKGSYGVVASAIDTHSGEKVAIKKINDVFEHVSDATRILREIKLLRLLRHPDIVEIKHVMLPPSRREFRDIYVVFELMESDLHQVIKANDDLTPEHYQFFLYQLLRGLKFIHTANVFHRDLKPKNILANSDCKLKICDFGLARVSFNDAPSAIFWTDYVATRWYRAPELCGSFFSKYTPAIDIWSIGCIFAEMLTGKPLFPGKNVVHQLDIMTDLLGTPPPEAIARIRNEKARRYLGNMRRKPPVPFTHKFPHVDPLALRLLHRLLAFDPKDRPSAEEALADPYFYGLANVDREPSTQPIPKLEFEFERRKITKEDVRELIYREILEYHPQMLQEYLRGGEQTSFMYPSGVDRFKRQFAHLEENYGKGEKGSPLQRQHASLPRERVPAPKKENGSHNHDIENRSIASLVTTLESPPTSQHEGSDYRNGTSQTGYSARSLLKSASISASKCIGMKPRNKSEYGESNNDTVDALSQKVAALHT

SEQ ID NO: 32297 - protein, 405 aa, Aeropyrum pernix K1
MPQKDPTLDIQERVVEIEGETAFAYLAVARKLIQEGRRVISFGIGQPDFPTPHHIREAAKKALDEGFTGYTETAGIPELREAIAWYLNSRYGADVSPEEVIATTGAKTAIFLGMALYLRPGDEVIIPDPSYYAYAQVAKLFGARPVYVPMKFEPGLGFRFDIEGIERAVSEKTRMIVVNNPHNPTGSVFPPDQVEAIHDIARRRGLIILADEIYDNFLYTEKPFKSTLSLPDWRENLVYVNGFSKTFSMTGWRLGYVVLRREVIPKALDLAVTIYSCPPSIAQKAGVAALRGDWGPVREMVEEFRSRARILYDILSQAEGIEPYLPEGAFYMFPRVAGLLRKTGLSVEQLAEKLLYSYGVLVLPGTSFPESVGREHVRLSFATATSDVKEGAEIIVRASRELSSG

SEQ ID NO: 32298 - protein, 332 aa, Trichodesmium erythraeum IMS101
MKAFEVREFGNLVCTERPQPEPKFGEVLVKVKAVSLNYRDILMVKGAYNPHLPLPVIPCSDGVGEVVSVGEGVTKVKPGDRVASIFMQKWLSGNLTREAARSALGGEIDGMLAEYVILSEDGVVNIPSYLSDIEAATLPCAAVTAWHALIEAGLKPGETVLVMGTGGVSLFALQFAVMAGARVIATSSSDEKLARVKQLGASDMINYKSVPKWEKQVLALTEGTGVDYVVEVGGAKTLSQSLKAVKIGGQISLIGILAGAQAEFNILPALMKEVRIHGIFVGSRQMFEAMNRAIDLSQLHPVCDRIFPFESAPEALSYMEIGSHFGKITIQF

SEQ ID NO: 32299 - protein, 326 aa, Trichodesmium erythraeum IMS101
MKALVLEKPGIPDSLYITEIPLPQPAAGEIRVQVHAVGLNPVDYKLAAGGFSTWSYPFILGLDVAGVVDAVGTDVTEWQVGEQVYYHGNLSKPGAYAEYTNANALAVAPLPEGISFTKAAAIPCAGFTAYHALHHRLHIQSKQTILIHGGAGGVGSFALQLASLAGLEVITTCSQSNFDYVQKLGAKHLIDYKNQDVVIRVKEITNDRGVDAILDTVGSETATTGLKMLAFNGGIACIAALPDFSNFKSFSLAASIHQIALGGAYLSGDKKAIQDLGKMGREMGELVREKKVSPMLTEVISLEEIPKALNRLKGRHVRGKIVAEIR

SEQ ID NO: 32300 - protein, 339 aa, Synechococcus sp. WH 5701
MKIGINGFGRIGRLVFRALWGRPGIALVHVNDPAGDAAAAAHLLEFDSVHGRWPEAVQAGGSGFLVGDQPVGYSQHADPTAVPWAAAGVDLVLECSGRFKTPETLEPYFSDLGLQRVIVACPVKGVVAGEEALNVVFGINHQRYDPSRHRLLTAASCTTNCLAPVVQVVHEAFGIRHGSITTLHDVTNTQVVVDGFKSDLRRARSCLQSLIPTSTGSARAIGLIFPELQGKLNGHAVRVPLLHGSLTDAVFELNQEVSAEQVNAAFAVAADGPLQGILGYETRPLVSIDYVNDSRSAIVDGLSTLVTGGTQLKVYAWYDNEWGYSCRMADLACHVAAIP

SEQ ID NO: 32301 - protein, 226 aa, Caulobacter crescentus CB15
MARYPRAMTAPIIAPSILASDFAKLGEEVAAIEAAGADWVHVDVMDGHFVPNITLGPDIVKAIRPHAKIPFDVHLMISPADPYLEAFRAAGADLISIHPEAGPHLHRSLKRIRELGAKAGVVFNPSTGIDHVEWILEDVDLLLVMSVNPGFGGQSFIPGQLRKVEALRKMVDKAGLDIIIEVDGGVTPVTAPQCVAAGATALVAGSAVFKGGPAAYADNIRALKGG

SEQ ID NO: 32302 - protein, 412 aa, Aeropyrum pernix K1
MGRIVQVKLPDIGEGIAEGEIVEWLVEEGAVVKQFSPLVRVLTAKATVEIPSPYTGRVVRLLAKPGDVVRVGDPIIEIEVEEGEAPKAPEAAEKPSATVEPPKAEEAAAPPPQAAPAILVRAPPRVRRLARQLGVDLARVRGTGPRGAITEDDVRRAAAMLATAPKPEAPPPVAEEAEERIPVRGIKRSMAQSMSLSKSKIPHAYIAEEVDFTELSKLREALKRDAEEKGVRLTYLPFVFKAVAKAIRKYPLVNSEFDEEKMEIVVKKAVNIGFAVDTPHGLVVPVVKNVEKKGLFAIAREIADLTAKAREMRLSLEEVSGATFTITNVGSIGSVIGFPVIYPPNVAILGVHRLVERPVYVDGELKPRKIGFVSLSFDHRALEGAYATRFLMEVKRLLENPALLFAEDYEFR

SEQ ID NO: 32303 - protein, 324 aa, Synechococcus sp. WH 7803
MAHSPNRLSNRALHRLLSGLMVPVLLVGLLLLSPLPSEAARGGRIGGGSFRAPSMPRSGGYGGGVRGGYNGGYGRGYGGGFGFPFIIPIFGFGGGGLLGFLVLMAIVGVVVNAVRGGGGRPALGGGIGGTDGPREIPMGPVSLLQLQIGLLASAKDLQSDLRALASSADTSSSSGLQRVLQDTTLALLRQPDLWVYANAESGSVPFNAAESTFNRLSMTERSKLREELTTNVGGVRSNVDTIASRGDADATNEFIVVTLLVASRRSVTLKSADNGEDLRETLRILGSTASSDLIALEVIWQPDGAGDVLSADELVTAYPNLQHL

SEQ ID NO: 32304 - protein, 450 aa, Gloeobacter violaceus PCC 7421
MEKADVIVIGSGQGGVPLAVDQARSGRRVVLFERGALGGSCINYGCTPSKALLAAAHAAGRARLAAPLGIHAEVTVDFARVMERVRGIRASFRQGIEQRLADAGVQIVHAEASFAGSSTVVGGGVEVQAPLVVINTGTGPTIPELPGLAGLPLLTNLNIFDLETLPRCTLILGGGYIGLELGQGLARLGSEVHIVHNHERLLNHEEPEVGEVLAEALRRDGIHLHLQSEVSQAVYQDGICALTLEDGQILRGEAALLAAAGRTPNTAALGAPAAGIALDKQGYVAIDEHFRTTAAGVYAIGDVARQPAFTHVSWEDYRRLQAILGGEERTRSDRVLGYAVYTEPQVGRVGLTLDQALAKGHRARSVTLPMAHIARAIEWGHDLGFYRLVVDEDTDKILGATLVGYEAAEIVHVLLAHMQADSTWKVLEQSVHIHPTYCEALPSLARLLKQ

SEQ ID NO: 32305 - protein, 375 aa, Sinorhizobium meliloti 1021
MRTRAALAVQAGKPLVVTEVELEGPRAGEVLVEVKATGICHTDDFTLSGADPEGLFPAILGHEGAGIVVDVGPGVTSVKKGDHVIPLYTPECRSCPSCLSRKTNLCTAIRATQGQGLMPDGSSRFSINGDKIHHYMGCSTFSNFTVLPEIALAKVNPDAPFDKICYIGCGVTTGIGAVINTAKVEIGATAIVFGLGGIGLNVIQGLRLAGADMIIGVDLNNDKKPWGEKFGMTHFVNPKEVGDDIVPYLVNLTKRGADQIGGADYTFDCTGNTKVMRQALEASHRGWGKSVIIGVAGAGQEISTRPFQLVTGRTWMGTAFGGARGRTDVPKIVDWYMEGKIEIDPMITHTMPLEDINKGFELMHSGESIRSVVLY

SEQ ID NO: 32306 - protein, 583 aa, Caulobacter crescentus CB15
MPAPPNRLAWRNDLLEAALRLFAPLAAALSAALLLVAPSVEAKPRSAAAAVRALEAGAVASPDQYGALAAQEVLKAGGNAVDAAVATGFALAVTYPEAGNLGGGGFMTVYMDGKPYFLDYRETAPAAARADMYLGPDGELVEGLSLYGGLAAGVPGTVRGLAMAHQRFGKLPWGQVLAPAIRYARDGFVVDAHLAGVLADEPPPEFAKTNFRTYFAAHKAGTLFKQPELAATLERIALVGDRAFYEGKTADLIVAQMARGPVKGLITKADLSTYKAAWRTPLVAKWRGYDVITAPPPSSGGIALMQLLLMKQNLAPMFQGVALNDPQYVHLLAEIEKRVYADRAEYLGDPDFVKVPVSNLIDPAYVARRAKEVDPAKPSATKAVQPGLEKHETTHYSIVDQWGNAVSNTYTLNGSFGSGVVVEGAGFILNNEMDDFSAKPGAPNMFGVVGGAANAIAPGKRPLSSMTPTILTKDGRVAMVIGTPGGSRIFAWVFQVLANVYDHGLSLKAAQAAPRFHHQLLPQNVIFYERSGPPSADLKAALEARGYTWTESFSGDVEAIQVLGRTPVPEPDPRARGVGLVVK

SEQ ID NO: 32307 - protein, 323 aa, Mycobacterium tuberculosis H37Rv
MTRYDSLLQALGNTPLVGLQRLSPRWDDGRDGPHVRLWAKLEDRNPTGSIKDRPAVRMIEQAEADGLLRPGATILEPTSGNTGISLAMAARLKGYRLICVMPENTSVERRQLLELYGAQIIFSAAEGGSNTAVATAKELAATNPSWVMLYQYGNPANTDSHYCGTGPELLADLPEITHFVAGLGTTGTLMGTGRFLREHVANVKIVAAEPRYGEGVYALRNMDEGFVPELYDPEILTARYSVGAVDAVRRTRELVHTEGIFAGISTGAVLHAALGVGAGALAAGERADIALVVADAGWKYLSTGAYAGSLDDAETALEGQLWA

SEQ ID NO: 32308 - protein, 160 aa, Synechococcus sp. WH 7803
MTLRIGNGYDIHRLVAGRPLILGGQRLEHPDGVGLDGHSDADVLVHAIMDALLGALSLGDIGLYFPPTDPQWKGADSLELLRQVVALIQQRGWQVVNVDSVVIAERPKLKPHIEAMRTAIAEAMGIAPEQVGVKATTNERLGPEGREEGISCHAVALLSQ

SEQ ID NO: 32309 - protein, 336 aa, Pseudomonas fluorescens PfO-1
MSRVTLSRYLIEQTRSNNTPADLRFLIEVVARACKEISHAVSKGALGGVLGSMGTENVQGEVQKKLDVLSNEILLEANEWGGHLAGMASEEMDNAYQIPGKYPKGAYLLVFDPLDGSSNIDINAPVGTIFSVLRCPNEYLSQNEALDEKAFLQPGTQQVAAGYAIYGPQTMLVLTLGHGVKGFTLDREMGSFVLTHEDITIPESTQEFAINMSNQRHWEAPVQRYVSELLAGEEGPLKKNYNMRWVAAMVADVHRILTRGGLFMYPRDSREPSKPGKLRLMYEANPMSFLVEQAGGASTDGHQRILDIKPEGLHQRVAVFLGSKEEVARATAYHKE

SEQ ID NO: 32310 - protein, 313 aa, Roseovarius nubinhibens ISM
MSREKIIIDTDPGQDDAVAILLALASPEEIDLLAITCVAGNVPLALTARNARMVCELAGRRDIPVFAGCDRPLGRALVTAEHVHGKTGLDGPDLPEPTMPLQDAHAVDHIIACLREHDSGTVTLCPLGPLTNIATALQKAPDIAPRIRRIVLMGGAYFAVGNVTPAAEFNIHVDPQAAGIVLKSGVDITMAPLDLTHKALVTESRNAAFRALGTPVGIAVAQMTEFFERYDREKYGSPGAPLHDPCVIAYLLRPDLFSGRHVNVAIETTSELTMGMSVADWWGVTSRAPNALFLGDIDADGFFSLLTERLARL

SEQ ID NO: 32311 - protein, 248 aa, Roseovarius nubinhibens ISM
MRRKLAAGNWKMNGDSATLDELATLAQRHAEASVDLLICPPATLISRAVSCAGPIRIGGQDCHAAPSGAHTGDISAAQLRDAGATAVILGHSERREDHDEDSDQVREKARAAHAADLLTVICLGESLAQREAQNTLDIIGAQLALSVPDSATGENTVIAYEPIWAIGTGLVPDTDQIGEVHDFIRARLERRFGAGVGRSVRLLYGGSVKPENAASIFAVSNVDGALVGGASLKAADFSPIVSALEASA

SEQ ID NO: 32312 - protein, 131 aa, Glycine max
  misc_feature (61)..(61): Xaa can be any naturally occurring amino acid
MESEALIWGDKLTQRGLSFFGFHGALPEERNLGQKFLVDVDAWMDLKAAGKSDHLSDTVSXDIYAIAKEILEGSPHILVESVAQKIAVTTLTNHNQILAVRVKVKKSHVAVRGPVDYLGVEIFRRRSDLSE

SEQ ID NO: 32313 - protein, 403 aa, Arabidopsis thaliana
MNSILSSVLPAPEDPVLSVIFACRDDPSPVKLNLSAGTYRTEEGKPLVLDVVRRAEQQLANDLDKEYLPLNGLPEFNKLSTKLILGDDSPALKENRVVTTQCLSGTGSLRVGAEFLATHNKESVIFVPNPTWGNHPRIFTLAGLSVQYFRYYDPKSRGLDFKGMLEDLGAAPPGAIVVLQACAHNPTGVDPTFEQWEKIRRLVRSKSLLPFFDSAYQGFASGSLDADAQAVRMFVADGGECLIAQSYAKNMGLYGERIGSLTIVCTSEDVAKKVENQVLLVVRPMYLTPPIHGASIVATILKNSDMYNDWTIELKGMADRIISMRQQLYAALEARGTPGDWSHIIKHIGMFTFTGLSEEQVRLMAKEYHIYMTYDGRISMASLSSKTVPQLADAIHAVVTRIA

SEQ ID NO: 32314 - protein, 240 aa, Bacillus anthracis str. Ames
MRTPLSFDKDTAILLASCCELTYEQYKQNGIFEIPNGFQYVQGFQGKTIQTTEWFGFILESEDTIIVAFRGTQTDTDWIIDSLVNQKPYPYALNSGNVHNGFLSIYESCRDSIMDMLVSLPAHKKLLATGHSLGGALATLHILDARINTAFAQYGLYTFASPKVGDIAFRNYYKLQVASSFRFVNLFDVVPLLPPRNVHFNEQDWEYAHVHHNMTFTKNTKSIANNHAMTTYKTCLTSHF

SEQ ID NO: 32315 - protein, 307 aa, Mycobacterium sp. JLS
MRHFLRDDDLTPEEQAEVLALAAELKKDPLLHRPLAGPRGVAVIFDKNSTRTRFSFEVGIAQLGGHAVVVDGRSTQLGREETLEDTGKVLSRYVDAIVWRTFAQERLTSMAAGATVPVINALSDEFHPCQVLADLQTLIERRGALPGLRMAYFGDGANNMAHSLMLGGATAGMHVTIAAPQGFEPHPMFVAAAQERAALTGASVTVTADPHQAADGADVLVTDTWTSMGQENDGLDRVRPFRPFQVNTGLLDRAHAEAVVLHCLPAHRGHEITDEVIDGPHSAVWDEAENRLHAQKALLVWLLERSG

SEQ ID NO: 32316 - protein, 402 aa, Mycobacterium sp. JLS
MTLQQRWSAVMMNNYGTPALALASGDGAVVTDTDGRSYVDLLGGIAVNILGHRHPAVIEAVTRQLNTLGHTSNLYATEPGIALAEALVGHLGAPARVFFCNSGTEANEVAFKITRLTGRTKIVAAQGAFHGRTMGSLALTGQPSKQAPFEPLPGYVTHVPFGDIDELARAVTSETAAVFLEPIMGEGGVVVPPAGYLAAAREITTRHGALLIVDEVQTGVGRTGVFYAHQHDGITPDVVTLAKGLGGGLPIGACLAVGAVGDLLTPGLHGSTFGGNPVCTAAALAVLKVLADDDLVTRAGVLGKTLSHGIEELNHPLVDHVRGRGLLIGIALRAAAAKPAEAAARAAGFLVNAAAPDVIRLAPPLVVTEAQIDDFLGALPGVLDTAAGGGESTPAASEVADS

SEQ ID NO: 32317 - protein, 313 aa, Azoarcus sp. EbN1
MNDALRIFSCNANRTLADEICKRLGLQQSPLEISRFSNDNLRVQVQDNVRERDVFVVQPFTEPVSEHIMELLITIDALRSASAGRVTAVIPYYSYARSDKKDAPRISITGRLIADMLATAGANRVLTMDLHADQVHGFFSVPVDHLTAVPTIAEHFRQNHDLSRMVAVATDAGGAKRVGRFSERLGIPMAIIDKRRVSDTDVKQGRVVGEVAGRDAVIFEDEISTGGTLLATIDTLRAAGARSIHAGAAHGVLCGPAIHRLRDASIESIVVTDTVHMPPHKRLDKITQLTVAPLFAAAIERIHSGESVGALFE

SEQ ID NO: 32318 - protein, 373 aa, Oryza sativa Indica Group
MPAGSSGGDGEVEAGFAKLQGEDFEYYMQTYSIMLGRNSKKSTVDVDLSSLGGGMNISRHHARIFYDFQRRRFALDVIGKNGCLVEGVLHLPGNHPVKLDSQDLLQIGDKKFYFLLPTRSIFASAAAARHPPIIPQQMPPPSYVRTGRPRLSEFHDRSFEGDYGREGDEIGNGISESGGMRGKLIKRNKKLSAESEMYGGHRINVEAIGTLGEGDSRSEIRSRGDRDMDNQHILQAEEKDVVSSVATVLSDLCGPGEWMPMAKLHTELLEQFGNVWHHSRVRKYLSPEDWSPTETKGQMGNRWEPASDELRESWPVGAKFFWNLSVLYSIDGWIIHLDFSRNQTFGSKVYRSSEFGSTLHQLWSALESGLIGL

SEQ ID NO: 32319 - protein, 467 aa, Debaryomyces hansenii CBS767
MSALIAASRSTMAFRAVACTKQYSAGYLQLARLYSSGKFPPHTVINMPALSPTMTQGNIGSWSKSVGDELHAGEAIAEIETDKASMDFEFQEDGYLAKILLGDGTKDVPVGKPIAVYVEESEDVQAFESFTAEDAGDASTEAKAPEPEKESKAEESKPEASEKKSKSESAPAQSKPVAGRIFASPLAKTIALDKGIALKNIKGSGPNGRIVAKDVENFKAPAAAAAAAPSATAAAYEDVPISNMRKTIATRLTQSTQESPSYIVQSQISVSKLLKLRQSLNAAADGRYKLSINDLLIKAIALANLRVPEANSAWLLDQGVIRTYSNVDVSVAVATPTGLITPIIKNAHTKGLSAISNEIKELGKKAKAGKLAPEEYQGGTITISNLGMNHAVNSFTSIINPPQSAIVAIGTVDKKAVPSNVNEQGFVFDDVMTITGTFDHRTVDGALGGEWIKALKTIVENPLEMLV

SEQ ID NO: 32320 - protein, 290 aa, Mycobacterium sp. JLS
MTAATHTKAQVLAAALPWLKQLHGKIVVVKYGGNAMTDDTLKAAFAADMVFLRNCGVHPVVVHGGGPQISAMLKRLGIPGDFRGGFRVTTPEVLDVARMVLFGQVGRELVGLINAHGPYAVGITGEDAHLFTAVRRDVMVDGVATDIGLVGDVEHVNTEAVRDLIAAGRIPVVSTIAPDANGVVHNINADTAAAALAAALSAEKLLMLTDIEGLYTDWPDRNSLVSQINTADLTELLPTLEAGMVPKIEACLRAVTEGVPSAHVIDGRVEHCVLVELFTDEGTGTKVVNP

SEQ ID NO: 32321 - protein, 175 aa, Anaplasma marginale str. St. Maries
MNLSAIGSGKNAPEEVNVVIEISKDSHPVKYELDKGCGAFCVDRFLPTAMYYPCNYGFVPETIAGDGDPVDVLVLTRFPVITGAVIVSRPVGALMMSDESGEDVKVVAVPARKVDPYYDGVNDYSDLPQSFLDSVSHFFSFYKKLEKDKFVSVGAWRDAEFAKSLIRESMSSVAR

SEQ ID NO: 32322 - protein, 73 aa, Brassica napus
VDPRVRVNPKYILRNYLCQSAIDAAEQGDFSEVNNLLRLMKRPYEEQPGMEKYARLPPAWAYRPGVCMLSCSS

SEQ ID NO: 32323 - protein, 223 aa, Oryza sativa Indica Group
MARFEAYENNGGTCVAVAGADYCVVAADTRLSVGYSILSRDSSKIAHLADKCVLASSGFQGDVKALQRNLAAKELLYEHNHNKKMSCPAMAQLLSNTLYYKRFFPYYAFNVLGGLDSEVAAHQYERMITTCENIFSSFAGYSAQGTGAALMMPVLDNQLKSPSPLLLPARDAVTPLSQSDAVDLVKDVFASATERDIYTGDKLEIVVINSAGSHREFIELRKD

SEQ ID NO: 32324 - protein, 466 aa, Acidobacteria bacterium Ellin345
MSLSTMIPGAIATPRTYVNEVLALVKAKNPAEKEFHQAVQEVLESLIPALERHPEYISHKILERVTEPERLLMFRVPWFDDKGEIQVNRGFRIEMNSAIGPYKGGLRFHPSVNLGILKFLAFEQVFKNSLTTLPMGGGKGGSDFDPKGKSDNEVMRFCQSFMTELQRHIGPDTDVPAGDIGVGGREIGFLFGQYKRLRNEFTGVLTGKGLNWGGSLIRPEATGYGCVYFAEEMLKTVKQTLEGKVCLVSGSGNVSQYTIEKLLDLGAKPIACSDSNGIIHDPAGIDREKLAYILDLKNTKRGRISDYAEKFKTAKYIPVDPKLDHNPLWDIKADCAFPSATQNEINAKDAKNLIKNGCKVVSEGANMPSTLEATNLFLEAGVLYGPAKAANAGGVATSGLEMAQNSARLAWTREEVDHRLHNIMIAIHKNCFETAEKYGKPGNLVVGANIGGFLKIADSMLDQGLV

SEQ ID NO: 32325 - protein, 388 aa, Zea mays
MATAGKVIKCKAAVAWEAGKPLSIEEVEVAPPQAMEVRVKILFTSLCHTDVYFWEAKGQTPVFPRIFGHEAGGRLKILDFASIIESVGEGVTDVAPGDHVLPVFTGECKECAHCKSAESNMCDLLRINTDRGVMIADGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFDLMAKGEGIRCIIRMEN

SEQ ID NO: 32326 - protein, 416 aa, Oceanicola granulosus HTCC2516
MERLTQRSMAFVLAGGRGSRLKELTDRRVKPAVYFGGKTRIVDFALSNAMNSGIRKIALATQYKAHSLIRHCQRGWNFFRAERNEFLDILPASQRMGGEAWYRGTADAVTQNFDIVDDYDVDYVIILAGDHIYKMDYEIMLRQHVETGADVTIGCLTVPRMEATAFGVMAVDDNGQITDFLEKPADPPGTPDDPDVALASMGIYVFSWKLLRELLLKDADDPDSSHDFGNDLIPDLVKNGKAIAHRFDISCVRDAGAPAYWKDVGTVDAFWEANIDLTNFTPDLDLWDTKWPIWTYSEGVPPAKFIHDERDRRGVAISSMVSGGCIISGTEVRNSLLFTQVHTNSYAVLDHAVVLPHVVVHRSARLRKVVIDSGVEVPEGLVVGEDPLVDQEFFRVTEKGVTLITQPMIEKWKAAQ

SEQ ID NO: 32327 - protein, 988 aa, Gibberella moniliformis
MHFFPKADAALLSSTVDKHSLPPRPKAIGPIFDANNFKVPIEPWTSDADSSFYPPKPDPFGPSSIPQEAHCASSSKYVRSRLAKNERLRLSMLWYYARDLDNEPELLAGLQEKACLAQESSDWEYAVVGVLDVNVYIRLATVGLQLAILPRGETLCAHTVTQPPGNVFLLPNMLEDWRFRESPYVEHGGLVAYAGVPLRMQHESGECVGLGSLCVASATGRDPLSKTQQLALARLADWIVHDIIQCARARRQRERHRFVELIAAVQQEPDGEDVQEPILRILRQAFPDESISLQSTGTDQSTIPYPATTSDLKHGLWEDDEYIEDFIANSNFDEPPKDRVVRFISAQCETKLGPSVLVVATKDFRRIFDDVDSWFVHTCATMLTQRWQKRLLTEVMRAKEKFLRGVSHQLRTPIHGILGAAELLTEDLRALTVPGSSKFQHGVEAIMKPLAELGKSSIYLDTISTAGRELMSTVNSMITLNRWADIAAAERQYATHGIESLETSLVKALADFTFRDTRTRAPVFFHHNLTSESEGLRIDINLFRDSILPLIVNALQNTTEGVVTVTQSYTQDTKTLVVDIEDTGCGIPPEDQGRIFDLYEKVGEHSTGAGLGLTLATKFSALLHGSIELVSSEVNRGSHFRATFRDIRPSASPIETKALQFKHLPLSYRHLPSDSPDAHLSSNLAKYLARNGFSSSNDPQECLNIIDYIRDPTEREKYHSILPQGQVAICLVTNSDETDVPESCTNIIFVDGPFSSSTLDSALRKADELLARLKSTQTSPQPSPASLEDPKSLLSPPDQTPESDQKSTSDEGYDSVTSSSVAHQTTETLLTDSLAKAVSQIEAATTDLPIRPLIPPTTSKPMTLIVDDNAVNLRILEMYCKKRGLPYLSAIDGHQAVELFKKQQTSAPIDLILMDLQMPVCDGISATRQIRAMETSSKAVLFIVTGQDSLMDREAASKAGADNYLVKPVGIRMLDSSLKRYFPDLVTS

SEQ ID NO: 32328 - protein, 259 aa, Anaplasma marginale str. St. Maries
MVSMVIVPGSTATALAASLSSVTGFPVVTPCISRFADGEINVEFPSGAAEAPYKNVVLLQSLCKPANDSLMELLLLADVVRRTCAPDRVTAVVPYMCYSRQDRVTSRVAGEYGAVTSALSSKVVAKLLGASGIDHLITVDLHSSQAAGFFEMPLTNLPVAGLFIEEIGDSHILDKLAVVAPDCGSLPRVRGFVRALSEGRKVNSVQVAVIDKYRESPGVSEVVHVIGSVKDRHCVILDDIVDSGGTLCNAAAALKRGGP

SEQ ID NO: 32329 - protein, 174 aa, Photobacterium profundum SS9
MIRNSIKSISDYPKPGILFRDVTSLMEDPEAYRATMQVLIERYSNTGITKVIGTEARGFLFGAPLALELGVGFVPVRKPGKLPREVISESYELEYGKDILEIHVDAIVEGDKVLLVDDLLATGGTIEATTKLARRLGGVVEDAAFVINLPDIGGAERLKGIGLNVFSICDFDGH

SEQ ID NO: 32330 - protein, 217 aa, Methanocaldococcus jannaschii DSM 2661
MRFNIDEWEPKTTIGRMVKEGQITDIDYILDNNLPILEPEIVDALLPDLEEKVLDVKLVQRMHKSGRRARFRATVVVGNRNGYVGVGKGKAKEVGPAIRKAIAQAKKNIIRVKRGCGSWECGCGTPHSIPYKGYGKCGSTAIEILPAPKGVGLVAGDVAKAVLGLAGIKDVWTKTFGETRTTYNFAMATFEALKSLNFTRTMEKHKEKLGIVEGRVL

SEQ ID NO: 32331 - protein, 112 aa, Physcomitrella patens subsp. patens
AAAPGQGGGVMDRPTIDKPTPGRESEFDLKKKKKMSPPYRVMLHNDNFNKREYVVQVLLKAIPGMTVDIAVNVMNEAHINGIAVVIVCPQEDAEDYCMQLRTNGLLSSIEPD

SEQ ID NO: 32332 - protein, 691 aa, Clostridium perfringens SM101
MIGKILGNRYELLQCVGEGGMSFVYKAKCRKLNRFVAVKILKDEFKNNEEIVRRFKKEATAIANLSNPNVVNVLDVGTQDDINYIVMEYIEGKTLKDIINEKGALPYEIAISIGIKVAKALECAHKSGIIHRDVKPQNILVTEEGVVKVTDFGIAKSMDSSTIAHTNSVMGSAHYFSPEQAKGTYTDYRTDLYSLGIVLYEMVTGVVPFNGDSPVTVAVKHIQEKAIPPKNINQNIPNSLNDLIMKAMEKDPVNRYQTAKEIIGDLEKIKKDPNVTISSKSAEDEDQFTRVMSPVVVPNTETNNLEPDEDDEDDEYYEDDEDEDEEENNIQTKPQKAINKKKKKSPILIIITTILVVALGITLGFLGMKNFMEGGKDVKIPNVVGEKVEDAKSKLEGLGLKVLEVTEESDQEKGIVLKVDPNVDSTVKTGSEVKLTVSGGEGKIKVPNFAEMNLDSVKKTLKNLGLELGNVDEEYSDSVPRGEVISQSPNANESVDKGSKVNVTISKGKEIKSETINIPDVSGKSVEEAKSILSNAGVGVNPVKGEAAKSEGEAGKVYSQSQSGSLTIKQGEKVTITINYHGDYVKPEKSVPGVTGKSVDEAKSELTNAGFKVNAVKGEAAKSADQAGKVYSQDGGSSAKEGATITITYYDKYVEPNQKPDGNNDGTGTGNEQGGQPSNNQHPNNDTNKKS

SEQ ID NO: 32333 - protein, 205 aa, Zea mays
MGEEASCDAVSLTEAGTNAKPVGKEVGREPAAAPAAAADPRLQGISDAIRVVPHFPKQGIMFNDITTLLLRPRVFKDAVDLFVERYRGMGIDAVAGIEARGFVFGPAIALAIGAKFIPLRKPRKLPGEVISEKYVLEYGTDCLEMRVGAIERSGERVLVIDDLVATGGTLCAAIRLLERAGADVVECACVIGLPKFKVPRCWIHN

SEQ ID NO: 32334 - protein, 497 aa, Zea mays
MFSHGADSAHDAGTVGVSSGVGATVPARFVWPYGGKRVFVSGSFTRWSEHLPMSPVEGCPTVFQAICSLSPGIHEYKFYVDGEWRHDERQPTISGEFGIVNTLYLTREFNQINALLNPSTPGSRMNMDVDNENFQHTVTLSDGTIPEGTVRVSEAAIQISRCRVSEYLNLHTCYDLLPDSGKVIALDINLPVKQSFHILHEQGIPVAPLWDSFRGQFVGLLSPLDFILILRELETHGSNLTEDQLETHTISAWKEAKRQTCGRNDGQWRAHQHLVHATPYESLRDIAVKLLLNDISTVPVIYSSSSDGSFPQLLHLASLSGILKCIFRYFKNSTGNLPILNQPVCSIPLGSWVPKIGDPNSRPLAMLRPNASLSSALNMLVQAGVSSIPIVDENDSLLDTYSRSDITALAKAKVYTHVRLDEMAIHQALQLGQDANTPFGFFNGQRCQMCLRSDPLLKVMERLANPGVRRVFIVEAGSKRVEGIISLSDIFKFLLSL

SEQ ID NO: 32335 - protein, 563 aa, Synechococcus sp. WH 7803
MRLASLAPGLVALRGYRPSQDLFRDVFAGLSVAAVALPVSIAYAELAGLPPVTGLYASILPLLAYALFGTSRQLMVNPDAATCAMLAAAVTPLAGGDPGLYAAMVMVLTLFTGLFCILASLFRLGVLADFLSRPILIGFLNGISFSIVLGQIGKLLGFSVHSGGIIPRLLEIIQKLPQTHTPTLLLGLFSFAVLLLSQRLLPRIPAALLVLVLGALAVWLLDLTSINVAVLAPVQAGLPPLKLPSAPLSALPSLAGSSAGVALVLFTSGTITCRSFASRGGYRIDVDRELVAYGVANMASALSGGFAVTGADSRTAMAVTSGGRSQVTGLVAAAALASILLWFTAPMQFVPLAALGAVLMLAAYSLFDLASLKRLWTLDRKEFALSLITSLGVVTLGAINGILIAVALAVIRFVKHTARPRVELLGRVKGLQGFHSLQTHPDGKAVPGLMLFRFNAPLVFFNADHFLEQSRRAVAEATPKPQWFVVDAIPMDRIDISGVNALQQLNQFLESEGIRLVLAGRRSEFIQGLKAMGMDSPTLEQKLFPTLHQAVRAFRMTPGQPGM

SEQ ID NO: 32336 - protein, 966 aa, Oryza sativa
MASIGLSVPPGFTVSTEACQQYQAAGKTLPAGLWEEIVEGLQWVEEYMAARLGDPARPLLLSVRSGAAVSMPGMMDTVLNLGLNDEVAAGLAAKSGDRFAYDSYRRFLDMFGNVRTVHHTGLGGLHNFCPLLGVRNRSVGHLAPDRTGPVAGVEVVRTPLRPEPSTTSLLLPIPAMVRLITSAAAAAAAAATAARRRAPCGPRLSPSWMLDLYQLRLPWPRFAEGNFAFIQPKNWLQVMDIPHALFEEKLEAMKAVKGLHNDTDLTATDLKELVAQYKDVYVEAKGEPFPSDPKKQLQLAVLAVFNSWDSPRAIKYRSINKITGLKGTAVNVQTMVFGNMGNTSGTGVLFTRNPSTGEKKLYGEFLVNAQGEDVVAGIRTPEDLDAMRDHMPEPYEELVENCKILESHYKEMMDIEFTVQENRLWMLQCRTGKRTGKGAVKIAVDMVNEGLVERRTALKMVEPGHLDQLLHPQFENPSGYKDKVIATGLPASPGAAVGQIVFTAEDAEAWHAQGKDVILVRTETSPEDVGGMHAAVGILTARGGMTSHAAVVARGWGKCCVSGCSSVRVNDASKIVVIEDKALHEGEWLSLNGSTGEVIIGKQPLCPPALSGDLETFMSWVDEVRKLKVMANADTPEDATTARQNGAEGIGLCRTEHMFFASDERIKAVRQMIMASSLELRQKALDRLLPYQRSDFEGIFRAMDGLPVTIRLLDPPLHEFLPEGHVEDMVRELCSETGAAQDDVLARVEKLSEVNPMLGFRGCRLGISYPELTEMQARAIFEAAITMTNQGIQVFPEIMVPLVGTPQELGHQVDVIRQIANKVFTDMGKTIGYKVGTMIEIPRAALVADEIAEQAEFFSFGTNDLTQMTFGYSRDDVGKFLPIYLSQGILQHDPFEVLDQRGVGELVKLATERGRKARPNLKVGICGEHGGEPLSVAFFAKAGLDYVSCSPFRVPIARLAAAQVLL

SEQ ID NO: 32337 - protein, 357 aa, Pyrus communis
MVSSDSVNSRVETLAGSGISTIPKEYIRPKDELVNIGDIFEQEKNNEGPQVPTIDLKEIESDNEKVRAKCREELKKAAVDWGVMHLVNHGISDELMDKVRKAGKAFFDLPIEQKEKYANDQASGKIQGYGSKLANNASGQLEWEDYFFHCVYPEDKRDLSIWPQTPADYIEATAEYAKQLRELATKVLKVLSLGLGLDEGRLEKEVGGLEELLLQMKINYYPKCPQPELALGVEAHTDVSALTFILHNMVPGLQLFYEGKWVTAECVPNSIVMHIGDTLEILSNGKYKSILHRGMVNKEKVRISWAVFCEPPKEKIILKPLPETVSEDEPAMFPPRTFAEHIQHKLFRKSQEALLPK

SEQ ID NO: 32338 - protein, 376 aa, Bacillus anthracis str. Ames
MAQKQKCVAMLLAGGKGSRLSALTKNLAKPAVPFGGKYRIIDFTLSNCANSGIETVGILTQYQPLELHNYIGIGNAWDLDRVSGGVTVLPPYAESSGVKWYTGTASAIYQNLNYLSQYEPEYVLILSGDHIYKMDYSKMLDYHIEKEADVSISVIEVPWDEASRFGIMNTNEEMEIVEFEEKPQFPRSNLASMGIYIFNWAILKEYLEMDARNPESSNDFGKDVLPLLLDEGKKLMAYPFEGYWKDVGTVKSLWEANMDLLRDETSLNLNDRDWRIYSVNPNEPPQYIAEKAKVEESLINEGCVIEGDVKHSVLFQGVTVEEGSMVIDSVVMPGAKIGKNVVIERAIVGSEMVIEDGTIIRPEKNVDDVVLIAEGK

SEQ ID NO: 32339 - protein, 1103 aa, Gibberella moniliformis
SGIRYSPWLHRYDELLRATCRPLSEISAAGPEKSPDSVLTSLAQLAACQTNTERSFVSLFDEKRQYIVAEATPSTSLLNSSSLHTSDDDLLLCGTYIPRAEGACHYALRATEEVLDASSSQELPVIIVQDLAADPRFAASPNCRPGSFARFYASVPIRSPRGINIGVLCVMKSTPGGDWEDRHSNVMRGLSQTIMDHLEGNRIKHSLKRSTAMSLGLQRFTERGLNSPMQRTHVGPELHASETPAPQDDKNISSTQSAPLENSSRYQREDRPSSNSFLIAATIIKEALPADNCAFFSGDSRDLHLVHSPETETHYDFSLDASCLSPGAYSAASIYDTPTATKFQPSCQLLGSSHSPGSNDTKDTNNISQVFLSHMLQQYPEGCIFDFDTQGSFTHDMNRFASASGEQPLPSSIFSRNEQHSYEQQELQRAFNGARYVAFIPIWDPLKGLVSIGGFAWSKAPRCESDRDSELPFFRALGILAASEAFQIETLAADKAKSDVLGSISHELRSPLHGITLGLELLNESGLGAAQQNIAHLIGTCCRTLLDTTEHLLDFTKVNQLVGSDTIKDCRSESSTISTAPSNREQIMNKAVRLDQIAEDVVESVYAGHSYQHASIAHIFNSSNSRTSADVSAIRRMDSIEAAEAKAFNQRNRSKDGVVSVFLLYDPTLSWSFQTTAGAIRRIIMNLFGNSLKYTSQGFIKVTMAQSQPEDAMGGERVIELVVEDTGRGISEDFLRNNIFKPFSQEDQLSSGTGLGLSFVQRMTYQLGGTISISSQVDVGTKVTVSIPMLQGTSSPASEFAVYTQSPCHGLRARLTDLPPGPGAALQHESMACQALMNELCFEHLGMVSDASPEVERLAPDIVVVQDTSTRNISELAQSWPDAPVLVVCNNALVVQRYESAHVSTGHSRLCDYIAQPLTPNKLGRAISSAITLWAEMEDNPRSTGTIPLPTPADTVSCSQPPTPAIESPLGGLVPAQDYFQTPQFLLVEDNPINLKMLTHFMRKLQKPYRTAVNGQEAVNAFKETPGQFKCVLMDISMPVMDGLEATRQIRAFERYSGIAASKILAITGLGSESTREEATRSGVDVFITKPIKLRELAVIINS

SEQ ID NO: 32340 - protein, 287 aa, Roseovarius nubinhibens ISM
MQERLAEVAAGVAAHLDHVLAPFGTGELAQAMRYATEGGKRLRAYLVIEGARLHGVPAEQAIWPATAIEALHAYSLVHDDMPCMDDDDLRRGRPTVHRKWDEATAVLVGDALQSLAFECVADPRAGSGEVRAELCLGLARAAGGQGMVLGQALDIAAETAGTPLSLDEITTLQAGKTGALIIWSGIAGAVMAGADPAPLTRYAQAVGLAFQIADDILDVEGCAEETGKAVGKDAAAGKATFVSHLGLAGAKSRASALIDEAIAALDIYGEDGDDLRALARFVIARSS

SEQ ID NO: 32341 - protein, 1241 aa, Gibberella moniliformis
MTGSKVSESTREREIFKYDSVFVANSIRNDVANLIPSSSLRPCSDPAMTALAQVALLRLGASRAMISLFDCQHQHIIAEATPALRISAHANPPSSGSDSLWLCGTAIPRSYGICDRVLVSRESGGPQQPSSASELPVTVVSNLAENEEYRDTWYYKVRPEHRFYAGVPIRTRRGINIGVFCILDNEPRESLDEASQQVMRDVSASILGQMELTRSGNGRRPGERMVRGLGSYVEGKTTVTGWENSSTNIFNADASTEEGSLNQTQQKIQKQRDSVTATAEMDSISTPDIFVLESPSQNRPTSPFHSTDKPPISVPTGEESRSNQLSQIFSKAANILRESIEVEGVLFLDAGVGSFAGRIRSGSLRRNSRTHVRSSSSSSSSSSPGRGNISVSSPRNSADYPSSGAMCPVLGFSTSVSSSINGEAPSGRSRTIPERQLQRLLRRYPKGKIFNFDGDGMVGSSDPTSEDSAMAAFQAKKARSIQQEQRGDKQKSRKVNDPYSRRNEGMAIRDVFPGARSVAFVPLWDSHRERWFSGCFVYTMTPTRIFTVQGELSYLAAFSAVIMADVAMMESSIVSLATTSLLSSLSHELRSPLHGIVLCAELLRDTALDVFQGDVLRSLEVCGRTLLDTINHLLDWTRINNFVKAPSGQSPNSGVAFVRGAQSNSRSRPTDGMMHIASNLDLDMLVEEVVECIHAGHTYQQQSLALVQDDKPNEELNRDPLTRLDGMDVADSVKAGENISNGAGPDAVLVMLDIDPTVDWAFHVESGALRRIIMNLCGNALKYTTRGYVKVSAYQDPPGQSRLKARVVHIDITDTGAGIGQDYLNHRLFAPFAQENIHSSGAGLGLSLVRKFVRALGGSIHVQSKVGTGTRIAVKLPLEAVSVDSTETMSDREEFQAQAIELSGLRVCINGFTPFVGGGSESQRWNSREFDERALLEKVCRNWLRMQVVDPLHNAEYLPDLILCDESQLEMIANQPRDELSSPVVVVCRSAAVARSLDRSHRSQHKLNWGLFSFISRPVGPRKLGKAFVLCFRRWMKLQATAADRASVSTRLDEPPTVSTGETDLVQRGSDDKERGYFDIAPTIAPKKRRAHWDYDDAETPLPSVPALQLPPTPQDQRFLLVEDNAINMKILQTYMKKLGVAYDSASDGLRALECYKAQEGCYRCILMDISMPVMDGFEATRQIRGFEKASDLPRRHIVAISGLASKDAQEDAFANGLDLFLSKPVQLKELSRILKSRGLI

SEQ ID NO: 32342 - protein, 621 aa, Roseovarius nubinhibens ISM
MSDAELRQLADELRAETISAVSQTGGHLGAGLGVVELTVALHAVFDAPRDKIIWDVSHQCYPHKILTGRRDRMRTLRQKDGLSGFTKRSESPYDPFGAAHSSTSISAALGFAVARDLGGASETGHGDAIAVIGDGAMSAGMAFEAMNNAGHLKKRMIVILNDNEMSIAPPVGALSSYLSRLYAEAPFQELKAAAKGAVSLLPGPFQEGAKRARDMLKGLAVGGTLFEELGFSYLGPIDGHDMDQLLPVLRTVQDRATGPILIHVLTKKGKGYGPAEAARDGGHATAKFDVVTGKQKKSPSNAPSYTAVFSDAILAHAAEDQRICAVTAAMPDGTGLKLFEERYPSRCFDVGIAEQHAVTFAAGLAAGGLRPFCALYSTFLQRGYDQVVHDVAIQRLPVRFAIDRAGLVGADGATHAGSYDVAFLANLPGMVVMAAADEAELVHMVATAAAHDEGPIAFRYPRGEGVGVEMPDRGVPLEIGKGRIIQEGKGVAILSFGTRLGEVRRAAEALGARGITPTIADARFAKPLDRDMILDLAARHEALITIEEGAVGGFGSHVAQLLSEEGVFDHGLKFRQMVLPDIFIDQASPEDMYRVAGLSAEDIEAKVLELLGVARISDQRA

SEQ ID NO: 32343 - protein, 753 aa, Photobacterium profundum SS9
MSYQVLARKWRPYQFSDVVGQSHVLTALSNALTHNRLHHAYLFSGTRGVGKTTIARIFAKGLNCEQGITATPCGQCGTCKEIDEGRFVDLLEIDAASRTKVEDTRELLDNVQYKPARGRFKVYLIDEVHMLSRHSFNALLKTLEEPPEYVKFILATTDPQKLPVTILSRCLQFHLKHLDNDQIQSQLSNVLTQENVDFEPKALSLLSRAAEGSMRDALSLTDQAIALGNGQVHADSVSMMLGTLNTDQALFLLEAVSGGQANTAMGGLEELASVGVEWDSLLRELAAQLHRVAMHQALPAALDMSAPDADRIITLSSVMTPQDVQLCYQIALQGRQDLAFAPDGRIGLEMVLLRMLAFRPVSGSGITPQSINVPASEPAAPQQGMQRVQALKAQMGSQPQAATSQVTIPQVVAPHAVAPQHSDQQLAASPSSIQESAGTVPAEQQYQQHQQVPTSQEAFRQEPSRQEPTPPPAQYQQQAPHSEQSAAPQNIPPAQPRSAASGLLAARNKLRSQSKRGNEEQPVKKGEPAPAKKVAMNVLDRIANKHAGMRVPTTGNTATNSAMPASMIATQANGTQANVPEKKDEYQWKPMQPVAPEEDTKLEVAPRKLKQALEHEKTPEMAKLLVNEAANQDSWSDLVTKLNVGRLVQQLALNSAFEQDNNQVTLYLRQSQSHLDNPKAREQLAQAIGELQSVDIDLKIELSGKGQTPLEWREGLYQQKLGQAKESLESDANVTFIRQRFAAVLDEDSIRPL

SEQ ID NO: 32344 - protein, 474 aa, Synechocystis sp. PCC 6803
MSQDFDYDLVIIGAGVGGHGAALHAVKCGLKTAIIEAKDMGGTCVNRGCIPSKALLAASGRVREMSDQDHLQQLGIQINGVTFTREAIAAHANDLVSKIQSDLTNSLTRLKVDTIRGWGKVSGPQEVTVIGDNETRILKAKEIMLCPGSVPFVPPGIEIDHKTVFTSDEAVKLETLPQWIAIIGSGYIGLEFSDVYTALGCEVTMIEALPDLMPGFDPEIAKIAERVLIKSRDIETYTGVFATKIKAGSPVEIELTDAKTKEVIDTLEVDACLVATGRIPATKNLGLETVGVETDRRGFIEVNDQMQVIKDGKPVPHLWAVGDATGKMMLAHAASGQGVVAVENICGRKTEVDYRAIPAAAFTHPEISYVGLTEAQAKELGEKEGFVVSTAKTYFKGNSKALAEKETDGIAKVVYRQDTGELLGAHIIGIHASDLIQEAAQAIADRKSVRELAFHVHAHPTLSEVLDEAYKRAV

SEQ ID NO: 32345 - protein, 475 aa, Vitis vinifera
  misc_feature (252)..(252): Xaa can be any naturally occurring amino acid
  misc_feature (263)..(263): Xaa can be any naturally occurring amino acid
  misc_feature (283)..(283): Xaa can be any naturally occurring amino acid
  misc_feature (319)..(319): Xaa can be any naturally occurring amino acid
MGTASFDEETVKKVIRQVEFYFSDSNLPRDNFLKKTISESEDGLVSLALICSFSRMRSHLNLGDVKPEDVSEDTLKAVAEILRNSTTLKVSEDGKKIGRATELLKPEEVVEQVNIRTIAASPLEYDAKLEDVEAYFGQFAKVNSVRLPRHVAEKRVFCGTALIEYSTEEDAAKVLQQSLVYAGVELELKPKKDFDAERAQQTEEFENSRALLGSNRKNNSNAESTYPKGLIVSFTLKRAGGSTEHNGTHEPXNDNADVGKTNXDIDSKENVTGETEDKASENXNNDEENSGEDIEKESEEKVEEKTSLESEGKETEDGXKSSEGCDLKGEEKATGEQKPTAATYKDNMDVVMREDLKSVFQKFGTVKFVDFKIGEESGYIRYDEPEAAQKARAAAVLSEEGGLTVKNYIANLEPVTGEAEREYWSLLRGNQEKHRGFKGNRGRGGKQNRGGKFGRPRDNDYATGRPNKTQKVGAA

SEQ ID NO: 32346 - protein, 498 aa, Synechococcus sp. WH 7803
MAGRFSQQNQRVRPSSKEDQVVLKAREHFERTLIPVRGHLAGSVAALEHPRHDEALNYGEIFLRDNVPVMVYLLTQKRFDVVKQFLSLCLDLQSTTYQTRGVFPTSFVEENGQLIADYGQRSIGRITSVDASLWWPVLCWMYVKSSGDEDFASSQAVQRGVQLLLDLVLHPTFEGTPVLFVPDCAFMIDRPMDVWGAPLEVEVLLYGSLRCCAQLMELGRKHQSSRLLDQRLVLTRQWVHDLRQFLLKHYWVTSKTMQVLRRRPTEQYGDNQHQNEFNVQPQVIPDWLQDWLENRGGYLIGNMRTGRPDFRFYSLGNSLGCLFGLLTAPQQRALFRLTLHNRDHLMAEMPMRICHPPMESLEWQNKTGSDPKNWPWSYHNGGHWPSLLWFFGSSILLHERRHPHADVLLMGQMKALLEECYWSHLNQLPRQQWAEYFDGPTGTWVGQQSRTYQTWTIVGFLLLHHFLRVNPDDVLLLDLDEGAVPDPDSHESQTSHNP

SEQ ID NO: 32347 - protein, 785 aa, Gibberella moniliformis
MGATDIASRLRAKFTKRRHSTAGSQASSSRSITDTTSSSFGSRHLWDRDRSRARDGDGDHSSQRAVSNSRGTVSSRHGMTATPDGSHRQREDGDDVAKPEGCREVSEAPKSSSNSNSNSNSESTAKSSSEIGAEAAVPPANDNSTAPDTTSEPLKQPSPPIDQQSLDDLDEEPDTTATSSSDQLPPHSDLHPPQPHPRLHFNQPPLLSPSLHPPEQPSPSRLRQASSNLDRIHEDSQDLEPPSPTARPRKVASLELDAGSELAGHNDDDVLSLDQAPNSPKSAAFVPLAAATSTTFVAPSPGLPTAGTPGSPSRPAPPPRRQSLLSNRQTTLINTLLSPPVNEPGYSQNTTYAPINGNMVTRKIWVKRPHASPTLVTVNEDDLVDDVRDMILRKYSNSLGRSFDSPDGYFPSVAAHPGAVGSPHLPVAVPAHVNPQAPHSIAVLGTGHIPPIPSPGRSRAYRDRPDRPRLGRTHTSSPTLLANGSAVSLAAAAAANHANHGTQHFNPRLPHSRTHSNSSDQPGMPPAAPPLPTPPAPEPSAVRVSTPPVRPTSPRPTAKTKKSKKAEHPSLPPGMLNGGVPPINVLIVEDNPINLKLLEAFVKRLKVRWSTAMNGRDAVKKWRTGGFHLVLMDIQLPVMNGLEATREIRRLERVNSIGVFSSSPDGVVTTENPDELDDKDRLQNPSLFKSPVIIVALTASSLQSDRHEALAAGCNDFLTKPVNFVWLERKVMEWGCMQALIDFDGWRKWKEISQEAEESAAAKKAAVAAAKAKSKKNRLSMTKPG

SEQ ID NO: 32348 - protein, 361 aa, Nicotiana tabacum
MKALILVGGFGTRLRPLTLSVPKPLVEFANKPMILHQIEALKAVGVTEVVLAINYQPEEMLNFLKEFEANLGIKITCSQETEPLGTAGPLALARDKLIDDSGEPFFVLNSDVISEYPFKEMIAFHKSHGGEASLMVTKVDEPSKYGVVVMEESTGQVERFVEKPKLFVGNKINAGFYLLNPSVLDRIQLRPTSIEKEVFPKIAAEEKLYAMVLPGFWMDIGQPRDYIPGLRLYLDSLKKNSSPKLASGSHIVGNVIVDESAKIGEGCLIGPDVAIGSGCVIESGVRLSRCTVMRGVRIKKHACISSSIIGWHSTVGQWARVENMTILGEDVHVCDEIYSNGGVVLPHKEIKSSILKPEIVM

SEQ ID NO: 32349 - protein, 1207 aa, Arabidopsis thaliana
MKCFLFSGGDKRGEQKTPISVSLTSIFSDREINRSGSEFNSRDVSGTSTESSMGRKNSYPPVSTRASNLREFSITDLKSATKNFSRSVMIGEGGFGCVFRGTVRNLEDSSVKIEVAVKQLGKRGLQGHKEWVTEVNFLGIVEHTNLVKLLGYCAEDDERGIQRLLVYEYMPNRSVEFHLSPRSLTVLTWDLRLRIAQDAARGLTYLHEEMEFQIIFRDFKSSNILLDEDWKAKLSDFGLARLGPSEGLTHVSTDVVGTMGYAAPEYIQTGRLTSKSDVWGYGVFLYELITGRRPVDRNRPKGEQKLLEWVRPYLSDTRKFKLILDPRLEGKYPIKSVQKLAVVANRCLVRNSKARPKMSEVLEMVNKIVEASSGNGSPQLVPLNSVKASRDARGKNNGGGGEGGWFGKKSKKDFSTAILERKKSPNRLVVDEAINDDNSVVSLHPATMEKLQLFRGDTILIKGKKRKDTVCIALADETCEEPKIRMNKVVRSNLRVRLGDVISVHQCPDVKYGKRVHILPVDDTVEGVTGNLFDAYLKPYFLEAYRPVRKGDLFLVRGGMRSVEFKVIETDPAEYCVVAPDTEIFCEGEPVKREDEERLDDVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEIGRLEVLRIHTKNMKLAEDVDLERISKDTHGYVGADLAALCTEAALQCIREKMDVIDLEDDSIDAEILNSMAVTNEHFHTALGNSNPSALRETVVEVPNVSWNDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGGGSGGDGGGAADRVLNQLLTEMDGMNAKKTVFIIGATNRPDIIDSALLRPGRLDQLIYIPLPDEDSRLNIFKAALRKSPIAKDVDIGALAKYTQGFSGADITEICQRACKYAIRENIEKDIEKEKRRSENPEAMEEDGVDEVSEIKAAHFEESMKYARRSVSDADIRKYQAFAQTLQQSRGFGSEFRFENSAGSGATTGVADPFATSAAAAGDDDDLYN

SEQ ID NO: 32350 - protein, 616 aa, Zea mays
MASISGAAAPPSSAVCRLRLRRHLLLRPSHLRLRAPHSIADLSRSSNSAPNPARPALGSGPENGSGGVRAVEKDPIKLWERYVEWLYQHKELGIFVDVSRMGFTEEFLRQMEPRMQQAFVDMRELEKGAIANPDEGRMVGHYWLRDPALAPNSFLRNKIETALDKILAFSQDVISGKILSPSGRFTSILSIGIGGSALGPQFVAEALAPDNPPLKIRFIDNTDPAGIDHQIAQLGPELATTLVIVISKSGGTPETRNGLLEVQKAFRDAGLQFSKQGVAITQENSLLDNTARIEGWLARFPMFDWVGGRTSEMSAVGLLPAALQGIDIKEMLVGAALMDEETRNTVVKANPAALLALCWYWASEGIGKKDMVVLPYKDSLLLLSRYLQQLVMESLGKEFDLDGNRVNQGLTVYGNKGSTDQHAYIQQLREGVHNFFVTFIEVLRDRPAGHDWELEPGVTCGDYLFGMLQGTRSALYANDRESISVTVQEVTPRAVGALIALYERAVGIYASLVNINAYHQPGVEAGKKAAGEVLALQKRVLTVLKEAICENPTEPLTLDEIADRCHCPEDIEMIYKIIQHMAANDRALIAEGSCGSPRSVKVYLGECSVDEDMQAA

SEQ ID NO: 32351 - protein, 346 aa, Triticum aestivum
TQKPKHHHQHNTNRHPTTTPHTKTTPPTHTPNPPTPPGGPLLRHCHGGRKEEDDQGSKIRDSPEGASDCGRTDGGSLRMVLVSTAVAVCGSFEFGTCVGYSAPTQSGIVEEVGLSISEFAIFGSVLTIGAMVGAVTSGRLADFLGRKMTMRISATICIFGWLSIHLAKSAIMLYFGRTLLGFSTGVLSYVVPVFIAEIAPKNLRGGLATSNQLLICSGSSATYIIGALVAWRNLVLVGLVPCVLLLAGLFFIPESPRWLANVGREKEFPASLQKLRGEDADVSEEAIEIKEYIESLYSPSKARLRDLFLSKIYMQSFWGVGLKVFQQLGRDKMGLAFYASFIFHFC

SEQ ID NO: 32352 - protein, 228 aa, Sinorhizobium meliloti 1021
MNEKTIIAPSVLSADFSRLGEEVEAVCRAGADWIHLDVMDGHFVPNITFGPPVIKALRDRTDKVFDCHLMIEPPTPYLGAFACAGCDIITVHAEATTHLDRSLQAIRDVGCKAGVSLNPSTPESVIEYVLDRLDLVLLMTVNPGFGGQDFIPAVVDKVRRVRSMIGGRPIHIEIDGGVTPETAPLVAAAGADVLVAGSAVFKGGSEEHYARNIAAIRAASDGAIRKAA

SEQ ID NO: 32353 - protein, 431 aa, Clostridium perfringens SM101
MERVFANELINFLYESPTAFHAVKNVKDTLEFEGFKELKEADRWNLEVEGKYFVTKNDSALIAFRVGKGDIAENGFKIIGAHTDSPGFRIKPNPEITVENTYVKLNTEVYGGPILNTWFDRPLALAGRVSLVSKNPLKPVNKIVNINRPILIIPNLAIHMNREVNEGYKINRQKDTLPLLSLVNETLEKGNYLVELLAKELYCEKEDILDFELYPYEYEKGCLMGLNEEFISSGRLDDLSMVHAGIKALMDAEVSQATNVMVCFDNEEVGSATKQGGDSDFLKTILERIVLALGKDREDFLRSLSESFMISADLAHAVHPNLGEKHDPVVRPVLGKGPVIKIAASQSYTSDSDSSAVYEMICRNAGVNVQKFVNRSDMRGGSTIGPISSTHLPIRSVDMGTPILAMHSIREFGAVKDHFDCIKSFTEFFRI

SEQ ID NO: 32354 - protein, 593 aa, Kluyveromyces lactis
MYGNQQNNSNPYQMSYYRMNNGQGQGTNRWPQQLSHQEMLAGHSQQILNTNKPAGNQSKPPIVMASNNVFSIGPYRQRKDSSRISVLQKYEIIGYIAAGTYGKVYKAKARDYQNGMNRDNVIILDSPDSVSADSNLDINSINRSTRQQEANDNLTTMDFRKPSHKRFTPPNNSNSTQIRSNSGSETNVRINSSSITNNSRKPSQIQFYAIKKFKTEREGVEHYTGISQSACREMSLCRELDNNHLTKLVEIFLEKKSIYMVSEFAEHDLLQIIHFHSHPEKRLIPPRMLKSIMWQILDGVSYLHQNWILHRDLKPANIMVTVDGCVKIGDLGLARKFNNMVQTLYTGDKVIVTIWYRAPELILGARHYTPAIDLWAVGCIFAELIGLRPIFKGEEAKMESKKSVLFQANQFQKILEVMGSPDHKIWPNIDSYPEYLQLAKMPKYRDNLTAWYQTAGGKDKTALDILYRLLQYDPIKRIDAIDALDHVYFTNGDPPVCENVFEGLNYKYPPRRIHTNDNDITNVGNDNNQANHSQKQPMHGNNNNKNGNMNGLGVNKRILAAAAAAAAAAAVSGNGNNPTSNTATGGSARKKRK

SEQ ID NO: 32355 - protein, 396 aa, Bacillus anthracis str. Ames
MKQFELSRAAESLQPSGIRKFFDLAANMKGVISLGVGEPDFVTPWNVRQACIRSIEQGYTSYTANAGLLELRQEIAKYLKKQFAVSYDPNDEIIVTVGASQALDVAMRAIINPDDEVLIIEPSFVSYAPLVTLAGGVPVPVATTLENEFKVQPEQIEAAITAKTKAILLCSPNNPTGAMLNKSELEEIAVIVEKYNLIVLSDEIYAELVYDEAYTSFASIKNMREHTILISGFSKGFAMTGWRLGMIAAPVYFSELMLKIHQYSMMCAPTMSQFAALEALRAGNDEVIRMRDSYKKRRNFMTTSFNEMGLTCHVPGGAFYVFPSISSTGLSSAEFAEQLLLEEKVAVVPGSVFGESGEGFIRCSYATSLEQLMEAMKRMERFVENKKRTKHNTFCP

SEQ ID NO: 32356 - protein, 417 aa, Pichia minuta
MSLSSKLSVKDLDVSGKRVFIRVDFNVPLDGDKITNNQRIVAALPTIQYVLENKPKVVVLASHLGRPNGEKNLKYTLKPVAKELETLLGQKVTFLDDCVGSEVESTVNSAPAGSVILLENLRFHIEEEGSKKTSEGKVKASKEDVEKFRKQLTALADVYVNDAFGTAHRAHSSMVGFELEDRAAGFLMAKELEYFSKALENPVRPFLAILGGAKVSDKIQLIDNLLDKVDLLIVGGGMAFTFNKVLNDMKIGKSLFDETGAEIVPKLVEKAKKNGVKIVLPVDFVTADAFSPDAKVGYATLEEGIADDLQGLDGGEKTRKLFADTIAQAKTIVWNGPPGVFEFESFASGTKSMLQACVESAQAGNTVIIGGGDTATVAKKFGGADKLSHVSTGGGASLELLEGKELPGVAALKSKTA

SEQ ID NO: 32357 - protein, 175 aa, Roseovarius nubinhibens ISM
MTLYTLDGVAPQTPEDGDFWVAPDANVIGKVALESATSVWFGATLRGDNELIRVGAGSNIQENAVLHTDMGYPLVIGAGCTIGHKAMLHGCVIGDNSLIGMGATVLNGAKIGRNCLIGAGALITEGKEIPDGSLVMGAPGKVVRALDAAAVDRLKLSALGYQKNMRRFRDGLERI

SEQ ID NO: 32358 - protein, 331 aa, Glycine max
MALNNGVPATGTGLIVSFGEMLIDFVPTVSGVSLAEAPGFLKAPGGAPANVAIAVSRLGGKAAFVGKLGDDEFGHMLAGILKENGVRADGINFDQGARTALAFVTLRADGEREFMFYRNPSADMLLKPEELNLELIRSAKVFHYGSISLIVEPCRSAHLKAMEVAKESGCLLSYDPNLRLPLWPSAEEARKQILSIWEKADLIKVSDAELEFLTGSDKIDDESALSLWHPNLKLLLVTLGEHGSRYYTKSFKGSVDAFHVNTVDTTGAGDSFVGALLAKIVDDQSILEDEPRLREVLKFANACGAITTTQKGAIPALPKEEAALKLIKGGS

SEQ ID NO: 32359 - protein, 479 aa, Prochlorococcus marinus str. MIT 9312
MAERFSQKNLRVRPSSEEEKIVTNAKKHFEKTLVEIAGELVGSVAALEHPTKNKKLNYGEIFLRDNVPVMIYLITQKRYEIVKRFLSVCLQLQSTNYQTRGVFPTSFVEENGKLIGDYGQRSIGRITSADASLWWPILCWYYVNKSGDYAFGKSQGVQRGIQLLLDLVLHPTFEGTPVLFVPDCAFMIDRPMDVWGAPLEVEVLLHGCLKSCINLMELSRADHVSRLLDQRLILTNQWVKDLGSFLLKHYWVTSQTMQILRRRPTEQYGDDQHFNEFNVQPQVVPSWLQDWLENRGGYLIGNIRTGRPDFRFYSLGNSLACMFGILPPAEQRALFRLVLHNRQHLMAQMPMRICHPHMDVEEWQNKTGSDPKNWPWSYHNGGHWPSLLWFFGAAVLLHQKNYDSDDVILMEEMKSLIEESYWCQLNQLPKQEWAEYFDGPTGTWVGQQSRTYQTWTIVGFLLMNHFLREENNDLDMFKI

SEQ ID NO: 32360 - protein, 1916 aa, Gibberella moniliformis
MVSPSGAILAPPAVASLRAQQTTAMERSLSQDIREEREELREAAEQTLNTIVDLNLDGTIKWVSPSWTDVVGTQFETVSGLPISDLIVSDNKNVFTEVVESMKKDDSRSHRVRFAVNIGPLSKLLPIDDLENDPENEQSHAVDLEAQGIMVYDSVSGGESHTMWMIRPWIAPREIKIDLPNVIVDSLGSGAEVLASYLTQLAESGLDDPEQQEPPPPVLCRICERQIPRWWFEKHTDLCLQEHRAEMDVQMAQESLTEHRHSIVKVLDALEARKSRSLAGDQTPVPVAEYKGLPIGPPPSTQSSPGSSLPRSRERSGGLGHTRARSFAIRRPQARIVELLMDLCDTAIEISTPAIKESSTQQSGDFRTQSPQSESRISQVLQWQSPSTNTLEQEQGLALLCADTEKVARNKVDAVFRHRKIIEYAERIRIELACLVQDCIDEALRKAARIANGELTDSTEEERLNSEYEQCDTCDEGTGDDDIPPEPLVSEPQHLLQRGSESFTEPLSNPSVLATALRQMNLSENKDRSRPTSFVASTRSSSPKECPTPRSHFGGQSSLGVQARDTRRDSVYLEGDFLDSEGSFRSSSVASRNAPRTESPISEFGDLRRAASTRRRHRRSLILPGTSSPHRQESPSRPGQPSSPLRIKARGFPMSQEGVVSPEASPMLPGSDFSSPATHSHRHHRRQSSAAISDFVMKPPPSPRLGANQAPPQPRPTQPSIKDFEIIKPISKGAFGSVYLSKKKSTGEYFAIKVLKKADMVAKNQVGNVKAERAIMMWQGESDFVAKLYWTFSSKDYLYLVMEYLNGGDCASLIKVLGGLPEEWVKKYLGEVVLGVEHLHSRGIIHRDLKPDNLLIDQKGHLKLTDFGLSRLGLVGRQKRALNSENSDGTPDLLKQGPFARSASIASSRSASLDLHGHTHSPGQTPQMTPEVGSLAQPSYFSLGQETRRVSGTHRSDSGGSETLARMVTNFSLHDAEIASQSNSVRSPLDEEAVAQGSPDLPMSVSSRMSMDSHVRNSLPLSNMMPPPMALFNPEDTNRRFVGTPDYLAPETIKGDKQDETSDWWSVGCILFEFLYGIPPFHAGEAEEVFENILARKIQWPDENECEPISEEAKDLINKLLCMEPHQRLGSNRDDKFASGGEEIRHHPWFQDVNWETLLEDEAQFVPQPENPEDTEYFDARGAVLQSFAEEMEDQASPQSSAAGSEYAERPHDALSRVRSQVNSINRKLMPLHIPPHVRDLKSRRLSEPVAMDDFGSFSFKNLPVLEKANKDVIQKLRAEALATQSKGTSVSPGAPSNVISPGPSLEGSPVLSNPVSRTISNAKATNRAQSPSGFGHTSASPNRASQPSSPLLVSFVAGPGADGRRKASSNSSSLSHQSTAASLQPGSAFEIPKVPPSLQKAATTVAASSPVQSRSAAPPPLSLSPQKTISTPRQSSNSSAGRSRSLTVGSQSQDGSPVASDIMHHHRNRRSQVFDMSPSSSDNEGEKHNALLRVQRRRQSSRRLSQIAFDGGPTFRPLDVLICEDHPVSRMVMEKLLEKLRCRTISVPNGSEAVRYSMSEIKFDVIFLEYQLPQINGADVARMIRETKNANSHTPIVAITAYLKELQAPHYFDSLIEKPISSSKLTEVLRGLCQWRPESPGQSSSMPRPIPMGIRKANSRLEDSPTSGSSIFASRLGNAMMSSREDSITSSLFGDSESVTTDELPVVVSRKPTNEWDEGGLNITDNNDASDPLRKGVPSLVAQQSAPAQMEHRPRSNDKLRGRREGPEHRTLEGTESADDEDEELGSGREKHHGRNSQQILSKAGLPSSKLGIEMMRANSHDSLTVGSESTPEAVTQVVTTPSKEMETGVLDGEVVAEPTARTPPDAGLKAEGVTPNKEKDGTDSVDATPRPLTVVKGDDDGGNDGEATPRPTEK

SEQ ID NO: 32361 - protein, 316 aa, Oryza sativa Japonica Group
MTYIRDEDTRLETTRARLSNVLKRHEDLKERLSRDSDKLIFERLQREFEAARTAQTEEIPIDDEQWNDGLLATIREKVHMEADRKAMANQANVPADPQFQSRTTYRVKNKVIYCLDGARIGIQYETYFAGEPCEIYHCVLESKSFLEKMTVIEHTLPFFLPIREVESEFLSSNAIKFIDHLEEILQSYVDRREQVRLIKELYGNQIGELFHSLSYNLIEFVMEDFECKVTVSIRYSDLLFTLPSQARVLAWPLRSSRGISVTERRASRSASAQLVPFRLPYAEDALKTLSLPEAFAEIVLSLPRALKRILSSQESD

SEQ ID NO: 32362 - protein, 509 aa, Oryza sativa
  misc_feature (185)..(185): Xaa can be any naturally occurring amino acid
MASPAPAPPAASSSAAGSAPPPRIGLAGLATMGQNLALNIAEKGFPISVYNRTAAKVDATVSRAEAEGALPVLGHRDPRGFVLSLSRPRTVVLLVQAGRAVDATIDALVPYLDAGDAIVDGGNEWYQNTERRIEEAAARGILYLGMGVSGGEEGARNGPSLMPGGHIDAYNNIRDILEKAAAQTXEDGACVTFVGPGGAGNFVKMVHNGIEYGDMQLIAEAYDVLRRVGGLSNSEIADVFAEWNRGELESFLVEITADIFTVADPLDGSGGGGLVDKILDKTGMKGTGKWTVQQAAELAIAAPTIAASLDGRYLSGLKDERVAAAGVLEAEGMPSGLLETINVDKKMLVDRVRQALYASKICSYAQGMNLLRAKSVEKGWNLNLAELARIWKGGCIIRAKFLDRIKKAYDRNPELANLIVDREFAREMVQRQNAWRWVVARAVEAGISTPGMSASLSYFDTYRCSRLPANLIQAQRDLFGAHTYERIDRPGSFHTEWTKLARKSNGAAI

SEQ ID NO: 32363 - protein, 1250 aa, Gibberella moniliformis
MASCSPKQVSEPARERESLKLVALSSYSNKQFHVHVCLITNKVRYGASLLNDITDSPTEGAPPGQPSANGTVPSDEIKRQETPRDTVLASLAQLGLWKTGTVRALISLFDRNHQYIVAETTQRSSLAKSPIRPKDRNGDFWLYPGTFPRQLSVCGRALMAQSHDPSSSDEELPLTLIPDLKADARLCSIPHPLSEFAARFYAAVPVRSPAGVDIGVYCVIDSEPREAESWTTNDTEVLREISSNIMDYLRSKSVGDAYRRSVRMTRGIGSFVEKESSMAGWRARTNSPAFHDDAAREGNLNSEQQALQQFRDIGLQKNLPVHVPVQPNTTGETTTISSGGSGEANMTSTSSKSMSVRESDANAKEKVIAKIFSRAANLIREGIEIEGVVFLDANFETSATDSMLHEGQSSTESSSSSDESSDRIEQGKSCGILGFATSTSSSINLDAGSDIHTTMPMKLLAALLRRYPAGKIFNFDEDGSLLSSGSSEADLCTPMPKEEYFGEGSTAKMSGKSQRPWSRSLEGPSVSKTFPGARSVAFVPVWDPKRDRWLAGGFAYTRTPTRTFTIEGELSYLRGFGMLAMSEAQRLEAMLVNKAQSDVLGSLSHELRTPLHGVMLSAELLSDTQLDVFQGNLLRTLETCGRTLSETIDHLLYFSKVNQAAAHRKKERRARKRSIVSDPATTVPASVSTSEVRLDALIEEVMDSVFAGHVFKGNEAHKAWQTANPSKRVNMEDENDLTGGQSEDPVKYEVPLGHDSQVAIFLDIDPYVPYRFHVAAGALRRVVMNLFGNALKYTHKGTITVSLSQKPLSSNNPSGHRRLVRISVTDTGQGISPDFLRNDLFKPFSQENHLSHGTGLGLSLVKKIVASMGGKISIESEVNVGTTATITLPLSRSKDSDSSNPGQEKNEVDEETKRLKGLRLRLVGFPSEEEIKSRTGRGIPMSAMKVMCHRWLEMDVINEATCQGVAPDLVLCNEIAIEDPVLSSEELVRCPVVVVCANAITAHKRSSESKVSEDQRVYEFVSQPFSIGPHKLARILHIALCRWGDLQALSPAAPVVEDEEHLDYASDDAKRFSTGSNTEGEAPDNKSTPGPGAASLKRPSPPSRVPSKRPSQATHQQGSTAASEPKSFLLVDDNPINLSVLCAYMKKLKSKYITAADGLEAVERFQESPDEFSCILMDISMPRMDGIEATKEIRAFENKEGREPVIILALTGLASASAQQDAYACGVDVFLSKPVKLKELSSILRERSLA

SEQ ID NO: 32364 - protein, 420 aa, Oryza sativa Japonica Group
MRSPVGRREVVVSGVFTALLVLSILSLPSLLLTGPAYKSWPFLAAARDDSTTGSGGGAGYYPVSFAYLISASTGDAARAARLLAALYHPANCYLLHLDREAPAEEHRRLAELVSGQPVYARAGNVWIVGRPNLVTYRGPTMLSTTLHAVAMLLRLGRRWDWFVNLSASDYPLVTQDDLMDVFSRLPRDLNFIQHTSHLGWKIKKRARPVILDTALYEADRSELIRPANLTTNRRNLPTAFKLFTGSAWTMMSRQFAEYFTVGYDDNLPRTLLLYYTNFVSSPEFYFQTLACNSRRFRNTTVNHDLHFIRWDSPPKQHPLYLGPRDYRRMLLSAAPFARKFREDDPVLDRIDRDILRRDGAAPGRAFAYGGWCSEGGVRLCSNPQEAGRKGMIKAGAGSRRLRAMLNKMMNARNFRRQQCR

SEQ ID NO: 32365 - protein, 474 aa, Synechococcus sp. WH 7803
MQRSQGTVMVQIAESSPFSATDLDALRAPVVTGTSRPEAWRRLQLDRLHALVCGHEQEVLDALHQDLLKPPLEGMAEVVSLLQELKLARRNLRRWMRPQSIRVPLVQQPGRAQLIREPLGCVLLIGPWNLPFSLTFWPLVSALAAGNTAVIKPSEQAPATAELIERLVPLYFPADVVRVVNGDSRVAADLVRLRFDHIFFTGGGRIGAKVLEGAAANLTPVTLELGGKNPAVVIPGADLAVTARRLIWGKGFNAGQACVAPDHILVEQSLREPLLQAMTDQRRALYGANPVQSEHLASLISERHYQRLAGLLDTARSEGRVLLGGECDATQRRIAPTLISIQDDSDPLMADELFGPLLPMIEIPDFKAAITRLQQQDKPLAIYLFGGDPSEQDQLLHSTSSGTVCFNDVILQAGVPGLPFGGVGASGMGTHHGEAGFRTFSHERSVLKRPFWLDLPQRYPPYTLKPETFRRLLS

SEQ ID NO: 32366 - protein, 1190 aa, Gibberella moniliformis
MASPACVKVPKKSIVSEATRERETFRYDDSLFTNVRFNDTGLPVPSNELSTCPDVILTALARLAASQTGAARSMISLFDQTHQYIIAEASAITPLIPSLGQDGHPETLWHCGTAIPRSHSACESTLCSDEIQSDESGPRPNHDLPVIVVDDVTLDPEYAAKPYCRPGGAARFYAAVPIRTDRGVNIGVICVIHTQPSLPWDDSHSRFMRELSRAVTEHLETISLKSHQRRSERKSWGLTSFVEGNTAPLSQVSSTGREYAQLETRGDGLARSQRLGIDDLQQALGGMSVRNSTVTTDSRAANAPHTKEVIMCEPQARSKFAHDPSQLLETPKQIFSKAAAIVKDSIETDGCLFLNADMLEFSSAGSSTEWIDEDLATRRPSTFSYNESEDAYTTVSSSDDRLRPSCQALGSSEHGAAHITLPQALLARMIRQYPRGHVFNYDADGNLLQEELPDDATRHLPNNNEWGNLHNRQDHRFRVQQREASILLETFPGARSIAFVPIWDLRKKRWSAGGFIHTYNIKRTFTIDLDLSYLRALGMLAAAEAFKLETLAADKAKTDALGSLSHELRSPLHGAVLSVELLNDTDLTIPQQNIVRTIETCCRTLSDTIDHLLEYSKVNKALPQEATRETQADGSGIKRSSSVSLASKPSRKVVQLDVLAEEVLESVYAGFNFQQVTLTQSSSQTPRRPGHTSIRRMDTMQAMEELQAPSKKKGNLSTKIGDVDVFLVIDSRPSWGFYTQPGPVRRIIMNLFGNSLKYTQCGIIRVSLEQTSAFGADDNDCWVTIKVSDTGMGISEDFLQNGLFKPFSQENHLSPGTGLGLSFVKQITAQFGGHISVDSRVGVGTTVTVRLPMKLGDDCHHIVCEIRQREEEFDAQTEKLRGLRVKLVDFNKDSVTGGGSVQRTIESPDQLVQDMCKDWLNMQVNTSETPCFMPDLAIWSEEGFERPNVSKDSVPDIPNIVLCANAVTAHQYATGAKTIPRPGVFEFISQPKLAKACSLALYRWTVMQTSTQSPTLASTEPESLSIVTSTAPSLTNPSSPFPASEDETPTQQKGYFKVSEFLLVDDNFINLKILSSYMKKLKQPYQTASDGLEAVTAYEADPGRYSCILMDISMPVMDGFEATRRIRAFESQQGLRPALILALTGLASEEAQREATVSGLDLFLTKPVRLKELGPILRAKGVLEEESNLG

SEQ ID NO: 32367 - protein, 524 aa, Synechococcus sp. WH 7803
MNDTGFDLLVIGGGASGACVAYEGVRRGLRVALLEGHDLGGGTSCRSTKLLHGGVRYLELAFKTADTAQLRLVREALLERGHWLQQAPFLAKRLELALPTDGVIGQAYYRLGLGLYDALSGRSGIGSSRLLSSQQLRHALPALRDDITRGVAYSDGQFDDARLNLLMALTAEQAGAVVRTRTRVVALETDSSGRLCGAISESASGQNERWQAKVVVNATGIHSDTIRRMADPSCEERMLTSRGIHLVLKQTLCPEGVGLLLPSTDDGRVLFMLPFFGRTLVGTTDTPCPQEQASVPAENEVKYLLDYVQRWFPARDPVDVGSCWAGGRPLLKPAGADVNSSRVVREHEVETLACGLVSVMGGKWTTCRPMAIDTLQAVEQQLGHTLKAPGALPLIGSAPDPLQTPALLQTQHASLESLLPDTPQRSQQIAHLQANHGLAAAQWVSSWSNDDRQPLSEVIPVCRGELRHAITHEHARGVTDVLCRRTRLGMVDQQDAERLRPNVSELLAQAGHGGADAEALDLSR

SEQ ID NO: 32368 - protein, 243 aa, Burkholderia sp. 383
MSKTHFGFESVEENEKAKKVAGVFHSVASNYDLMNDLMSAGMHRAWKAFTIAQANVRPGFKVLDLAAGTGDLTKAFAKAAGPTGEVWHTDINESMLRVGRDRLLDKGVVTPSLLCDAEKIPFPDNYFDLVTVAFGLRNMTHKDAALAEMRRVTKPGGRVMVLEFSKVWDPLKKAYDLYSFKVLPWLGDKFAKDAESYRYLAESIRMHPDQDTLKTMMEQAGLDAVKYYNLSGGVVALHMGAKY

SEQ ID NO: 32369 - protein, 330 aa, Trichodesmium erythraeum IMS101
MIHATLPIQAPIPAIVNDHNRLRLFSGSANVPLSTEVARYLGLDLGPMVRKHFADGELYIQIQESIRGCDVYLIQPSCHPVNDNLMELLIMIDACHRASARQITAVIPYYGYARADRKTAGRESITAKLVANLITEAGASRILAMDLHSAQIQGYFDIPFDHVYGLPVILDYLLSKNLSDIVVVSPDVGGVARARAFAKKLNDAPLAIIDKRRQAHNVAEVFNVIGDVKDKTAVLVDDMIDTAGTICEGGRLLREKGARQVYACATHAVFSGTAIERLSNGIFEEVIVTNTIPFNQENSFPQLIVLSAANLLGETIWRIHEDTSVSSMFR

SEQ ID NO: 32370 - protein, 464 aa, Bacillus cereus ATCC 14579
MDKNLKKDLKIRHITMISIGGVIGAGLFVGSGAVVHSAGPGSIVSYALAGLLVIFVMRMLGEMAAVNPTSGSFATYAREAIGPWAGYTIGWLYWFFWVIVIAIEATAGAGIIQYWIPQIPLWLLSLILTILLTLTNVFSVKSFGEFEYWFSFIKVISIVLFLCLGLAVILGFVPGTEAPGTSNLIGQGGFMPNGISSVLLGITVVIFSFMGSEIVAVAAGESAEPVKAVKTATNSVIWRILVFFIGSIAVVVTLLPWNSANILKSPFVAVLEHIGIPAAAQIMNFIVLTAVLSCLNSGLYTNSRMLFSMAERGDAPKSFLKLNSSGVPVRAVLFGTFFAYIGVVFSYISPDKVFLFLVNASGGIALLVYLVIAVSHLKMRKKMGKVEQQNLKVKMWLFPYVTYVTIAAIIAVLVAMFAIDTLRSQALLTMFVTVLIILSYFIFNRNKNSTVLNPKSKNEESVRF

SEQ ID NO: 32371 - protein, 552 aa, Oryza sativa Japonica Group
MATRRALSSLVRAASRLRGASPAPRPRGPLHRPSPSGYLFNRAAAYATAAAAKEAAPPAPATGKATGGGKITDEFTGAGAVGQVCQVIGAVVDVRFDEGLPPILTALEVLDHNIRLVLEVAQHLGENMVRTIAMDGTEGLVRGQRVLNTGSPITVPVGRATLGRIMNVIGEPIDEKGDITTNHFLPIHREAPAFVEQATEQQILVTGIKVVDLLAPYQRGGKIGLFGGAGVGKTVLIMELINNVAKAHGGFSVFAGVGERTREGNDLYREMIESGVIKLGDKQSESKCALVYGQMNEPPGARARVGLTGLTVAEHFRDAEGQDVLLFIDNIFRFTQANSEVSALLGRIPSAVGYQPTLATDLGGLQERITTTKKGSITSVQAIYVPADDLTDPAPATTFAHLDATTVLSRQISELGIYPAVDPLDSTSRMLSPHVLGEDHYNTARGVQKVLQNYKNLQDIIAILGMDELSEDDKLTVARARKIQRFLSQPFHVAEVFTGAPGKYVELKESVNSFQGVLDGKYDDLPEQSFYMVGGIEEVIAKAEKIAKESAS

SEQ ID NO: 32372 - protein, 225 aa, Synechococcus sp. WH 5701
MLSSLFKLASWPRIPAAPPELPECPGSGSLRATMILPDPAAEASPPLGRRERMVLAAIAAALALLLFGLRGGLQPQAPLEQLARRSPELPLALASGRPTIVEFYADWCEACRSMAPAMAALESEHRGELNVVLLNVDNPRWSPEIDRYAVNGIPQLELFDRGGHAIGRSLGARSRPELASIMTALIEETPLPLLAGVGSLSPLTGGEAQGTGQTTPAQAGPRSHS

SEQ ID NO: 32373 - protein, 171 aa, Triticum aestivum
  misc_feature (155)..(155): Xaa can be any naturally occurring amino acid
MSPEMRFTPPRRASRRIAAVLVHPLPLDLLPPHLLLASCRRFVKVPAAMAARLAQLRTKAAQAAEFASKHGGAYYKEAMEKNKQYVVQPPSVEKCQELSKQLFYTRLASLPGRYEALWKEVDGVKQLWKNRKELKVEDLGIATLFGVELYAWFCXVGEIAGRGFTLTGYKV

SEQ ID NO: 32374 - protein, 451 aa, Pseudomonas cichorii
MNSTMTPLDTWRQEHSERLQRCAPVEVMGRIAGVSGILLHSHMPQARIGDLCEIRRADGTEVMAEIVGFDRKHTLLAALGALDGIAIGAPVRPLFQPHSLVVGEYLLGSVLDGFGRSLSGDGPSAFALSGAAGAQPVIRDAPPATERPRIEAPLSTGLRAIDGLLTLGEGQRVGLFAGAGCGKTTLLAEMARNTPCEAIVFGLIGERGRELREFLDHELDEELRSRTVLVCSTSDRSSMERARAAFTATTIAEGFRQQGKSTLLIIDSLTRFARAQREIGLASGEPAGRGGLPPSVYSLLPRLVERAGRTRTGAITALYSVLIEQDSMNDPVADEVRSLLDGHIVLSRRLAERGHYPAVDILTSLSRTMSNVVGTEQVKGATQIRRLLAAYQQVEMLIKLGEYQQGNDPLTDFAVQSRDQIMDFLQQSLRDPVSLEDTLDHLIQVTADVPR

SEQ ID NO: 32375 - protein, 289 aa, Sinorhizobium meliloti 1021
MSAKFPIISITGSSGAGTTTVKDTFEKIFKRENISASFIEGDAFHRFDRETMRSKIAEEKARGVDFTHFSAEANELEILESVFAEYGRRGVGRTRHYVHDEAEAAKFGSDPGTFTDWEEFRDSDLLFYEGLHGCAVTDTVNLAQHCDLKIGVVPVINLEWIQKIHRDKATRGYSTEAVTDTILRRMPDYVNYICPQFSLTDINFQRVPIVDTSNPFIARWIPTPAESILVIRFAKPQSIDFPYLLSMLHNSYMSRANSIVVPGDKLDLAMQLIFTPLIHKLLERKHRMS

SEQ ID NO: 32376 - protein, 349 aa, Sinorhizobium meliloti 1021
MSGATLEAYLASCTARGDDLSRDVAAVIQRLAKAALDIRKLVNQGALGTAFNGTHGGSNTDGDLQKDLDILCDDQFLTCLQGAPVACYASEELENPVLLDPSARLAVAIDPLDGSSNIDNNVSIGTIFSVLPAAKGPDVDPSQSFLQPGNRQLAAGFFIYGPQTALVLSLGKGTEIFIFSSRLGCFVEAYKSAIIPERAHEFAINMSNYRHWEEAIRLYVDDCLAGSEGPRERDFNMRWIASLVAETYRILIRGGIFLYPADGRKGYSQGRLRLVYEANPIAFIIENAGGAATTSIDRILDLVPENLHQRVPLVFGSRREVARITRYHVDPNMIGERAPLFGKRGLFRA

SEQ ID NO: 32377 - protein, 482 aa, Synechococcus sp. WH 7803
MSDASFDFDVIVIGAGYGGFDAAKHAAEHGLKVAIIESRDMGGTCVNRGCVPSKALLAASGRVRELADADHLAGFGIHAAPVRFERQKIADHANQLVATIRGNLTKTLERAGVTIIRGQGRLESAQAVGVREISGVDRVITGKDVILATGSDPFVPPGIETDGRSVFTSDEAVSLEWLPRWLAIIGSGYIGLEFADVYTALGCEVTMIEALDRVMPTFDPDITRIAARHLIDGRDIDARSGVLAQSIKPGAPVQIDLVDMKTREPVETLEVDAVLVATGRVPSSRNLNLDKLGVETQRGFVPINDRMQVLANGQPVPHLWAVGDVTGKLMLAHTAAAQGTVAIDNILGHSREIDYRSIPAATFTHPEISSVGLSEADAKQLAADQGFELGVVRSYFKANSKALAELDSDGLMKLLFNKASGEVLGAHIYGLHAADLIQEVANAVARRQSVRQLSTEVHTHPTLSEVVEVAYKQAAASLLTPA

SEQ ID NO: 32378 - protein, 406 aa, Synechococcus sp. WH 7803
MVEPKADSKSTAVMGTYNRFPLSLVKGRGCWVWDDQNRRHLDAVAGIATCTLGHSDRVLRRALTRQLRTLQHVSNLYQIPEQEQLAQWLVANSCADSVFFCNSGAEANEAAIKLARKHGHQRRGIDRPVIITASASFHGRTLAAVSATGQPRYHQGFEPMVEGFEFFPYNDGDAFEQLLMQLEHNGPKVAAVLIEPLQGEGGVNPGDPAVMQRIRKLCSERDILLIFDEVQVGMGRTGTLWGYQQLGVTPDALTLAKGLGGGHVIGALLVSEHADVFEPGDHASTFGGNPFACRAGLTVASELQRRDLLKNVQMRGQQLQDGLNHLVERYPDHLAGCRGWGLLQGLVLRDTCGYSAADVVKAALEEQLLLVPAGAAVVRMVPPLVIGPREIQSLLTRLDRALQHLM

SEQ ID NO: 32379 - protein, 328 aa, Brucella melitensis
MTILVTGGAGYIGSHTCVQLIEAGHEVVVVDNFDNSHPEALHRIEKITGPGDIAIVALMEQMIKRHKCTAVIHFAGLKAVGESSEKPLLYYDCNVLGTLRLLQAMEVTGVKKLVFSSSATVYGVPGKLPITEDQPLSATNPYGRTKLVIEDMLRDLYNSDNSWAVAILRYFNPVGAHESGLIGEDPNDSQQSDAIIAQVATGQTVKLNIWGNDYPTPDGTGVRDYIHVNDLAAGHLKALKKLDKPSASSVNLGTGQGYSVLDVIKAFEHVSNREIKYEIAPRRPGMLPECYADPGFAKKFLGWSAEKNLREMCQDMWNWQSKNPTAYE

SEQ ID NO: 32380 - protein, 380 aa, Physcomitrella patens subsp. patens
MLPPKTHSIRIVHLALVVVQLGYAGLQMFSRVALDAGLNQFLLSMYRNMIAFAILAPIAYYYEREKRPPMSLKIFGGLNLLALTGVVGSQQLFLSGLQLTSPLMAAVSQNMIPVFTFLLAITLGLEEVNMRRREGIAKVVGTAICIGGAIIMSVYKGIAIFGGGDDTHDAGLMQPFGHLGAFLHPDIVQFSVNKYHLGLFFLFMNCVSWGVYLTAQAPVMRMYPALLSMTAGTYFFGFIQVGILGVISAGKLHFAEFALTSWQQIVGVLYAALIASTLNLLLQSWCVQKGGPFIVSLYVPLQMLMVAVLSVLLLKDTLFMGIVLGGLLTVAGFYLVVWGQGLERRRKRGVLAQILEPQHDVYKVDIRRLSQDLKEPLLSK

SEQ ID NO: 32381 - protein, 361 aa, Glycine max
MGIYLSSPKTEKFSEDGENDCLRYGLSSMQGWRATMEDAHAAYTDLDESTSFFGVYDGHGGKVVAKFCAKFLHQQVLKSETYLTGDIGTSLQKAFLRMDEMMRGQKGWRELSILGDKINKFTGMIEGLIWSPRSSDGNCQVDDWGLEEGPHSDFAGPTSGSTACVAVIRNNQLVVANAGDSRCVISRKGQAYNLSRDHKPDLEIEKDRILKAGGFIHAGRVNGSLNLARAIGDMEFKQNKFLPAEKQIVTANPDINTVELCDEDEFVVLACDGIWDCMSSQQLVDFVREQLHLKTKLSAVCESVLDRCLAPSTAGGEGCDNMTMIVVQFKRPAQSSAPAEEQSSSSNGQAEPETKLERSES

SEQ ID NO: 32382 - protein, 501 aa, Sphingobium chungbukense
MATQLKSTENDYGIKSEYGHYIGGEWIAGDSGKTIDLLNPSTGKVLTKIQAGNAKDIERAIAAAKAAFPKWSQSLPGERQEILIEIARRLKARQSHYATLETLNNGKPMRESMFFDMTQTIGQFELFAGAAYGLHGQTLDYPDAIGIVHREPLGVCAQIIPWNVPMLMMACKIAPALASGNTVVLKPAETVCLSVIEFFVEMADLLPPGVINVVTGYGADVGEALVTSPDVAKVAFTGSIATARRIIQYASANIIPQTLELGGKSAHIVCGDADIDAAVESATMSTVLNKGEVCLAGSRLFLHQSIQDEFLAKFKTALEGIRQGDPLDMATQLGAQASKMQFDKVESYLQLATEEGAEVLTGGTRADAANLAGGNFIKPTVFTNVKNTMRIAQEEIFRPVTTVISWNDQTHMMQQANATTYGLAGGVWTKDLARAHRIARQLETGTVWINRYYNLKANMPLGGYKQNGFGREFSHEVLNHYTQTKSVVVNLQEGRVGMFDQ

SEQ ID NO: 32383 - protein, 439 aa, Streptococcus agalactiae A909
MKKYDVIVLGFGKAGKTLAAKLATQGKSVAMVEEDNKMYGGTCINIGCIPTKTLLVSASKNHDFQEAMTTRNEVTSRLRAKNFAMLDNKDTVDVYNAKARFISNKVVELTGGADKQELTADVIIINTGAKSVQLPIPGLADSQHVYDSTAIQELAHLPKRLGIIGGGNIGLEFATLYSELGSKVTVIDSQSRIFAREEEELSEMAQDYLEEMGISFKLSADIKSVQNEDENVVISFEDEKLSFDAVLYATGRKPNTEGLALENTDIKLTERGAIAVDEYCQTSVENIFAVGDVNGGPQFTYISLDDSRIVLNYLNGDKDYSLKNRGAVPTSTFTNPPLATVGLDEKTAKEKGYQVKSNSLLVSAMPRAHVNNDLRGIFKVVVDTETNLILGARLFGAESHELINIITMAMDNKIPYTYFQKQIFTHPTMVENFNDLFNF

SEQ ID NO: 32384 - protein, 463 aa, Prochlorococcus marinus str. MIT 9312
MKISNKFHLEDINKLKNTVLSGKTEDIKWRIKQINIVSKLLDENKKEIIKSLFIDLGKSEIEGMSEILLVKEEISLIKKRLNSWMRPKKVDTPFYLFPSSSKVIHEPLGCVLILSPYNYPLLYVLKPLVNIFSAGNTAVIKPSEKCHSTSKLIKKLTSKYFKKDVLLTVEGDYKQSIKLVEQNFDHIFFTGSTETGKSIMKLASKNLTPLTLELSGTNPVIIFKNANLEVAAKRIVWGKFFNSGQSCMAPNHIFIDKRIENDFIEKLKQCIVSFYGKDPIISENLSKLEKKHFSSTVEIIKRYKKEKRILYGGTFSKKKLKITPTILRTKLDEKDILQKELFSSILPVIGINDKESALKQINQTSKPLAIYLFGGNNKIHSQISRVTSSGTVCINDVMLPVLIPNLPFGGVGQSGIGKFHGEEGFRNFSNQKSITFKGFLFDLNLRYPPYKRIKKFLKFIFKI

SEQ ID NO: 32385 - protein, 200 aa, Zea mays
  misc_feature (121)..(121): Xaa can be any naturally occurring amino acid
MGEEASCDAVSLTEAGTNAKPVGKEVGREPAAAPAAAADPRLQGISDAIRVVPHFPKQGIMFNDITTLLLRPRVFKDAVDLFVERYRGMGIDAVAGIEARGFVFGPAIALAIGAKFIPLRXPRKLPGEVISEKYVLEYGTDCLEMRVGAIERSGERVLVIDDLVATGGTLCAAIRLLERAGADVVECACVIGLPKFKVSE

SEQ ID NO: 32386 - protein, 93 aa, Zea mays
  misc_feature (85)..(85): Xaa can be any naturally occurring amino acid
TYYATSSLLAPTVMMASSATAVAPFQGLKSTASLPIARRSSRSLGNDRNGGRIRCMQVWPAYGNKKVKTLSYLPPLSTDNLLKQXVDYLLHNR

SEQ ID NO: 32387 - protein, 166 aa, Glycine max
  misc_feature (100)..(100): Xaa can be any naturally occurring amino acid
VKDAEVVHELKNYLKSCGADIHVIVKIESADSIPNLHSIITASDGAMVARGDLGAELPIEEVPLLQEEIINLCRSMGKAVIVATNMLESMIVHPTPTRAXRLALYQGVCPIYMEFCDDSEATFRRALDLLQKQAMVKEGEEVALVQSGRQPIWRFQSTHNIQVRKV

SEQ ID NO: 32388 - protein, 507 aa, Burkholderia sp. 383
MASHDYLKKILTARVYDVAIETELESARILSARLRNAVYLKREDNQPVFSFKLRGAYNKMAHIPADALARGVITASAGNHAQGVAFSAARMGVKAVIVVPVTTPQVKVDAVRAHGGPSVEVIQAGESYSDAYAHAVKVQEERGLTFVHPFDDPYVIAGQGTIAMEILRQHQGPIHAIFVPIGGGGLASGVAAYVKAVRPEIKVIGVQAEDSCAMAQSLEAGRRVELSEVGLFADGTAVKLVGEETFRLCSEYLDGVVTVNTDALCAAIKDVFQDTRSVLEPSGALAVAGAKLYAEREGIENQTLVAVTSGANMNFDRMRFVAERAEVGEAREAVFAVTIPEERGSFKRFCSLVGDRNVTEFNYRIADAQAAHIFVGVQIKRRGESAEIAANFESHGFKSVDLTHDELSKEHIRYMVGGRSPLALDERLFRFEFPERPGALMKFLSSMAPDWNISLFHYRNQGADYSSILVGLQVPQADRAEFERFLAALGYPYVEESANPAYRLFLS

SEQ ID NO: 32389 - protein, 370 aa, Debaryomyces hansenii CBS767
MSFLSSNTAASTTNTSASNGQELINDITINNPPEDSISDIAFSPQQDLLVAASWDKKVRIYEIDPNTGNNQGRAMFEHEAPVFSARWSIDGTKVISGGADKQVKLFDIASQQTQQIGAHDAPVRAVRFVECGPTNTQVVVSGSWDKTLKYWDMRAPQPVSTVNLPERVYCMDSSQKLLVVGCAERQISIIDLNNPQQIFKNSMSPLKWQTRSISCYPQGNGFAVGSIEGRCAIQYIDESEQSKFGFSFRCHRKTPTGANTTSALRTSANSESHIYSVNSIAFHPVYGTFSTAGSDGTFCFWDKDAKQRLKTFPAVNCTIPATCFNKNGTIFAYAMSYDWSQGHTGNKPDYPNQIKLHATKDEEIKQKKKR

SEQ ID NO: 32390 - protein, 496 aa, Vitis vinifera
  misc_feature (209)..(209): Xaa can be any naturally occurring amino acid
MELFRTAKAVTLRSHLDKYLVADDDKETVRQSRNGLSRRAKWLVEGSGHVIRLKSCHGRYLTASDTAYLLGMTGKKVTQTVPGNTSDALIEWEPIRDGFQVKFKTRGGKFLRANGGTPPWRNSVTHDYPNSSATRNWILWDVEPVEVPEVDPVADYLSSLSSFSSISDDLFGSEPPSPMSITATEPFGLSSKRIAMELFHNAKAVRLRXHHDKYLLADDDEESVIQDRSGSSKTARWTVELVKDADNIIRLRSCFNKYLTASNQPFLLGMTGRKVLQTRPGRLDSSVEWEPVKEGNRIKLRTRYGNFLRANGGLPPWRNSVTHDVPHRTATQDWILWVVDIVEIQIQSPNAKPPLQSLSHSDSFASASDSSSPSSVSLHPASFSRQESNDSLENSPPKTEGRTIYYHVADDNGNVDDSAGGQYFTLKENGVFELTRRLEEETGLEDIIVCSRSNLNGKLYPLRLQLPPNNATMHVIVIQASSKGEYLLLLSFAMFA

SEQ ID NO: 32391 - protein, 389 aa, Ostreococcus tauri
MRARGGKALWVDCDPGHDDAFALYLAAWGRGDGEASNATMVDGDDGAASLVLAGVSTVAGNQSIEKTTANARRVLRWIDWGGARRRGRGCRDFATANCRVYEGAGRPLLREAKICEEIHGQSGLDAVDGTCALPELTAEEKRYVTVSDEPAAVAMFKAIKDAEGDLIIVATGPLTNVALMISVFRKELNALPKPPTIFFMGGAVGEGNTGARAEFNIQCDPEAAKIVLESGLPLYMIPLEVTHTALVTPEVLAMLRAKALLHSSGEDHANRIEALLTFFAKTYKDVFEFDHPPLHDPCAVWAAIEFAHAEHNGLPSSFEYTLERVDVECASPLTYGQTVVDRWRTSGRPNNVRLARKMNVKRFWSALAGAIELHASLERAQVEWPGSGE

SEQ ID NO: 32392 - protein, 506 aa, Saccharomyces cerevisiae
MPESRLQRLANLKIGTPQQLRRTSIIGTIGPKTNSCEAITALRKAGLNIIRLNFSHGSYEFHQSVIENAVKSEQQFPGRPLAIALDTKGPEIRTGRTLNDQDLYIPVDHQMIFTTDASFANTSNDKIMYIDYANLTKVIVPGRFIYVDDGILSFKVLQIIDESNLRVQAVNSGYIASHKGVNLPNTDVDLPPLSAKDMKDLQFGVRNGIHIVFASFIRTSEDVLSIRKALGSEGQDIKIISKIENQQGLDNFDEILEVTDGVMIARGDLGIEILAPEVLAIQKKLIAKCNLAGKPVICATQMLDSMTHNPRPTRAEVSDVGNAVLDGADCVMLSGETAKGDYPVNAVNIMAATALIAESTIAHLALYDDLRDATPKPTSTTETVAAAATAAILEQDGKAIVVLSTTGNTARLLSKYRPSCPIILVTRHARTARIAHLYRGVFPFLYEPKRLDDWGEDVHRRLKFGVEMARSFGMVDNGDTVVSIQGFKGGVGHSNTLRISTVGQEF

SEQ ID NO: 32393 - protein, 370 aa, Vitis vinifera
MGRYRISRLPKIQILQFSPFTKPTSVQLHLIRNPSPSQSRSPFPSLSLNASKAPSPQTQVTGPPLVVVGSANADIYVEIDRLPKEGETVSAKHGQTLAGGKGANQAACGGKLSYPTYFVGQVGEDAHGKLISEALKDGGVCLDHLSTVSAAPTGHAVVMLQSDGQNSIIIVGGANMSFWPDTLSDEDLKIVRNAGIVLLQREIPDFVNIQVAKAARDAGVPVILDAGGMDAPIPVELLNVVDILSPNESELARLTRMPTESFEQISQAVAKCHEMGVKEVLVKLGEKGSALFVKGEEPIRQPIISAAKVLDTTGAGDTFTAAFAVAFVEGRSKKECLRFAAAAASLCVQVKGAIPSMPDRRSVLDLLQTC

SEQ ID NO: 32394 - protein, 254 aa, Arabidopsis thaliana
MEACLRCSRGSYLIEAMRPLSSSLRPSSSVSFSTGKPIKRAYDGLLLDAGGTLLQLSKPVHETYASLGQKYGLKTTPAEIKEGFKRVFSAPWPEKLRYQGDGRPFWKLVVSEATGCSDNDYFEDVYQYYANGEAWHLPEGAYETMSLLKDAGVKMAVVSNFDTRLRKLLKDLNVIDMFDAVIVSAEVGYEKPDERIFKSALEQISVDVNRAVHVGDDEGADKGGANAIGIACWLWGEDVQTFSDIQKRILVSEL

SEQ ID NO: 32395 - protein, 154 aa, Zea mays
YSSCKRSARKRKQRAMASGGPKPKLAYIILYVRDVEKAASFYDAAFGYTVRRLDQSRKWAELESGATTIAFTPLHQRETDELSGAVQLPDSSAAGRGSVEVCFAYADVDAAYKRAVDNGAVAVSAPEDKPWGQKSGFVRDMDGNIVRIASYVRE

SEQ ID NO: 32396 - protein, 412 aa, Rhodobacter capsulatus
MTDVMVPALGESVAEATVSTWFKKPGDAVAQDEILCELETDKVSVEVPAPAAGVLSEILAPEGASVAAGGRLAILAAGSARLQPPAAAAAAPAPAPAAPAKDVEHAPAAKKAMAEAGLTPDQVTGTGRDGRIMKEDVAAAAAAPAAAPAPAAPAPVATAQVSIAPPPATVPRAPVPAEDAAREERVKMTRLRATIARRLKDAQNTAAMLTTYNEVDMSGVMDLRNVYKDQFEKKHGVKLGFMGFFVKACCHALKEIPEVNAEIDGGDIIYKNYVHMGVAVGTPSGLVVPVVRDADQKGFAHIEREIAELGKRGRDGKLTMQEMQGGSFTISNGGVYGSLMSSPILNPPQSGILGMHKIQDRPVVVNGQIVIRPMMYLALSYDHRIVDGKGAVTFLVRVKEALEDPRRLLMDL

SEQ ID NO: 32397 - protein, 183 aa, Methanocaldococcus jannaschii DSM 2661
MKIMEPEIKIVNVVVSTKIGDNIDLEEVAMILENAEYEPEQFPGLVCRLSVPKVALLIFRSGKVNCTGAKSKEEAEIAIKKIIKELKDAGIDVIENPEIKIQNMVATADLGIEPNLDDIALMVEGTEYEPEQFPGLVYRLDDPKVVVLIFGSGKVVITGLKSEEDAKRALKKILDTIKEVQEL

SEQ ID NO: 32398 - protein, 626 aa, Rubrobacter xylanophilus DSM 9941
MAHVNQKTVDATTLRELAQQLRVDSIRASTTAGSGHPTSSMSAADLMAVLMARYLRYDFDDPENPLNDRLVFSKGHASPLLYSMYKAAGAITDEELLSFRKFGSPLQGHPTPALRWVDVATGSLGQGLPIGVGLALAGKHLDRLPYRVWVLCGDSEMAEGSMWEAFQHAAHYGLDNLVAVLDMNRLGQTRETMDGWNGDAYAGRARAFGWHAIQIDGHDVEEIDRAYAEALEQDKPVLVIARTRKGRGVSFLEDQLGKHGKPVPPEQAEQAIEELGGERSITVEVPRPDRRPQPPVRDGFTGEYRPKRWEVGDSEATRTAYGEGLKALGAAREDVVVMDGEVSDSTRAQKFAEAYPDRYFEMFIAEQQMVATAVGMSVRGYVPFASSFAAFLTRAHDFIRMAAISGANLRLCGSHAGVSIGPDGPSQMGLEDLAMMRSLHGSTVLYPCDANQTVKLVREMAGLEGISFLRTTRDSTPVIYPADEEFPVGGSKVVRSSEEDAVTVVAAGITVHQALRAAEELQGEGIRVRVIDAYSVKPIDARTLISSARQTAGRVVVAEDHWPEGGLGEAVLSAFAENGALDGLRLRHLAVSGMPGSGKPQELLDAAGIGFGDIAGAVRSLLDGRA

SEQ ID NO: 32399 - protein, 100 aa, Physcomitrella patens subsp. patens
KRKRGLFNKDLRLMMYGFGDDPDPMPETVHLMEDILIDYITDTVHKSQNVASRRGKLTTEDVMFLVRKDSRKFARVKELLAMNEELKRARKAFDLDEEKL

SEQ ID NO: 32400 - protein, 364 aa, Agrobacterium vitis
MREYKIAAIPADGIGPEVIAAGLQVLEALEQRSGDFKIHTETFDWGSDYYKKHGVMMPADGLDKLKKFDAIFFGAVGAPDVPDHITLWGLRLPICQGFDQYANVRPTKILPGITPPLRNCGPGDLDWVIVRENSEGEYSGHGGRAHRGLPEEVGTEVAIFTRVGVTRIMRYAFKLAQARPRKLLTVVTKSNAQRHGMVMWDEIAAEVATEFPDVTWDKMLVDAMTVRMTLKPETLDTIVATNLHADILSDLAGALAGSLGVAPTANIDPERRFPSMFEPIHGSAFDITGKGIANPIATFWTAAQMLEHLGERDAAARLMSAVERVTEAGILTPDVGGTANTRQVTEAVCNAIAGSNILKMAAAE

SEQ ID NO: 32401 - protein, 510 aa, Rubrobacter xylanophilus DSM 9941
MSGVREELRDALADERRIPRPPEPAAMVIFGASGDLTARKLVPALYDLAAARRLPMGFAVVGVSRTKMSHEQFRQRLRGSLERHRAGGFSEEVWESFSRSIFYLPGDSRRPETYGELRGLLERLDAGRGTGGNRIFYLASSPSLFSPTVERLGEAGMSREGGGSYVRLVVEKPFGRDLESARRLNADLLRHFREDQIYRIDHYLGKETVQNILALRFANGIFEPVWNQHYVDHVQITVAEDIGIEGRGAFYEEAGALRDIVQNHMMQLLCLTAMEPPVAFDAEPVRDEKVKVLSAVRPIPEERVEEVAVRGQYGSGWIWGEEVRAYREEEGVAPDSATETYAALKLYVDNWRWAGVPFYVRTGKRLPKKVTEIAIRFKPTPHTPFARAAGAEPNVLVIRIQPEEGVSLKIGAKIPGSGFEVGSVNMDLLYGTAFLEEVPEAYQRLLLDLMLGDATLFIRADEAEAAWSILDPVLRAWSGAEDVPVYPAGSWGPAEADDLLRRDGRGWRRP

SEQ ID NO: 32402 - protein, 364 aa, Agrobacterium vitis
MREYKIAAIPADGIGPEVIAAGLQVLEALEKRSGDFSIHTETFDWGSDYYKKNGVMMPADGLEQLKKFDAIFFGAVGAPDVPDHITLWGLRLPICQGFDQYANVRPTKVLPGITPPLRNCGPGDLDWVIVRENSEGEYSGHGGRAHKGLPEEVGTEVAIFTRVGVTRIMRYAFKLAQARPRKLLTVVTKSNAQRHGMVMWDEIAAEVSKEFPDVTWDKMLVDAMTVRMTLKPQSLDTIVATNLHADILSDLAGALAGSLGVAPTANIDPERRFPSMFEPIHGSAFDITGKGIANPVATFWTAAQMLEHLGEKDAATRLMSAVERVTEAGILTPDVGGTADTQQVTDAVCEAIAGSNILNMAAVG

SEQ ID NO: 32403 - protein, 358 aa, Agrobacterium vitis
MREYKIAAIPADGIGPEVIAAGLQVLEALEQRSGDFKIHTETFDWGSDYYKKHGVMMPADGLDKLKKFDAIFFGAVGAPDVPDHITLWGLRLPICQGFDQYANVRPTKILPGITPPLRNCGPGDLDWVIVRENSEGEYSGHGGRAHRGLPEEVGTEVAIFTRVGVTRIMRYAFKLAQARPRKLLTVVTKSNAQRHGMVMWDEIAAEVATEFPDVTWDKMLVDAMTVRMTLKPETLDTIVATNLHADILSDLAGALAGSLGVAPTANIDPERRFPSMFEPIHGSAFDITGKGIANPIATFWTAAQMLEHLGERDAAARLMSAVERVTEAGILTPDVGGTANTSQVTEAVCNAIAGSNII

SEQ ID NO: 32404 - protein, 295 aa, Bacillus anthracis str. Ames
MKRVRKAIIPAAGLGTRFLPATKAMPKEMLPIVDKPTIQYIVEEAVKSGIEDIIIVTGKTKRSIEDHFDNAFELEQNLLEKKKYELLEKVQASSKMVDIHYIRQKEPKGLGHAVWCARKFIGDEPFAVLLGDDIVQAEKPCLRQLIEEYDKTLSSVIGVQTVPEDETHRYGIIDPLEQEGRRYQVRNFVEKPAAGTAPSNLAIMGRYVLTPEIFMFLEQQHVGAGGEIQLTDAIQSLNEIQRVFAYDFEGKRYDVGEKLGFVQTTIEMALQHPELRDDMVTMMKKILEEQTNQES

SEQ ID NO: 32405 - protein, 358 aa, Agrobacterium vitis
MREYKIAAIPADGIGPEVIAAGLQVLEALEKRSGDFSIHTETFDWGSDYYKKNGVMMPADGLEQLKKFDAIFFGAVGAPDVPDHITLWGLRLPICQGFDQYANVRPTKVLPGITPPLRNCGPGDLDWVIVRENSEGEYSGHGGRAHKGLPEEVGTEVAIFTRVGVTRIMRYAFKLAQARPRKLLTVVTKSNAQRHGMVMWDEIAAEVSKEFPDVTWDKMLVDAMTVRMTLKPQSLDTIVATNLHADILSDLAGALAGSLGVAPTANIDPERRFPSMFEPIHGSAFDITGKGIANPVATFWTAAQMLEHLGEKDAATRLMSAVERVTEAGILTPDVGGTANTQQVTDAVCEAIAGSNIL

SEQ ID NO: 32406 - protein, 358 aa, Agrobacterium vitis
MREYKIAAIPADGIGPEVIAAGLQVLEALEQRSGDFKIHTETFDWGSDYYKKHGVMMPADGLDKLKKFDAIFFGAVGAPDVPDHITLWGLRLPICQGFDQYANVRPTKILPGITPPLRNCGPGDLDWVIVRENSEGEYSGHGGRAHRGLPEEVGTEVAIFTRVGVTRIMRYAFKLAQARPRKLLTVVTKSNAQRHGMVMWDEIAAEVATEFPDVTWDKMLVDAMTVRMTLKPETLDTIVATNLHADILSDLAGALAGSLGVAPTANIDPERRFPSMFEPIHGSAFDITGKGIANPIATFWTAAQMLEHLGERDAAARLMGAVERVTEAGILTPDVGGTANTSQVTEAVCNAIAGSNII

SEQ ID NO: 32407 - protein, 414 aa, Zea mays
MTASLSYFDTYRSSRLPANLIQAQRDLFGAHTYERRIQEAAARGVLYLGMGVSGGEEGARNGPSLMPGGSADAYANIRDILQKAAAQTEDGACVTFVGPGGAGNFVKMVHNGIEYGDMQLIAEAYDVLRRLGGLSNSEIADVFAEWNRGELESFLVQITADIFTVADPLDGSGSGGGALVDRILDKTGMKGTGKWTVQQAAELAVAAPTIAASLDGRYLSGLKDERVAAAGVLEEEGMPAGLLETVNVDKKVLVDRVRQALYASKICSYAQGMNLLRAKSVEKGWNLNLAELARIWKGGCIIRARFLDRIKSAYDRNPELANLIVDREFAREMVQRQNAWRWVVARAVEAGISTPGMTASLSYFDTYRSSRLPANLIQAQRDLFGAHTYERIDCPGSFHTEWTKLARRSNGAAI

SEQ ID NO: 32408 - protein, 107 aa, Triticum aestivum
  misc_feature (54)..(54): Xaa can be any naturally occurring amino acid
QGLDCGEQSTKLFREEILKSKPIVWNGPSGVFEFEAFSNGTKAVLDAVIEATKXGATTIIGGGDPATAALKWGAEGQVFHISTGGGAPLELLEGKELPGVTALSRKN

SEQ ID NO: 32409 - protein, 431 aa, Mycoplasma conjunctivae
MNKFDIAVIGAGPGGYSLALILAKAGNKVVIFEESFFGGNCVNRGCIPTKTLMKSARIANTLARSKDFGIDSENYYDLQTMFKNVANNSAKLQNAIKGGLTTSNVTIIEASATVIDENTIEANGSQYSFDKLVIASGSRPNFFKIEGAEATNVYTSDDLLTKNPKFDELTIIGGGAISLEFAYFYASFGKKVTIIEAAPQLFANLDESISRAAKAVIAEKGITLYEATKVLRYEDGALILENHDGHIYHKTNNILLAVGRRANNEAFASLNLKFNEKNFIEVNEFFQTSIDHIYAIGDVTGKLMLSTVAYKHGDIVAKHIITGSSDEKFNARFIPWTIYATPEIASVGSSEQQLQAQGIDYEVAEIAASSLPRAHAENAFKLGFIKLIFNKKTFEILGATIFLDEASLLINQIALAIKSKLTILDQYLLVI

SEQ ID NO: 32410 - protein, 264 aa, Brassica napus
SSTPGPHVLPEGYEKLTSPCLKGEAWKFPFTGFIAMVAAILTLSVDSFATSYFHRLHNKTSKKIGEGEEQIGGGGGGDELGLHVHAHGHAHGIVSVDSGESEVQLHRTRVVAQVLEVGIIVHSVVIGISLGASQSPHTAKALFAALMFHQCFEGLGLGGCIAQGKFNCMSITIMSIFFSVTTPIGIAVGMGIASSYNESSQTALIVQGVLNAASAGILIYMSLVDFLAADFMHPKMQSNTGLRIMAHISLLIGAGIMSLLAKWA

SEQ ID NO: 32411 - protein, 305 aa, Oceanicola granulosus HTCC2516
MHILSIGECMAELAPADLPGTYRLGFAGDTFNTAWYLARLRPESRISYFSAIGDDALSQQMRAAMSAAGIDGGGLRVIPGRTVGLYLITLEQGERSFAYWRGQSAARELAGDADALAAAMARADVVYFSGITLAILDQCGRATLLRALAQARATGRTIAFDPNLRPRLWAGTGEMTETIMQGAAVSDIALPSFEDEAAWFGDAGPDATADRYARAGVRSVVVKNGPHAVHFLQDGRRGRVPVPPVAQVVDTTAAGDSFNAGLLDSVLAGQPLETAIAAAAALAGQVVQGKGALVEVPSLRPHADA

SEQ ID NO: 32412 - protein, 401 aa, Photobacterium profundum SS9
MTIEILVPDLPESVADATVATWHKQPGDFVTRDEVLVDIETDKVVLEVPAPQDGILEAIIEADGTTVLSKQLIGKIKVGAVAGEPTKDVPVAAESSPNKRNTASLTEETNEALSPAVRRLLGEHSIEASAVKGTGVGGRITREDVEAYLKKSSAPAVAPEAKAEAPLAARSQKRVPMTRLRKRVAERLLEAKNSTAMLTTFNEVNMKPIMDLRKQYKDIFEERHGIRLGFMSFYVKAVVEALKRYPEVNASIDGDDIVYHNFFDVSIAVSTPRGLVTPVLRDCDKLSLAEIEKGIRELAIKGRDGKLTVDELIGGNFTITNGGVFGSLMSTPIINLPQAAILGMHKIADRPMAIDGKVEILPMMYLALSYDHRLVDGRESVGYLVTIKDLLEDPTRLLLDV

SEQ ID NO: 32413 - protein, 388 aa, Photobacterium profundum SS9
MNLHEYQAKQLFAEYGLPVPEGFACDTAQEAFEAAGRISTDKKVVKCQVHAGGRGKAGGVEIHDTKDGVKEFAQKWLGKNLVTFQTDAKGQPVTKILVEEASNIANELYLGAVVDRATRRIVFMASTEGGVDIEKIAEETPELIHQAAIDPLVGPQPYQGRELAFKLGLVGDQIKQFVKIFLGLGNMFAQYDLALLEINPLVVTAEGNLLCLDGKINIDSNAMYRQPKLREMHDPSQEDEREAHAAQWELNYVALDGSIGCMVNGAGLAMGTMDIVNLHGGQPANFLDVGGGATKERVTEAFKIILSDTNVKAVLVNIFGGIVRCDLIADGIIGAVEEVGVKVPVVVRLEGNNAPLGSKKLAESGLNIIAATSLTEAAEKVVAAAEGK

SEQ ID NO: 32414 - protein, 197 aa, Staphylococcus aureus subsp. aureus Mu50
MILVIDNNDSFTYNLIDYIKTQTKLTVQVVGIDNLLIEDVINMKPKAIVISPGPGNPDDYPILNEVLEQFYQRVPILGVCLGFQCIVSYFGGNIIHGYHPVHGHTTQLRHTNEGIFQGLPQNFNVMRYHSLIADGATFPNCLKITAKNDEAIIMAFEHIRFPVFGVQYHPESILSEYGYRQVELFLSKVGDYCENRI

SEQ ID NO: 32415 - protein, 417 aa, Streptomyces coelicolor A3(2)
MTVSVTLPALGESVTEGTVTRWLKQVGDRVEADEPLLEVSTDKVDTEIPSPAAGVLLEILAAEDETVEVGAGLGIIGAPDTAPAAPAAPAAPAPAPAPTPTPTPTPTPTASAPAPTPAPAPAPAPAPAPAEPFVPPAASAVPAPPAPAPAPTTPQAPAPAPAPVRAAPAEDASSLRGRTVAMTRIRRAIGNNLKKALLEQAQLTSTVEADVTRLMRLRNRAKDGFLAREGLKLSPMPFFVKAAAQALKAHPVVNARINEDEGTITYFDSENIGIAVDTEAGLMTPVVKAAGDLTVAGLARAVHDLADRARGGHLTPDDVSGATFTISNTGSRGALFDTVIVPPNQAAILGVGATVRRPGVVRVGDEEVIGVRDLVHLSLSYDHRLVDGADAARYLTAVKALLESAAFEDDLYPDAAA

SEQ ID NO: 32416 - protein, 643 aa, Oryza sativa Japonica Group
AYVYDVDGKFSSRCNYELVDLYAVVEEDDITTLRMMIQQHRLHTQSDLARDILLNFDTLLPKFIKVYPRDYKRVLDKLKEEKAAKEAEQKAREVVDKKPVEVIQAPNGISVKTEKVMNEEPSSRPSRVSNAVKYRGFIKYEREGTSYRDPNERVKDWNEVAIELVPGPLLKTQSARCMDCGTPFCHQEGSGAGCPLGNKIPEFNELVHQNRWHEALDRLLETNNFPEFTGRVCPAPCEGSCVLGIIDNPVSIKSIECAIIDKGFEEGWMVPRPPLRRTGKRVAIVGSGPAGLAAADQLNKMGHFVTVFERADRIGGLMMYGVPNMKADKEGIVQRRVELMAKEGVQFIVNAHVGSDPLYSVEKLRSENDAIILACGATKPKDLPIPGRELAGIHFAMEFLHANTKSLLDSNLEDGNYISAQGRKVVVIGGGDTGTDCIGTSIRHGCTNLVNLELLPEPPRKRAPDNPWPQWPRIFRVDYGHQEATSKFGKDPRSYKVLTKRFIGDENGNVKALEVIRVEWGKVNGRFQFKEVEGSEEIIEADLVLLAMGFLGPEATVANKLGLEQDMRSNFKAQFGNFATNVEGVFAAGDCRRGQSLVVWAITEGRQAAAAVDNYLSKDDEGETNGTEDIAVSSEGLVQPVVA

SEQ ID NO: 32417 - protein, 547 aa, Oryza sativa Indica Group
MSASLSIQTKVMRDPMMSEADMWARVAFGNEILGEWHLGTGIWQIYFAVGDSRGRVFVFSAAGDALLELEPGVSGEPPVTALLAYLSPRRTDCFLFAGHADGSIAAHRLIESSPHGDDWLTLAAASSRLLVRGLDAAPVLHLEAHHAGRARYVLSCDSGGRIRVFTENGTLYGTAIASSTPLAFVKQRLLFLTEAGAASLDLRSMSVRETPCEGLAEALNGSLPKAYSFDPSERFKAYGFTDAGDLVHVLLLGDIASLKCRVRAIKKAEIDNPVAIQTIKGYLLVASQDKILVYNTSTQYYGRVGAPRLLFATSIKDIKSVFAGSGGVMPASPAGKPLVAADREKLVILGLGDGYIAIYRSNFPVYKPESNAVVWSGPALLFLLFLIGIWQVYVKKKDSLGWTPEETFNTSVTAPTGSILNHSTSDRAFADSSTRTGERGYVDGTTRASDRSYVDATTRATDRAYAEATRGVDLRGGALRGAPRRYVSPTRYTGAAGIPYRPVSTEPVLRTTPELKYRGPGMEPPGFPKKRDTLFSSNQTVVDDHVD

SEQ ID NO: 32418 - protein, 186 aa, Frankia sp. EAN1pec
MLTVGDVFPAYDLTGVVSSDPDTAFIQETSTSRTGQWRVVFFWPKDFTFVCPTEIAAFGRLNSEFADRDAQILGVSTDNEYVHLAWRQNHSDLRELPFPMLSDIKRELAVACGVLGDDGVAQRATFVIDPDGVIQFVMVTAGSVGRNPAEVLRVLDALQTDELCPCNWQKGEATLGAAAAPAEVAA

SEQ ID NO: 32419 - protein, 336 aa, Neisseria meningitidis Z2491
MNDNTHTLPPRRLSVAPMLDWTDRHYRYMARQITRNTWLYSEMVNAGAIVYGDKDRFLMFNEGEQPVALQLGGSDPSDLAKAAKAAEEYGYNEVNLNCGCPSPRVQKGAFGACLMNEVGLVADCLNAMQDAVGIPVTVKHRIGVDRQTEYQTVADFVGTLRDKTACKTFIVHARNAWLDGLSPKENRDVPPLKYDYVYRLKQEFPGLEIIINGGITTNEAIAGHLQHVDGVMVGREAYHNPMVMREWDRLFYGDTANPIGYADLVQRLYTYSQAQIQAGRGTILRHIVRHSLGLMHGLKGARTWRRMLSDATLLKDNDGSLILEAWKEVERANTRE

SEQ ID NO: 32420 - protein, 208 aa, Zea mays
  misc_feature (196)..(196): Xaa can be any naturally occurring amino acid
MAAPPATAPAASRCLSGAKSCWAAERSSSSFAVSAPSTGLRQSRSRVLSVRAKVATGVQRASTVDDGAKRPWKLSDARLVLEDGSVWRAKSFGASGTQVGEVVFNTSLTGYQEILTDPSYAGQFVLMTNPHIGNTGVNPDDEESNQCFLGGLIIRNLSICTSNWRCKETLEEYLTKRNIMGIYDVDTRAITRRLRXDGSLIGVLSTDQ

SEQ ID NO: 32421 - protein, 357 aa, Porphyromonas gingivalis W83
MREQRKATLILDDGSRFEGYSFGCERAVAGEVVFNTAMTGYVESLTDPSYRGQIMVMTYPLVGNYGVPMKAAEPNGVSCFMESDRIHMEGIVVSDYSHSYSHWNAVESLGDWLKREQVFGLTGIDTRALAKHLREHGSMKGKIILEGGEDIGFADPYTVNQVAEASCREVIVYGTGSKKVVLVDCGVKDNIIRSLLREDITLYRVPWDYDFHRIAYDGLFISNGPGDPNMCSVTVEHIRRAVAGDKPICGICMGNQLLAKAAGASIFKLKYGHRSHNQPVREVGTNKCYITSQNHGFAVDPASLGSDWEELYINLNDGTNEGIRHKSKPFFSAQFHPEACGGPVDTMFIFDEFLKNL

SEQ ID NO: 32422 - protein, 477 aa, Brunonia australis
PTTSSSGFSTLEKKKPGRITQIIGPVLDVAFPPGKMPNIYNALVVKGLDPLGQPINVTCEVQQLLGNNRVRTVAMSATDGLTRGMGVIDTGVPLSVPVGGATLGRIFNVLGEPVDNLGPVDTSTTSPIHRSAPAFINLDTKLSIFETGIKVVDLLAPYRRGGKIGLFGGAGVGKTVLIMELINNIAKAHGGVSVFAGVGERTREGNDLYKEMKESGVINEENFAESKVALVYGQMNEPPGARMRVGLTALTMAEYFRDVNEQDVLLFIDNIFRFVQAGSEVSALLGRMPSAVGYQPTLSTEMGSLQERITSTKKGSITSIQAVYVPADDLTDPAPATTFAHLDATTVLSRGLAAKGIYPAVDPLDSTSTMLQPLIVGDEHYEIAQQVKQTLQRYKELQDIIAILGLDELSEEDRLTVARARKIERFLSQPFFVAEVFTGSPGKYVGLAETIRGFQLIHSGELDGLPEQAFYLVGNID

SEQ ID NO: 32423 - protein, 396 aa, Arabidopsis thaliana
MSQNGKIIPNLDQNSTRLLNLTVLQRIDPYIEEILITAAHVTFYEFNIELSQWSRKDVEGSLFVVKRLLLSIFNYVYLIFNRLLKSDWILFFVSFRSTQPRFQFIVMNRRNTDNLVENLLGDFEYEVQGPYLLYRNASQEVNGIWFYNKRECEEVATLFNRILSAYSKVNQKPKASSSKSEFEELEAKPTMAVMDGPLEPSSTARDAPDDPAFVNFFSSTMNLGNTASGSASGPYQSSAIPHQPHQPHQPTIAPPVAAAAPPQIQSPPPLQSSSPLMTLFDNNPEVISSNSNIHTDLVTPSFFGPPRMMAQPHLIPGVSMPTAPPLNPNNASHQQRSYGTPVLQPFPPPTPPPSLAPAPTGPVISRDKVKEALLSLLQEDEFIDKITRTLQNALQQ

SEQ ID NO: 32424 - protein, 644 aa, Zea mays
MISARTAAASPASLWKQGGRSEGGGSCDGCRTYRNTLRRAAAAKVRALPSRAVEAVKMGSAAEMEQEEAEVAAAAAGVVVEDHYGEDSATEELPILPWAFSVASGYTLLRDPHHNKGLAFMEKERDAHHLRGLLPPAVVPQELQIKKIMHNLRQYQVPLQRYMAMMDLQERNERLFYKLLIDNVEELLPVVYTPTVGEACQKYGSIFRQPQGLYVSLRDKGKVLEVLRNWPHRNIQVICVTDGERILGLGDLGSQGMGIPVGKLALYTALGGVRPSACLPITIDVGTNNEKLLNDEFYIGLRQKRATGEEYHELMEEFMAAVKQIYGEKVLIQFEDFANHNAFNLLAKYSKSHLVFNDDIQGTASVVLAGLLAALKVVGGTLAEHTYLFLGAGEAGTGIAELIALEISKQTSAPIEECRKKIWLVDSKGLIVDSRKNSVQSFKKPWAHEHEPLTTLYDAVQSIKPTVLIGTSGVGRTFTKEVVEAMASFNERPIIFSLSNPTSHSECTAEEAYNWTQGRVIFASGSPFGPVEYDGKVFVPGQSNNAYIFPGFGLGLVISGAIRVHEDMLLAASEALAAQATQENFDKGSIFPPFTNIRKISARIAAAVAAKAYELGLATRLPPPRDLVKYAQSCMYTPVYRNYR

SEQ ID NO: 32425 - protein, 257 aa, Zea mays
MASRKFFVGGNWKCNGTGEDVKKIVTVLNQAEVPSEDVVAEVVVSPPFVFLQQVKGLLRLDFAVAAQNCWVRKGGAFTGEISAEMLVNLQVPWVILGHSERRALLGESSDFVADKVAYALTQGLKVIACIGETLEQREAGTTMDVVAAQTKAIAEKISDWTNIVLAYEPVWAIGTGKVATPAQAQEVHDGLRKWLHSNVSPAVAELTRIIYGGSVNGANCKELAAQPDVDGFLVGGASLKPEFVDIIKSATVKSSSA

SEQ ID NO: 32426 - protein, 303 aa, Streptococcus agalactiae A909
MSNIVIIGSISMDLVMETNRIAKEGETVFGQRFSMVPGGKGANQAVAIGRLSQDRDNITILGAIGEDSFGPILLDNLNKNHVTTDFVGTIPPSSGVAQITLYNNDNRIIYCPGANGKVDTKKWSQEWAIIKKADLVVLQNEIPHQANMKIANFCKEHSIKLLYNPAPSRETDIEMLDKVDYFTPNEHECQELFPNQKLEDILATYPEKLIVTLGTKGAIYSDGKESHLIPALETKAVDTTGAGDTFNGAFGYAISKKFKIANALRFATLAAHLSVQKFGAQGGMPTIKEMEDNQHYEKDWHIK

SEQ ID NO: 32427 - protein, 429 aa, Thermobifida fusca YX
MSDLLARHRAVMPAWMPLYYETPIEIVSGKGNRVVDADGNTYLDFFAGIVTNMIGYDVAEVREAVEAQLARGVVHTSTLYLLRGQVELAEKIARLSGIPDAKVFFTNSGTEANETALLLATYARRSDEVLALRNSYHGRSYGTIAVTGNRGWKNSSLSPLTVHYLHGTDRSHPAFAHLSDREYIDVCVADLRDVLSTTAPNVACLIAEPIQGVGGFVMPPDGLFAAYKEVLDEQGILFISDEVQTGWGRTGTSFWGIGNHGVTPDMMTFAKGLGNGFAIGGVVARGDLMDALPANGVSTFGGNPISTAAANATLDYVLDHDLQANAARLGPLVLERLQPLEQLPTVSAVRGRGLMFAIDMADPATGAPSAELAVAVLEETRKRGLLIGKGGLHGQTLRMAPPLTLTEEEAEEGAAILVDAVTAVNDAVA

SEQ ID NO: 32428 - protein, 284 aa, Methanococcoides burtonii DSM 6242
MIVGVLGPAGSYSEKAAKGWISKESKSEGTSLVYYDDINDTFTSVINGDSDIGIVPIENSIEGSVGITLDLLLESEITIIGEIVVPIGHCLLSKGEIKDIKIIMSHPQALGQCSKFIREHFKNAEIRTTGSTSHAAKLANEFCEMAAIASKESAREYGLKILVPNIQDWEKNHTRFIIIKQGKWKEDEACVPENDTCKTSIIADIDEDKPGSLYEIIGEFAKRDINLTRIESRPSKRSLGDYMFYIDIEGSTGDADIKDALYYINLKVSMLKVLGSYNGYKLDN

SEQ ID NO: 32429 - protein, 500 aa, Thermobifida fusca YX
MSVTHVSHWIDGKPWQGPAERRGDIYNPATGRVSGTVDFAGPAEVDAAVAAAKRAFPAWRDTSLSRRTEILFAFRELVRAHRDELARIISAEHGKVVSDALGEVSRGLEVVEFACGIPHLLKGGYSENVSTRVDAYSILQPLGVVTGITPFNFPAMVPMWMFPIAIACGNTFVLKPSEKDPSAPMRLAELWAEAGLPDGVFNVVHGGKEAVDALLTHEDVKAVSFVGSTPIARYVYATAAAHGKRVQALGGAKNHMVVLPDADLDLAADAAVSAGFGSAGERCMAISAVVAVGGIADDLVARIKQRVAQLRVGPGDDERSEMGPLVTREHRDRVASYLESGVREGATLVVDGRIHPVIGGERDGFWLGPSVLDHVTPDMACYRDEIFGPVLSILRVDTYEEAIDLINANPYGNGTAIFTNDGGAARRFQNEVEVGMVGINVPIPVPMAYYSFGGWKNSLFGDSHAHGTEGVHFYTRTKAVTVRWQDPSHGGVNLGFPTTK

SEQ ID NO: 32430 - protein, 156 aa, Zea mays
  misc_feature (78)..(78): Xaa can be any naturally occurring amino acid
  misc_feature (113)..(113): Xaa can be any naturally occurring amino acid
SYASSKRNEDNAEGHTFMRGGARQPRPRARTRERHHRREAVQETVHDELTLDGRPRVNLRAGGGRPWIGARGADKPHXDSINANYVHMDESPATTELQSRCADRMAHLSNAPXKADETAIGVGTVRTSQAIMPAGLAANRKWLARGREQGNPCDSP

SEQ ID NO: 32431 - protein, 274 aa, Arabidopsis thaliana
MTRSHRLLLLLLLIFQTAQRLTTADPNDEACLKNLRQNLEDPASNLRNWTNSVFSNPCSGFTSYLPGATCNNGRIYKLSLTNLSLRGSISPFLSNCTNLQSLDLSSNQISGVIPPEIQYLVNLAVLNLSSNHLSGEITPQLALCAYLNVIDLHDNELSGQIPQQLGLLARLSAFDVSNNKLSGQIPTYLSNRTGNFPRFNASSFIGNKGLYGYPLQEMMMKSKGLSVMAIVGIGLGSGIASLMISFTGVCLWLRITEKKIVEEEGKISQSMPDY

SEQ ID NO: 32432 - protein, 204 aa, Gibberella zeae PH-1
MSQAFVQRPAPEFTATTLFPGGEFKDIKLSDYQGQWVVLLFYPMDFTFVCPTEIIQYNNALDRFKEINTTVFGVSTDSHFTHLAWVEKPRKQGGLGPDLELPLIADKSTKISRNYGVLIEDEGIALRGLFIIDPKGVLRQITVNDLPVGRDVEETIRLVKAFQFTDEYGEVCPAGWQEGGKTMKADPKGSLEYFSAQGENGAKA

SEQ ID NO: 32433 - protein, 489 aa, Cyphia rogersii
TTSGSTLEKNKPGRIGQIIGPVLDVAFPPGKMPNIYNALVVKGRDTLGKPINMTCEVQKLLGNNRVRAVAMSATDGLMRGMEVIDTGAPLSVPVGSATLGRIFNVLGEPIDNLGPVDTRTTSPIHRSAPAFIELDTKLSIFETGIKVVDLLAPYRRGGKIGLFGGAGVGKTVLIMELINNIAKAHGGVSVFGGVGERTREGNDLYKEMKESGVINEKNFAESKVALVYGQMNEPPGARMRVGLTALTMAEYFRDVNKQNVLLFIDNIFRFVQAGSEVSALLGRMPSAVGYQPTLSTEMGSLQERITSTKKGSITSIQAVYVPADDLTDPAPATTFAHLDATTVLSRGLASKGIYPAVDPLDSTSTMLQPRIVSDEHYETAQSVKQTLQRYKELQDIITILGLDELSEEDRLTVARARKIERFLSQPFFVAEVFTGSTGKYVYLAETIRGFQLILSGELDRLPEQAFYMVGNIDEATAKAMNLQMESNLK

SEQ ID NO: 32434 - protein, 448 aa, Thermobifida fusca YX
MASEHADLPQERRLVTEIPGPRSRALQERRTAAVAQGVGSSLPVYVVRASGGIVEDVDGNRLIDFGSGIAVTNVGNANPRVVARASEQLARFTHTCFMINPYEGYVDVCEALNRITPGDHEKRSILVNSGAEAVENAVKIARHATGRQAVVVFDHAYHGRTNLTMALTARNMPYKQGFGPFAGEVYRMPMAYPFRWPTGPDNCGPEAAAQAIDLITTQIGPENVAAVLIEPIQGEGGFIVPGEGFLPALVEFCRKHGIVFIADEIQTGFARTGRLFACEHEGIVPDLITTAKGIAGGLPLAAVTGRAELMDAVHGGGLGGTYGGNPVACAAALAALETIEQDNLVERARAIGDVLLSRLRALAERYDIIGDVRGRGAMVAMELVAGAGDKTPNPEALASVVKYCHAKGLILLTAGTYGNVIRLLPPLVISDALLDEGLTIIEEAFAQL

SEQ ID NO: 32435 - protein, 215 aa, Nicotiana tabacum
MGYWQAKVVPKFKQIFDKNGPKKAAAAEACKTFDEAKEQYSKEFEEKKTELQPKVVEIYEAAAVEIKTLVKGPKVSGLKKHSTQVQKFLDELVKIEFPGSKAVSEASSNFGPSYVSGPVLFVFEKVSTFIVTEDKKEEEAAASEAEATTAAPVEVKEKEIVAEAEAKKEEEPAPAPAATPAAEVAPAEVAPAADVAPAKVEEAPAAVAAPEPPKA

SEQ ID NO: 32436 - protein, 419 aa, Pseudomonas syringae pv. tomato
MRGILLECKIPAAKVGDLCEVSKADGSFLLAEIVGFTQECTLLSALGAPDGIQVGAPIRPLGIAHRIGVDDTLLGCVLDGFGRPLLGDCLGAFAGPDDRRDTLPVIADALPPTQRPRITRSLPTGIRAIDSAILLGEGQRVGLFAGAGCGKTTLMAELARNMDCDVIVFGLIGERGRELREFLDHELDETLRARSVLVCATSDRSSMERARAAFTATAIAEAFRARGQKVLLLLDSLTRFARAQREIGIASGEPLGRGGLPPSVYTLLPRLVERAGMSENGSITALYTVLIEQDSMNDPVADEVRSLLDGHIVLSRKLAERGHYPAIDVSASISRILSNVTGRDHQRANNRLRQLLAAYKQVEMLLRLGEYQAGADPVTDCAVQLNDAINAFLRQDLREPVPLQETLDGLLRITSQLPE

SEQ ID NO: 32437 - protein, 325 aa, Vitis vinifera
MAEEKCFIAKDVTELIGKTPLVYLNNVVDGCVARIAAKLEMMEPCSSVKDRIGYSMITDAEEKGLITPGESVLIEPTSGNTGIGLAFMAAAKGYKLIITMPASMSLERRIILRAFGAELVLTDPAKGMKGAVQKAEEILAKTPNSYILQQFENPANPKIHYETTGPEIWRGTGGKVDAFVSGIGTGGTITGAGKFLKEQNSDIKLYGVEPVESAVLSGGKPGPHKIQGIGAGFIPGVLDVNLLDEVVQVSSEEAIETAKLLALKEGLLVGISSGGAAAAAIKLAKRPENAGKLIVVVFPSFGERYLSSVLFDSVKREAENMLFEP

SEQ ID NO: 32438 - protein, 198 aa, Triticum aestivum
  misc_feature (60)..(60): Xaa can be any naturally occurring amino acid
GFAVYADRFVDPALGFSLGYTYWFKYIITTPNQLTAGALVISYWLPADRVNPGVWITIFXVLIVTINVLGIKYFGEIEFWLSSIKVLVILGLILLSLIIALGGADGDVRGFRYWNNPGAFNPYKGSGSWGRFLAVWQSMVTAVFAYLGTELVGVTVGEAQNPRKNVPRAIKLTFYRICVFYICSVILLGMCVPRPRPR

SEQ ID NO: 32439 - protein, 625 aa, Staphylococcus aureus subsp. aureus Mu50
MEAYKIEHLNKSYADKTIFDNLDLSISEGEKIGLVGINGTGKSTLLKVIGGIDDDFTANVMHPNQYRIRYSSQKQDLNEDMTVFDAVLSSDTTTLRIIKQYEQAVQAYADDQSDKLFKRMIDAQDAMDQHDAWDYNAEIKTILSKLGIHDTTKYIKELSGGQQKRVVLAKTLIEQPDLLLLDEPTNHLDFESISWLINYVKQYPHTVLFVTHDRYFLNEVSTRIIELNRGKLASYPGNYESYIEMRAEREVTLQKQQQKQRALYKEELAWMRAGAKARTTKQQARINRFNDLENEVNQQYKDDKGELNLAYSRLGKQVFELEDLSKAINDKVLFEHLTEIIQKGERIGVVGPNGAGKTTLLNILSGEDQQFEGKLKTGQTVKVAYFKQTDETLDRDIRMIDYLREESEVAKEKDGTSVSITQLLERFLFPSATHGKKVYKLSGGEQKRLYLLRLLVHQPNVLLLDEPTNDLDTETLTILEDYIHTFGGTVITVSHDRYFLNKVAQSYWFIHDGQMEKIIGTFEDYESYKKSLDKNKSTLKQQSKSYTTVRKKNGLSYKEKLEYEQLMKRIEQAEVRMEEIDVLMIEASADYGKIKELNEEKEQLEIQYDLDITRWSELEEIKEQQ

SEQ ID NO: 32440 - protein, 397 aa, Oryza sativa Indica Group
MERYKIIKEVGDGTFGSVWRAINKESGEVVAIKKMKKKYYSWEECINLREVKSLRRMNHPNIVKLKEVIRENDMLFFVFEYMECNLYQLMKSRGKPFSETEVRNWCFQIFQALSHMHQRGYFHRDLKPENLLVTKELIKIADFGLAREISSEPPYTEYVSTRWYRAPEVLLQASVYNSAVDMWAMGAIIAELFSLRPLFPGSNEADEIYKICSILGTPNQRTWAEGLQLAASIRFQFPQWLCSWDPQRRPTAVEVLQHPFFQPCFYIPPSLRFRSTNGYAATPPSVGAKGAVDQKNARRYSVGPLSNGRPAVNYSYLSANTPARAAGVQRKLELDHQVNMNSCQAPEGNHKLTKAEAMNQPWSRPPPAAAAVRSNGVQTFDVTWCKIFVGELNRAYS

SEQ ID NO: 32441 - protein, 386 aa, Magnetospirillum magnetotacticum MS-1
MVMPTYARSDLAFERGEGAYLFTMDGRRFLDFASGVAVNALGHCHPRLVKALAGQAAKVWHTSNLYRVPGQESVAAKLVGQSFADTVFFCNSGAEALECCIKMARRYHFAAGNPQRTRIICAEGAFHGRTLATVAAGGQKKHLEGFAPAVDGFDHVPFGNLNALRAAITEESAAILVEPVQGEGGIVPGDPDYLRRLRATADEFGLLLIFDEVQTGMGRTGTLFAHEQAGIAPDIMGLAKGLGGGFPVGACLATAKAASGMVPGTHGSTFGGNPLAMAVADEVMTIMAEPGFLDHVRAVAQKLRTGVEEAASRFPDVIEEVRGLGLMLGFKPRMPNTDMVARLAANGLLSVGAGDNMVRLLPPLIINDAQVDEAVGILARTFGEVK

SEQ ID NO: 32442 - protein, 1419 aa, Gibberella zeae PH-1
MASPSRIPSDQPPRSSSPSSFRPRSISASVPRADLTARLASPIPSQFGTTPPVGGTPRPDAASRSDNLDDLSQLPGTGTSMQGPGQSPPRHGTPAARVSTPPIRSQSPLLGARNSGTPTNYGSFNSRSQNALGTSAPYEDPEIVKRHLVQPSDENPTSEESSIQGNTKGKQPADIGGAGLNEDEFSSLRLQGGDVTRGIYKWTEQAEARAKYNRSKSFDLGRPEPEAEVLDINSIKVPGGFRRNHLRRSVQSPGPHGHLEDGHNSPAPGQQRLFTSSFLEFLSIYGHFAGEELEEDDENLGPNEYFSSGEDSDEYNSDDEREPMEDSALLTPSRRRRKRKVRGGSGNNSPMNAALLLLKSFVGTGVLFLPRAYLNGGMLFSNLILFGVAALSYYCFVLLVKTQLKIGGSFGDLGGALYGKKMRTLILSSIVISQIGFVAAYTVFTAANLQAFVRAVSDCKSSISIQWLILIQMIIFLPFALLRDIGKLAFTALVADAFILIGLAYLLYYDILTLNQNGIADIIMFNKKDWTLFIGTAIFTFEGIGLIIPVQESMRHPEKFPRVLLIVMIIITVLFIGMGAISYAAYGSHTETVVLLNLPQDNKMVNGVQFLYSVAILLSTPLQIFPAIRIAETELFTRSGKYNPWVKWQKNVFRFFVVMLCASIAWLGADHLDKFVALVGNFACIPLVFIYPPMLHYKAIARTKFWRVADIALCIFGFVAMAYATTLTAMSWATADPKHPGYCDQKVHGVEYGPRGPRDCTQHLEWQTRPPPPPPFNTVPTCPEPTCGCAEPPKMPDDLPLDREGPLKGAIAGYAEHVLPFHNVSVLNSSFPSSTSPRPQLQTTSAYLLPSFKYIPFLPRVSFDSVEALVKGFLLPEKLHRMHDGLSPIHRDRLTRKEGYQGLLPGVQDVRDILVLICGHTGRDARCGIMAPILATEFEEKLEKEGFDVQHGPVQINLNEMQRIQGEAGEEKTSARIGMISHIGGHKFAGNVIIYLPPDLKMGSEPHPLAGHGICQLSASKARTLKTSPNPSITPTQRYASHKPNFPAPLQARIFPSLILVGIVLVSGGCYLLTPPSRPNTLNDITFVPYAITAREAISPTSFVITAVPRTPNPSLPYLNPSDSQWKNPLWSVEFKQPEVQISRHYTPLPPLSSEDPTDGTLRFYIRAVGDGEMSNYLGRRRVGDDVFLRGPHVGFELAERLGEHSRLVFLAGGTGVVPGIQAAKAVLEANEKSSVDLLWAVRKREEVQNSAFPSSSSWKFWQGKRPTALGLEVESPSPVTKRLQDLKKTYGDRLRIQVVVDEEGTRFQDKDINSTITASPGTVASFNAGCRFHDQAMHVHASEFALSEGPGCVCEPPAGTTPGKNLFIVSGPDGFIEHYAGPKIWLGGHQTQGPIAGVAGHLQRQNPALARDWLVLKM

SEQ ID NO: 32443 - protein, 405 aa, Bradyrhizobium japonicum USDA 110
MIVMTNSAAPHLLPVFARSDLGFERGEGCWLIATNGDRYLDFTSGVAVNALGHAHPALVKALQEQATKLWHMSNLFQSPDGEKLATRLCNESFADFVFFCNSGAEALEGVIKLVRHHHFSKGHPERYRIITFEGAFHGRTLATLAATGSAKYLEGFGPPMDGFDQVPHGDIEAVKKAIGPQTAGILIEPIQGEGGVRSATPAFLKALRQLCDEKGLLLAFDEVQTGMGRTGDLFAHRRTGVTPDVMSLAKALGGGFPIGAILATADAAAGMGPGSHGSTFGGNPLAIAAANAVLDVMLKPGFFDHVQKMSLLLKQKLASVIDRHGDVVSEVRGEGLLIGIKAVVPSGDLVAALRNEKLLTVGAGDNVVRFLPPLIVTEAEIEDSVGRLERACAAISSSQTKRAAS

SEQ ID NO: 32444 - protein, 489 aa, Dampiera spicigera
SGVSTLEKKKPGRIAQIIGPVLDVAFPPGQMPNIYNALVVKGRDTLGQPINVTCEVQQLLGNNRVRAVAMSATDGLTRGMDVIDTGAPLSVPVGGATLGRIFNVLGEPVDDLGPVDTSTTSPIHRSAPAFIQLDTKLSIFETGIKVVDLLAPYRRGGKIGLFGGAGVGKTVLIMELINNIAKAHGGVSVFGGVGERTREGNDLYIEMKESGVINEQNIAESKVALVYGQMNEPPGARMRVGLTALTMAEYFRDVNGQDVLLFIDNIFRFVQAGSEVSALLGRMPSAVGYQPTLSTEMGTLQERITSTKEGSITSIQAVYVPADDLTDPAPATTFAHLDATTVLSRGLASKGIYPAVDPLDSTSTMLQPRIVGEEHYETAQQVKQTLQRYKELQDIIAILGLDELSEEDRLTVARARKIERFLSQPFFVAEVFTGSPGKYVALAETIRGFQLILSGELDGLPEQAFYLVGNIDEATAKAMNLEMESNLKK

SEQ ID NO: 32445 - protein, 546 aa, Glycine max
MGFEISTVVSKLQTLSTSDHASVVSMNLFVALLCGCIVLGHLLEENRWMNESITALLIGVCTGIVILLFSGGKSSHILVFSEDLFFIYLLPPIIFNAGFQVKKKQFFVNFMTIMLFGAIGTLISCTIITLGATQIFKRLDVGPLELGDFLAIGAIFAATDSVCTLQVLNQDETPLLYSLVFGEGVVNDATSVVLFNAIQSFDLNQIDPSIAGHFLGNFLYLFIASTMLGVLTGLLSAYIIKKLYIGRHSTDREVALMMLMAYLSYMLAELSYLSGILTVFFCGIVMSHYTWHNVTESSRITTKHSFATLSFVAEIFIFLYVGMDALDIEKWKFVSDSPGTSVATSSVLLGLILLGRAAFVFPLSFLSNLAKKSPNEKISFRQQVIIWWAGLMRGAVSIALAYNQFTMSGHTSLRSNAIMITSTITVVLFSTVVFGLLTKPLIRLLLPHTPHHKESSITIITDPSTPSPKSVTIPLLGSAQESEVDIDGHDIHRPSSIRALLTTPTHTVHRLWRKFDDAFMRPVFGGRGFVPVEPGSPTERNGHQWR

SEQ ID NO: 32446 - protein, 530 aa, Prunus persica
MAEVEGEPGSSMHGVTGREQTFAFSVASPIVPTDPTAKFDLPVDSEHKAKVFKIFSLANPHMRTFHLSWISFFTCFVSTFAAAPLVPIIRDNLNLTKQDIGNAGVASVSGSIFSRLVMGAVCDLLGPRYGCAFLIMLSAPTVFCMSFVSDAGGYLAVRFMIGFSLATFVSCQYWMSTMFNSKIIGLVNGTAAGWGNMGGGATQLLMPLVFDIIGRVGATPFTAWRIAFFIPGWLHVIMGIMVLTLGQDLPDGNLAALQKKGDVAKDQFSKVLWHAITNYRTWIFVLLYGYSMGVELSIDNVIAEYFYDRFNLKLHTAGIIAAAFGMANIVARPFGGFASDRAARYFGMRGRLWTLWILQTLGGVFCIWLGRANSLPIAVFAMILFSVGAQAACGATFGVIPFISRRSLGIISGLTGAGGNFGSGLTQLVFFSSAAFSTATGLSLMGVMIVCCTLPVTLVHFPQWGSMFLPPSKDVVKSTEEFYYGAEWNEEEKQKGLHQQSLRFAENSRSERGRRVASAPTPPNTTPSHV

SEQ ID NO: 32447 - protein, 547 aa, Neisseria meningitidis Z2491
MNAFTRAWYALERHYQDTRHVLLRDRFACEPDRFERMHERLDGMLFDYSKNRLGEDTLQLLCRLAETADLEGKMRALRTGAKVNNSEGRAALHTALRLPDGAGAVYADGRDVLPEIRRELNRALKFAHSLDDGSYQGTTGKRITDFVHIGIGGSDLGPAMCVQALEPFRRHIAVHFAANADPACLDEVLCRLNPETTVFCVASKSFKTPETLLNAEAVKAWYRGAGFSESETGCHFCAVSADTEAAQSFGIAAERVFAMYDWVGGRYSVWSPVGLPVMVAVGGARFRELLAGAHAMDSHFFHTPPRRNIPVLMALIAVWYNNFQHADGQTAVPYSHNLRLLPAWLNQLDMESLGKSRASDGSPAACKTGGIVFGGEGVNCQHAYFQLLHQGTRLIPCDFIVPMTAQGVEDGRSRFTVANAFAQAEALMKGKTLDEARAELADLPEAERERLAPHKEFPGNRPSNSILLERLTPYNLGMLMAAYEHKTFVQGVIWDINPFDQWGVEYGKQLAKTIIGELEGGTSVHDASTEGLMAFYRECRLKGGGAA

SEQ ID NO: 32448 - protein, 138 aa, Oryza sativa
  misc_feature (69)..(69): Xaa can be any naturally occurring amino acid
  misc_feature (89)..(89): Xaa can be any naturally occurring amino acid
  misc_feature (101)..(101): Xaa can be any naturally occurring amino acid
NRRAAPKIRNPKSRGARSLCGSEGVEETFIMIKPEGVQRGRIGEGHRPLSRRKGFYLKAMKLINVEKSXSPEKHYADLSSKPFFGGLVXYICLRDPVVAMXWEWQRQVVSTRPHCSYGATNPPWPADAWAPLLCATFA

SEQ ID NO: 32449 - protein, 495 aa, Dialypetalum sp. Gustafsson 244
NPTTSGSGVSTLEKNKPGRIGQIIGPVLDVAFPPGKMPNIYNALVVKGRDTLGQPINVTCEVQQLLGNNRVRAVAMSATDGLMRGMEVIDTGAPLSVPVGGATLGRIFNVLGEPIDNLGPVDTRTTSPIHRSAPAFIELDTKLSIFETGIKVVDLLAPYRRGGKIGLFGGAGVGKTVLIMELINNIAKAHGGVSVFGGVGERTREGNDLYKEMRESGVINEQNFAESKVALVYGQMNEPPGARMRVGLTALTMAEYFRDVNKQDVLLFIDNIFRFVQAGSEVSALLGRMPSAVGYQPTLSTEMGSLQERITSTKKGSITSIQAVYVPADDLTDPAPATTFAHLDATTVLSRGLAAKGIYPAVDPLDSTSTMLQPRIVGDEHYETAQSVKQTLQRYKELQDIITILGLDELSEEDRLIVARARKIERFLSQPFFVAEVFTGSMGKYVGLAETIKGFQLILSGELDGLPEQAFYMVGNIDEATAKAMNLEMESNLKK

SEQ ID NO: 32450 - protein, 526 aa, Arabidopsis thaliana
MEGVAMKLPSFPNAISIGHRSFSRVRCSSSLSVCSAAAASSATISTDSESVSLGHRVRKDFRILHQEVNGSKLVYLDSAATSQKPAAVLDALQNYYEFYNSNVHRGIHYLSAKATDEFELARKKVARFINASDSREIVFTRNATEAINLVAYSWGLSNLKPGDEVILTVAEHHSCIVPWQIVSQKTGAVLKFVTLNEDEVPDINKLRELISPKTKLVAVHHVSNVLEGKYLTYVSFCLASSLPIEEIVVWAHDVGAKVLVDACQSVPHMVVDVQKLNADFLVASSHKVGIMCGPTGIGFLYGKSDLLHSMPPFLGGGEMISDVFLDHSTYAEPPSRFEAGTPAIGEAIALGAAVDYLSGIGMPKIHEYEILISCVIQVEIGKYLYEKLSSLPDVRIYGPRPSESVHRGALCSFNVEGLHPTDLATFLDQQIKQIHLDRSNVNRPPQTPTLLSHQNIHSGMKTENEYCMLQHGVAIRSGHHCAQPLHRYLGVNASARASLYFYNTKDDVDAFIVALADTVSFFNSFK

SEQ ID NO: 32451 - protein, 494 aa, Echinops bannaticus
PTTSGSGIATLDKKNLGRIAQIIGPVLDVAFPPGKMPNIYNALVVKGRDTAGQPINVTCEVQQLLGNNRVRAVAMSATDGLTRGMDVMNTGAPLSVPVGGATLGRIFNVLGEPIDNLGPVDASTTFPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYDIAQEVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEMESNSKK

SEQ ID NO: 32452 - protein, 355 aa, Hypocrea jecorina
MGGCMSSNNDEVEQKKRSQAIDKELDEDSKRLRKECKILLLGSGESGKSTIVKQMKIIHLKGYSEEELYNYRPTVFKNLVECAKAVITAMQQFDIELEKEENRAYADFLIDYQPESGPQARIDPKVGLAVQAIWSDPAKDQLMEHQTEFYLMDSAEYFFQEAMRIVAPNYLPNEMDVLRARTKTTGIYETRFQMGQLSIHMFDVGGQRSERKKWIHCFENVTSIIFCVALSEYDQVLLEESSQNRMMESLLLFDSVVNSRWFMRTSIILFLNKVDIFKQKLGRSPLSNYFPDYTGGTDVNKAAKYLLWRFNQVNRAHLNLYPHLTQATDTSNIRLVFAAVKETILNNALKDSGIL

SEQ ID NO: 32453 - protein, 421 aa, Arabidopsis thaliana
MAMSILAKIFLVFAIYCAIDPFSHSSISKFPDFKTYKIDMPPLSSLPKERDRQNLLQNSEIRFLNEVQGPESIAFDPQGRGPYTGVADGRILFWNGTRWTDFAYTSNNRSELCDPKPSLLDYLKDEDICGRPLGLRFDKKNGDLYIADAYLGIMKVGPEGGLATSVTNEADGVPLRFTNDLDIDDEGNVYFTDSSSFFQRRKFMLLIVSGEDSGRVLKYNPKTKETTTLVRNLQFPNGLSLGKDGSFFIFCEGSIGSMLFPYRFNDSARNKLQYCEQNLSHFLLLLFRLRKYWLKGEKAGTSEVVALLHGFPDNIRTNKDGDFWVAVHCHRNIFTHLMAHYPRVRKFFLKLPISVKFQYLLQVGGWPHAVAVKYSEEGKVLKVLEDSKGKVVKAVSEVEEKDGKLWMGSVLMSFIAVYDLP

SEQ ID NO: 32454 - protein, 163 aa, Triticum aestivum
NDCPGVLNIITGVFARRGYSIQSLAVGPAEKEGISRITTVVPGTDESIEKLVQQLYKLIDVHKVDDLTDLPFAERELMVIKVSGNTAARREILDIGNIFRAECVDLSDHTVTLQLTGDLDKMVALQRLLEPYGICEVARTGRAALIRESRVDSKYLRGYSLPL

SEQ ID NO: 32455 - protein, 198 aa, Zea mays
LRTRACRLIAAKSTLAARIDSIRGDPTGKAGRNLLEEIRKKIEKWQEPPPAKLPKPLPVPDFEPKKKRGGRRLRKMKERYAQTDMMKLANRMQFGIPEESSLGDGLGEGYGMLGQAGSGKLRVSAGQSKLAAKVAKKFKEKSYGSSGATSGLTSSLAFTPVQGIELSNPQVQGNLFGGGTQSTYFSETGTFSKIRRTQ

SEQ ID NO: 32456 - protein, 497 aa, Pseudomonas fluorescens Pf-5
MTTLTRADWEQRARDLKIEGRAYINGEYTASASSDTFECISPVDGRVLATIASCDAADAQRAVENARATFNSGAWSRLAPAKRKSVMIRFAGLLKQHAEELALLETLDMGKPISDSLDIDVPGAAQALSWSGEAIDKIYDEVAATPHDQLGLVTREPVGVVAAIVPWNFPLMMACWKLGPALSTGNSVILKPSEKSPLTAIRIAALAVEAGIPAGVFNVLPGYGHTVGKALALHMDVDTLVFTGSTKIAKQLLVYSGESNMKRVWLEAGGKSPNIVFADAPDLQAAAESAASAIAFNQGEVCTAGSRLLVERSIKDKFLPLVIEALKGWKPGNPLDPATNVGALVDTQQMNTVLSYIEAGHADGAKLVAGGKRTLEETGGTYVEPTIFDGVSNAMKIAQEEIFGPVLSVIAFDSVEEAIQIANDTPYGLAAAVWTANISKAHQTAKALRAGSVWVNQYDGGDMTAPFGGFKQSGNGRDKSLHAFDKYTELKATWIKL

SEQ ID NO: 32457 - protein, 519 aa, Saccharomyces cerevisiae
MFSRSTLCLKTSASSIGRLQLRYFSHLPMTVPIKLPNGLEYEQPTGLFINNKFVPSKQNKTFEVINPSTEEEICHIYEGREDDVEEAVQAADRAFSNGSWNGIDPIDRGKALYRLAELIEQDKDVIASIETLDNGKAISSSRGDVDLVINYLKSSAGFADKIDGRMIDTGRTHFSYTKRQPLGVCGQIIPWNFPLLMWAWKIAPALVTGNTVVLKTAESTPLSALYVSKYIPQAGIPPGVINIVSGFGKIVGEAITNHPKIKKVAFTGSTATGRHIYQSAAAGLKKVTLELGGKSPNIVFADAELKKAVQNIILGIYYNSGEVCCAGSRVYVEESIYDKFIEEFKAASESIKVGDPFDESTFQGAQTSQMQLNKILKYVDIGKNEGATLITGGERLGSKGYFIKPTVFGDVKEDMRIVKEEIFGPVVTVTKFKSADEVINMANDSEYGLAAGIHTSNINTALKVADRVNAGTVWINTYNDFHHAVPFGGFNASGLGREMSVDALQNYLQVKAVRAKLDE

SEQ ID NO: 32458 - protein, 549 aa, Geobacillus stearothermophilus
MLTFHRIIRKGWMFLLAFLLTALLFCPTGQPAKAAAPFNGTMMQYFEWYLPDDGTLWTKVANEANNLSSLGITALWLPPAYKGTSRSDVGYGVYDLYDLGEFNQKGAVRTKYGTKAQYLQAIQAAHAAGMQVYADVVFDHKGGADGTEWVDAVEVNPSDRNQEISGTYQIQAWTKFDFPGRGNTYSSFKWRWYHFDGVDWDESRKLSRIYKFRGIGKAWDWEVDTENGNYDYLMYADLDMDHPEVVTELKSWGKWYVNTTNIDGFRLDAVKHIKFSFFPDWLSDVRSQTGKPLFTVGEYWSYDINKLHNYIMKTNGTMSLFDAPLHNKFYTASKSGGTFDMRTLMTNTLMKDQPTLAVTFVDNHDTEPGQALQSWVDPWFKPLAYAFILTRQEGYPCVFYGDYYGIPQYNIPSLKSKIDPLLIARRDYAYGTQHDYLDHSDIIGWTREGVTEKPGSGLAALITDGPGGSKWMYVGKQHAGKVFYDLTGNRSDTVTINSDGWGEFKVNGGSVSVWVPRKTTVSTIAWSITTRPWTDEFVRWTEPRLVAWP

SEQ ID NO: 32459 - protein, 454 aa, Saccharomyces cerevisiae
MSEPEFQQAYEEVVSSLEDSTLFEQHPEYRKVLPIVSVPERIIQFRVTWENDKGEQEVAQGYRVQYNSAKGPYKGGLRFHPSVNLSILKFLGFEQIFKNSLTGLDMGGGKGGLCVDLKGRSNNEIRRICYAFMRELSRHIGQDTDVPAGDIGVGGREIGYLFGAYRSYKNSWEGVLTGKGLNWGGSLIRPEATGYGLVYYTQAMIDYATNGKESFEGKRVTISGSGNVAQYAALKVIELGGTVVSLSDSKGCIISETGITSEQVADISSAKVNFKSLEQIVNEYSTFSENKVQYIAGARPWTHVQKVDIALPCATQNEVSGEEAKALVAQGVKFIAEGSNMGSTPEAIAVFETARSTATGPSEAVWYGPPKAANLGGVAVSGLEMAQNSQRITWTSERVDQELKRIMINCFNECIDYAKKYTKDGKVLPSLVKGANIASFIKVSDAMFDQGDVF

SEQ ID NO: 32460 - protein, 274 aa, Lactobacillus reuteri
NLWSHGGFFTGGWSGFFFSMSIIVGSYEGIELLGISAGEVANPQKAIVKSVKSVLFRILIFYVGAIFVIVTIYPWNELSSVGSPFVSTFAKVGITAAASIINFVVLTAALSGANSGIYSSSRMLFKLSHEGDAPKIFGRLSKRIVPDAAILGISGGILIGFIIDMISATYSHSTADMFVVVFSSSVLPGMIPWFVILLAELRFRRNNKDLMVDHPFKLPLYPFSNYFAFLMLIVIVIFMFINPDTRISVIVGAAVLILAVTVYLVRHGFKNEKA

SEQ ID NO: 32461 - protein, 77 aa, Zea mays
ARGRWVVARAVEAGISTPGMTASLSYFDTYRSSRLPANLIQAQRDLFGAHTYERIDCPGSFHTEWTKLARRSNGAAI

SEQ ID NO: 32462 - protein, 665 aa, Ostreococcus tauri
MSASRGRSIVVNVATPSGKGQAEPKRSKVEIIKERSDYLRHPLIEELATTASSISEDAAQLYKFHGGYQQDDREKRAFGEGKFYQFMMRTKQPGGKVPNKLYLTMDDLAMTHGNGTLRLTTRQTYQLHGILKSDLKETFSTVIRNMGSTLGACGDINRNVTAAPAPYAKREEYHIAQELADDIAALLAPQSGAYYDVWLDGEQIMTAEKPEVTAARNENRNGTNFEDCPEPIYGQLFLPRKFKIGVTVEGDNHIDVLTNDIAIVVVMRDGKHVGYNVYVGGGMGRSHRNDATFPRAATLLGFCGPRDILYAVKAIVCTQRDYGRRDDRKQSRLKYLVESWGMERFKTVTEGYYGKKFEPGMELAPFEFPTYLGWNEQGDGKLWYGVHVQNGRLRGEMKKALRNVIERYELPVRLTANQDLLLTDVDPAWKADIMATLKAAGVKDVTEVDALERLSMACPALPLCGLAITEAERGLPEINKRLRGVMTKVGLATSEDILIRMTGCPNGCARPYMAELGFVGDGPASYQIWLGGTRAMTGVAEAFADRVKVADMETFFEPIFAMWAQQRQDKEYFGDFVNRVGFDAVRAFSKSYVPAPTAAAAPAAAAASPAAAAASPAAVETGGRLPRVMIERDAFEALQVYAEKKNTTLTQATTDAIMKMIADDK

SEQ ID NO: 32463 - protein, 455 aa, Candida albicans SC5314
MLRTYSKSLLKTSTTIKKSFSFNTATLSLPTYKKYSTSVPDANDESHTGKFINSISKPYSVTTYARPNLVLTHGKGSYIYDLEDRKYIDFTSGIAVTCLGHSYEPITQLIKDQSEKLIHCSNLYYNLPAGELSNKLIVKTKEFDGMKDASRVFLCNSGTEANEAALKFARKYGKSINPEKYEFITFENSFHGRSMGALSVTPNPKYQEPFSPLIPGVKIAKPNDIESVKQVINKDKTCAVIIEPLQGEGGVNIIDESFLIELRKLCDENNVLLIYDEIQCGLGRTGKLWAHSWLSPEAHPDIVTIAKALGNGFPIGATMITEKVEKSLNVGDHGTTYGGNPLASTVGSYIVDHIGDKEFLQQVENKSQIFLEGLNKIAEENPNLIEKVKGKGLLLGLQFKENVDIGEIVAKCRQHGLLIITAGMNTIRLVPALNIPDQTIKDGLEILTQSIKEVN

SEQ ID NO: 32464 - protein, 301 aa, Pseudomonas fluorescens Pf-5
MTIERDAAANTAKVLSEALPYIRRYVGKTLVIKYGGNAMESEELKTGFARDIVLMKAVGINPVVVHGGGPQIGDLLKRLSIESHFVDGMRVTDAQTMDVVEMVLGGQVNKDIVNLINRHGGSAIGLTGKDAELIRAKKLTVTRQTPEMTTPEIIDIGHVGEVVGINTDLLNLLVKGDFIPVIAPIGVGANGESYNINADLVAGKVAEALKAEKLMLLTNIAGLMDKSGKVLTGLSTQQVDELIADGTIYGGMLPKIRCALEAVQGGVGSSLIIDGRVPNAILLEIFTDTGVGTLISNRKRP

SEQ ID NO: 32465 - protein, 88 aa, Synechococcus sp. CC9605
MPDGVKHFVCPDDEYVLEAAEQAGIDMSYSCRAGACSTCVGKIIEGTVDQSDQSFLDDEQMEDDYTLLCVAYATSNLIVKTDCEEELW

SEQ ID NO: 32466 - protein, 307 aa, Bradyrhizobium japonicum USDA 110
MSKSPKHFLDINELPLSELKSMLDASSAMKAKQKAHQPVRPLEGKTLAMIFERPSTRTRVSFDVAMRQLGGEPIMLTGAEMQLGRGETIADTARVLSRYVDAIMIRILNHDALLELAANATVPVINGLTRRSHPCQVMADLLTYQEHRGPIEGRTVAWTGDDNNVLASWAHAAERFKFQLNVATPPELAPKKAMRDWIKASGAPIMLGTDPEAAVRGADCVVTDTWVSMGDKEGEHRHNVLKPYQVNAKLMSLAKPDALFMHCLPAHRGEEVTDEVIDGPQSVVFDEAENRLHAQKGILAWCFDAVK

SEQ ID NO: 32467 - protein, 463 aa, Zea mays
MATYDKAIESYKKAVTTAASLAASAMLVRGVVNELVPYEVRDLLFSGLGYLRSRMSSRHTVVIEETEGWTSNQLYDAARTYLATRINTDMQRLRVSRVDEGKSLMFSMEEGEEMADVHAGAEFRWRLVCRDGAGNGAGNGAGNGHGHGHARGGSYRVEVRSFEMSFHRRHKEKAIASYLPHILAEAKKIKDQDRTLKIYMNEGESWFAIDLHHPSTFTTLAMDRKMKRAVMDDLERFVRRKEYYRRIGKAWKRGYLLYGPPGTGKSSLIAAMANYLKFDVYDLELTEVNWNSTLRRLLIGMTNRSILVIEDIDCSLDLQQRADEAQDAGTKSNPSEDKVTLSGLLNFVDGLWSTSGEERIIIFTTNYKERLDPALLRPGRMDMHIHMGYCCPESFRILASNYHSITDHDTYPEIEALITEVMVTPAEVAEVLMRNEDPDVALEGLIQFLNGKKDHAKDDSRQG

SEQ ID NO: 32468 - protein, 80 aa, Synechococcus sp. WH 5701
MSQEAIFEKVRSIVAEQLSVDAAEVKPESNFQNDLGADSLDTVELVMALEEAFDIEIPDESAEGITTVGDAVKYILDKQA

SEQ ID NO: 32469 - protein, 405 aa, Rubrobacter xylanophilus DSM 9941
MVYFWPAAEENRPLGGLYPVRKADATPLRLNPVLERQGEYPLLRLDERRERLKEQGVRLFDFGAGDPREPTDPRIRRALLEAVPEVSQYPSASGTRALREAFCGWMERRHGVELDPDAEVLPASGSKEAIFHAHLPFLHHTHERRGVAYGTPGYPVYERGALFAGGEALPVRLVREDGFLLPLEAVDPQRTRILWLNYPHNPTGARAPRSYLEEAAAFCREHDILLFSDECYNEIYSGDPPPSVLEVSRERTLAFCSLSKRSGMTGYRSAMMAGDAELISALGKLRPSVGVASPSFVQAAAAAAWSDDEHVEERRRTFARKRGLFVEFFRRAGLDFLPTDATFYLWVAVPGGDDEAYALRLLEEGIVVAPGRSFGPGGEGYVRVALVPSLEECEEAVRRWEALAA

SEQ ID NO: 32470 - protein, 339 aa, Kineococcus radiotolerans SRS30216
MPTQRMPAEWEPHQRTWMAFPTPNPTFGEAGGPDLTRARAAWSTVANTVARYEPVTVLVSPADRTAAREALDPRIEVVEVPLDDAWLRDSGPTFVRGAQGPVAVDWTFNGWGAQSWSRWEDDARVARFVAGRTGTPVSSSPLTQEGGGFHVDGAGTVLLTDTVQLDPGRNPGWTREQVEAEVHAQLGTTTAIWLPRGLTADYGEFGTRGHVDIVAAFTPSGAVLVHTQPDPGHPDHAVTQEVTEVLRGARDARGERLEVVELLAPERHEVDGELVDHSYVNHYVANSVVVLCAFDDPRDARARAVLAAAYPDRAVVPVDARDVFAFGGGIHCITQQQPA

SEQ ID NO: 32471 - protein, 318 aa, Rubrobacter xylanophilus DSM 9941
MEASGALEVVTLGEALIVMDPVERGPLRHVPGFRKRVGGAELNVAVALARLGHRAGWAGSVGDDEFGREVLGFLRAEGVDVSGAVLDPGAPTGLYFKEWRAGGLRAHYYRAGSAASRMAPGRLDEGFLLSGRVLHLTGITPALSGGCEELVRRLAGEAGRRGVLLSFDANIRWRLFGERDPRKAIEPLLPLADLLFLSDEEAELLLGGSDPRSVERARGRLGAGVVVVHSASGSFAAGGEGVVRREGYRVEAVDTVGAGDAFVGGFLAGFLRGWETGACLELANACGACAVAVPGDAASMPAEEEALALLRGRRERER

SEQ ID NO: 32472 - protein, 281 aa, Rubrobacter xylanophilus DSM 9941
MRRPGGGLEEMFSLDGRVAVVTGGTGVLGGAVAAGLARAGARVGVLGRRRGRAEEVAAGLGAEGAEALALRADVLDEGQLRRAREELLGRWGRLDILVNAAGGNVPGAVLGSGEDVFRGLRVGAFREALDLNLLGTVLPSLVFGEAMASGGRAEGCIVNVSSMAALRPLTRVAGYSAAKAAVENFTRWLAVELSRRYGPGMRVNAVAPGFFLGEQNRGLLIGEDGNLTPRGRAVIEHTPMGRFGKPEELAGAVVWLCGPGASFVTGAVVPVDGGFSAFGGV

SEQ ID NO: 32473 - protein, 478 aa, Kineococcus radiotolerans SRS30216
MKQFQNVIAGASRDAADGATSEVVNPATGQVYATAPVSSAADVDAAYTAASDAFTSWRRTTPADRQKFLLDLADAVEDRAEEFIAAEVENTGKPVGLTRSEELPPAVDQLRFFAGAARVLEGRAAGEYLAGHTSWVRREPIGVVGQVTPWNYPFMMAIWKIGPALAAGNTIVLKPSDTTPASTVLLAQVANEVLPPGVLNVVCGDRGTGRALVEHPTPQLVAITGSIRAGMQVAGSAAKDVKRVHLELGGKAPVVVFDDADVAAAAEAIAGAGYFNAGQDCTAATRVLVAPRLHDDFVAALSEQARATKVGLPDDDDAALGPVNNVNQLAHVSGFVDRLPDHAVLGAGGSRSAGQLASGFYYEPTVVSGLRQDDEAVQEEIFGPVITVQRFTDEDEAVRWANGTKYGLASSVWTKDFGRAMRVSAALDFGCVWINTHIPLVAEMPHGGFKQSGYGKDLSMYGFEDYTRVKHVMANLDS

SEQ ID NO: 32474 - protein, 507 aa, Yersinia pestis
SGKHSAETHHAAKKRWLDSHDTGYHKSMGLRHIQMIAIGGSIGTGLFLGTGARLQMAGPALALVYLVCGIFSFFILRALGELVLHRPTSGSFVSYAREFLGEKASYVAGWMYFLNWAMTGIVDITAVALYMHYWGTFSDVPQWLFALGALSIVATMNMIGVRWFAEMEFWFALIKVAAIALFLIVGVIFLGTGQSVAGHTTGIHLITDNGGFFPHGLLPALIMVQGVIFAFAGIELIGTAAGECKDPEKMLPKAINSVIWRIGLFYVGSVVLLVCLLPWHAYQAGQSPFVTFFSNLGVPYIGTIMNIVVLSAALSSLNSGLYSTGRILRSLSMGGSAPKFMSKMSPQSVPYAGILVTVGIYVLGVLLNYLVPSQVFEIVLNIASLGIISSWAFIIICQMKLRQAIKRGMAKPVSFKMPGAPVTSWLTLIFLAGVLVMMAFDYPNGTWTIASIPVLTLLLIAGWFSLRKRANEVAAAPIDVWSQEILFEEPDAQNVSPKELYEQKSVG

SEQ ID NO: 32475 - protein, 480 aa, Zea mays
MVKICCIGAGYVGGPTMAVIALKCPDIEVVVVDISKPRIEAWNSDTLPIYEPGLDDVVKQCRGRNLFFSTDVEKHVAEADIIFVSVNTPTKTRGLGAGKAADLTYWESAARMIADVSKSDKIVVEKSTVPVKTAEAIEKILTHNSKGINYQILSNPEFLAEGTAIEDLFKPDRVLIGGRETPEGRKAVQALKDVYAHWVPEDRILTTNLWSAELSKLAANAFLAQRISSVNAISALCEATGANVSEVAYAVGKDTRIGPKFLNASVGFGGSCFQKDILNLVYICECNGLPEVANYWKQVIKINDYQKSRFVNRVVASMFNTVAGKKIAVLGFAFKKDTGDTRETPAIDVCKGLLGDKAQISIYDPQVTEDQIQRDLAMNKFDWDHPMHLQPTSPTAIKQVSCVWDAYEATKGAHGVCILTEWDEFKTLDYQKIFDNMQKPAFVFDGRNIVDPEKLREIGFIVYSIGKPLDAWLKDMPAVA

SEQ ID NO: 32476 - protein, 549 aa, Oryza sativa Japonica Group
MRRTTNDAGPISPWIYANRHLVQMGRKERLVSRVLALDFLRSAGVSDPAGELEAVELPSSLEVLQERLDFLLRLGLSTDDLSAYPLLLACSLRKNAIPVLSYLEKLGVTRARLAAFVRAYPACLHASVAVDLTPVVKSLRGLDVDRQDLPRVLERYPDILGLKPDGTISTSVAYLVGIVGVAPRDIGPMVTHFPFFLGMRVGTTIKPLCEYITSLGLPMRILARILEKRPYILGYDLEETVKPNVEALLSFGIRKEMLPLVIAQYPPILGLPLKTKLAAQQYFFNLKLQIDPDAFACAIEKLPQLVSLHQNIILKLVEFLRGRGISNEDVARMVVRCPQILLLRMELMKNSLYFFKSEMKRPISELLDYPEYFTYSLESRIKPRYMRVSTKGIRCSLDWFLNCSDQRFEERMRGDFIEGDAPGPSFTMGGKLQMPGSQLVSDDDNAESDDEIWWRIIPKIFRDVLLTASCTQAIPSLSVNSCLVICICKLKFANHAGILNCKMKKALALMEHSHTNRGHWSAGLSNSSKGLTKVLYRTLLKKNSNNSPS

SEQ ID NO: 32477 - protein, 425 aa, Prunus persica
MAPEPEDIKDEKNPRPLDEDDIALLKTYGLGPYSTHIKKAEKEVKDLAKKVNDLCGIKESDTGLAAPSQWDLVSDKQMMQEEQPLQVARCTKIINPNSEDAKYVINVKQIAKFVVGLGDKVSPTDIEEGMRVGVDRNKYQIQIPLPPKIDPSVTMMTVEEKPDVTYNDVGGCKEQIEKMREVVELPMLHPEKFVKLGIDPPKGVLCYGPPGTGKTLLARAVANRTDACFIRVIGSELVQKYVGEGARMVRELFQMARSKKACIVFFDEVDAIGGARFDDGVGGDNEVQRTMLEIVNQLDGFDARGNIKVLMATNRPDTLDPALLRPGRLDRKVEFGLPDLESRTQIFKIHTRTMNCERDIRFELLARLCPNSTGADIRSVCTEAGMYAIRARRKTVTEKDFLDAVNKVIKGYQKFSATPKYMVYN

SEQ ID NO: 32478 - protein, 177 aa, Ostreococcus tauri
MRVRARGIDRPPIEVGETLPGEASVAYVDDDGALVRARAGDLWAKRRVVVFAVPGAFTPTCSNKHLPGYVRLAEEFRARGVDDVMCVSVNDAFVMNAWGETAGARKARVRMVADGSATLARAMGTDLDLSEQGMGTRSRRFAMIAYDGVVEYLAMENGTKYETSGADEVLEHLKKSR

SEQ ID NO: 32479 - protein, 1484 aa, Candida albicans SC5314
MSDIPPTNESNSDSTLINQNNNGNNDNKETGKDISSTHTHHRVTFAEQQPISTSSRKSSLLRKHSSNNTSSDSDKRPSIISRNSNPDIHRDSLPPLNRGPSYNGNYTRSHSSRNVNANNTINTGVTSDSNSNNNVDSNAPISSPATPAISSPPANSKYFNLTLPAGKSREKSPGRHSKEGHTRSRSFTKQQHGIGSTSSQSSSQYLAQEKAYLRKMRNQSVDDYYSKGIPGAHEVSKADDNDDEDDDDDEEHSSFDGGDNANLLAAIDDDKYQIDYSMALSLMKNSNVNLRKIANLNTDDTDDPAIIERLEWQSMLTSVLTGDVVRSEKTKIININNPDSTQESYLHATFKENLWFGIRAKIFNRTEDEQRKIVAYRRTLVDQLIDDVMKFEIDYENSTDNPIRDQVKTILDRYDQACSLWKTLEDMYSDKPACRSEEFQNRIDALTAWLTITDAISRETKSLRLWIGNDELDITKSPVEVSSSNAATSTSKIVKKIFDEDNKSLAERLMKEKDVQTIFRKRIFKPIAPWMIKSKDTYIRLGVIFENMKLPDYLHDLLQICIIPVRLIKEIVIVRLGYAMKLQNPTLMMIDQMLDDFKSYITVALEVKSGISEYKEPDEDRKWLISDLFDSELEDFDNVILRCVRYFLVLLNRKLLDSSRSPTTFRTFKEPEELEEAWNFLKPLGHYVDGGSVVVAEEITMLASRLIHRLMAYFNHQIREPTYNGVPQDLIRWYSSTSENFGQLRRKLARFMGEISRDFKNSVVFDIPSQSNCTKTLLEILRSSNHFLVYTGTVETQGTYFFASPELLGNEQEILKILTGSCVGLDPSTDNSHFTDLLHLIRSGSEEHLRYNDDDLDSYDDSNGAYAYVLALCPMKPIVWDGLVVNVDIDSVPITDMKNGELLLVSKLSYYDLHIVRNRFLEVASEVSLGNAGLKQVEYRCSLAKVNQELKKMNRVVFKMCSSVLESVQVIKTRIAELDPVGEYQALINSYFIYARDYGKNSVRTLDPQRKSTIIMKMIQLSIDWVSFICDDCIPTDRKTFRWCVLALEFSMEMIRGINIFLLTEEQFTKLKVKVARCMSLLISHFDIMGARSSEAEKNKLLKWTAQRHNIASSQNDDEYLNKVYHEEVMGQINKIEERRRNLQEEFQSIGRVLDVSDSEYQFLTLLASSFSSVSIRWQKGACIGRGTFGQVFSAVNLDTGGVMAVKEITFHDSQSVKTIVPSIKEEMTVLEMLNHPNVVQYFGVEVHRDKVYIFMEFCEGGSLAGLLTHGRIEDEMVIQVYALQMLEGLAYLHQSGVVHRDIKPENVLLDHNGVIKYVDFGAAKVIASNGRTIGGMTNSSLRKSVKRDGHNNLNSMTGTPMYMSPEAITGTSTDRSGVVDIWSLGCCVLEMATGRRPWANLDNEWAIMYHIAAGHKPQLPSPEQLSEPGRTFLARCLEHDPTKRPSAVELLADPWMVEIRHMAFGNSDVTTTPLSEVAGPVSE

SEQ ID NO: 32480 - protein, 285 aa, Pseudomonas fluorescens Pf-5
MSSPSVLIAGCGDVGSRLATQLLAEQWQVYGLRRNVSRLPQGVVGIAGDLFSEQCPGQWPQKSPDYLVYCAAATEHDEAGYRAAYVDGLQHVLGWLKQRGQAPKRLLFVSSSSVYEQKDGEWVDETSVAEAQAYSGRMMLEAEQVALGSGIPATVVRLTGIYGPGREWLLTQVRRGYRVAIEPPLYGNRIHADDAAGLLAFLIKADRSGTALDDCYIGVDDAPAPLAEVVDWLRDYLGVTEWADDASVRRTGSKRCSNARARALGWVPRYPSYREGYAAILTTQG

SEQ ID NO: 32481 - protein, 557 aa, Streptococcus pyogenes SSI-1
MMYQALYRKYRSQTFDEMVGQSVISTTLKQAVESGKISHAYLFSGPRGTGKTSAAKIFAKAMNCPNQVDGEPCNQCDICRDITNGSLEDVIEIDAASNNGVDEIRDIRDKSTYAPSRATYKVYIIDEVHMLSTGAFNALLKTLEEPTENVVFILATTELHKIPATILSRVQRFEFKAIKQKAIREHLAWVLDKEGIAYEVDALNLIARRAEGGMRDALSILDQALSLSPDNQVTIAIAEEITGSISMLALGDYVRYVSQEQATQALAALETIYDSGKSMSRFATDLLTYLRDLLVVKAGGDNQRQSAVFDTNLSLSIDRIFQMITVVTSHLSEIKKGTHPRIYAEMMTIQLAQKEQILSQANLSGELISEIETLKNELAQLKQQLSQLQSRPDSLARSDKTKPKTASYRVDRVTILKIMEETVRNSQQSRQYLDALKNAWNEILDNISAQDRALLMGSEPVLANSENAILAFEAAFNAEQVMSRNNLNDMFGNIMSKAAGFSPNILAVPRTDFQHIRKEFAQQMKSQKDSVQEEQEVALDIPEGFDFLLDKINTIDD

SEQ ID NO: 32482 - protein, 264 aa, Edwardsiella tarda
SLSGRVLDGSARPLDGLQPPDESDHGGLSSQPFNPLQRTPITQVLDVGVRAINALLTVGRGQRMGLFAGSGVGKSVLLGMMARYTQADVIVVGLIGERGREVKDFIENILGEEGRQRSVVIAAPADVSPLLRMQGAAYATRIAEDFRDRGQHVLLIMDSLTRYAMAQREIALAIGEPPATKGYPPYVFAKLPALVERAGNGISGGGSITAFYTVLTEGDDQQDPIADSARAILDGHVVLSRRLAEAGHYPAIDIEASISRAMTS

SEQ ID NO: 32483 - protein, 437 aa, Saccharomyces cerevisiae
MSITKVHARTVYDSRGNPTVEVEITTENGLFRAIVPSGASTGIHEAVELRDGNKSEWMGKGVTKAVSNVNSIIGPALIKSELCVTNQKGIDELMISLDGTSNKSRLGANAILGVSLCVARAAAAQKGITLYKYIAELADARQDPFVIPVPFFNVLNGGAHAGGSLAMQEFKIAPVGAQSFAEAMRMGSEVYHHLKILAKEQYGPSAGNVGDEGGVAPDIDTAEDALDMIVEAINICGYEGRVKVGIDSAPSVFYKDGKYDLNFKEPNSDPSHWLSPAQLAEYYHSLLKKYPIISLEDPYAEDDWSSWSAFLKTVNVQIIADDLTCTNKTRIARAIEEKCANTLLLKLNQIGTLTESIEAANQAFDAGWGVMISHRSGETEDPFIADLVVGLRCGQIKSGALSRSERLAKYNELLRIEEELGDDCIYAGHRFHDGNKL

SEQ ID NO: 32484 - protein, 113 aa, Magnetospirillum magnetotacticum MS-1
MAPSASLREAASLLLEKNIGALICSDRAGGIVGILSERDISRSFARLGADIISMSVSDAMTRDVIACSADDGVAEILEIMTETRCRHIPVVGDGELLGLVSIGDLVKALKEEG

SEQ ID NO: 32485 - protein, 372 aa, Ostreococcus tauri
MSSYLSGWFSSAPTEGADGAEVDPSKLFHEFPHPEDWRTIAETLLERFGEDGDEIPRAMCPLGDKRATARRFLVARKYSIDDAESALREAIAWRKNVKVGDRVGVEAILSGEPRWDLLAENRKIMTGTPFLCHTKQGFPVYLLRIGKGDAALATTASEETHIYSTIVRGEHLVNVLIPEATKRSKKLVADGVEQEAASVDYDGLIDKQVVIIDLEGVGMSALRCLFVLKTINSVASKNYPELSKAIYVVNAPSAFDYLWSAVKPLLAAHTQHKIKIYSQPEEQYAALQKLLEDADIPDFLVPAGRAAGAKDTVTTTDGFLPETVKAVDEWLKGLGGEETIEEEKTGEEVSATIEKMSTISIQEDYAAAEAEA

SEQ ID NO: 32486 - protein, 146 aa, Magnetospirillum magnetotacticum MS-1
MIVKTILKSKARGGGIVSVTPDASIGDAARLLAQHKIGAVLVMTGDRVAGILSERDIVRGLADAMDVCVTAKVRDLMTAEVFVCHEDDTVERLMEIMTAKRIRHLPVMDSSGEVTGMVTIGDVVKSRLDETKMEAESLRDYVMAGR

SEQ ID NO: 32487 - protein, 482 aa, Pseudonemacladus oppositifolius
INPTTSGSGVSTLEKNKPGRIGQIIGPVLDVAFPPGKMPNIYNALVVKGRDTLGQPINVTCEVQQLLGNNRVRAVAMSATDGLMRGMEVIDTGAPLSVPVGGATLGRIFNVLGEPIDNLGPVDTRTTAPIHRSAPAFIELDTKLSIFETGIKVVDLLAPYRRGGKIGLFGGAGVGKTVLIMELINNIAKAHGGVSVFGGVGERTREGNDLYKEMKDSGVIKEQNFAESKVALVYGQMNEPPGARMRVGLTALTMAEYFRDVNKQDVLLFIDNIFRFVQAGSEVSALLGRMPSAVGYQPTLSTEMGSLQERITSTKKGSITSIQAVYVPADDLTDPAPATTFAHLDATTVLSRGLAAKGIYPAVDPLDSTSTMLQPRIVSDEHYETAQSVKQTLQRYKELQDIITILGLDELSEEDRLTVARARKIERFLSKPFCVAEVFTGSTGKYVDLAETIRGFQLILSGELDGLPEQAFYLVGNIDEAT

SEQ ID NO: 32488 - protein, 211 aa, Prochlorococcus marinus str. MIT 9312
MNPSNYLKIKNKIPSNVNILAVSKGFKSQEIKTIQNIGQNDFGESKFQEAFEKQLILKDLKKIKWHFIGRIQSNKIRKIVQNFKYIHSVDSFEKLQKISNISDAEKKNPLIMLQVKLSDDPTKGGFNPDLLVLKWREIQELKNITLTGLMTINPKGLSSKENTKLFKKCRSLADSLQLPDCSMGMSGDWEEAIDAGSTWVRLGSLIFGDRS

SEQ ID NO: 32489 - protein, 456 aa, Methanococcoides burtonii DSM 6242
MSENSNEVDLVKSLRPYHVWALGVGIVLVGEYMGWNFTVAKGGILGSLFALLVAGTMYVMVSLCASELGSSTKLAGGPYDWARLFVGPGAAAIVGLAVYMEYIALEAADAIVVASIAQSIFPEIQTFPVTLLVIAALTFMNYRGVVAALNLNFALTFTALIAIIAFFFMNISGIGGTWHPEYLISGAIPNGFIGIFAALQFGPWFYLGIEGAAMCAEECKHPTRAIPLGQQAGMITLLLGSGMTLYVCSGLIPTAELGVSVYPLFEAANRSGVKFLIAFLAVGTLFTCLASANGTVCDSSRSWFALSRDHFLTNWFAAVHTKYSTPYRAVIFTMPIAVAFAYSGFLDQVITFSITSGLVCYVMIPFSLIRFRKMFPEHTQKVRPFVGPLQPYLAYFTILLAIVIMSTLNWGYSYNLIFGLVFYVVAYFYFSWRYRSIDAKHDWGEDLGWPEPAHKR

SEQ ID NO: 32490 - protein, 270 aa, Prochlorococcus marinus str. MIT 9312
MTDKIAIIGFGNIANAIITPLFDKNLIQPERVYCVVNSEKSLENIKKNYKYNINVYKSGSKESEIIWDCQFKLLSIKPQHLKDITEGDIIKNKNNLLVSILAGVSINKLHQKFPNHKCVRVVTNIPITVGKGLTGIAWGENLTEDQKEFTKKLFENTSKIYEFTEEYLDIFLALTSSGPAIIALIIESLSDGGLSGGLPKILSEELVMEMIIGTISLIKEKKLTTSELKNLVTSPGGTTISALRVLEKKGVRSALIESIVSASNRSKEFS

SEQ ID NO: 32491 - protein, 630 aa, Zea mays
MGREKISSLQLYLVVVGGAAAFLSDVRGSTGTRSGLRVPVRRDRGPKVPARYGAGREVVGGHQTRAVGLGISRVMECGRLVDKEANASTSKRVRGWDNTAWLVDGSRLGVGRSGQQKAGRKDWRVETEAAGGRRDSAAEPHINCVINSTFSAFVGIYLREEETIQFIMSGGSSESSPLSGQNSLSSLSISKDNELSSESGCLSIVVLGASGDLAKKKTFPALFHLFQQGFLQSGEVHIFGYARSNLSDDGLRERIRGYLKGASDEHLSQFLQLVKYVSGSYDRVEGFELLNKAISEYETSKNNDSGSYRRLFYLALPPSVYPSVCKMIRSYCMSPSSHTGWTRVIVEKPFGKDLNTAEELSAELGQLFQEEQLYRIDHYLGKELVQNLLVLRFANRLFLPLWNRDNIANVQIVFKEDFGTEGRGGYFDQYGIIRDIIQNHLLQVFCLVAMEKPVSLKPEHIRDEKVKVLQSVEPIKHEEVVIGQYDGYKDDPTVPDDSNTPTFASVVLRVHNERWEGVPFILKAGKALNSRKAEIRVQFKDAPGDIFRCKKQGRNEFVIRLQPSEAMYMKLTAAWEIFTPLLHDIDGGKLRSVPYKPGTRGPQEADELSRRMGYVQTHGYVWVPPTLSKV

SEQ ID NO: 32492 - protein, 188 aa, Burkholderia sp. 383
MPHSSSGAPLDPVAFIHSQIRTVPDWPQPGVMFRDITTLLQSPKALRILVDLFVERYVDAKLDYVAGLDARGFIIAPIVAYELSVGFVPIRKVGKLPYKTRSESYDLEYGSATVEIHEDACRPGDRVIIMDDLIATGGTMMAGRNLLQRLGAEVVEGAAIIDLPDLGGSALLRNAGLPVYTVTEFAGH

SEQ ID NO: 32493 - protein, 668 aa, Burkholderia sp. 383
MISPLEMTLLLLLASVVGVVVFRSLNLPPMLGYLTVGILVGPHAFGIAADLERAEHLAEFGVVFLMFSIGLEFSLAKLRAMQRLVFGLGLLQVVATLVLALVLGMLFEHWVHITWQGSIALGGALAMSSTAIVSKMLAERLEIETEHGRNIFGVLLFQDLAVVPLLIVIAAFGAESSKDLAITLGFAAVKIVIALTLLLVIGQRFMTRWLNVVARRRSQELFVLNLLLVTLGAAFITDRFGLSLALGAFIAGMLISETPFRHQVEEDIKPFRDVLLGLFFVTTGMLLDPRVIWEHPFLVLGFFVGQILFKGTMIAGLARLFGATPGVAMRTGIGLAQAGEFGFVLLNLILDRHLVDSTLLQAILASMLLSMLAAPFLIQNADRIVMRLSSTEWMQQSLQMTRIATQSLKQRGHVIICGYGRAGQNLARMLEQEGIPYVALDLDPDRVSAAGAAGESVVFGDAARRESLLAAGIHRAAAVAITYANTPSALRVLHHVHELEPTLPAIVRTVDDADLEKLLAAGATEVIPEIVEGSLMLASHTLVLVGVPMRKVVRRVEEMRDERYSLLRGYFRGADDADDDDHEQVRLQSVPVDARADAVGRSLEELGLYALGLEVTAIRRHGIRGVEPDPQTKLRASDIVVLRGLPEALALAEERLSRHRRDPPAAAA

SEQ ID NO: 32494 - protein, 454 aa, Burkholderia pseudomallei K96243
MKNLQRHLSARHIRFLALGSAIGTGLFYGSASAIRLAGPAVILAYIVGGAAVYMVMRALGEMAVREPVPGSFGHYATENLGPFAGFVTGWTYTLEMVIVAIADITAFGIYMGFWFPHVPQWIWVLAIVAIICGLNLCHVKVFGELEFWLSIVKVGAIVAMIGGGAAILFTGMRLGSGGAPSLANLWSHGGFLPNGVGGLVASLSVVIFAYGGIEVIGMSAGEAKEPERAIPRAINAVPMRILLFYVLTMIVLMSIFPWTGVGANGSPFVQIFSALGVRSAAEILNLVVISAAISAINSDIFGAGRMMYAMALQGQAPRALAAMSARGVPWVTVLVMAGALLVGVVLNYLMPKDVFLMVAASATFATVWVWLMILLSQIAMRRRLGAAEVAALKFKVPFWPVGPALTIAFMAFVIAMLGYFDDTRVALFVGAAWLAILALVFYTRIRPRLAAVAR

SEQ ID NO: 32495 - protein, 192 aa, Bacillus cereus ATCC 14579
MNLPNKITISRIFLIPIFMVIMLAPFDWGSYKIGDVDLPIQHLVGALIFIIASATDWIDGHYARKYNLVTNLGKFLDPLADKLLVSAALITLVEMQYVPAWIVIVIISREFAVTGLRLVLAGTGEVVAANQLGKIKTWTQIIAIAAYLLHDVPLNLIHIPVADIFIWIALIFTVISGWDYFWKNRAAFVNSK

SEQ ID NO: 32496 - protein, 548 aa, Ustilago maydis 521
MKGNTPSSPGSTPSLLRRLSQFVQPSPSSSAFQPRAKGSSDSPLTPTANLPRDDATIKSVWLDCDPGHDDAMALLMAVHHPSIDLLGISTVAGNAGGRDTFLNAVRLMALYRADPSIPVIRGSDCPLVKEVKVDVGIHGQGGLGGVQGLPSLSSPLCQPWLQPAYPKTSSPTTGPEPSLFLYTLSTILTERLNNGKPPIHLAVTGPMTNVALFIRCYPHLIRGIEQIVLMGGAAGVRGNRGPLAEFNILNDPEAAAIVFNTDIKVVMAGLNVTHQAIFTAELHDRLLSGKIRSVSSSRRQSRTALSAISPTQSPSTSPFAPTADLSASTQVGPSDLKKMLSSTLTFFAKTYASEFGFTRGPPVHDMLAIAYIIDPTLFYRRVPSPGDVPNVSMVDADPYTNKGMPMAASLAKPNKLGGLQGGNSLGLDMSVVGGGSGETSNIPDVPVNTAETTTTPRGTPPKRYRVDVECSDGLACGATVVDFWGDRVEHEGWGKGGRNVEVLENLDCPRMWDIFFEVVERAETHIASSGLFTFEIADQGIRDLASWR

SEQ ID NO: 32497 - protein, 376 aa, Bordetella petrii
MNAKTELRSITVAVVRAPQQPFTIEAARIRAPRKDEVLVRVVATGLCHTDLIVRDQYYPVPLPAVLGHEGAGVVEEVGPNVKNLKVGDHVVLTYGACGHCNPCASGHEAYCKDFYPLNFGGCDIHGDTALQTADGVPLHDHFFAQSSFATYALARENNAIQVPADAPLELLGPLGCGIQTGAGAVINSLKVRVGSSFAAYGAGAVGLSAVMAARVAGATTIIAIDVVPSRLELAKELGATHTVNSKEVDVIETVREITNGGADFALESTGRPEVLEAGIDALGGLGTMGIVGAPKLGTRASFDINSLLLGGRSIRGIVEGDSVPQVFIPQLVKLYQQGRFPFDRLVKFYPLEQINQAAEDSTKGITLKPILRIADA

SEQ ID NO: 32498 - protein, 488 aa, Bordetella petrii
MSQSQTFLPAELWSGRLFAGRWREGATTAAVLEPATGTELGRVALADPALIASQAAEAAHAQRAWAALPYDERAQVLRKAARLAEDHADEIAGWVVRESGSIQMKAGFEVAVTIKALHEASGLPSRSAGEVLPSEPGRLSLARRRPLGVVGVIPPFNFPLYLAMRAVAPALALGNAVVLKPDPRTAVCGGMVIARLFELAGLPAGVLQVLPGDGAAGAAMTSDPNIDMIQFTGSTAAGRKVGEAASRHLKKVSLELGGKNSLIVLDDADLDLAIANTAWGVYLHQGQICMSAGRVLVQRGIYDSFVQKLIAKASSLKVGNPVHGDVRIGPLINAVQRDNALRIIDAATQAGAVVETGGTHEGLFLAPTVLSGVTPDNPAFHEEIFGPVAVVIPFDSDEDAIRLANDTEYGLSMAVLSRDVGRALKLGESLRTGLLHINDQTVNDEVVNPFGGVGASGNGSSIGGAANWEEFTQWQWLTVKGQAPAYPF

SEQ ID NO: 32499 - protein, 622 aa, Gibberella zeae PH-1
MRPKLLSVEAALFLALPELARAATRKFDFEIGWVRANPDNAFERPVIGINGQWPIPTIEVDIGDRVIINAHNNLGNQSTSLHFHGLYMNGSTHMDGPAGVSQCPIIPGTSFTYNFTVDQPGTYWYHSHTAAQYPDGLRGPFIVHDKDFPYAKKYDEEVVLTLSDWYHDEMRSLIPQFMAKSNPSGAEPVPKNALMNETTNFTMSVQPEKTYLFRVINVGAFAGQYLWFEGHKMQIVEVDGIYTEEAEAEMIYISAAQRVSFLLTTKKDTSKNFPIVASMDTTLFDVLPPDLKYNSTGWLVYDKKAEKPVPATVDSLNPFDDMTLVPYDKMEILGKPDKEVVLDVKMDNLKDGKNYAFFNDITYTEAKVPTLYTALSAGKDAEDPAVYGTYTHSMVLKKNEIVQLVVNNLDSGRHPFHLHGHAFQSVYRSEEEAGIWADANVTEKNLPKTPMRRDTLVIYPNGNIVMRFKADNPGVWLFHCHIEWHVISGLIATFVEDPLALQETIEIPKNHLDACAAANMPTKGNAAANTEDFLDLTGENKPANTLPPGFTPRGIVALVFSCICGILGVAVVAWYGFSAPVGSTSAGALSAGLVENDSGDVHSAQKGPQETVVSPTGDARSH

SEQ ID NO: 32500 - protein, 298 aa, Physcomitrella patens subsp. patens
MADESPFRNTVLKGKVALITGGGSGICFEIATQFGLHGAMVAIMGRRKHVLDAAVASLESLGIRAVGVQGDVRKKEDASRVVETVVEELGRLDILINGAAGNFLSAAEDLSPNGFKTVMDIDTVGTFTMSHAAVNYLKQGGKGKGPNEGGVIISISATLHYSANWYQIHVSAAKAAVDSLTRSLALEWGTDYKIRCNGIAPGPISGTPGMEKLNPEEAGISSGDAVPLGKMGEKWDIAMAAIFLASESGKYINGAVLPVDGGSWLAKPRYISKEQLRQFGRAVEQRSRSKTQLPNSKL

SEQ ID NO: 32501 - protein, 300 aa, Burkholderia pseudomallei K96243
MAYKTIEDTIGNTPLVQLVRLPDDEIRARNNVILAKLEGNNPAGSVKDRPALSMIRKAEERGTIKPGDTLIEATSGNTGIALAMAAAIRGYKMVLIMPEDLSIERRQSMAAYGAEIVLTPVKGGMEFARDLADQMQREGKGVILDQFANPDNPLAHYEGTGPEIWRETEGRVTHFVSAMGTTGTIMGTSQYLKERNPTVEIVGAQPEEGSRIPGIRKWPEAYLPKIFDRSRIDRVENVSQAASEAMARKLAAVEGIFCGISSGGACEVALRVARQAENATIVFVVCDRGDRYLSTGVFPA

SEQ ID NO: 32502 - protein, 163 aa, Salmonella typhimurium
MRRILSVLLENESGALSRVIGLFSQRGYNIESLTVAPTDDPTLSRMTIQTVGDEKVLEQIEKQLHKLVDVLRVSELGQGAHVEREIMLVKMEASGYGREEVKRNTEIFRGQIIDVTPTLYTVQLAGTSDKLDAFLASLRDVAKIVEVARSGVVGLSRGDKIMR

SEQ ID NO: 32503 - protein, 422 aa, Rubrobacter xylanophilus DSM 9941
MERRHRQRERPLGIVVQKYGGSSVATAEHIKAVAGKIQRARKAGLDLVVVASAMGKTTDRLLRLAGEVSSDPSPREIDQLLATGEEQSVALLAMALHDRGVPAVSLTGPQAGMRATGRYGSGVISEIRPGRIRRLLGEGRVVIVAGFQGMNALGDVMTLGRGGSDTTAVALAAALGADRCEIYTDVDGVYTADPRIVPGARRIPVISYAEMSEMAWRGAKVMHPRAVELGALYGVEIHVLSSFDEESPGTIITGGEKVEHLETRETVAGIVHDTDVARITLNGVRTGPGTLSKVFTPLAERGISVDVIVESGIKEGVADIAFTVSRADFAEARSAAGEVARALGGSVEGEEGLAKVSVVGTGMLNRPGYAARMFSALGSEGIPIRMVSTSEIQVTCVIPAERVQEAVRRLHRDFELEEREDV

SEQ ID NO: 32504 - protein, 490 aa, Physcomitrella patens subsp. patens
MTIARYKPAWAEHFQFVSAVKVDVDVSCLHVLPHEGDDGMSRYVAVGDSAGRIYIFFIYGDLLVDYATLSKAPVTAMLSFTLRKNESWLVTGHADGAVLVHRIWEIMQRGSQSSDEAHQLGLEYVHSLVLEGIGSKSKLITHLEMYRVGKMRYVLVADSTGKMQVFRENGTLFGAADSSSRPLAFLRTPNTQRLLFLTKTGGGSLDLRTMTVRSCPCDGLNGSTVVAYAFDAAGRSRAYGVTEEGDLVYVILSGDTLHFECHARTTKRKLDVEGPVSLHGIKGYLVVATPKNVFVYNTTLQLGFSYANIRGSAGPRPLFSASLDDISLSFLPTPIAPGKWPMMACNRDKLIVVGFGGGYVGIYRSTLPVHKLPDFNAKLWSSPIFISVILLLVAWQLLSRKRDPAPTDNNNAVMQIASSPASGFGYRENRDGAGSLKSRSRYESPSRSYTTNPVGYGQSSMNYRAASSDPSYSTLREPLFSNQTVGDLRH

SEQ ID NO: 32505 - protein, 95 aa, Glycine max
MGYIQDARQNHVKKKVEEALRSKMKQKALKECDHYTAKYAECALGRTLSVVWRCRQQAQELNDCLHQFTNDSVLEEMKKEYMLKQGEGSTRIQTA

SEQ ID NO: 32506 - protein, 574 aa, Thiomicrospira crunogena XCL-2
MNTEIKFSDLGLSAPILKTLEEIGYETPSPIQEQAIPVLLKGGDILGMAQTGTGKTAAFALPILSKIDLKQKDPQVLVLAPTRELAIQVAEAFQTFSRGVKGLHVLPIYGGSEYGTQIRALKRGVHVVVGTPGRVMDHIKKGTLKLDTLKVMILDEADEMLRMGFIDDVEWILKHTPDTRQIALFSATMPKEVHRIANTYLQDPTEVIIKQKAATASLIEQKYWLVSGLHKLDALTRILEAETFDGIIIFVRTKTATVELAEKLEARGYAAAALNGDVAQNQRERTVDQLKKGKLDILIATDVVARGLDVERISHVINYDIPYDNESYVHRIGRTGRAGRSGTAILFVAPRERRLLRSIEASTKKKITQMELPTAQEINDSRITRFKDKIVDAAQGTDLDFYQKMVESIESDNNIPAIEIAAGLAKLLQGDVPFFLDEKPVKHKEFKERDGGRERNPRRAKGERSERGDRGNRSRRQTPPNEGMARFRVEVGRQHGVKPGNIIGCIANEAGLDGEFIQKLTIEDNYSMVDLPSDMPKNVFNELKGAWVCGQQLKINPVKDVSQSAKRRLKPRKK

SEQ ID NO: 32507 - protein, 699 aa, Kineococcus radiotolerans SRS30216
MARVLLVVPTGHGAGLTSTCLGLVRALDARGVAVGFHKPLAQPTRATGPDRSVALVRLTTALDPSEPIPASRVVERLSRGDIDDLMEEVVAAAEGVLAAHDVVVVEGLAPSADQVFSGRVNQALATALDADVLLVGSAGVDGTDPGAPERIAEDMAVTAGTYRTGEALRVIGGVVSRWPVPEDPETAVARVARLRGALEHHGIPLVGAVPFRADLVWARVRDLVHDLDVEVLTHGDQGRRIKEVVVAAQAVPGMLPLLREGRLILVPGDRHDVVMATCLAALNGNRLAGLLLTAGVGMDPRVAELTAAAAATGLPILRSDRSTYATATAVNRLDPEVPADDAERALAVSTTVADALDPGWLAKLPTASHTPRLSPAAFRRRLTTLAAERVQRIVLPEGAEPRTVQAAAICAERGIARPVLLAHPDEVASVAAGLGLTLPEGVEVLDPAGLVERYVDVLVEARKHKGMQPDVARDSLADPIWLGTTMLQAGDVDGLVAGAVHTTAATVRPALQVVRTKPGARLVSSVFFMCLPDDVVIYGDCAVNPDPGAEDLADIALQSAASARAFGIEPRVAMISFSTGSSGSGSSVDKVAEATRIARERDPDLIIDGPLQYDAAAVASVAASKAPDSPVAGRATVFVFPDLNTGNTTYKAVQRNAGVISVGPMLQGLAKPVNDLSRGALVDDIVYTIALTAIQASRG

SEQ ID NO: 32508 - protein, 307 aa, Synechocystis sp. PCC 6803
MAEVVCFGEMLFDCLADQLGVPLEQVKSWTNYAGGAPANVACALVKQGVSAAFVGRLGADQAGQELKNVLQQCQVNTDGLQIDPHRPTRLVYVTRTGDGDRHFAGFGEYHTGDFADTAMQGETIPESLFTSAQYLVMGTIALAYAPSRTATERLVALAKKHQVKIFLDVNWRSVFWDDEAQAKERIPALITHAQILKCTDEEAVWLFGHQDPVTIHQKLPHLQGVLVTAGDKGCSYSLGKNHGEVPAFKVNVRDTTGAGDSFVAGFLAQALTHGENLFIDPHLSCQAVTYASAIGALTTLHPGAIAR

SEQ ID NO: 32509 - protein, 140 aa, Brassica napus
  misc_feature (125)..(125): Xaa can be any naturally occurring amino acid
MASAVGGGSDVEVGFAKLQGEDFEYYMQSYSIMLGRNSKKSTVDVDLSSLGGGMNISRNHARIFYDFTRRRFSLEVLGKNGCFVEGVLHLPGNPNVKLDSQDLLQIGDKEFYFLLPVRSILGGPXGPRHHVSGGSCCSVP

SEQ ID NO: 32510 - protein, 164 aa, Synechocystis sp. PCC 6803
MTVYEGSFTPPARPFRFALVIARFNDLVTEKLLSGCQDCLKRHGIDVDPAGTQVDYIWVPGSFEVPLVTRKLAVSGQYDAIICLGAVIRGQTPHFDFVAGEAAKGIAAIASQTGVPVIFGILTTDTMQQALERAGIKSNHGWGYAMNALEMASLMRAMAPLTEG

SEQ ID NO: 32511 - protein, 266 aa, Methanococcoides burtonii DSM 6242
MSVSQQILEFCDLLAESASNAISDIVGTEEAFRTVYVGADGTDTKLIDDVSEKAIIEILKADGRSIRLLSEELGEVVFGDDPEFTIILDPIDGTYNVANDIPFYGISIAIGTPDLSSTYFGYVRNLANGDTFYAESGKGAYFNDKRISHSKCSSLNDFCVSLYGYRKNVERTVDLCKNVRRIRIFGSVSLELCYVASGRLDAFVDVRGSLRLVDVAAGKLIIEESGGIVTDGDGNTLKLKDSVINPVYMVASNGCAHSDILKLVMR

SEQ ID NO: 32512 - protein, 413 aa, Arabidopsis thaliana
MGSLSTILRHPDELYPLLKLKLAITKAQKQIPLEPHLAFCYSILHKVSKSFSLVIQQLGTELRNAVCVFYLILRALDTVEDDTSVPVEIKVPILIAFHRHIYDGDWHFSCGTKEYKLLMDQFHHVSAAFLKLEKGYQEAIEDITKRMGAGMAKFICKEVETIDDYDEYCHYAAGLVGLGLSKIFIASELEILTPDWKQISNSTGLFLQKTNIIKDYLEDINERPKSRMFWPREIWGKYVDKLEDFKNEEKATKAVQCLNEMVTNALNHVEDCLKSLASLRDPAIFQSCAIPQIVAIGTLALCYNNVQVFRGVVRLRRGLIAKVIDRTKTMDDVYGAFYDFSCMLQTKVDNNDPNAMKTLNRLETIKKFCKENGGLHKRKSYVNDETQSKAIFVVMFVLLLAIVVVYLKANQCK

SEQ ID NO: 32513 - protein, 328 aa, Prochlorococcus marinus str. MIT 9312
MARIYEDNSFAIGNTPLVKLKSVTKNAKATVLAKIEGRNPAYSVKCRIGANMIWDAEKSGKLTKDKTIVEPTSGNTGIALAFTASARGYKLILTMPESMSIERRRVMAVLGAEIVLTEASKGMPGAIAKAKEIAESNPSQYFMPGQFDNPANPEIHFKTTGPEIWDDCDGEIDVLVAGVGTGGTITGVSRYIKQEKGKNITSVAVEPSHSPVITQTMNGEEVKSGPHKIQGIGAGFIPKNLDLSIVDKVEQVTNDESIEMALRLAKEEGLLVGISCGAAAAAAVRLAEQDKYAGKIIVVVLPDLAERYLSSIMFNEVPSGIIQEPVKA

SEQ ID NO: 32514 - protein, 426 aa, Lingulodinium polyedrum
MGLGSRSAAPGLTLLLAGCAALAGPLSFLAPGLGRQPARLRAGSGGAPASAAQGAVQAERPGAGCLAAGAGVLCLAAVGLAAARRSAARPAAVRRAEADDAYGASHTSFYTDAVAKDKYDSIEEVMEKSLKDPKLQGMVKELLAACVKITEALRVNLVTVNDSSNTFGDTQLTVDVIADDLLWDLAKSSQLVCEASSEEEPEIVKTNPDGQYVLCWDPLDGSSIVDNNWAVGTIVGVWDKSTGLLGATGRDQVMSLVALYGPRTTVFMTMDDGVYEFTLGPGNQWICSREKIEIKKDCKIFAPANMRAAQEVDGYAKLIDHYMTNRYTLRYSGGLVPDVCQQFTKTQGVFTNPTSKASPAKLRLAFEAAPFGRLVEMAGGKTSDGVSGQSVLDVKIEAVDQRTALAIGSANEVDRFNETVLQKTPA

SEQ ID NO: 32515 - protein, 608 aa, Glycine max
MDSKTSSRALPKHHQKTAGIQTLEAKDTGSSLQKGEKTELAAPVDLSMYAANASKQNTGETAEIKKLGGLTLKGSADSMSIKSGSGASSSVLDKVVHAANENIGSQESSIDLDKKTSEDGSVKNSSVSAKVSDGASSLAKTSGSAKISNRADFVESGKSSICRGSTSSDVSDESTCSSFSSSINKPHKANDLRWEAIQAVRSRDGVLGLGHFRLLKRLGCGDIGSVYLSELSGTKCYFAMKVMDKGSLASRKKLLRAQTEREILQSLDHPFLPTLYTHFETEKFSCLVMEFCPGGDLHTLRQKQPGKHFPEQAVKFYVAEVLLALEYLHMLGIVYRDLKPENVLVRDDGHIMLSDFDLSLRCAVSPTLVKTSSTDSEPLRKNAVYCVQPACIEPPSCIQPSCVAPTTCFSPRLFSSKSKKDRKPKNEIGNQVSPLPELIAEPTDARSMSFVGTHEYLAPEIIKGEGHGSAVDWWTFGIFLYELLFGKTPFKGSGNRATLFNVVGQPLRFPEAPVVSFAARDLIRGLLVKEPQHRLAYKRGATEIKQHPFFEGVNWALIRCATPPEIPKAVEFEKIPSPASSSGGEKAVNHMSIANQKGSDNYLEFDFF

SEQ ID NO: 32516 - protein, 182 aa, Pseudomonas stutzeri
MIFDEFSIKTLIRPVQDFPRPGVVFRDITPLFQSPKALRMVADSLIQRYVEADFTHIGALDARGFLVGSILAYELNKPLVLFRKQGKLPADVLSQAYSTEYGEAHLEIHADSLCEGDSVLLFDDLIATGGTLLAAAQLVRRMRANIHEAAAIIDLPELGGSQKLQDIGIPTFTLTAFALSDR

SEQ ID NO: 32517 - protein, 327 aa, Ustilago maydis 521
MPPGQMLEPSETESDFVVSCLSDGVRPDGRSFLSTRDVDISFGEELGNCTVAIKGTRVSTCVRATLMPPRSDRPYEGFLQITTDISPMAGIEYDSTGGGANSSARAREVLFDRLIDKAVRRTEAVDREALCVVAGEQVWNVHLTVHLLSDTGAALDAAVLCSMLSLRHFRRPDYSIENGNQVRLYSLDERVPVPLAIHHTPLCVTFAIFNHLPSISTAASKTQPEDRADSHLIDPNAKASSPDTSTSTSVALLDPTLLEESLAQSKLTLVLNAQREICVLDKSYGSPIDAHLLLHLIQIGLIRIQQLTERLEHALSVDAETRVVEVI

SEQ ID NO: 32518 - protein, 342 aa, Zea mays
  misc_feature (156)..(156): Xaa can be any naturally occurring amino acid
  misc_feature (161)..(161): Xaa can be any naturally occurring amino acid
  misc_feature (171)..(171): Xaa can be any naturally occurring amino acid
MAIVGEFLFQRIAASHLANPLELPPLDGVSIVVTGATSGIGLEIARQLAFAGAHVVMAVRRPKVAQELIQKWQNENSETGRPLNAEVMELDLLSLDSVVKFADAWNARMAPLHVLINNAGIFAIGEPQHFSKDGHEEHMQVNHLAPALLAMLLILXLLRGXPSRIVNVNSXMHSVGFVDAEDFNLRKHKYRSWLAYSNSKLAQVKFSSMLHKRIPAEAGISIICASPGIVDTNVTRDLPKIVVAAYRFLPYFIFDGQEGSRSALFAACDPQVPEYCEMLKSEDWPVCACINYDCNPMNASEEAHSLETSQLVWEKTLEMIGLPPDALDKLIAGETVPCRYGQ

SEQ ID NO: 32519 - protein, 214 aa, Zea mays
  misc_feature (91)..(91): Xaa can be any naturally occurring amino acid
MGWSAGLWWLVAAVWVAVAAAATAEGEVAVGAAPRRHAYASMMYMGTPRDYEFYVATRVMMLSLRRLSPNADRVVIASLDVPPLWVQALPXMDVFKNMLHELAVGRENPDGADQGFLASYFPDLLDQPMFHPPANGTKLWGTYRLPLGYQMDASYYYLKLRWSIPCGPNSVITFPSAPWFKPWYWWSLACFTLGLSWHETRRENLGYSSWRNFE

SEQ ID NO: 32520 - protein, 295 aa, Ostreococcus tauri
MSRRRGSGKDFYAALGVAPTADENEIRKAYRKLAMKYHPDKNRADTSGQSEKKFKEVSEAYEVLSDPKKRELYDAYGEEGLENERGGYIRAILWGRRDAGWWILRRWKQRKKAPKIEQTLKVSLEEMFYGAQKNFSVTRKVIRNGRQESVQETLTIDIKPGWKSGTKLTFQEKGDETPTTIAADIVFTLEQKPHPHFEREGNDLVRTMKVDLNEALLGTSFSVYTLDGKAIPVTVDEIISPTFVKVLPGEGMPVSKAPGSRGDMRIKFDIRFPKGPLTSAQKSALRTALENGVQY

SEQ ID NO: 32521 - protein, 410 aa, Bacillus cereus ATCC 14579
MKIIVQKFGGTSVRDDNGRKHALHHIKKSLAAGYKVVTVVSAMGRKGEPYATDTLLSLVNQEESTISKREQDLLLSCGELISAIVFSNMLNENGIKAAALNGAQAGFVTNDDFTNAKIIEMNCDRIHEELENVDVIVVTGFQGQTKKGDTTTLGRGGSDTSASALGVALHAEYIDIFTDVEGVMTADPRIVKDARHLQTVTYNEICNMAYQGAKVVHPRAVEIAMHAKVPLRVRSTYSDSEGTLISAYDGATRGRDVEERPVTGIAHVSNVTQIKVLAKETAYDLQQHVFKEMANEGISVDLINISPTGVAYTVSDNVSSHAVKLLQNLGYEPIVTEHCAKVSIVGAGMAGYPGVTAKIVTALAEKGIQILQSADSHTTIWVLVKETDLVEAVNALHSAFELSKEKQLEQ

SEQ ID NO: 32522 - protein, 466 aa, Burkholderia pseudomallei K96243
MKITIIGTGYVGLVTGACLAEIGHDVFCLDVDPRKIDILNNGGMPIHEPGLQEIIARTRAAGRIAFSTDIEASVAHGEIQFIAVGTPPDEDGSADLQYVLEAARNIGRHMTGYKVIVDKSTVPVGTAQRVRAVIDEALAARGLAGSAEHRFSVVSNPEFLKEGAAVDDFMRPDRIIIGVDDDAAGAIAREKMKKLYAPFNRNHERTIYMDVRSAEFSKYAANAMLATRISFMNEMSNLADRVGADIEAVRRGIGSDPRIGYHFLYAGVGYGGSCFPKDVQALIRTASENGQPLRILEAVEDVNHAQKNVLLDKIEKCYGADLAGRTFAVWGLAFKPNTDDMREAPSRRLIASLLARGATVRAYDPVALDEARRVFALDLHDGADALARLAFVDSADDALAGADALVIVTEWKEFKSPDFAHLKSVLKAPVIFDGRNLYEPDAMAELGIDYHAIGRPYVEPFSSERG

SEQ ID NO: 32523 - protein, 331 aa, Synechococcus sp. CC9605
MTSFLTAARAEQEQLAPDSRRLRLFSGTSNPALAKEISAYLGVPDGPRVCKRFADGELYVQIQESIRGCDVFLIQPTCAPVNDHLMELLIMVDACRRASARQITAVVPYYGYARADRKTAGRESITAKLTANLLVTSGVDRVLAMDLHSAQIQGYFDIPCDHIYGSPVLVDYLSTQDLGDVVVVSPDVGGVARARAFAKQMNDAPLAIIDKRRTGHNMAESLTVIGDVAGRTAILIDDMIDTGGTICAGARLLREQGAKRVLACATHAVFSPPASERLSAEGLFEQVVVTNSIPIPQDRVFPQLKVLSVANMLGEAIWRIHEESSVSSMFR

SEQ ID NO: 32524 - protein, 869 aa, Saccharomyces cerevisiae
MTESAIDDQRFNLTKELQRHSCRDQGKITQKDDALDFISYSSFQSSFNTDQKSANNGSTVRRSIRSIFRRAAELPRVHMGPLTYSHGINELVNKKLRKDCDLSTLCRVLQRGIRMIRMTRRRRKFYEFKLINNNGQIIWKDGSKYLELDSVKDIRIGDTASTYQEEVDPKRLRSDSKLWIAIIYKVSNKLKALHVVALNELDFNTFLSCICGLVKLRRELMESILLPDNSQFARIHWQITVSEKEEDEKKDTLSFADVKKLCDKFHIYVSTGQLLEFFQLADINHNGLLNYFEFEKFIKILKNRKEVNMIWSKFTKPPHSHLSFENFFQFLITEQHEQVDRQTAWSYFIKYREPTQLTMGQDGFTKFLKEQPYLVEVKEELYSKPLNHYFIASSHNTYLLGKQIAETPSVEGYIQVLQQGCRCVEIDIWDGENGPVVCHGFLTSAIPLKTVIRVIKKYAFITSPYPLIISLEINCNKDNQKLASLIMREVLAEQLYFVGTRTDKLPSPRELKHKILLKSKKTSEATRGLSVNEPFPSSFSSSYESANEQELRMKDDSTNSSSATNSSSMQRIKRIGLKKHADIINDVSNISGIHGIKFRNFSLPESKTIAHCFSLNERKVEYMIKDKHLKLSLDKHNRRYLMRVYPHVLRYKSSNFNPIPFWKAGVQMVATNWQTNDIGQQLNLAMFQILDHQPDGSFKSGYVLKPKKLLPVVTKAKMIPLIYEHFENGSDPVTVKIRILSTQLLPRLNDTSPSRNNTNSFVKVEFHTDDEPTMPISIDKGTRISATEASTKSSQGNGFNPIWDAEVSITLKDTDLTFIKFMVISEETQIASVCLKLNYLRMGYRHIPLFNMEGEQYIFCTLFIHTQIL

SEQ ID NO: 32525 - protein, 195 aa, Staphylococcus aureus subsp. aureus Mu50
MNLIPTVIETTNRGERAYDIYSRLLKDRIIMLGSQIDDNVANSIVSQLLFLQAQDSEKDIYLYINSPGGSVTAGFAIYDTIQHIKPDVQTICIGMAASMGSFLLAAGAKGKRFALPNAEVMIHQPLGGAQGQATEIEIAANHILKTREKLNRILSERTGQSIEKIQKDTDRDNFLTAEEAKEYGLIDEVMVPETK

SEQ ID NO: 32526 - protein, 590 aa, Ostreococcus tauri
MSSIRAAARAALERKRREAEAMAGERRVERPDLNDEAGENARPGTAAVKPKAVAKKSRWGSSDDESEEEDDNHACGRREEVMNAGGPSTGGQGYTEKMLAEANLFAAAQRDMQDVVESGKQRSQGVDPKQFFAPSPSSEDGHTDASPEAGPARPPEGLTAALAELESCDKEEPIAGPARPPPVESSVNDSELEDAPTGPARPDPEISRLRAQEAKQPVQSLNLVDAELQVTRSMSMSMLPLKKKALDMLQRCRSVDEFERLNKIDEGTHGIVFKARDKRTGEVAALKRVIMDEADDGFPLTALREVNILLSLDHPSIVNVNEVVVGSKLNFVFMVMEYVENDLKGLMDQMAESSVPRFTVPEVKAFMLQLLSGMSYLHENWIMHRDLKLSNILVTNSGDLKICDFGLARQFGGVGRYTQLVVTLWYRPPELLLGATTYGPAIDVWSLGCIFGELLSGAPLFNGRAEIDQLQKIFKLLGTPNDKIWPEFSSLPSVQKVTFTEQPYNKLRQKFPRDSTGLSDNGFELLNRMLTYDPSKRFTCSEALNHPFFEEYPPPQRPVFVEEAYRRASLGSEKVPAHTVASVTRSSCEI

SEQ ID NO: 32527 - protein, 360 aa, Burkholderia pseudomallei K96243
MDDELNSRLKPLRERIDAIDTQLIALLNQRAAVALEVGEVKKHFNAPVFRPEREQQVIARLQDMSAGPLASEHISAIWREIMAASRDLEQTIHVAFLGPVGTYSEQAMFDYFGQSIEGLPCPSIDEVFRSVEAGAATFGVVPVENSSEGAVSRTLDLLLHTQLLIGGELSLPIHHNLLTQTGKLDGVKRVCAHAQALAQCQQWLASNAPHLERQAVASNAEAARLAADDATVAAIAGDRAATHYGLQIAYALIQDDPHNRTRFAVIGQEPAGPSGHDQTSLIVSVKNEPGAVFKLLEPLARHGVSMTRFESRPARVGTWEYYFYIDIEGHRDDAAVQGALAELGRKAAFLKILGSYPRAR

SEQ ID NO: 32528 - protein, 506 aa, Frankia sp. EAN1pec
MNGRPTAIGRTTAGQARGDRTTDDETAVTGRTAHAAQPTLARVLSGRMLLFLVLGDVLGSGIYALTGQIAADVGGMIWAPFLIAFALAFLTGTAYAELVGKYPRAAGAALYANEAFRRPFLTFMVGFTVLAAGITSTATAARAIGGKYLAEFVAAPTVVVAVVFILLTAVLNARGIEESARVNLVLTVIELTGLLLIVGIGVHALATGAGEPGRAFELRAEGPAPLALLAGTTLAFYAMLGFENSVNLVEEARRPRRDLPRALFGGMFIAGTVYLFVAFTCAMLVDPDILTGSGAPLLEVVKASDVPVPSKLFAAVALVAVANTALMNMVMASRLVYGMAAQGTIPTVFARVLPGRRTPPIAIGFVTALTVALASTGQLAGLADTTVLLLLLVFFVVNISALVLRREPVPPGAYRAPTWAPALGALSCAALATPLVHREGTVYLRALGLLALAVVLVLAQKVVSGRFRACELSGAARPAPSQPYPTATGTADFSGSRTSSPTAWRA

SEQ ID NO: 32529 - protein, 170 aa, Brassica napus
  misc_feature (148)..(148): Xaa can be any naturally occurring amino acid
  misc_feature (169)..(169): Xaa can be any naturally occurring amino acid
RNVIGDRGLEVLAQHCKKLKRLRIERGADEQGMEDEEGLVSQRGLIALAQGCQELEYMAVYVSDITNESLESIGTHLKNLCDFRLVLLDREERITDLPLDNGVRSLLIGCKKLRRFAFYLRQGGLTDVGLSYIGRYSPNVRWMLLGYXGETDEGLMEFSRGCPSLQKLXM

SEQ ID NO: 32530 - protein, 481 aa, Thiomicrospira crunogena XCL-2
MQQSAFLELPKNFYELVLPEPQQNARLVTVNHSLMDELNCDLSDKQLLALASGNLTDESLINFNLIPLAQKYTGHQFGYYNPDLGDGRGLLLGQWHDKNNQAWEFHLKGAGRTPFSRRGDGRAVLRSVIREYLASEALHGLGVPTTRALAIASSQEQVQREIFEPRASLIRVTPTHIRFGHFEWAASLGKDALDALIAFVIQHHYPELAELPENEQAGALLKAVCGRTATLMAKWQAVGFNHGVMNSDNMSIIGETFDFGPYAFFDDFQIEYICNHSDVEGRYAYNQQPKIGVWNCQVLAAAFGQSVTEAEQTAALDHFVQTYNQQYVSEMNAKLGLATQQETDKDLIGDLLVLMDKQRVDFSLFFRRLAKLGHADENDLRRLLSQPEEFEPWFERYHQRVAQEALSEDKRQQRILNNNPSIILRNYIAQQIIEAAEVGNFQPLNDWVKALHSPFENHPGLAEFQQPPTPEQKGLQLSCSS

SEQ ID NO: 32531 - protein, 291 aa, Bradyrhizobium japonicum USDA 110
MGRKDRVGEPINSTRDGHCDSPRLSPRLRAHRRSNSSWGNMMNRRHALKALAGLALCPVCKPAFAAEGVHWSYEGAGAPAKWGDLDAANKACAVGLQQSPIDIEATIKSQLPTLKLNWGKSADTIVNNGHTIQLNFAEGSTLTLGDVKYKLLQVHFHRPSEHMIGGKNFPMEAHFVHRNDAGGLAVVGVLMAEGKPNPAFGKIVKTMPAADGPAVKADASIDPLAMLPTRLSYFRYPGSLTTPPCSEVVEWLLLTTPIQVSAADVAAFAKLYPMNARPVQKDNRRYVLRST

SEQ ID NO: 32532 - protein, 506 aa, Porphyromonas gingivalis W83
MLEKLIILDFGSQTTQLIARRIRELNTYCEVYPYNKLPEDLSGVRGIILSGSPYSVYDSKAFRIELSELRGKLPLLGICYGAQSLVHQAGGKVEPCDSREYGRTHLTLRQPDDALLTGLQSGTTVWMSHGDTITSLPEGFEVIAGTEDVPNAAFRIRGEKTWGVQFHPEIYHSEEGTKLLGNFLDICGMKRDWTPASFIEATVQELRERLGDDKVILALSGGVDSSVVAVLLNKAIGRNLTCIFVDHGLLRKGEFERVLQDYEHLGLNVIGVNAKEKFFAALSGVTDPEQKRKIIGRGFIEVFDEEARKLKDIKWLGQGTIYPDVIESLSITGMVIKSHHNVGGLPERMNLRLVEPLRMLFKDEVRRVGLELGMMPHLIHRHPFPGPGLGIRILGEITEEKATILQNADDIYMSLMREWGLYDQVWQAGAILLPVRSVGVMGDERTYEYTVALRAVTSMDAMSADWVHLPYDFLAKVSNEIINKVRGVNRVVYDISSKPPSTIEWE

SEQ ID NO: 32533 - protein, 591 aa, Synechocystis sp. PCC 6803
MQTSPLPRRTKIVATIGPATQSKEVLRQLIQAGATTFRLNFSHGDHAYHQQSIRLIRQIAFELNQPVGILQDLQGPKIRVGKFLNDAGSVQLKNGDPYTLTSRPVECTETISSISYEYLADEVPSGARILLDDGKLEMLVEEVDTVARDLHCRVIVGGTLSSNKGVNFPGVCLSVKAMTDKDKEDLMFGLDQGVDWVALSFVRNPQDIDEIKGLIAAAGKSVPVIAKIEKHEAIKDMQAVLEKCDGVMVARGDLGVELPAEDVPILQKKLIATANRLGIPVITATQMLDSMVNSPRPTRAEVSDVANAILDGTDAVMLSNETAIGKFPVEAVAIMAKIAERIEQEDINPSQAEASRTSIPNAISSAVSQIAETLNAAAIMSLTKTGSTARHVSKFRPKTPILAVTPHVDVSRQLQLVWGVKPLLVLDLPSTSQTFQAAINVAQENHFLRDGDLVVMTAGTLQGVAGSTDLIKVEVVKAILGRGVGIGQGAVSGRARVASRPQAIAQFTQGEILVVPSTNADCVDMMRRAAGIITEEESLTSHAAIIGLRLGVPVIVGFKGATQKIRDGAIVTIDAQKGLIYSGALPPVSKG

SEQ ID NO: 32534 - protein, 492 aa, Fulvimarina pelagi HTCC2506
MSSQIIPVDPFDYVVFGGNGDLAARKLLPALYHRDRDGQIPIEARIIGASRTAFSSEEYRNFARDALTDHVKPEDLHDDTITRFVNRLFYCHVDARSDEGWPELKALLDENGSSRIRAFYMAVSPNLFGDFAAKVSQFGLADEHTRVVVEKPVGRDLDSAKALNSEIARYFREDQVFRIDHYLGKETVQNLMALRFANALYEPIWNAGHIDHVQITVAEEVGLEGRAGYYETAGALRDMVQNHIVQLMCLVALEPPSVFKDDALRDEKLKILRSLHPIDASNVETLTVRGQYRAGASGGNAVKSYLEDLGEAESMTETFVAIKAEINNWRWAGVPFYLRTGKRLAGRMSEIVITFRKPPHNIFADVTGEVSHNQLVLRLQPDEGMKQYLMIKDPGPGGMRLRQIPLDMTFAQSFKVRNPDAYERLLLDVVRGNQTLFMRRDEVEAAWDWIDPILKAWEEKRQKPQGYTSGTWGPSAAIALIERDGRTWHEPD

SEQ ID NO: 32535 - protein, 542 aa, Medicago sativa
MGCLLSKDKDSEQEHNNGGYRYAESSGMHNHRNNHEQVNTSRTAPTSSYQPQIPTKPSSISAPSPKPLIKQDTNTILGKGLEDVKQFYTLGKELGRGQFGVTFLCTENSTGLLYACKSISKRKLVSKSDREDIKREIQIMQHLSGQPNIVEFKGAYEDRNSVHVVMELCAGGELFDRIIAKGHYSEKAAASICRQIVNVVNICHFMGVMHRDLKPENFLLASKDENALLKATDFGLSVFIEEGRVYRDIVGSAYYVAPEVLRPRCGKEIDIWSAGVILYILLSGVPPFWAETEKGIFDAILEGHIDFESEPWPKISDSAKDLVRKMLIQEPKKRITAAQVLEHPWIKGGNASDKPIDSAVLSRMKQFRAMNKLKKLALKVIAENMSEEEIRGLKAMFTNMDTDNSGTITYEELKAGLQRLGSKLSEAEVKQLMEAADVDGNGTIDCIEFITATMHRHKLERDDHLYKAFQYFDKDSSGFITRDELETAMKEYGMGDDATIKEIISEVDTIISEVDTDHDGRINYEEFCAMMRSGNQQQVKLF

SEQ ID NO: 32536 - protein, 253 aa, Xylella fastidiosa Ann-1
MSESSEKTSTTHFGFRQVAAKDKKTLVAEVFTSVSRRYDLMNDLMSLGIHRAWKRYFVATAQVKSGDRVLDLAGGTGDIAMLLKNRVGAEGSIVLGDINASMLSVGRDRLIDRGVVARLDYVQCNAEALPFQDKCFDLVTMSFGLRNVTDKDAALREMFRVLKVGGQARVLEFSTVTAEWFKPIYDFHSFQVLPRLGRLFARDAASYRYLAESIRKHPPQEELQAMMGAAGFERCGYRNLTGGIVAIHSGYKY

SEQ ID NO: 32537 - protein, 156 aa, Zea mays
MEWEEAGRMPPNMYCCFTGLCEAASQGGAIPTDAAGGNNKVKVLGGDGKVWFAGKRVRGKLAMWEEDEMGSSGKWDWVDGLPGYAYGHCTGSLARVLRQSSWLLRKSPNMMTQFFVVPHGRQEVNVELKKEGDVWGSTVTVTIPASGTLAQSGQQL

SEQ ID NO: 32538 - protein, 514 aa, Fulvimarina pelagi HTCC2506
MAKRDKTSSRPRNPEVSKPLRKPNPDGAPTAPARSGPKAPPSVRKDIPAAPSGSSHAFWESKRGVASMEDARDWLMARGIDDVECITPDLAGVARGKMMPAKKFVDNTSLALPSALFMHTISGEYPEETGEFRYSPNDGDLKLVPDLSTLCAVPWETDPTAQVICDLVDQTGVAVGYTPRNVLKHVIGLYEERGWKPVIAPEIEFYLVSKNADPDYPLTPPIGRSGRQIQSGQSYSIGGVNEFDELIDDIYDYSDAQGLEIDTLIHEEGAAQLEINLRHGDPVELADQVFLFKRTIREAAMAHDIYATFMAKPIQGQPGSAMHIHQSVIDRETGRNIFSNGDGGPSDLFHHFIGGMQKYVPAALIMMAPYVNSYRRLTHGMAAPTNCEWGFDNRTTAFRVPTSDPEGRRVENRLPSSDTNPYLSIAASLACGYLGMVEAIMPTDPTERTANEDGEISLPRGLLEAVAIFEGEKALHDVLGRDFVVTYAGIKRGEHETFMQVISPWEREFLLLQV

SEQ ID NO: 32539 - protein, 298 aa, Ustilago maydis 521
MAAVDDIPRHTIATRGDRLCIFVTVGTTRFDSLIRAVLSHAFLDAIAELVPQSPSRRAAQAQVIVQYGNSPIADILTSSALATVDEGSGIVPEPGIRIVNGRRVYQNSPNIAGLDPGKTGTISGLRLRTTPQDTNRSHPDMVQDARSAGTSIFQSMLNEAKAMQGLGSKVTDSALQGATLQAETERGIELQLFAFAPDLKSYIQSADLVISHAGSGTILDTLRMRPRPPGLVVVPNTSLMDNHQVELAEALGKDNFLIAGSEATLPNDVVRACDTTCDAFPEFDASRFATIVDETVDC

SEQ ID NO: 32540 - protein, 365 aa, Methanococcoides burtonii DSM 6242
MMDAVIGLEDGTFLKGTGFGAEGIVCGELVFTTQYTGYEESLTDPSYSGQILMFTYPLIGNYGVNDETFQSDGVKVEGLVVREACRSPSHHQSMRNIYKLMEDEGKPGISGVDTRMLTIGTREHGTMRAALINGSDDGEEAVRLARAQPDISSLDLISRVTCKEPYIIKSQVNTDDKKNVVLIDLGMKKNISTSLLNRGIDVTVVPATTPASVIQEFDPDLLFLSNGPGDPQNANAAIDAVKEMAGTVPIAGICLGHQIIARALGADTYKLKFGHRGANQPVKDLETGIVHITSQNHGFAVEGDSFDDTDVIVTQINTNDRTVEGIEQKDLDIFSVQYHPEAHAGPRDTEKIFFGKVMKAMGGRV

SEQ ID NO: 32541 - protein, 432 aa, Bacillus cereus ATCC 14579
MLSLNNSTYLEKLAVGGKFLIKKYTCKNGVRIVMENIPTVRSVAIGIWIHAGSRNENEKNNGISHFLEHMFFKGTETRSAREIAESFDSIGGQVNAFTSKEYTCYYAKVLDEHAKYALDVLADMFFNSTFDEEELKKEKNVVCEEIKMYEDAPDEIVHDMLTKATYETHPLGYPILGTEETLNTFTGDTLRQYIKDHYTPENVVVSIAGNIDEAFLQTVEQYFGSYEGTTNREQVHSPIFHFNKVARKKETEQAHLCLGYKGLQMGHEDIYNLIVLNNVLGGSMSSRLFQEVREQRGLAYSVFSYHSSYEDTGMLTLYGGTGSQQLDTLYETMQETLETLKNTGITEKELMNSKEQLKGNLMLSLESTNSRMSRNGKNELLLRKHRSLDEIIESVNTVTKENVDGLIRNMFTDEFSAALISPDGKLPKGIKL

SEQ ID NO: 32542 - protein, 234 aa, Oryza sativa Japonica Group
MAGHDELKLLGHWSSAYVTRVKLALHLKGVSYEYVEEDLRNKSDLLLASNPVHKTVPVLIHNGNPIRESQIIVQYIDEVFSGAGDSILPADPYERAVARFWAAYIDDKLLAPWKKVFRAKTEEERAAWMKQMFVAVDVLEGGLKECSKGKGCFFGGDSVGYVDVVLGGAVSFVHANDMITGGKLFDAARTPLLAAWLERFGELDAAKAVLQDVDRAVEHTKVRYARNAATAAND

SEQ ID NO: 32543 - protein, 785 aa, Oryza sativa
  misc_feature (446)..(446): Xaa can be any naturally occurring amino acid
MTTLPTAILLLLLLLALPPPSAVVALTADGLALLALKAAVTDDPLSVLSSWSESDPDPCRWPGVTCSNVTAAGGEPRRRVVGVALAGKNLSGYIPSELGSLLFLRRLNLHDNRLAGGVPAALSNASSLHSLFLYGNRLTGALPAALCDIPRLQNLDVSRNALSGGLPGDLRNCRSLQRLILAGNSFSGEVPAGIWAEMASLQQLDISSNGFNGSIPADLGELPRLAGTLNLSHNRFSGVVPPELGRLPATVTLDLRFNNLSGAIPQTGSLASQGPTSFLNNPGLCGFPLQVPCRAVPPPTQSPPAPTTTTTTTTPSSASAAAAAASEHHQPIRTSLIALISIADAAGVALVGVILVYVYWKVKDRKKQGRSSTVAAGDENESRHGLCRCIWGHRGVDSDTDTDDSSASENGGGGGKYGEGELVAIDRGFRVELDELLRSSAYVLGXGGKGIVYKVVVGNGATPVAVRRLGGGGGGGERCKEFAAEARAVGRARHPNVVRLRAYYWSADEKLVVTDFVGNGNLAAAMRGRPGQTPLSWSTRLKIARGAARGLAYLHECSPRRFVHGEVKPSNILLDADFTPRVADFGLARLLAVAGCADDVVDAPPAAPSSGGLLGGAIPYAAKPASSVAADHRGGGYRAPEARTAGARPAQKWDVFSFGVVLMELLTGRGPGDHASPSTSASFSAPSSSSAATTDRSGSGEHGHGAGVGGAVVPEVVRWVRRGFEEEARPVSEMVDPALLRDAPPLPKKEVVAAFHLALACTELDADLRPRMKAVADTLDKIASS

SEQ ID NO: 32544 - protein, 227 aa, marine gamma proteobacterium HTCC2143
MPTMTLNINNGLHILTLTNDDNENTITLDVLNEYLAAFDRVEQYQGNTALLITCGHQKTFSTGINLVWLTAQTKQVRKEFLRTFDTVLYRLALLNAPTVVCINGNAYAGGAIIAAAADFKIMRSDRGRFCLPEVDINMSFPPVMADIIDLIPNKHALKHMTLMGTAYTGQECEALNIVDYIYPAEQLQDEAFTLAKKVASKDRKSYTAIRNSLRPNIARHGKKLGLI

SEQ ID NO: 32545 - protein, 358 aa, Cytophaga hutchinsonii ATCC 33406
MDINNYAVIMAGGIGSRFWPFSRTKYPKQFHDVLGTGATLIQQTVNRFKNICPPENIIIVTNKDYVGLVKEQLPFLQDHQILAEPIGRNTAPCLAYASYKILQRDKNANIVVAPSDHIILQEKEFENVIVEALQATEQADILITLGMKPTRPDTGYGYIQYIDEKKLRIKKVKTFTEKPALELAIKFIESGEFVWNAGIFIFNAQTIVDAIKKHLPEMDEVFTEGSGLYWTDKENDFINKAYSRCGNISIDYGIMEKSDNVYVMLADFGWSDLGTWKSLFENMPKNDDGNVIDGNVLTYDAKDTIIKTPKNKLVVVEGLEGYIVAEFDDVLMICRKENEQRVKDFVSDVKATQDKRFV

SEQ ID NO: 32546 - protein, 334 aa, Chlorobium tepidum TLS
MAKVKVGINGFGRIGRLVFRQAMENPEIEIVGINDLTDVKTLAHLLKYDSSHKKFNGEVTIEGDNLIVNGRTIAICAQKDPAQLPWASLGATLVVESTGIFTSREAASKHLAAGAKKVIISAPAKDKIDATIVIGVNDKSITGKEEIISNASCTTNCLAPMTKVLNDNFGIVKGFMTTVHAYTNDQNILDLPHKDLRRARAAACSIIPTSTGAAKAIGEVLPELAGKLDGFAMRVPIPDGSVTDLSVIIEKSATKEEINAVMKAAAEGPMKGILEYNVDPIVSCDIVGNAHSCIFDSPLTMSSGNMVKIVGWYDNELGYATRVVDLLGIYSKFV

SEQ ID NO: 32547 - protein, 265 aa, Arabidopsis thaliana
MNYSNNYIEHQNKKKTIIIFFRQFKKQKPMLRMGVHLVVINKNTFNFFNRQNNYFNSGKTKKIFVIDRFLAVHQIVRKKLQLVGVTALLLACKYEEVSVPVVDDLILISDKAYSRREVLDMEKLMANTLQFNFSLPTPYVFMKRFLKAAQSDKKLEILSFFMIELCLVEYEMLEYLPSKLAASAIYTAQCTLKGFEEWSKTCEFHTGYNEEQLLACARKMVAFHHKAGTGKLTGSTTHLSSFMLQEVNQLGFCFKGGKNYNKNLI

SEQ ID NO: 32548 - protein, 258 aa, Ostreococcus tauri
MAGAGRDDDDGGEDLSAIVEAEEDAVDRSVHPSGIVPVLQCTDETDDVRRNIVATVNLDCKLDLKTIAFHARNVEYNPKVRRATRAPTLGEPTRRDENDFRFAAAIMRIRNPKTTALIFSSGKMVCTGAKTEALAREAARKYAKVIIKLGFPAQFKDFKIQNMVGSCDVQFPIRLEGLAWQHGHFAQYEPELFPGLIYRMQMPKIVLLIFVSGKIVLTGGKRREDIYQAFENIYPVLTEFKKLAQPEEGATAALPAAK

SEQ ID NO: 32549 - protein, 177 aa, Triticum aestivum
VFCRTKKTTVLLASHRIRSSSCPAARWLSGFLQPINPAGSPRSAHLISLAFTQLILLASPLPSDLLPPSSAPAKMSTVTRAYLDQRLAAANRCSKEAAMAGAKAAAVATVAAAVPTLASVRMLPWAKAHLNPTGQALIISTVAGMAYFIVADKTILSMARKHSYETAPEHLKNTSFN

SEQ ID NO: 32550 - protein, 336 aa, Staphylococcus aureus subsp. aureus Mu50
MAVKVAINGFGRIGRLAFRRIQEVEGLEVVAVNDLTDDDMLAHLLKYDTMQGRFTGEVEVVDGGFRVNGKEVKSFSEPDASKLPWKDLNIDVVLECTGFYTDKDKAQAHIEAGAKKVLISAPATGDLKTIVFNTNHQELDGSETVVSGASCTTNSLAPVAKVLNDDFGLVEGLMTTIHAYTGDQNTQDAPHRKGDKRRARAAAENIIPNSTGAAKAIGKVIPEIDGKLDGGAQRVPVATGSLTELTVVLEKQDVTVEQVNEAMKNASNESFGYTEDEIVSSDVVGMTYGSLFDATQTRVMSVGDRQLVKVAAWYDNEMSYTAQLVRTLAYLAELSK

SEQ ID NO: 32551 - protein, 403 aa, Chlorobium tepidum TLS
MKRDYYEILGVARSADKDEIKKAYRKLALKYHPDKNPDNKEAEEKFKEVNEAYEVLSNDDKRRRYDQFGHAGVGSSAASGSGPGGAGYGDINDIFSAFNDMFSGGGGRARTGGSPFSGFEDVFSGGFSGSGSGRRRSAGIQGTDLKIRLKLTLEEIAKGVEKTIKIKKLVTCRECNGTGSKSGKTEICPTCHGSGEVRQATKTMFGQFMNISVCPTCGGEGRVVKDRCPSCYGEGIKQGEATVKITVPAGVQDGNYLTLQGQGNAGPRGGAPGDLIVVIEEKPHELFKRNGDDIIYDLSVGFPDLVMGTKIEVPTLDGHVKLTIPAGTQPNTMLRIGGKGIGHLRGGGSGDLYVRVNVFVPKEVSGKDRDLLKELKKSTVICPNHGDENHEKSIFEKAKDIFS

SEQ ID NO: 32552 - protein, 396 aa, Staphylococcus aureus subsp. aureus Mu50
MAKKIVSDLDLKGKTVLVRADFNVPLKDGEITNDNRIVQALPTIQYIIEQGGKIVLFSHLGKVKEESDKAKLTLRPVAEDLSKKLDKEVVFVPETRGEKLEAAIKDLKEGDVLLVENTRYEDLDGKKESKNDPELGKYWASLGDVFVNDAFGTAHREHASNVGISTHLETAAGFLMDKEIKFIGGVVNDPHKPVVAILGGAKVSDKINVIKNLVNIADKIIIGGGMAYTFLKAQGKEIGISLLEEDKIDFAKDLLEKHGDKIVLPVDTKVAKEFSNDAKITVVPSDSIPADQEGMDIGPNTVKLFADELEGAHTVVWNGPMGVFEFSNFAQGTIGVCKAIANLKDAITIIGGGDSAAAAISLGFENDFTHISTGGGASLEYLEGKELPGIKAINNK

SEQ ID NO: 32553 - protein, 172 aa, Campylobacter coli RM2228
MDLSKIKIGDIPNKINAVIEIPYGSSIKYEIDKDSGAIMVDRVMASAMFYPANYGFIANTLADDGDPVDILVLNEYPIQAGAVIPCRLIGVLIMEDESGMDEKLLAVPNSKIDARYDNIKTYTDLPQATLNKIKNFFETYKILEPNKWVKVQDFKDEKAAVEILEKAIKNYK

SEQ ID NO: 32554 - protein, 475 aa, Saccharomyces cerevisiae
MASAVYFCDHNGKPLLSRRYRDDIPLSAIDKFPILLSDLEEQSNLIPPCLNHNGLEYLFIQHNDLYVVAIVTSLSANAAAIFTFLHKLVEVLSDYLKTVEEESIRDNFVIIYELLDEVMDYGIPQITETKMLKQYITQKSFKLVKSAKKKRNATRPPVALTNSVSWRPEGITHKKNEAFLDIVESINMLMTQKGQVLRSEIIGDVKVNSKLSGMPDLKLGINDKGIFSKYLDDDTNIPSASATTSDNNTETDKKPSITSSSATNKKKVNIELEDLKFHQCVRLSKFENEKIITFIPPDGKFDLMNYRLSTTIKPLIWCDVNVQVHSNSRIEIHCKAKAQIKRKSTATNVEILIPVPDDADTPTFKYSHGSLKYVPEKSAILWKIRSFPGGKEYSMSAELGLPSISNNEDGNRTMPKSNAEILKGPVQIKFQIPYFTTSGIQVRYLKINEPKLQYKSYPWVRYITQSGDDYTIRLT

SEQ ID NO: 32555 - protein, 253 aa, Staphylococcus aureus subsp. aureus Mu50
MRTPIIAGNWKMNKTVQEAKDFVNALPTLPDSKEVESVICAPAIQLDALTTAVKEGKAQGLEIGAQNTYFEDNGAFTGETSPVALADLGVKYVVIGHSERRELFHETDEEINKKAHAIFKHGMTPIICVGETDEERESGKANDVVGEQVKKAVAGLSEDQLKSVVIAYEPIWAIGTGKSSTSEDANEMCAFVRQTIADLSSKEVSEATRIQYGGSVKPNNIKEYMAQTDIDGALVGGASLKVEDFVQLLEGAK

SEQ ID NO: 32556 - protein, 262 aa, Oryza sativa Japonica Group
MDRYQRVEKPREEAAIGANEIRITAQGRTRNYITYALALLQDNATDEIVIKAMGRAINKTVAIVELLKRRIVGLHQNTSIESIDITDTWEPLEEGLNTLETTRHVSLITITLSKKELDTSSPGYQPPIPADQVRPPTDFDQEAEAVPSGRGRGRGRRGRGRGRGFNNEDYDDEHGDAEVPQPQGYRGRGRGRGRRGSFGPGRGYGGDGFAMEEAGGYDDGEPNAPPMQGHEGGRGRGRGRGRGCGRGRGGGRGRGPPPPPQE

SEQ ID NO: 32557 - protein, 514 aa, Picea sitchensis
MDLLSIFALPYLPVLAIVSVYLIYMRLRPSVKLPPGPRAWPIIGNLNLMGKLPHRSLDRLSKTYGPLMYIRLGSIPCVVASSAEMAREFLQTHDLTFSSRPQVASGKYTTYNYSDITWSPYGDYFRLARKVCLMELFSAKRLESFEYIRVEEVARMLGSVFETCQRGLPVEIRKETYGVSNNIISRMALGRRYFDKEAGNMMRLEELKEMLEEFFLLNGVFNIVDFIPWLGWLDLQGYVGRMKKLSERLDVFLEEVVEEHDRRRKGVENYVAKDMMDVLLKQADDPQLNLSRIKVKAFTLDIIAGGTETSATLVEWGLSELLKKPEMLERATKELDRVVGRERWVEEKDMGGLEYVQWIVKETMRLHPVAPLLVPHLSTQRCRIAGYDIPANTRVFVNVWSIGRDDQSWENPNEFRPERFKGSTVDVMGRDYELLPFGSGRRMCPGNSLGLKVVQIALANLIHGFQWKLPDGQSPKDLDMGEIFGLSTSKTCPLVAMARPRLPSHLYNFNSSHG

SEQ ID NO: 32558 - protein, 505 aa, Staphylococcus aureus subsp. aureus Mu50
MAKKPTALIILDGFANRESEHGNAVKLANKPNFDRYYNKYPTTQIEASGLDVGLPEGQMGNSEVGHMNIGAGRIVYQSLTRINKSIEDGDFFENDVLNNAIAHVNSHDSALHIFGLLSDGGVHSHYKHLFALLELAKKQGVEKVYVHAFLDGRDVDQKSALKYIEETEAKFNELGIGQFASVSGRYYAMDRDKRWEREEKAYNAIRNFDAPTYATAKEGVEASYNEGLTDEFVVPFIVENQNDGVNDGDTVIFYNFRPDRAAQLSEIFANRAFEGFKVEQVKDLFYATFTKYNDNIDAAIVFEKVDLNNTIGEIAQNNNLTQLRIAETEKYPHVTYFMSGGRNEEFKGERRRLIDSPKVATYDLKPEMSAYEVKDALLEELNKGDLDLIILNFANPDMVGHSGMLEPTIKAIEAVDECLGEVVDKILDMDGYAIITADHGNSDQVLTDDDQPMTTHTTNPVPVIVTKEGVTLRETGRLGDLAPTLLDLLNVEQPEDMTGESLIKH

SEQ ID NO: 32559 - protein, 713 aa, Saccharomyces cerevisiae
MTASVSNTQNKLNELLDAIRQEFLQVSQEANTYRLQNQKDYDFKMNQQLAEMQQIRNTVYELELTHRKMKDAYEAEIKHLKLGLEQRDHQIASLTVQQQQQQQQQQQVQQHLQQQQQQLAAASASVPVAQQPPATTSATATPAANTTTGSPSAFPVQASRPNLVGSQLPTTTLPVVSSNAQQQLPQQQLQQQQLQQQQPPPQVSVAPLSNTAINGSPTSKETTTLPSVKAPESTLKETEPENNNTSKINDTGSATTATTTTATETEIKPKEEDATPASLHQDHYLVPYNQRANHSKPIPPFLLDLDSQSVPDALKKQTNDYYILYNPALPREIDVELHKSLDHTSVVCCVKFSNDGEYLATGCNKTTQVYRVSDGSLVARLSDDSAANNHRNSITENNTTTSTDNNTMTTTTTTTITTTAMTSAAELAKDVENLNTSSSPSSDLYIRSVCFSPDGKFLATGAEDRLIRIWDIENRKIVMILQGHEQDIYSLDYFPSGDKLVSGSGDRTVRIWDLRTGQCSLTLSIEDGVTTVAVSPGDGKYIAAGSLDRAVRVWDSETGFLVERLDSENESGTGHKDSVYSVVFTRDGQSVVSGSLDRSVKLWNLQNANNKSDSKTPNSGTCEVTYIGHKDFVLSVATTQNDEYILSGSKDRGVLFWDKKSGNPLLMLQGHRNSVISVAVANGSSLGPEYNVFATGSGDCKARIWKYKKIAPN

SEQ ID NO: 32560 - protein, 434 aa, Staphylococcus aureus subsp. aureus Mu50 [sequence omitted]

SEQ ID NO: 32561 - protein, 273 aa, Brassica rapa subsp. pekinensis
  misc_feature (219)..(219): Xaa can be any naturally occurring amino acid
MASVASSTTLISSSASVLPATKSSLLPSPSLSFLPTLSSPSPSASLRSLVPLPSPQSASSSRRSFAVKGQTDDLPLVGNKAPDFEAEGVFDQEFIKFIKVKLSDYIGKKYVILFFLPLDFTFVCPTEITAFSDRYAEFEKLNTEVLGVSVDSVSVFSHLAGVQTDRKFGGLGDLNYPLISDVTKSISKSFGVLIHDQGIALRGLFIIDKEGVIQHSTIXNLGIGRSVDETMRTLQALQYIQEGPGEVCPAGWKPGEKSMKPDPKLSKELFSAI

SEQ ID NO: 32562 - protein, 283 aa, Triticum aestivum
  misc_feature (24)..(24): Xaa can be any naturally occurring amino acid
  misc_feature (269)..(269): Xaa can be any naturally occurring amino acid
TGDAAVGEGGAESTVVYCVSSSYXALLFIYIPVLRRAPATYRRGMAATATKLSSGHEMPAVGLGVWRMDSAAVRGLIHSALRAGYRHFDCAADYKNEAEVGDALAEAFETGLVKREDLFITTKLWNSDHGHVVEACKDSLKKLRLDYLDLYLIHFPVATKHTGVGTTGSALGDDGVLDIDTTITLETTWHAMEDLVSMGLVRSIGISNYDIFLTRDCLAYAKIKPAVNQIETHPYFQRDSFVKFCQKHGISVTAHTPLGGSTANTEWVXLGLMPRRYCIQVPG

SEQ ID NO: 32563 - protein, 333 aa, Triticum aestivum
QLISVLQLSWIPSSDAIYSSDVALQAGFDTSYSNYGMLDDLSAFPCAQDKSLPTADEQFNDNYPFNEQKNVNVYGEQAYQGGAMELLSTDQICNGDGNLDMIRERYSSENALQQLEDRKFSVSSGSQLSSSQNLLKQKHHSDKTSPSNITSDCYSDRNCQFSPSGSFAQRNLMVQKQVADLQPGQLINDEGQLGQQTLTRRASYPCENYEVEKKGFGKRSKDTLGTSVVVDGSFVSSLSSDNSVEESSFRQLQDAVSQLGVKTKLCIKDGLYRLARSPPNRPVFPNAMNRHEESRDVKDAQNMETSGKYVGILIKDHTLYNHDFFICGFAIVQ

SEQ ID NO: 32564 - protein, 193 aa, Arabidopsis thaliana
  misc_feature (155)..(155): Xaa can be any naturally occurring amino acid
YLATKFGPKKKLWAPPRSPPAALVTPPVKATMAAQSTGLKSSASFPVTRKANNDITSITSNGGRVSCMKVWPPIGKKKFETLSYLPDLTDVELAKEVDYLLRNKWIPCVEFELEPRFVFREHGHTPGCYDGAYWTMWKLPLFGCTDSAQVLKEVXECKKEYPGAFIRIIGFDHTRQVQCVSFIASQPPSFTDA

SEQ ID NO: 32565 - protein, 236 aa, Zea mays
  misc_feature (138)..(138): Xaa can be any naturally occurring amino acid
  misc_feature (166)..(166): Xaa can be any naturally occurring amino acid
  misc_feature (203)..(203): Xaa can be any naturally occurring amino acid
METSTKKLSSLRITSLDDDDDETEIPHQPPQAGLSTAEADYEDDDDEEEEAEVTLGVLSKPKHPGLLLRHLFPSKAGGIPAWLDPVNLPSGKSSYCGFCGEPLQFVLQVFSLCAMKLPHSTAYCLDIDLVTVRLGCVXIYAPIEDNVAAFHRTLFMFMCPSMACLXLRDQHEQWKHKYGNPCRSVKIFRCQLPRNNAFYSAQXPKHDGSNKPLCLGGSVVFCRVAVDSIYPALDVV

SEQ ID NO: 32566 - protein, 318 aa, Vibrio fischeri
WIGRIGRSVLRALYESDKCDKVEVVAVNELSQPEAMAHLFQYDSTHGRFQHKVTHDQEYLYIDLPDGSQDKVRILHQADLSLLPWQSLEVDLVLDCTGVYGSKSDSEKHITAGAKKVLFSHPGGSDLDNTIIYGVNHDTLLPEHRIVSNGSCTTNCIIPVIKAIDDAFGIDSGTITTIHSSMNDQQVIDAYHSDLRRTRAASQSIIPVDTKLHKGIERIFPKFSNKFEAISVRVPTVNVTAMDLCVTINTNVKVNDINQTIVNASRCTLHNIVDYTEAPLVSIDFNHDPHSAIVDGSQTRVSNGHLVKMLVWYDNEFG

SEQ ID NO: 32567 - protein, 303 aa, Alkaliphilus metalliredigens QYMF
MIYKNITQTIGNTPVVKLNNLVDENMADVYVKLEMFNPGGSVKDRISISMIEEAEKKGLIKPGDTIVEPTSGNTGIGLGLVAASKGYKLVLTMPESMSLERRKLLKAYGAELELTKAHLGMKGAIDKANELVEENGYVMLQQFNNLANPEIHRNTTAKEILNDFGNDLDAFVVGIGTGGTITGVGEVLKKKIDKITVVAVEPEDSPVLSGGNPGPHMIQGIGAGFVPEVLNVKIFDEVIKVQNEEALETARQLAKQEGLMVGISSGAAVFAAIKVAQKLGKGKKVLTIAPDTGERYISTALFE

SEQ ID NO: 32568 - protein, 417 aa, Mycobacterium sp. MCS
MTTAASRLDVPGIRADFPILQRVMRGGNQLAYLDSGATSQRPLQVLDAEREFLTTSYGAVHRGAHQLMEESTDAYEAGRADIAAFVGADTDELVFTKNATEALNLVSYVLGDDRFEGHAVGPGDVIVTTELEHHANLIPWQELARRTGATLKWYSVTDDGRIDLDSLDLDERVKVVAFTHHSNVTGAVAPVAELVSRARAVGALTVLDACQSVPHQPIDFHALDVDYAAFSGHKMLGPNGIGVLYGRRELLAEMPPFLTGGSMIETVTMEGATYAPAPQRFEAGTPMTSQVVGLAAAARYLSTIGMAEVEAHEAELVAAALEGLSGIDGVRVVGPLSLVDRGSPVSFVVDGIHAHDVGQVLDDDAVAVRVGHHCAWPLHRRFGITATARASFAVYNTSDEVERLVAGVRHAVEFFGR

SEQ ID NO: 32569 - protein, 298 aa, Fulvimarina pelagi HTCC2506
MKLFVFGYGYSASHYVDRLPPSRVLGVTVRSVEKAESLAKGRLSAFVFDGESFDPDVANALGEATHILVSVPPGHTAPPEAQVGGANAPEGDPVLKVYGETIAEQCPELRWIGYLSTVGVYGDHGGGWVDEETPVDPRSERSKSRVTAERGWLTLAERRGVPLAILRLSGIYGPGRNQFESLKSGKAKRLIKPGQVFNRIHVDDIAGSLELLAERTVGGIFNVTDDEPAPPQDVVTYAAELAGVEPPPEVNFEQADLSSMARSFYGDNKRVSNAKIKAAGYEFRYPTYREALAALKPG

SEQ ID NO: 32570 - protein, 397 aa, Ustilago maydis 521
MEAIAQAGRAFLSSTSGMLQDALVSCNASASNAHADSLTKDLVVQQILIHPIKSCRGTSVDQAAFDHQGLQYDRTWLIIDANTKKFYTARELPKMVLIHPRIQHEKNTLSIEIPQSENGVPASTVQVSLQPSKEQVATYEVVDGILIWGAYVDGYAVSAEADSKLSAYFGKQVRLVRKGPSPRQSGPTNPDGAVEWTDAVLRYQDFFPCLVASAESLRDVQRTLTASVYPSLSDKDDAKSFKVPRSVNREYWTPEELSSLPITRFRPNIIIDNASDASTPLSAWEEDGWTAAELFPANTAAPFGKQAERKGRAGIYMLAKCARCMVPNIDPETGVRDNFLPYRVLQEYRQVDQEAAKKGKPCFGMLSVPREKQGVIKVGDVFRVTKTTDPQTRPSPV

SEQ ID NO: 32571 - protein, 352 aa, Pseudomonas aeruginosa
MHHHHHHGSMGMMSRYEELRKELPAQPKVWLITGVAGFIGSNLLETLLKLDQKVVGLDNFATGHQRNLDEVRSLVSEKQWSNFKFIQGDIRNLDDCNNACAGVDYVLHQAALGSVPRSINDPITSNATNIDGFLNMLIAARDAKVQSFTYAASSSTYGDHPGLPKVEDTIGKPLSPYAVTKYVNELYADVFSRCYGFSTIGLRYFNVFGRRQDPNGAYAAVIPKWTSSMIQGDDVYINGDGETSRDFCYIENTVQANLLAATAGLDARNQVYNIAVGGRTSLNQLFFALRDGLAENGVSYHREPVYRDFREGDVRHSLADISKAAKLLGYAPKYDVSAGVALAMPWYIMFLK

SEQ ID NO: 32572 - protein, 416 aa, Vibrio sp. Ex25
MTDKTQQATFADLGLIPTLVERLEALEYSQPTPIQSHTIPYILEGKDIVGGANTGSGKTAAFSLPILQKIVQQDETNHRRGNFVSHLILVPTRELASQVAYNVKSYSYHLRDKIKTVAVFGGVSVNPQMLALRGGCDIIVATPGRLLDLVSSNAIKLDQVKTLVLDEADRMLSLGFTEELNKILALLPEKKQTLLFSATFPDKVTTLSQHLLRDPVEVQLQSAEASTLVQRVFSVNKGEKTAVLAHLIKQHQWRQTLIFVNAKNACNHLAQKLSKRGITAEVFHGDKGQGARTRVLDGFKSGEIQVLIATDIAARGLDIEKLPVVINFDLPRSPADYMHRIGRSGRAGEVGLGLSLIDYDDYHHFKVIEKKNKFQLEREQVEGFEVEDDQSEAYFLPMKPRAKPAGTGKKKKKRNQ

SEQ ID NO: 32573 - protein, 614 aa, Polaromonas sp. JS666
MSASSSLIDIKVPDIGDFDEVSVIEVLVKAGDTIKAEQSLITVESDKASMEIPSSQAGVVKEVKVKIGDKVKQGSIVLLLEGAGAALAPKSEEKQTPAPVPSGQAAPASAAAQAPAPAAASFAGTADLDCDVLVLGAGPGGYSAAFRAADLGLKVVLVERYATLGGVCLNVGCIPSKALLHVAAVMDEVRHFDSLGVSFGEPVLDINKLRTHKEKVVGKLTGGLAAMAKMRKVTVVRGYGSFVGAHHVEVQETSGAAQETTGKKQTIAFKHCVIAAGSQAVRLPFMPEDPRVVDSTGALNMKEVPKRMLILGGGIIGLEMGTVYSSLGARLDVVEMLDGLMQGADRDLVKVWQKMNAPRFDNIMLKTKTVAAKATAAGIEVSFEGEGAPAPQTYDLVLQAVGRTPNGKKIAAEKAGITVTDRGFIPVDIQMRTNVPHIFAIGDVVGQPMLAHKAVHEAHVAAEVIAGELQGNKELASAAFNARVIPSVAYTDPEIAWVGLTEDQAKAQGIKVKKGLFPWTASGRAIANGRDEGFTKLLFDDSPEAHGHGKILGGGIVGTHAGDLIGEIALAIEMGADAVDIGKTIHPHPTLGESMGLAAEVAHGSCTDIPPARK

SEQ ID NO: 32574 - protein, 556 aa, Polaromonas sp. JS666
MAVVDIQVPDIGDFDEVTVIELLVKPGDTVKAEQSLITVESDKASMEIPSSQAGVVKELKVKLGDKVKQGSIVLTVEAAGAAVPATASAAAASAAPAASTAAAPAPAPAPAPVPASAPAAAAGPVEVRVPDIGDFKDVSVIEVLVKPGDTIKLEQSLVTVESDKASMEIPSSAAGVLKELKVKLGDIVNIGDLLAILEGSVAATGTSPAPAPAAPAAAPAPVSAAAAAPAAAVMPAHEPATAQQGSLPHASPSVRKFARELGVPLAEVKGTGPKGRITQDDVQAFTKSVMAGDTRTQAQAAKAPASSGGTGVGLDLLPWPKVDFTKFGPVERKDMSRIKKISGANLLRNYVMIPHVTNHDDADITELEAFRVSTNKENEKAGLKVTMLAFLIKASVAALKKFPEFNASLDGDQLVYKQYYHIGFAADTPNGLVVPVLKDADKKGVLQISQEMGELAKKARDGKLTPAEMQGASFTISSLGGIGGRYFTPIINAPEVAILGVSKSQMEPVWDGKAFQPRLMLPMSLAWDHRVIDGAGAARFNAYLGQILADFRRVLL

SEQ ID NO: 32575 - protein, 189 aa, Methanococcus maripaludis S2
MIVILNNGGQYVHRIQRSLKYLDVPAKIVPNSTTLEEIAANPEIKGVILSGGPDITKATNCENIALNSELPVLGICLGHQLISKAYGGEVSRADSEEYASIKIYVKQENDLFKGVPSEFTAWASHMDEVKVTPDCFEVLAYSDICGVESIKHKEKSIYGVQFHPEVSHTEYGDIILKNFCKKCGFGFEE

SEQ ID NO: 32576 - protein, 195 aa, Chlorobium tepidum TLS
MSVLVGRPAPDFNAAAVVNGSTFVDSCQLSAYRGKYVVLFFYPLDFTFVCPTELHAFQEKLDEFKKRNVEVLGCSVDSKFSHFAWLNTPRSKGGIQGVTYPLISDINKTIAKDYDVLTPDGSVALRGLFLIDKEGIVRHQVVNDLGIGRNIDEVLRIVDALQFTEEFGEVCPANWNKGDKTMKPTDEGLKEYFAE

SEQ ID NO: 32577 - protein, 196 aa, Campylobacter coli RM2228
MIISAKFITSLDKFDKNFASHFSEVAFLGRSNVGKSSLINSLCKQKKLAKSSATPGKTQLINIFEVLCKKDEDKFSIHFIDLPGFGYAKVSKNLKEIWNKNLDEFLKLRSSIKLFVHLIDSRHTNLDIDLNLDEYLKSFLKPDQRVLKVFTKCDKLNQSEKAKLKNNFKDAILISNLNKMGLDDLEHEIIKQTLGL

SEQ ID NO: 32578 - protein, 418 aa, Neurospora crassa
MSLSNKLSIEDVDLKGKRVLIRVDFNVPLDAEKKVTNPQRIAGAIPTIKYALDHGAKAVVLMSHLGRPDRKPNPKYSLKPVVPELEKLLGKKVTFAPDCVGPEVEEIVNKADNGEVILLENLRFHIEEEGKGTDAEGNKVKADKAKVEEFRKNLTKLGDVYINDAFGTAHRAHSSMVGIDLPVKAAGFLMKKELQYFAKVLESPQRPFLSILGGAKVSDKIQLIDNLLDKVNTLIVCGGMAFTFKKTLQNMPIGNSLFDEAGAKIVPDLVKKAEKNNVKLVLPVDFTIADKFDKDANTGYATDKDGIPDGWMGLDCGEESVKLFTQAINESQTILWNGPAGVFEFDKFAKGTKATLDACVKAAEEGRTVIIGGGDTATVAAKYGVEDKLSHVSTGGGASLELLEGKALPGVVALSERQ

SEQ ID NO: 32579 - protein, 454 aa, Oryza sativa Indica Group
MAATEAASSSSSSSSCAQPSEQQPPPTPTATARPASSSPLPRRPPPRRCSGGGRGGWRRPRSAPRTSLGQRRVAAAGGCRLAAVVPRRPGFFPVVGGGGRPSQALSALLPLVVAATAVAALGNPATFSWVSKEYYAPALGGIMLSIGIKLSIDDFALAFKRPVPLTIGYMAQYIVKPLMGVLIARAFGMPSAFFAGFVLTCCVSGAQLSSYASFLSKGDVALSILLTSCSTISSVVVTPVLTGLLIGSVVPVDGIAMAKSILQVVLVPVTLGLLLNTYAKAVVNVIQPVMPFVAMLCTSLCIGSPLAINRSKILSSEGFLLLLPIVTFHIAAFIVGYWISKLPMLRQEEPVCRTISVCTGMQSSTLAGLLATQFLGSSQAVPAACSVVIMAIFGLTLASYWGNGLRIRDIGSRFVPQASAGYYAVYLASRVALCSVLSCECHRLRAESNYDWPI

SEQ ID NO: 32580 - protein, 122 aa, Allium cepa
GYLKKGRYAQRVGTGAPVYLAAVLEYLAAEVLELAGNAAKDNKKNRIIPRHVLLAIRNDEELGKLLGGVTIAHGGVLPNINPVLLPKKIAAKGIRDSKSPKKTAAKSPKKVAAENTQKSVAA

SEQ ID NO: 32581 - protein, 424 aa, Alkaliphilus metalliredigens QYMF
MKIIVFGITHKKATIDLREKVAFSQSKKQEAYSLLKESPFIHEAVILSTCNRSEVFAVVQDTSIARRWFKRFYTDFFQLKETALEGCNHFEKGREAVQYLYHVCVGVDSLVIGEDQILGQVKEAHAEALDFAATGKILNKLFLEAVTTAKEVKTETAISENALSISSIAVKQMENHLKGLVGKTVLVVGFGKMSRIAIENLLCKGIKRLYICNRTKESVQELIEKHPQIHYLSYDQKYEMLNGVDAVISATGAPHFIFYKEDMEKIYQKHRPMCMIDIALPRDIDPAVKEIEGIELFHIDDLKEIANENLAYRMDCIEIIKQSINEAIEKYEGWYQCLPIYPRIQAIKAYSETLTDQELEKLFKRLDHMAEEDRQVIEVVVKSLVKKMWKTPILQLKDAGIRGNGEAFAAFVDEFLGLDAGCGK

SEQ ID NO: 32582 - protein, 337 aa, Vibrio cholerae O1 biovar eltor str. N16961
MFNQYHKLPLFLYTVLCVRLSSRALNTFEELNMTNYLERGIKELVEEFISSGKPCPSKQTISERRAGYLSSTVLAGSSPEMADEFVDELDGIQVKVYKPSDKIDLPITIYFHGGCFISGGFETHEAQLRQLAHLSETIVVCIKYRLAPEHAYPSAHDDVFQAALGIKEHGHKYGGDTEHVFFVGDSAGAQLALATALRLKNKKLWLPEKQILIYPMVDPLGVSDSYQKNGTDFIITAQMLLSGFQLYAGESERLASEKELNLLARKDLQGLPPTLIITAEYDPLRDEGEQLYRLLLSQGVDAYCERYLGVIHGFYQLSGVSESARRCIRNIANAIKN

SEQ ID NO: 32583 - protein, 107 aa, Salmonella enterica subsp. arizonae serovar 62:z4,z23:--
MPGFSCKFFNILYTTKTIAKASFDRKFKSMSTIEERVKKIIGEQLGVKQEEVTNNASFVEDLGADSLDTVELVMALEEEFDTEIPDEEAEKITTVQAAIDYINGHQA

SEQ ID NO: 32584 - protein, 121 aa, Mycobacterium sp. MCS
MTTRDLTADQFNETITDNEIVLVDFWASWCGPCRAFAPTFAASSEKHPDVVHAKVDTEAEQQLAAAADIRSIPTLMAFKKGKLVFNQAGALPPAALEDLVQKVKEFDIDAAMAQQENAQSE

SEQ ID NO: 32585 - protein, 203 aa, Triticum aestivum
  misc_feature (158)..(158): Xaa can be any naturally occurring amino acid
DTVVLAAVYGPRPGTRKGENPEKASVEVVWKPKTGQIGRQEKEYEMTLKRTLQSICLLTVHPNTTTSVILQVMGDDGSLLPCAINASCAALVFAGVPMKHLAVAIGCGVLADGAVILDTSKAEEQQLKSFAHLVFPNSSKSVDVKESQQKDGQSERGXLITSITHGVMSEDDYFNCIERGLAASARISDFMRTTLQKHTPDYL

SEQ ID NO: 32586 - protein, 542 aa, Mycobacterium sp. MCS
MITATDLEVRAGARTLLSIDGAALRVQPGDRIGLVGRNGAGKTTTMRILAGEGEPYAGTVTRSGEVGYLPQDPREGDLDMLARDRVLSARGLDTLLSDLEKQQALMAEVADDAARDKAVRRYGELEERFAALGGYAAESEAGRICASLGLAERVLTQPLRTLSGGQRRRVELARILFAASDTGSGSDTTLLLDEPTNHLDADSIGWLRTFLQNHSGGLVVISHDVELLAAVVNRVWFLDAVRGEADVYNMGWQKYLDARATDEQRRRRERANAEKKASALRTQAAKMGAKATKAVAAQNMLRRAERMISELDEERVADKVAKIRFPTPAVCGRTPLVGKGLTKTYGSLEIFTGVDLAIDKGSRVVVLGLNGAGKTTLLRILAGVEKADAGDIEPGHGLKLGYFAQEHDTIDGNASVWENIRHAAPDTGEQDLRGLLGAFMFTGPQLDQPAGTLSGGEKTRLALAGLVASTANVLLLDEPTNNLDPASREQVLDALRSYQGAVVLVTHDPGAAEALEPQRVVLLPDGTEDYWSEEYRELIELA

SEQ ID NO: 32587 - protein, 250 aa, Kineococcus radiotolerans SRS30216
MTEAAHTLVLLRHGESEWNALNLFTGWVDVALSEKGRAEAAAGGRMLVENGVLPDVVHTSVLRRAITTAFLALDAADRHWIDVKRSWRLNERHYGALQGKDKKQTLAEFGEEQFMLWRRSYDTPPPAIEAGSEFSQDGDPRYAGLGDDMPATECLADVVARMLPYWTESVVPDLRAGRTVLLAAHGNSLRALVKHLDGVSDADIAGLNIPTGIPLVYRLDADLKPLVPGGEYLDPAAAAAAAAAVANQGR

SEQ ID NO: 32588 - protein, 83 aa, Synechocystis sp. PCC 6803
MSIYVGNLSYQATEDDVLTVFSEYGTVKRVQLPTDRETGRMRGFGFVEMSSDKEEDAAIEALDGAEWMGRDLKVNKARPRTPR

SEQ ID NO: 32589 - protein, 413 aa, Clostridium thermocellum ATCC 27405
MNFDTIESAIEDIRQGKMIVVVDDEDRENEGDLLMAAELVTPEHINFMATYGRGMICAPITEARAKELGLELMVTKNSEHMRTAFTVTVDHKSTTTGISAFERAKTIKELSNPDAKPDDFVRPGHVFPLIAKEGGVLKRAGHTEAAVDFAKLAGLYPAGVICEIMNDDGTMARVPQLMEFVKKHGLKLVTIADLIKYRRNNEKLIRRAAEAKLPTEYGDFKIVAYENVINGEHHVALVKGDVANSDEPVMVRVHSECLTGDAFHSLRCDCGEQLHKAMEMIGKEDKGVLLYMRQEGRGIGLVNKIRAYELQDQGKDTVEANVLLGFPPDLREYGIGAQILYDLGVRKIRLLTNNPKKLIGLGGHGLEIVERVPIEIKGNEINSFYLKTKKEKMGHLLTSINTTEHQEGESNGN

SEQ ID NO: 32590 - protein, 139 aa, Arabidopsis thaliana
MSRWSSCQEFLKHVESRNPGQPEFMQAVTEVIESLWPFIEKNPKYADASLLERIVEPERVVMFRVCWMDDKGVVQVNKGYRIQHSMAIGPYKGGLRFHPSVNLSILKFLAFEQTFKNALTTLPMGGGKGGSDFDPKGKS

SEQ ID NO: 32591 - protein, 394 aa, Crocosphaera watsonii WH 8501
MLLLISVFASKVANKFGVPALLLFLFIGMLAGSEGIGGLSFENYNLAKTIGDLALIFILFTGGLETEWKSIRPVLVQGLIMSTLGVALTMFFLGTFAWFMLGSFSSVMVGSDGINWVDGLLLGAIISSTDAAAVFSILKSSNLKLKGNLQALLELESGSNDPMAVLLTTTLVNIVKTGDVSFLNLGITLIAQLAIGIIGGYGFGRLMTWIINNIKVNAQGLYPVISLGQVLLTYSVITLLQGNGFLGVYIAGVVLGNSNFTYKSTILDFHDAISWLMQIGMFLLLGLLVFPSQLITVAPIAIIIALFLMFIARPLSVIIGLAISPYNNSEKLFISWVGLRGAVPIILAISPIAVGIPDAKTLFNVVFFIVLISVSIQGFSLGPTARWLKLENKE

SEQ ID NO: 32592 - protein, 155 aa, Clostridium thermocellum ATCC 27405
MAIKTNEGKLIASGLKFGVVVARFNEFISSKLLGGVIDGLIRHGASEEDIEISWVPGAFEIPLVAQKMANSKKFDAIICIGAVIRGSTPHFDYVANEMSKGIAKVSLDTGIPIAFGVLTTDTIEQAIERAGTKVGNKGYDAAVTAIEMANLLKMI

SEQ ID NO: 32593 - protein, 324 aa, marine gamma proteobacterium HTCC2143
MHIKSVKIDQFGGPDVLQLVSTPCPEPGPGEVRVRLTAIGINLIDTYHRTGLYPLPLPTGLGCEGAGVVEAVGDQVTSLQLGERVGFCLGLGAYSEAIVLPHTSLVKIPEGISDQQAAAVLLKGMTVDYLFNETFPLHGGETILFHAAAGGVGLLACQWARHLGVTLIGTASTPEKCQLAVHHGAAQCLQIDQEGLAEKLAELSPDGGFPVVYDSLGKASYELSLNALAPLGMFVSFGNASGPIEGVSPAALAASGSLYFTRPTLGTHVTRPGWMQRSADRLFDLIANQVLDIQINQTYGLDDIVQAHKDLESRKTTGCSIILP

SEQ ID NO: 32594 - protein, 294 aa, Arabidopsis thaliana [sequence omitted]

SEQ ID NO: 32595 - protein, 605 aa, Burkholderia pseudomallei K96243
MYRYTEFDKAFVRNRAAQFRDQLERWRQGALSEDAFRPLRLQNGWYVQRHAPMLRVAVPYGELSSAQIRMLARIARDYDVPEPARYRAACDAQARLGTVRLPTRNAHFTTRTNVQFNWIPLEKAADVMDLLATVDMHGIQTSGNCIRNISCDERAGVAPDEIADPRPFAEVMRQWTTLHPEFAFLPRKFKIAITGAADDRAATDWHDVGLRLVRDAAGELGFRVSVGGGMGRTPMTATLVRAFVPWRHVMNYIEAIVRVYNRYGRRDNRYKARIKILVKAEGQRYIDDVDEEFRQIVEHDGGPHTIEQAEFDRVGASFVPPVPPPCAAGRHAKTDIDADMDAALARMRTLAGAQPAFARWLERNVAPHRDPARRIVTLSFKRRHQAPGDASPEQLDALAHLAERFSAGEARVTHAQNVVLPWVRAIDLHALWEAARDAGLASANVRLLTDMIACPGGDFCALANARSIPIADAIAERFDDLDELHDIGDVDLHVSGCINSCGHHHSGHIGILGVDKDGDEWYQVTLGGSDGTAANGPAQPGKVIGPSFSADEIVDVVDALVATYLRVRRTEAGRVERFIDAYRRVGPEPFKAAANAARHPETSVA

SEQ ID NO: 32596 - protein, 566 aa, Vitis vinifera
MHSSLSLSFSSSTAIPRSGHSSELSCAAPPSPLNLRFCGLRREALGFSSPKRNDSCRVIVSSRGRFKKVSASVSDNGSAPKAFDYDLVIIGAGVGGHGAALHAVEKGLKTAIIEGDVVGGTCVNRGCVPSKALLAVSGRMRELQSEHHLKALGLQVSAAGYDRQGVADHANNLASKIRNNLTNSMKALGVDILTGVGTILGPQKVKYGKNVITAKNIIIATGSVPFVPKGIEVDGKTVITSDHALKLESVPDWIAIVGSGYIGLEFSDVYTALGSEVTFIEALDQLMPGFDPEIGKLAQRVLINPRKIDYHTGVFASKITPAKDGKPVRIELIDAKTKEPKDALEVDAALIATGRAPFTNGLGLENISVVTQRGFIPVDERMRVIDADGNLVPHLYCIGDANGKMMLAHAASAQGISVVEQVTGKDHVLNHLSIPAACFTHPEISMVGLTEPQAREKAEKEGFEVSVAKTSFKANTKALAENEGEGLAKLIYRPDNGEILGVHIFGLHAADLIHEASNAIALGTRIQDIKFAVHAHPTLSEVLDELFKSAKVHAHVPSPVSEPVTV

SEQ ID NO: 32597 - protein, 401 aa, Polaromonas sp. JS666
MLLSLQGISGQPPHAILALADGTVFIGNSIGAPGSTIGEVVFNTAMTGYQEILTDPSYCQQIVTLTYPHIGNYGINAEDIEADKVHAAGLIIKDLPLLASNFRMSMTLSEYLVKEGTVAIAGIDTRQLTRLLRTNGAQNGCILALPEGEEVSQPAIEKAVAAARGAPSMAGLDLAKVVSAKQTYEWTQTEWKLMNLEGKPGYGVQITPKFHVVAYDFGVKKNILRMMAERGARITVVPAQTPAADVLKLKPDGIFLANGPGDPEPCDYAIAAVRELIETGIPTFGICLGHQIMALASGAKTFKMKFGHHGANHPVKDLDNGRVSITSQNHGFAVDEKSLPANLRPTHISLFDGTLQGLARTDKPAFCFQGHPEASPGPHDISYLFDRFTALMEQAGEKKNA

SEQ ID NO: 32598 - protein, 178 aa, Triticum aestivum
  misc_feature (24)..(24): Xaa can be any naturally occurring amino acid
EEKERKEKELRAQILAEAEEFKKXFYEKRIQNCETNKVHNREREKIFVASQEKFHAEADKQYWKSISELIPHEIATIEKRGKKDKDKKPSITVIQGPKPGKPTDLSRMRQILVKLKHAPPPHMMQPPPASAAKDGAKDGAKDGTPAPANGTKKPAESKEKPANGSPAEAEKEQPAASE

SEQ ID NO: 32599 - protein, 299 aa, Oryza sativa Japonica Group
MDAVAGASVSSSSARLRPCPRPRRIGNVAPATVRRRSRRRAVTCAAAADADVVGLFDAAKLTVDRFVESGMVVGLGSGPASGLAIQYLGTRLRRGSLTGILGIPSSTISASEAVKAGIQVSSYEEGTQIDFAFTDADIIEEDTMTAVIGRRKTESGEPSFMVEKGIVKSADKLAFIIGHEKYVKGIEGSIPVLVKSANWIDTAEEIDDLFLGDAEVWRRPSIGTAGPLGGDFPLVTKEGHHVLDVIFTTPIPDLGKVAESLEKIAGVVDHGIVSSIPSYVVVALNGEVQVLDEKSSVIP

SEQ ID NO: 32600 - protein, 425 aa, Gibberella zeae PH-1
MAPKQKIILDTDPALLLALSAKPEELEVLLVSVTYGNVPLQSCLRNVVSAFHVIEKELEWRKSTGKPEGFGAMKANKPIVAVGPDHPLCDEELMADYFHGIDGLHNVHEAHPDLSPADTWKGIFGDGAEGGEHSPLFTPSKAPSHQEILRILKENPADTVSILAVGPLTNVALAAAEDPETFLRAKELVVMGGAVNVEGNCTPVAEFNCYADAVAAARVYALTSLKPSSTMPIIPKELSTLKAYPEKLSRQLKLTLCPLDITTPHLIGKNYFKENIQAHIDAGSPLARWVSHFVTASFKKIEEMEGDENEPGLSLHDPLTVWYMLTRDDPKWKTPEKLEDIRVETSGQWTHGMHVVDRRFRKKPAEAAVALSANPTEDPQILALDEVPGDDHAWLSVLKGNRLNRVIDSPGHDIFKEVLMQRIFG

SEQ ID NO: 32601 - protein, 309 aa, Apium graveolens
MAITLNSGFKMPVLGLGVWRMDRNEIKNLLLSAINLGYRHFDCAADYKNELEVGEAFKEAFDTDLVKREDLFITTKLWNSDHGHVIEACKNSLKKLQLEYLDLYLIHFPMASKHSGIGTTRSILDDEGVWEVDATISLEATWHEMEKLVEMGLVRSIGISNYDVYLTRDILSYSKIKPAVNQIETHPYFQRDSLIKFCQKYGIAITAHTPLGGALANTERFGSVSCLDDPVLKKLSDKHNKSPAQIVLRWGVQRNTIVIPKSSKTKRLEENINIFDFELSKEDMELIKTMERNQRSNTPAKAWGIDVYA

SEQ ID NO: 32602 - protein, 699 aa, Synechococcus sp. CC9605
MAMQASISHVMHHPLGVFSLLVAISAAVPPLIRRLGLPDLVGLLAAGVVVGPHALNWVDSSSETVRLLSDLGAVYLLFTMGLEIDLEEFNRVKRRSFIYGLLILLIGVGTGVSIGLMAGFASVSCLLLGALMATHTPLGYPIVRSYGAQKDESVVVSVGSTIFTDIVALLLLAVGLGLGQGSLSGLGLGLLLLKIGGFALVVVIGIRWLGRRLVLRGISDENRMVLAVLVALFLASLGAELAGVEKIVGAFLAGLAVNSVLPEGRVKEQVIFVGGVLFIPIFFIDLGLLLDLGSLGDSLGNFQFTALMLVGAIGGKGLASWLSGRLFGYRRAQILMMWSLTMPKVAATLATAFIGYQAGLLNQTVLNSVLAVMVVTATLGPILTEQSVTRLKDPRPDAVPVSFGEEAAVLDGVNEVVQRPLRIVVPVANPSTEKGLLSMAARLVQGSSGAEGLLLPLAMVNPSLEEMRGGLNRAVAAARGRLSTAESIGAQLEVPTRSLLRLDEDIAGGMSRTALEQAADLLLVGASRSDQLRAWLMGDIVDGVCRTAHCPVVVVNLGRETDSGLGRILVPIKDLSASAREQFELALRVINSAPEDQRVRITLLHVHDPRFSGQDRHWMEQQLIRWRPPGIPEERFHIVIVRGPGIDGAIHRLSGEHDLVILRTQRRRVAGLPIPGSDRTSKLIRQLPCASMVISDPLV

SEQ ID NO: 32603 - protein, 737 aa, Bradyrhizobium japonicum USDA 110
MAYKNFKVETDADGIALVTWDIPGRSMNVLDETSTSELDAIVKATTADAAVKGVVITSAKEAFCAGADLSMLEGMNQAYAKVFREQGETAANQMLFEQSRRFSQVLRSIETSGKPWAAAINGLALGGGFEITLCCHYRVAAENPKTRLGLPEVKVGLFPGAGGTQRVPRLVPPQDAMTILLKGDPVTVEKAKALNLIHAIVPAADLIKAAKDWIKGGGKAVAPWDEKGFKLPGGPVFSKAGMMMFPAGNAIYRRETYDNYPAARAIMSCVYEGLQLPIDAALRVESRYFTSVLRSKEAAAMIRSLFLSMQELNKGARRPKDVPATKVKKIAVIGAGFMGASVGYVSARAGLDVVLIDRDQDSADKGKAHAQKVIEEQIKKGRAKPNDAEALLARITPTADYAALKDVDLVLEAVFEDRKVKAETFAKAQEYLKPDVVFASNTSTLPITSLAEAFKDQGKFVGIHFFSPVEKMMLVEIILGKNTGDVALATALDYVRQIGKTPIVVNDSRGFFANRCVGRYVAEGNEMFLEGVPPAMIENCAKMAGMPVGPLSLSDEVALDLGLKIMKATEADLGPNAINPDQKKLMVEMVEKQGRLGRKNSKGFYDYPEKGKGQKSLWPGLSALQPKQLDPDTLDVEELKQRFLVVQAVEAARTVEDHVITDPREADVGSILGFGFAPFTGGTLSYIDFMGTKKFVELCHKLEAKYGSRFTPPKLLEEMAAKGETFYGRFAPKKAAA

SEQ ID NO: 32604 - protein, 347 aa, Chlorobium tepidum TLS
MSEPTYFMPPEWAPHASTWLSWPHKLESWPGKFEPVPAVFAELAYQLSRSETVNINVLDDAMEAQARELLKERDPEGKYAERIVFHRIPTNDAWCRDHGPNYVIRTQDGRRDKVIMNWEYNAWGGKYEPYDDDNAVPERVAKAQGLPMVSTGMVLEGGAIDVNGAGLLLTTTACLLNPNRNPSLGKAEIEAQLRRYLGIEKVLWLGDGIAGDDTDGHVDDMARFVNENTVVIAVEEDPEDENYKPLRENYELLKTMTGLDGKPLNIVKLPMPEPVYYDGERLPASYANFYIANTVVLVPTYRCPRDQQAIDILQQCFPKREVVGIDCSDLIWGLGAIHCVTHEEPAM

SEQ ID NO: 32605 - protein, 438 aa, Gibberella zeae PH-1
MASIDRYRPPREGYQPPTLPTGSRPERDSRSRSPRRRDAVPPAVPTPPQHSTRTSPPRPQARQPQSPARSGAQTPVAGSNQWAFTSDEVRSTPSILEGITPADERMRRAKGVNFIYQAGVMLDLPQITLWVAGVFFHRFYMRCHMVQEKGGIHHYNIAATALFLANKVEENCRKTKDIIIAVAKVAQKNSKLIIDEQSKEYWRWRDSILTYEEVMLEQLTFDLMVDNPYRHLFELLGKLDIVHNKHLRQAAWAFCNDACLTSIPLLIEARDVAISAIFFASVHTSQQIDDIGGKPWWKHLKGDEVLCSQAIEVMRQFYTENPLRKQNPSLPSPAFHLENTRRRGDTLLSQPDTLSSTTGTPLEADRASRSPGVNSRVNGASKDSEGRHLGSQSKLDENEVASKSPLKRREPDDGDTKSDRAEKRAKLSEDEEGELVED

SEQ ID NO: 32606 - protein, 338 aa, Burkholderia pseudomallei K96243
MSITRRTTLSKYLIEQQRETHNLPADLRLLIEVVARACKAISYNVSKGALGDALGTAGSENVQGEVQKKLDILSNEILLDANEWGGNLAAMASEEMETFFPIPANYPRGEYLLVFDPLDGSSNIDVNVSIGTIFSVLRCPDGQQATEQSFLQPGTEQVAAGYAVYGPQTVFVLTTGNGVNCFTLDREVGSWVLTQSNLRIPEDTREYAINASNARHWYEPVKRYIDELNAGAEGPRGENFNMRWIASMVADVHRILNRGGIFMYPADKRTPDRPGKLRLMYEANPMSFIVEQAGGAATTGLKRILDVQPTGLHQRVPVILGSKNEVERVARYHEQAQS

SEQ ID NO: 32607 - protein, 622 aa, Magnetococcus sp. MC-1
MTTLLSTIDSPKALRQLNEAKLPQVAQEMRDHIIECVSQSGGHLGASLGVVELTIALHYVFNTPDDRLVWDVGHQSYGHKVLTGRRDQLASIRQRHGLSGFTKRSESPYDPFGTGHSSTSISAAMGMARAAKANGIQRKAVAVIGDGAMGAGMAFEALNHAGHDNHDLDLVVVLNDNEMSISPNVGALSSYLNRMLSGGAYNAFRDGTGKVLKTISRSMWDAAKKAEEHVKGLVMPGTLFEELGFTYFGPINGHDFDALLPTLRNVQKLGGPILLHVITKKGKGFPPAEEHPCTYHGVAPFDKDTGIIQSSSGGTSYTKVFAQELCALAEQNPHIHAITAAMREGTGLNLFEKRFPERFHDVGIAEQHAVTFAAGLATEGILPVVAIYSTFMQRAYDQLIHDVALQDLPVIFALDRAGLVGADGATHAGAYDLSYLRTVPGMTIMAPADENELRHMLHTAVALNKPVALRYPRGTALGLPPEPPHVLEIGRGRTLRKGEHAAILAVGQPVHPALEAAAILEQQGISVSVYDARFVKPLDQRLLQEVAMHGVVLVVEENAVQGGFGSAVLESLSNQGALDRGLKIRCMGIPDRYIPHGTQKELRGEIGLDAVGIATTLKELLG

SEQ ID NO: 32608 - protein, 294 aa, Magnetococcus sp. MC-1
MELKPYLADRKYLVESALDRLLPAADREPRALTGAMRYSLLIGGKRLRPILTLACCEAVGGALERAMNFACAMECVHTYSLIHDDLPAMDNDDLRRGHPTCHRQYGEATAILAGDALLTHAFELAAKPVTGVLPEARLELIGELAMAAGTYGMVGGQMLDIQGEKRPLELVQLQNIHIHKTGALIRVACLAGARLGGGTPDQVKHLKRYGEALGLAFQITDDILDEVGDTKTLGKATGVDRALDKATYPKLMGLAQAREAAENLMQEATRCLTEFGPQADPLRALAQYVIARTH

SEQ ID NO: 32609 - protein, 159 aa, Kineococcus radiotolerans SRS30216
MSGLPRVGTGVDVHQLVAGRPCWVAGLLWEGEAAGPEGHSDGDVAAHACCDALFAAAGLGDLGAHFGTARPEFAGASGARLLAEAARLVREAGFEIGNVSVQVVGNRPKVGRRRAEAQAALSRACGAPVSVAGTTTDALGLTGRGEGIAAIATALVVPR

SEQ ID NO: 32610 - protein, 298 aa, Neisseria meningitidis Z2491
MNPTNDLKAWQQRAQAQTELLLERFLPSENEIPHTLHEAMRYAALDGGKRLRPMLVLAASELGEAVHEAVGQAMAAIEMIHAYSLVHDDMPAMDNDSLRRGKPTCHVKYGEATALLTGDALQTQAFDVLSRPTELPAARQLAMLSVLAKAGGSMGMAGGQAIDLANVGKQMAQTDLEQMHSLKTGALIRAAVLLGAMSCPNLSEDSLAVLDDYAAKLGLAFQVIDDVLDCEADTATLGKTAGKDADNDKPTYVKLMGLEAARSYAHKLVAEAVALLEPFGDKALRLRQLAEFAVARKY

SEQ ID NO: 32611 - protein, 210 aa, Cyanidium caldarium
AAGGISEMSELPLSVHDTTDKLDALGNTTAAKGKDFYNGSVCGKCLALLVALVFEFGLAPVGLSKLCKSPQTSSHVIELDVILQLTDIYVVASMLVGIMLPHLFGALTMLGVSRAAQAMIVEVRRQFREIPGLREGGPGVSPEHQSSAIQIATKSAIIEMVLPGALAILSPLIIGFGFGQKALIAMLLAAIGSGYHDGIISNAGGAWDNA

SEQ ID NO: 32612 - protein, 434 aa, Gibberella zeae PH-1
MADWGNDHGGSANGYGDDGHNNYDSPNDAGFGNNGFNGAEDLGDGQPGGDDKCFGCGEIGHRRAECPNPQEMACRYCKKEGHMRKDCPEAPPMVCENCGEEGHFRKHCEKPRKINRDHIANVHPEVAWKKIQQAVAEQDVDDAKEAVNEYVKGIEGEITYRQLQEALIDHNIGLWLIPTERTLVQVFTNMDLQGNIDKKYTVSYRFVEKADRPREIEGWPKTREELLERLDDAGEIVDRGLPLCSNCRELGHISKFCTQEKMERTDGPKISCYNCGADGHRVRDCPEPRVDKNACKNCGKSGHKVVDCEEPPNPANVECRKCSEVGHFAKDCPQGGGRACRNCGQEGHMAKECDQPRDMSTVTCRNCEQQGHYSKECPLPRDWSKVQCSNCQEYGHTKVRCKAPLAEESADDRWGADDSGAVAVTVGDGDDGGW

SEQ ID NO: 32613 - protein, 256 aa, Zea mays
MDEWIRQAEVWVRQSESWIRQQPPEQIYVAATVVAVTILLLIVASYLKSSKPSTIVLSGLSGSGKTTIFYQLRDGSSHQGTVTSMEENRDTFVLHSEQERKGKVKPVHIADVPGHARLKPKLDEVLPKAAGVVFIVDAQDFLSSMQAAAEYLYDILTKASVVKKRIPVLIFCNKTDKVTAHSKEFIKKQLEKELNKLRESRNAISSADISDEVQLGVPGEAFNFSQCQNKVAVAEGPGSTGNVLAVEQFIREHVRG

SEQ ID NO: 32614 - protein, 496 aa, Mycobacterium sp. MCS
MDGGPDLYIGGSWRRAGDGGTRQIINPADGSVAATVDEATPDDARAAVAAARQAFDDGAWPATAVTERAALLDLIADLLVRDKEDLALLETRDTGKTLPESRIDIDDVTSVFRYYARLIAVQSDRVVDVGDPSVISRVVHEPIGVCVLIAPWNYPLLQMSWKVAPALAAGCTMVMKPSEVTPLSTIAFTRLLEEAGVPAGVVNLVQGSGATLGSALTDTADVDFISFTGGVATGRTIAEAAAKHVTKVALELGGKNPHIVFADIGTGDGWDSAVDHVLTGVFLHSGQVCSAGTRLIVEESIADDFVADLAARAAEIRVGDGMDPASETGPLVSEQHRAKVESYVALGISEGAQLVCGGSRPGDPALAKGSYYLPTIFDRCDRSMRIVTDETFGPILTVERFTDESEAIRLGNDTQYGLAAGVRTSDTARGERVVRALRHGTVWLNDFGYYTAAAEWGGYGKSGNGRELGPAGLAEYQETKHIWHNVAPQKAGWFKG

SEQ ID NO: 32615 - protein, 273 aa, Glycine max
MADRVHPSHSPSVSADSQPPSPQDSPVVPKPPSPPSPEKPVPPPGTYVIKIPKDQVYRVPPPENARRYDQYARRKHRRSRCCCCFCWLIGILFILVVLLAIAAGVLYLVFRPEAPKYSIENITVRGINLTSPSSVAAISPEFNVTVKADNPNDKIGIRYLKDSSAEVFYKDARLCNGALPAFYQPSNNVTVFGTALRGDGIELRSEDRRALLEAQTKRRVPLTVRIRAPVKIKVGSIRTWKITVKVNCDVTVNELTAQAKIVFKRCSYDVDLW

SEQ ID NO: 32616 - protein, 536 aa, marine gamma proteobacterium HTCC2143
MELRTSNLDSLNKNNFDVLIIGGGINGAVAFAALAAKGVKVALIDKGDFAGMTSSNSSNLAWGGIKYLESYELLLVSRLCESRNELMRSFPSTVREIRFFTTIQKGFRFPAFFVFLGTILYWIIGRFFTQPPRYIPTSSVKTMEPVINTENTASGFEYSDCFLHDNDARFVFNFVRSGLDQGGTAANYVEAHHSRRENGRWCTQATDTISGNSFDIHSKIMINACGPYVDHYNQINNQQTQYKHLFSKGIHLIVDRITDSEKVLTFFASDGRLFFVIPMGPKTCVGTTDTPVESPVVSVTKEDRDFVLENINRLLNLPKPLTAADVISERCGVRPLAVDSSDKKASADWVKLSRKHEIATNKDDKHISIFGGKLTDCLNVGEEVAGLVANLGVDLAASDSKWYGEASAKHKETFLQQARKIDLDAMTDPSSSEPLTVRLWRRYGIHCMTLLEQIQHDPKQAELLIENAEYIRCEVALASQLEMITKLEDFLRRRSKIEQVLKIEDILSAPGLRDACELLFGDDADAKLEEYVASRS

SEQ ID NO: 32617 - protein, 506 aa, Candida tropicalis
MIEQVLHYWYYVLPAFIIHWIVSAIHTNSLRRKLGAKPFTHTQLDGFYGFKFGRDFLKAKRIGRQVDLINSRFPDDIDTFSSYTFGNHVIFTRDPENIKALLATQFNDFSLGGRIKFFKPLLGYGIFTLDGEGWKHSRAMLRPQFAREQLPMSPSLEPHFNVKAYPQEQRWVFDIQELFFRFTVDSATEFLFGESVNSLKSASIGCDEETELEERKKFAEAFNKAQEYISTRVALQQLYWFVNNSEFKECNEIVHKFTNYYVQKALDATPEELEKQSGYVFLYELVKQTRDPNVLRDHHSISLLAGRDTTAGLLSFAVFELARNPHIWAKLREDVESQFGLGEESRIEEITFESLKRCEYLKAVMNETLRLHPSVPRNARFALKDTTLPRGGGPDGKDPILVRKMSCSIFISGTQIDPKHYGKDAKLFRPERWFESSTRNLGWAYLPFNGGPRICLGQQFALTEAGYILVRLAQSFDTLELKPDTEYLTKISHLTMCLFGAFVKMD

SEQ ID NO: 32618 - protein, 425 aa, Cytophaga hutchinsonii ATCC 33406
MISNFKSISLTYRKAPLEIRERVALNEAECKSLMLRIKDFTDTAELLILSTCNRTEIYYTSNEDYSNDIIKLLGVEKNITGLIQQKEYFEIYNEQADAVLHLFEVGIGLDSQVVGDMQIVNQVKYAYQWSADLNLAGPFLHRLMHTIFFTNKRVVQETAFRDGAASVSYATVELSEELLSATPNANILIVGLGEIGADVCRNFKANTSFKNITLTNRSPLKSEALAAECGIEHVPFETLWEAVAKADLVISSVAKEEPLFTKEEIQKLSILSHKYFIDLSVPRSVDARAEELPGIIVYDIDHIQNRSNEALENRLNAIPHVRKIILDSIVEFNEWSKEMEVSPTINKLKNALEQIRKEELSRFVKQLSDEEAKKVDEITKSIMQKIIKLPVLQLKAACKRGEAETLIDVLNDLFNLDKQPEQIRD

SEQ ID NO: 32619 - protein, 363 aa, Ralstonia metallidurans CH34
MPLTHPLAVPQAVAPGQSFDAEPFEAAHDAWSDADDYLRRILTARVYDVARETALEAAPTLSAHLGHRVWLKREDHQPVFSFKVRGAYNKMASLPADALARGVITASAGNHAQGVALAAARLGVRAIIVVPQSAPQVKVDAVRAHGSGMVEVVLAGESYSDAFDHALSLQQQHGLTFIPAFDDPDVIAGQGTVGMEILRQHRGPLDAVFVPIGGGSLAAGVAAYVKAVRPEVQVIGVQTEDSCAMARSLAAGERVTLDTVGLFSDGTAVKRVGEETFRLCQKYLDGVLTVDTDALCAAIKDIFQDTRSLVEPAGALAVAGLKQYAATAGNASLALVAITSGANMNFDRLRIVAERAEVVGAAR

SEQ ID NO: 32620 - protein, 593 aa, Vitis vinifera
MAFWWPLLVLGFAFALCRFLLMLIPPNVPSIDVDASDVLDDGKTKENSFIYIPSRGRTPEKVQCYEPATMKYLGFCPALRPDEVREHVAQARKAQKIWARSSFKQRRQFLRILLKYIIEHQELICEISSRDTGKTMVDASLGEIMTTCEKITWLLSEGERWLKPEYRSTGRSMLHKTAKVEFHPLGVIGAIVSWNYPFHNIFNPMLAAVFSGNGVVIKVSEHASWSGCFYLRIIQAALAAVGAPENLVDVITGFAETGEALVSSVDKIIFVGSPGVGKTIMRNASDTLIPVTLELGGKDAFIVCEDVDVPHVAQIAVRAALQSSGQNCAGAERFYVHQDIYSKFVAEVVRIVKSVTAGPPLSGKYDMGAICMQEHSEKLQNLVNEALDKGAEFAGRGSFGNLGEDAVDQFFPPTVLVNVNHSMQLMQEEAFGPILPIMKFSSDEEVVKLANDSRYGLGCAVFSGSQRRAKAIASQIHCGMAAINDFASTYMCQSLPFGGVKDSGFGRFAGIEGLRACCLVKSVVEDRWWPFIKTKIPKPIQYPVADNGFEFQESLVEALYGLNVWDRLRALVHVLKMLTEQNTPSNSTKRKND

SEQ ID NO: 32621 - protein, 458 aa, Bacteroides fragilis NCTC 9343
MKQYDAIIIGFGKGGKTLTAELAKRGWKVALIERSAMMYGGTCPNIACVPTKRLIHEAEKVSWLYPTDYEKQAEAYKAAIARKNEMTAASRGNMFNKLSSLPNVTIYTGMASFVSKDVVKVTLPDEVIELQGKKIFINTGSTSIIPAIDGLKDSKRVYTSTSLMELDVLPRHLIIVGGGYIGLEFASMYASFGSKVTVLEGGNKFIAREDRDIADAVKETLEKKGIEIRLNARAQSIQDTADGVTLTYTDTADGKPVTIEGDAILVATGRKPMTEGLNLQAAGVEVDSHGAIVVNGYLHTTAPNIWAMGDVKGGLQFTYISLDDYRIIRDDLFGNKERTADDRNPVAYSVFIDPPLSHVGLTEEEAIKRGYSFKVSRLPASALPRARTLQQTDGILKAIVDSHSGRIMGCTLFCAESSEVINVVNMAMKTGQHYTFLRDFIFTHPSMGEGLNDLFSID

SEQ ID NO: 32622 - protein, 234 aa, Vitis vinifera
MARIKPQALLLQSKKKKGPTRISITTIIFCNLVVVLVVFSLFATYRHWSNRSRNQFQSGVSNVEENDGFVDSKRFDLPGYAILNTSKGYITVELYKDGSPEIVDKFLDLCQKGYFKGMPFHHVIKNYVIQGGHSQGIGAAEDWTSKGKPHGHLPLSPKHEAFMLGTSKTKQDRKKFELFITTAPIPDLNDKLIVFGRVIKGEDVVQEIEEVDTDEHYRPKSRIGIINVTLKREA

SEQ ID NO: 32623 - protein, 113 aa, Synechococcus sp. CC9605
MRVERPWGWYETLTQGDNYLVKRLLVHAGQQLSLQRHRHRSESWTVVSGSGALLCGETWHAASAGVMLSIPCGAVHRARADSSDLLILEVQHGDDLREDDIERLQDDYGRVIT

SEQ ID NO: 32624 - protein, 192 aa, Glycine max
  misc_feature (13)..(13): Xaa can be any naturally occurring amino acid
  misc_feature (24)..(24): Xaa can be any naturally occurring amino acid
GWGFFVDVGANVXGMASFAASAMXGFRVLAFEPVFENLQRICEGVYFNRVADLVTVFEAAASDRVGNITVHKLVGRLDNSAISATGAKLAFKSNEEIAFKVRTVPLDEVIPKSERVLLLKIDVQGWEYHVLKGASKLLSRKGSQAPYLIYEEDECLLQASNSSAKEIRDFLHSVGYHDCTQHGTDAHCIKKD

SEQ ID NO: 32625 - protein, 510 aa, Picea sitchensis
MMNSMAIESVYDPLVFGVVLSFIFLLLLHWKKKNSRLPPGPPGWPIIGNVLQLGDKPHESLFGLAQKYGPLMSLRLGCKLTMVVSSPSMAKEVLKDNDQTFSSRSINMAARTFAYQGTSLVWSPYGPHWRFLRRICNAELFSPKRLDALQHLRREEVNRTIRSIFEVSMEGQSVNIGEIAFLNSLSLVGMMVCSRNLFNPGSKEVAEFKEMVWEVLKLTGTPNLSDLFPFLERFDLQGLKKGMKTLARRFDSLFDSIIEERLGEDGAGVHHEGKDFLEIMLGLRKAGTQFTLENIKAVLMDMFIAGTDTTSVTVEWAMAELLGKPAVIRKAQAELDEIVGQAKRMEESDIAKLPYLQAIVKEALRLHPAAPLIIPRRSDNSCEIGGYVVPENTQVFVNVWGIGRDPSVWKEPLEFNPERFLECNTDYRGQDFELIPFGAGRRICIGLPLAHRMVHLVLGSLLHAFNWSIPGATKDDDFVIDMSEVFGLTLQKKVPLIAVPTPRQPINLLY

SEQ ID NO: 32626 - protein, 210 aa, Zea mays
MDQMVVCFTKKIKDWSNVVVAYEPVWAIGTGKVATVAQAQEVHASLRDWLKTNVSPEVAESTRIFYGGSVTAANCKELAAQPDVDGFLVGGASLKMGLLVLFKYFRFCGRKSGCCGALVNGTLNVDDAENEVEEVLTASLILESTADYKDPCSRFLDHCCPREITRTSYPRIVIVADRQNFPSFNTVLDCHSRREVIKQDAKIVRKELCD

SEQ ID NO: 32627 - protein, 292 aa, Thiomicrospira crunogena XCL-2
MNWNALADSISKLTGTPFQIESAAPVGGGDIHNAYRLHTAEGNFFLKSNQSSQAALFETEANSLKALSSTLSITVPKVIATGVENDQAWLLLEYLELSPQGDDFQRGKDLALLHHQINETKQFGWFEDNFIGKTRQPNGWASDWVQFYGQNRLLPQLKLALSNGASPTLMDKGTRLIDKLPDFFQTYQPEASPLHGDLWGGNSSFTQTGEAVFYDPASYYGDREADLAMTELFGGFRPDFYQGYDSVFPLDSGYAQRKNLYNLYHVLNHFNLFGGHYANQSERMIQTLLDSV

SEQ ID NO: 32628 - protein, 189 aa, Ashbya gossypii ATCC 10895
MGRAKKTRKFALVKRTLNAKKDTRIKANAEKEAKKDDPELTKHIPQVSSALFFQYNQAIKPPYQVLIDTNFINFSIQKKIDLVRGMMDCLLAKCVPLITDCVMAELEKLGPKYRIALKLARDPRIKRLNCSHKGTYADDCLVNRVLQHKCYIVATNDAGLKQRIRKVPGIPLMSVGGHSYVIEKLPDVF

SEQ ID NO: 32629 - protein, 209 aa, Micromonas pusilla
AGGISEMAVLPEDVRKQTDALDAVANTTKASTKGYAMGYAGLGALVLLAAYTQDLSFLAATSEPYPYFAGGVSDFSLSNPYVVVGLFVGGLLPYLFGSMGMMAVARAAGAIVEEVRRQFKEKPGIMQGTEKPDYGAAVDLLTKAAIKEMIIPMPCLPVLSPVVLYFHQSMAVADKYRGLLQQLGAMLLGVIITGLHVALSASGGAWDNA

SEQ ID NO: 32630 - protein, 308 aa, Magnetococcus sp. MC-1
MRRRCLDEVFALAQQDARVLFMGSDLGAGTLETMRQACPRQFFMEGIAEQNLIGVAAGLALEGYLPYVNTIATFLTRRALEQIAIDVALHKLPVRLIGNGGGMVYAPLGPTHTTLEDVALMRALPNMTVLAPCDADEMQRLMGQTLAWPGPIYIRLAKGGDAVVSREELPCTIGKAIPLLYGRDVLIISYGIMVQRALTAAHALAQEGIECSVLNMHTLKPLDEAAIVREAQGKRLVVTVEEHSQIGGLGSAVAQLLATRDLLDGGPRLRILAFADAFCSGYGSQNQQIAQAGVDVLDIQRTIKEAFV

SEQ ID NO: 32631 - protein, 430 aa, Triticum aestivum
  misc_feature (238)..(238): Xaa can be any naturally occurring amino acid
  misc_feature (275)..(275): Xaa can be any naturally occurring amino acid
  misc_feature (310)..(310): Xaa can be any naturally occurring amino acid
  misc_feature (323)..(323): Xaa can be any naturally occurring amino acid
NKFVQKSRLVPVRNSRDIVDPRVRSPYPVIITLEDHLTPELQDKVAKMVLEVFGDILYYPQEEHPKELPSPEFLKGRVLLSTKPPKEYLEAKDGGAVKDGDAEQNPGKGTDDDAAWGTEVPDFKTEIQSAKQEDDASENRRDGDEDDDDEDEQKMQQHLAPQYKRLITIRAGKPKGGTTSDALKCDPNKVRRLSLSEQQLAKAVVNHGTEIVRFTQRNLLRIYPKGTRVTSSNYNPFXLGWVHGAQMVAFNMQGYGRALWLMHGFYKANGGCGYXVKKPDFLMQSEPEVFDPKKPQPGKRTLKVKVYMGXDGWRMDFKQTHFXQDSPPDFYARVGIAGVPADSVMRKTKAVEDNWVPVWGEEFSFGLTVPELALLRVEAHEYDMSEKDDFAGQTVLPVSELQPGIRAVALFDRKGNKFPNVKLLMRFEFV

SEQ ID NO: 32632 - protein, 193 aa, Picochlorum maculatum
AGGISEMALQDYPEVSEKTDALDAAGNTTAAIGKGFAIGSAALVSLALYGTFAVRIGIRNGVNILSPVTFAFLLIGSNLPYWFSALTMKSVGTAAMQMVMEVERQFREQPQLLNEGTTLPPDYTRCVDISTKAALKEMVPSRPPLVMGATRMIPGIVSFFNVAREAGVLTVGLVSGVQLAVSMSNTGGAWDNA

SEQ ID NO: 32633 - protein, 372 aa, Kineococcus radiotolerans SRS30216
MAWTVPGVISRAKGAPVETVDIVVPEPIAGEVVVDVAACGVCHTDLHYREGGINDDYPFLLGHEAAGTVAQVGEGVTNVAVGDAVVLNWRAVCGECRACKRGRPQYCFATRNASQKMTLTDGTPLSPALGIGAFTPKTLVAAGQATRIDTSIYDGSTTGFDPAVAGLLGCGVMAGIGAAVNTAPVQRGDTVAVIGCGGVGCAAIAGAVLAGARRVIAVDLDDRKLAWARQLGATHTVNSRGLSEDEVVKAVQDLTDSFGADVVIDAVGRPETWRQAFYARDLAGTVVLVGVPTPDMQLQVPLLDVFGRGGALKSSWYGDCLPERDFPALLELHADGRLPLDAFVSERIGLGDVEEAFATMKAGGVLRSVVVL

SEQ ID NO: 32634 - protein, 202 aa, Picochlorum maculatum
AGGIFEMSQQPEFVRESTDRLDAAGNVTKAITKGYSIGSASLACFLLFGAFMDEFSQFSGKPFRVVDIAVPEVLIGGIIGTMMVFYFVGLTVAAVGKTAGEVVKEVRRQFRDNPEIMTFKARPDYRSCVALVTHAALKEMVWPGLLATGLPIVVGVVFREVGAITDRSLLGAEVLAGYLMFGTETGIMMALFLTAGGAWDNA

SEQ ID NO: 32635 - protein, 189 aa, Nannochloropsis gaditana
AGGLAEMALQDYPEFREKTDALDAAGNTTAAIGKGIAIGSAALVSLALYGAFAVSIGIRNGVNILSPVTFAFLMIGSNLPYWFSALTIKSVGTAAMQMVMEVERQFREQPQLLNEGTTLRPDYTRCVDISTKAALKEMVPPTALVMLSPLIAGTFFGKYAVAGVLTVGLVSGVQLAVSMSNTGGAWDNA

SEQ ID NO: 32636 - protein, 220 aa, Triticum aestivum
RLASAAITGGLDSKLAVWDFSKGRALFSIDYGSPELQNSNSSGSTGQCLNPAFVHSVAVSEEGILGGLYKVCAVARGDGVVDVVDLEYELAPAKSKGPSRAGGLAMSSKTNDLGDGSNNQCQGRRIHLDYSMGGHTAAVSCVAFSAFGEKGKLLVSGGNDASLKVWDWSKGFSPETSSNSELVLDIDVKKKVNWLCTAPTDSDNLIVCDTSKVVKVYNFL

SEQ ID NO: 32637 - protein, 406 aa, delta proteobacterium MLMS-1
MALIVQKFGGTSVADPERIRAVARRVLKEQQAGNRMVVVLSAMAGETNRFVDLAQQMQSLPDPREMDVLLATGEQVTVALFAMAIKELGHDAVSLLGDQVKIHTDGMHTRARILSIDHELINSHLDQGRVVVVAGFQGVTADGELTTLGRGGSDTTAVALAAALQADQCEIFTDVDGVYTTDPNICASACKIDRIAYEEMLELASLGAKVLDIRSVSIAKQHRVPVQVRSTFTDTEGTWVVEEDKQMESNPVSGVTYNRNEARITVSKLPDIPGVASRLFTPVAEEGVVVDMIIQNTRDGNLTDLTFTVPKSDYQRALKVIEKTAAEIGAEGVSGSENISKVSIVGVGMRNHFGIATTMFEVLSREGINIQMISTSEIKISCVIEEKYTELAVRALHEAFGLSGQE

SEQ ID NO: 32638 - protein, 315 aa, Burkholderia pseudomallei K96243
MNAAATTLHPKLAPAGASWFEASARQRLAGLVDAGSLDEFAGPPARLASPHLPLFDLPQQFDDGMIVGRATLAGEPVFVAAQEGRFMGGAFGEVHGAKLTGLLRAARELRAAPVLILFDTGGVRLQEANAGEIAVSEIVRAVIDARAAGVPVVGLVGGRAGCYGGGGIIAACCSALAVSEAGRIGVSGPEVIESRRGVDEFDSRDRALVWRTMGGKHRRLVGGADAFVDDTIDAFRHAAIALLARVRAGGAFGTATLEAEHARLAARIARFRDCDDALDVWRALGAPDAGAIPALDAAAFAALADRLTEVCDDAR

SEQ ID NO: 32639 - protein, 486 aa, Oryza sativa Japonica Group
MARGRGRWLLPTRLLNVCLAALCRGGSLAAAESVLVDAIRLGLPPDVVTYNTLLAAHCRAAGLEAGLVVMGRMREAGVEPDAVTYNSLIAGAARRGLPIHALDLFDEMLPFGDRPRLLELQPPHALPVPKGIAPCDTTYNTLLDGMFRAGYAMNAYRMFRYLQRAGLPVSIVTYNTMINGLCSSGKVGYARMVLRELGRTDHAPNIITYTAVMKCCFKYGRFEQGLDTFLSLLDRGYISDVYPYCTVISALVKKGRLGEANNYCDLMLQNGSRLDSVCYNTLIHMRCQEGKLDDAFELVSMMEDGGLESDEYTFAILVNGLCKMGHIEAAEKQLFYMEIKGMQSNVVAYNCLVDALCKFQEVDAAIRLLQCMKLKDDFTYTSLVHGLCRVGRYHMASKFLRICLHEGNNVLASAKRAVIAGLRSSGFKNDLRKVRSVKPKRNKIKHHGKLQTSPLVGERYRLSMCTKPPLTGVCLALDFVGKIDWV

SEQ ID NO: 32640 - protein, 626 aa, Streptococcus thermophilus LMG 18311
MSDFIVEKLTKSVGDKTVFKEISFIIHDLDRIGIIGVNGTGKTTLLDVVSERIGFDGDVSPFTKANGYKIAYLTQEPEFDDGKTVLDTVLSSDLREMALIREYETLVADYFEDNQSRLETVMAEMDSLDAWSIESEVKTVLSKLGLSDLSQKVGDLSGGLRRRVQLAQVLLNDADLLLLDEPTNHLDIDTIAWLTNFLKSSKKTVLFITHDRYFLDSVATRIFELDQANLIEYQGNYQDYVRLKAEQDERDAAALHKKKQLYKQELAWMRTQPQARATKQQARINRFKELKGEVHQTLNNDDFEINFETSRIGKKVVNFEHVDFAYEDGKPILSDFNLIMQNRDRIGIVGDNGVGKSTLLNLINGDLVPTAGVLDIGETVRIGYFSQQIKDMDESKRVINYLQEVADEVKTTVGTTSITELLEQFLFSRSTHGTQIAKLSGGEKKRLYLLKILIEKPNVLLLDEPTNDLDIATLTVLENFLNGFGGPVVTVSHDRYFLDKVANKILAFEEGGVREFFGNYTDYLDEKAFLQEQSALLEKEKEQARVKVEKVKEDKRRMSYFEKQEWAIIEDEITDLEAKIEEIEAAMLENASDYGQLASLQRDLDTTNETLLEKYERYEYLSGLEG

SEQ ID NO: 32641 - protein, 435 aa, Arabidopsis thaliana
MSKPEETSDPNPTGPDPSRSSSDEVTVTVADRAPSDLNHVSEELSDQLRNVGLDDSAKELSVPISVPQGNVETDSRALFGSDQKEEEEGSEKRMMMVYPVRPDSEDCSFYMRTGSCKYGSSCKFNHPVRRKLQIGRERVRERDEDVENPKLMECKYYFRTGGCKYGESCRFSHMKEHNSPASVPELNFLGLPIRPGEKECPFYMRNGSCKFGSDCKFNHPDPTAIGGVDSPLYRGNNGGSFSPKAPSQASSTSWSSTRHMNGTGTAPFIPSMFPHSRGVTPQASDWNGYQASSAYPPERSPLAPSSYQVNNSLAETSSFSQYQHQMSVEEFPERPDQPECTYYLKTGDCKFKYKCKYHHPKNRLPKQAAFSFNDKGLPLRPDQSMCTHYSRYGICKFGPACRFDHSIPPTFSPSSSQTVEARQVGANGNEDDSWH

SEQ ID NO: 32642 - protein, 499 aa, marine gamma proteobacterium HTCC2143
MLFLPDKFLEKRMSLLLKDPSLLATGAYINGEWIQADSGETLAVTNPSTGEIIAEVAKCGAAETRRAIEAAYRVQKQWKLTTAKERAALLRGWFNLIMDNQDDLAEILTAEQGKPLQEAKGEIAYGANYIEWFAEEAKRIYGDTIPQPSNDKRLIVIKQPIGVVGAITPWNFPCAMLTRKIAPALAAGCTVVCKPANATPLSAYALAVLAERAGIPAGVIHVITGKTAEIGSEITGSELIRKVTFTGSTPVGKQLMKECADTVKRTSMELGGNAPFIVFDDADIDEAVAGAMASKYRNAGQTCVCSNRLLVQDAVYDEFAKKLLAAVNALVLGDGTGEGVTVGPLIDQKAARDVCEMIDDAVASGAEVMVGGGASSLGGSFVEPTILTNVSRDMRVFKEEIFGPVAPLIRFSSEEEALELANDTEVGLASYIYTRDIGRIWRVSEGLEYGIVGVNEGIISNEMAPFGGVKESGNGREGSKYGLEDYLEIKYLCLGGIDR

SEQ ID NO: 32643 - protein, 456 aa, Streptococcus thermophilus LMG 18311
MKGNIDMTTGKEYVASVFEKVKAQNSHEAEFLQAVEEVFNSLVPVFDKYPKYIEENLLERLVEPERIVSFRVPWVDDKGQVQVNRGFRVQFSSAIGPYKGGLRFHPSVNQSIIKFLGFEQIFKNSLTGQPIGGGKGGSNFDPKGKSDNEIMRFCQSFMTELSKHIGADTDVPAGDIGVGGREIGYLYGQYKRIRNEYTGVLTGKGLNWGGSLARTEATGYGAVYFAEQMLNARGENFNGKTAVVSGAGNVAIYAIEKLQSLGAKAVTCSDSSGFVYDPDGIDVDLLKEIKEVKRERIVKYAEARPNATFTPAGGEKTVWSIKADLAFPCATQNELDETDAETLVANGVLAVSEGANMPSTLGAIDVFLKAGVSFGPAKAANAGGVAVSALEMAQNSGRTSWTFDEVDAKLYDIMKGIYENAAAAAKEFGQEGNLVVGANIAGFLKVADAMSAQGIV

SEQ ID NO: 32644 - protein, 414 aa, marine gamma proteobacterium HTCC2143
MTQQYSLQRTLGFSTVTFYGVGAILGAGIYVLIGEVAGLAGYAAPLSFIVAAVIAIFSAFSYAELSARFPKSAGEAVYIEQAFGCKWLTITVGLLVILTGIVSAATMTTGIVGYAQVFVTLPSFALITVFVIAISSIAIWGIKQSAWLVTAITVLEVAGLLYVVYVASDNLTSLSIPPLPAGADMDSSVATGILLGSFLAFYAYIGFEDMVNIAEEIKQPEKVLPVAIVLALVIATLLYMLVAYTALSVLSPAQLSASKAPLADVVISKGYSGSWISLISLVAVINGAIIQIIMASRVIYGMASRELFPVWLASVNRVTSTPIPATLLCAAAVLILALLFPLSTLAQLTSLIVLSVFVLVNVALIRLNRRFLAGAKESKDTGHKTVNFPRWIPYIGALLCVGMLLVKAIFWWSL

SEQ ID NO: 32645 - protein, 478 aa, Zea mays
  misc_feature (350)..(350): Xaa can be any naturally occurring amino acid
MAAPQPVAQAPEAPPSAQVVGNAFVQQYYLVLHQSPDLVYRFYQEASRLGRPASAAGAAGMDSVTTMEAIGEKIMEMDVSKAEIRTVDSQESLGGGVTVLVTGHLTGRDGVRREFSQSFFLAPQEKGYFVLNDMFRFVGEIPAPTAVEAQPEADAVVLSVAANGTSTLAVEPATPDDRNAVPQQEHHVVDRSPPQPEEEEEAEVYDPPPEEVVDEEQPVPEVINEVPNNVAAVLATTVAPVLQEEAPKKSYASIVKVMKEVSLRAPAPPTRTAPPKPEKQSPALAPVKDVLPFSSNPENGNIQEPEDDAHAIYVRNLPLNATETQLEDEFKKFGTIKQNGIQVRSNKIQXGFCYGFVEFEDSTSVQSAIEASPVMIGGRQCYIEEKRTPGSRGSSRGGRFVPGRGNNFRSEGTRGRGNYGGGRGYGRGEFSYRSDYGGRSGGRGVSARGADVGYQRVDHAGYAGGRGGRTVAAGAPAK

SEQ ID NO: 32646 - protein, 194 aa, Triticum aestivum
  misc_feature (17)..(17): Xaa can be any naturally occurring amino acid
MPPTGMASSATSVVPFXGLKSTPGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESAQAYTAHSRQAIYKVPLQFCQL

SEQ ID NO: 32647 - protein, 59 aa, Silene latifolia
AWSRPRYNPAGEILQILEDRSGKVVKAISEVEEKDGKLWIASVLMPFIAIYDLGSSFSS

SEQ ID NO: 32648 - protein, 133 aa, Zea mays
MASFTASASTVSAARPALLLKPTVAISAPVLGLPPMGKKKGGVRCSMETKQGNVSVMGARVSAAATAALTAVMSNPAMALVDERMSTEGTGLPFGLSNNLLGWILFGVFGLIWTFFFVYTSSLEGGPGTQLPP

SEQ ID NO: 32649 - protein, 385 aa, Thermus thermophilus
MRGLSRRVQAMKPSATVAVNAKALELRRQGVDLVALTAGEPDFDTPEHVKEAARRALAQGKTKYAPPAGIPELREALAEKFRRENGLSVTPEETIVTVGGSQALFNLFQAILDPGDEVIVLSPYWVSYPEMVRFAGGVVVEVETLPEEGFVPDPERVRRAITPRTKALVVNSPNNPTGAVYPKEVLEALARLAVEHDFYLVSDEIYEHLLYEGEHFSPGRVAPEHTLTVNGAAKAFAMTGWRIGYACGPKEVIKAMASVSSQSTTSPDTIAQWATLEALTNQEASRAFVEMAREAYRRRRDLLLEGLTALGLKAVRPSGAFYVLMDTSPIAPDEVRAAERLLEAGVAVVPGTDFAAFGHVRLSYATSEENLRKALERFARVLGRA

SEQ ID NO: 32650 - protein, 335 aa, Magnaporthe grisea 70-15
MAARQTVLRAAARQCRSNLQRSPIASYSQPPVLQFSRNVSSSNETSTSNHNAAGSERTTHFGFQTVPESQKAERVADVFHNVAETYDRMNDLMSFGWHRVWKDHFVRTLNPGLSADPLKPSPQHILDVAGGTGDIAFRMLHNAHVLNANPNVRVTISDINASMLAVGRSRAESTLPPAQLSALSFLEADATDFLSANSSATPRHNVPAPGSLDLYTVAFGIRNFTDIPAALREAYRALRPGGVFACLEFSKADRHPLFNAVYKRWSFGAIPLIGQLVAGDRDSYQYLVESIERFPSQEEFRDMIVEAGFEVSGDGYEDLTGGVAAIHKGVKPLDG

SEQ ID NO: 32651 - protein, 429 aa, Bradyrhizobium japonicum USDA 110
MSVEISKLASGLTVVTDKMPHLETAALGVWAGVGGRDEKPNEHGISHLLEHMAFKGTTKRSSREIVEEIEAVGGDLNAGTSTETTSYYARVLKADVPLALDVLADILANPAFEPDELEREKNVIVQEIGAAQDTPDDVVFEHLNELCYPDQPMGRSLLGTAKTLRAFNRDMLRGYLSTHYRGPDMVVAAAGAVDHSQVVAEAEKRFASFEGTPGPKPQAAQFGKGGAKVVHRELEQAHLTLALEGVPQNDLSLFSLQVFTNILGGGMSSRLFQEVREKRGLCYSIYSFHAPYTDTGFFGLYTGTDPADAPEMMEVVVDVMNDSVETLTEAEIARAKAQMKAGLLMALESCSSRAEQLARHVLAYGRPQTVQELVARIDAVSVESTRDAARALLSRSRPAVVALGSGRGLDTAVSFAEGLTRARAKARLH

SEQ ID NO: 32652 - protein, 358 aa, Ashbya gossypii ATCC 10895
MAATRRSANCLQQLRSYGIDVKQLVLNTKVNVPSKEATVKPSKVPVTLSKPIPKATTSISMQLFEEYNPGIVLPKAADMSLISRFFNSSKVKFEWCAREYLEIPGERYKIEQAQLQQQELLDEKSFNESLDIREPTEAYRVSADIKNRPIPNTEQLTRGSFLLHDELPEIIFLGRSNAGKSTLLNNLTTNFKQVQLNRHATTSKKAGHTRALYCYNVGNRLRLVDSPGYGVMSTQQQGECTMQYIRERKQLRRCFMLISAKDGFTKTDYGMLEFLMNYGIAFEVIFTKMDKVRDVKTLRDSISTSGILDAPIRPRLMFLNSVVNKAYPKRLGIAHLRQTIFEACNIKPNTLPSKAYKQ

SEQ ID NO: 32653 - protein, 165 aa, Photobacterium sp. SKA34
MANEKTQSDLNEKLIAVNRVSKTVKGGRIFSFTALTVVGDGNGRIGFGYGKAREVPAAIQKAMEKARRNMVTIAINEGTLHHAVKGRHTGSQVYMQPASEGTGIIAGGAMRAVLEVAGIRNVLAKAYGSTNPINVVRATIDGLSGMNSPEMIAAKRGLSVKEILE

SEQ ID NO: 32654 - protein, 686 aa, Vibrio cholerae O1 biovar eltor str. N16961
MIVSMDVIKRVYQYAEPNLSLVGWMGMLGFPAYYFIWEYWFPQSYENLGLRCAAAVLFGGLVFRDSMPKKWQRYMPGYFLFTIGFCLPFFFAFMMLMNDWSTIWAMSFMASIFLHILLVHDTRVMALQALFSVLVAYLAVYGLTDFHPTTLIEWQYIPIFLFTYVFGNLCFFRNQISHETKVSIAKTFGAGIAHEMRNPLSALKTSIDVVRTMIPKPQTAAHTDYSLDAQELDLLHQILNEADDVIYSGNNAIDLLLTSIDENRVSPASFKKHSVVDVIEKAVKTFPYKNAADQHSVELEVHQPFDFFGSDTLLTYALFNLLKNAFYYQKEHFSVCISIEQTSEHNLIRVRDNGVGIAPEMLEDIFRDFYTFGKNGSYGLGLPFCRKVMSAFGGTIRCASQQGQWTEFVLSFPRYDSDTVNEIKTELLKTKSLIYIGSNQAIVRELNQLAVEDEFGFTAISAQQAVRRQDYEFEFDLILLDLDDATAQGELLPKLEGTLSFAEGCIGYVYDPGKTYAVNINRYLRIQPISIHSILRKPRKIIERLLFEQESLSMNRNVIPLQKSRHERRILVVDDNQSIRTFTAILLEQQGYEVVQANDGSEVLKHMESQNIDLVLMDIEMPNVGGLEATRLIRNSEHEYKNIPIIGYTGDNSPKTLALVQTSGMNDFIVKPADRDVLLNKVAAWV

SEQ ID NO: 32655 - protein, 641 aa, Ricinus communis
MISLKNSFLSGSCSSPVPGKQRAGLVVPTAPSSLKVVALNPNRERNGSIMMESTLQEMRDGASVLDLDPKSTVAGGVRDVYGEDTATEDQFVTPWSLSVASGYSLLRDPHHNKGLAFNDKERDAHYLRGLLPPAIVSQELQVKKMMHIIRQYQLPLQKYMAMMDLQERNERLFYKLLIQNVEEMLPIVYTPTVGEACQKYGSIFGRPQGLYISLKEKGRILEVLRNWPEKNIQVIVVTDGERILGLGDLGCQGMGIPVGKLSLYTALGGVRPSSCLPVTIDVGTNNEKLLNDEFYIGLRQRRATGQEYAELLHEFMTAVKQNYGERVLVQFEDFANHNAFDLLAKYGTTHLVFNDDIQGTASVVLAGLVAALKLVGGSLADHRFLFLGAGEAGTGIAELIALEMSKQTNMPVEETRKKIWLVDSKGLIVSSRMDSLQHFKRPWAHEHEPIKTLLDAVNDIKPTVLIGTSGVGRTFTKEVVEAMASFNEKPIILALSNPTSQSECTAEEAYTWSQGRAIFASGSPFAPVEYEGKVYVPGQANNAYIFPGFGLGLIMSGTIRVHDDMLLAASEALAAQVTQENFDKGLIYPPFTNIRKISANIAANVAAKAYELGLASRLPQPKDLVKYAESCMYSPAYRSYR

SEQ ID NO: 32656 - protein, 470 aa, Selenomonas ruminantium
MLKKTKIVCTQGPSTEKPGVIDALIANGMNCARFNFSHGDHEEHLGRINMVREAAKKAGKVISLILDTKGPEMRLGEFKDGKVMLEKGNKFTLTYDDEPGDETHVSVNHKGLYTEVKPGDTLLLSDGLVALKVDEIKGKDIVTTIQNSGKMSTRKRVAAPGVPLGLPPISEQDAKDIIFGCEQDMDFVAASFIQRPDDVIAIRKLIEEHNGHMEILPKIENLEGVKNFDAILEVSDGIMVARGDLGVEVPAEDVPLIQKEIIRKCNAAGKPVIVATQMLDSMERNPRPTRAEVSDVGNAILDGTDAIMLSGETASGDYPVEAVATMNRIAQRMESSLEYKELYVERGLQHMESRTRAIAHATVQMAYELDAPAIITPTESGYTTKVVSKYRPKAAIVAYTPSEKVLRQLNLRWGVYPVLGTQWSDVDEMISNATAAAVKEDLVQRGDLTIITSGVKMESRTRAIAHATDI

SEQ ID NO: 32657 - protein, 185 aa, Phaeodactylum tricornutum
AGGIAEMSELPEEVRERTDILDSVGNTTAAIGKGFAIASAALTALALFAAYVEFTGIDGINIYKADVLAALFIGGMVPVVFSALAMNSVGKAAMEMVKEVRRQFKEIPGIMEGTGTPEYGKCVDISTKAALREMMLPGAITIVAPILIGFLMGPEALGSYMAGVAVSGVLWAIFQNNAGGAWDNA

SEQ ID NO: 32658 - protein, 394 aa, Kineococcus radiotolerans SRS30216
MHTAALLIELGAVIFGLGLVGRLAGRLGISPVPLYLLAGLAFGAGGVVPLNAPDAFLEAASQIGVVMLLLLLGLEYSAGDLLGNLRRQAPVGVLDLLLNGLPGAAFGLLLGFGPVGALAMFGITAVSSSGIVAKVLADLGRLGNRETPSILGILVLEDLGMAVYLPILTAVLAASGVWEATGSVLIALACLAVALVVALRWGSVISKFVSGGSGEVTLLRVLGLALLVAGVAEQLHVSAAVGAFLLGISLSNDLEEETHHRLEPLRDLFAAVFFVSFGLSTDPSSLPPVLLPALGLVVVGVLTKLVTGWVAAKRAGIAVPGRIRAGAALIPRGEFSIVIAGLATAAGVDPQLAALAAAYVLAMAVLGPVLARFADPWARAYVRRQRERAATTVR

SEQ ID NO: 32659 - protein, 189 aa, Phaeodactylum tricornutum
AGGIAEMAELEERVRDTTDALDALGNTTAATGKGFAIGSAVLTALSLLSAFTDKAGLGNVNVDIGEPVVLAGVLIGAMLPFLFAALTMLSVQKAAGAIIIEVRRQFAEIPGLREGTAEADSDKCVAISTQSSVEEMVLPGIYAILSPITVGFLIGPRCLTGLLGGAIASGMMLALMMIQSNAGGAWDNA

SEQ ID NO: 32660 - protein, 162 aa, delta proteobacterium MLMS-1
MRLELLLLGKTRQDYLARGIDDFSRRLRRYVELEIKVIKPPKPPGAAGRQGGGAERELIREEGRLLLSRLTPGSCLVALDAGGRELDSPGLADLLERWQQQGKSRLSFVLGGHLGLDSAVLERAELVLALSRLTFTHEMARLLLLEQLYRAWTIQQGGNYHK

SEQ ID NO: 32661 - protein, 183 aa, Porphyra purpurea
AGGIAEMSGLPKEVRERTDILDAVGNTTATTGKGFAIAFAALTSLALFAAFVGIAGIDSIDIYKADVLAGLFVGAMVPFIFSALSIAAVGRAAMEMVQEVRRQFKEIPGIMEYKANPEYDKCVDISTKASIREMMLPGAIAIITPIVVGFIFGPEMLGGLLAGVTVSGVLMHFQNSGGAWDNA

SEQ ID NO: 32662 - protein, 208 aa, Porphyra purpurea
AGGISEMAELPSEVRERTDKLDAVGNTTAAVGKGFAIASAALTALALFAAFMKTAGVTAIDVSQPKIMAGLLVGGMLPFVFSALSMNAVGRAAMAMIEEVRRQFRDIPKLKAALEVMRAVDSDMTKASKEQRAIFDEADGVADYGKCIDISTKASIKEMVFPGLLAIVVPVAVGFLALEAEMVGGLLAGVTTGSLNAISNTGGAWDNA

SEQ ID NO: 32663 - protein, 336 aa, Clostridium thermocellum ATCC 27405
MAVKIGINGFGRIGRLVFRASLNNPNVEVVGINDPFIDLEYMQYMLKYDTVHGQFKGEISQDNGKLVVNGRKISVYGFTDPAEIPWSECGAEYIVESTGVFTTTEKASAHFKGGAKKVVISAPSADAPMFVMGVNHDKYTKDMNVVSNASCTTNCLAPLAKVIHENFGIVEGLMTTVHATTATQKTVDGPSKKDWRGGRAAAGNIIPSSTGAAKAVGKVIPELNGKLTGMAFRVPTLDVSVVDLTCRLEKPATYDEIKAAVKKASENELKGILGYTEDAVVSSDFIGDPRTSIFDAEAGISLNSNFVKLVAWYDNEWGYSNKVVDLIVHMASVDAK

SEQ ID NO: 32664 - protein, 397 aa, Clostridium thermocellum ATCC 27405
MAMMNKKTIEDIDVKGKKVIVRVDFNVPLDENRKITDDKRIVGALPTIKYLVEHGAKTILVSHLGRPKEGFEEKYSMAPTAVRLGELLGKEVIMAKDVIGPDAKAKAAALKEGEVLMLENVRFHKEETKNDPAFAKELASMAEIYVNDAFGTAHRAHASTAGLADYLPAVCGYLIQKEIEVMGKALSNPERPFVAILGGAKVSDKIGVIENLIDKVDTLIIGGGMAYTFFKAKGYSIGTSLCEDDKVELAKSLMDKAEKKGVKLLLPVDNVVGKEFSNDTERKTVPSDQIPDGWMGMDIGEETIKLYSEAIKNAKTVVWNGPMGVFEFSNFANGTREVARAVAESGAISIIGGGDSAAAIEQLGFADKITHISTGGGASLEFLEGKVLPGIDVLMDK

SEQ ID NO: 32665 - protein, 325 aa, Vitis vinifera
MDHLKKLSTVLCFLLLQFGVEGRGLSYSIYQKSCPQVEDIVRAALGPIFLSDPSSPPAFLRLLFHDCQVQGCDASILVDPAGGKTPLEMASSKNFGVRKRESISLIKSVVEAQCPGTVSCADILVMAARDAVAFSGGPWIKVPFGRRDSSRATSYKLADALLPPANVDVNGLLQIFTQKGMTIKEAVAIIGAHTIGITHCLNIRDRLQRPEGGGRARGMEPGFEAFLRLSCPEGSLISNSTFVVNDPSAFTFDNHYYSNAMHGRGILRVDAEVSSDSRTAPIVSSFAADQSEFFRYFASAFVKLSTSGVLTGNQGVIRKSCNRLD

SEQ ID NO: 32666 - protein, 251 aa, Clostridium thermocellum ATCC 27405
MSRKVIAAGNWKMNKTPKEAVEFVQALKGRVADADTEVVVGVPFVCLPGVVEAAKGSNIKVAAQNMHWEEKGAFTGEVSGPMLAELGVDYVIIGHSERRQYFGETDETVNKKVHAAFKYGLKPIICVGESLTQREQGVTAELVRYQVKIALLGLSAEQVKEAVIAYEPIWAIGTGKTATNEQAEEVCGIIRECIKELYGQDVAEAIRIQYGGSVNAANAAELFNMPNIDGGLVGGASLKLDDFEKIAKYNK

SEQ ID NO: 32667 - protein, 511 aa, Clostridium thermocellum ATCC 27405
MKDKLVMLIILDGYGINPRKEGNAIEAANKPNIDRFMREYPNTIVRTSGMDVGLPDGQMGNSEVGHTNIGAGRIVYQELTRITKSIQDGDFFEKKEFLDAAENCRKHNSKLHLFGLLSDGGVHSHNTHLYGLLEFAKRQNLKDVYVHCFFDGRDVPPDSAMGYVEELENKIREIGVGEIATVMGRYYAMDRDNRWERVKLAYDAMVLGRGNQAQSAKEAVAESYKRQEFDEFVKPTVIMKNGSPVATVGENDSIIFFNFRPDRAREITRAFTEVNFSGFEREKGYFPVFFVCMTQYDKTFENVVVAFKPESLENTFGEYISKKGLRQLRIAETEKYAHVTFFFNGGVEAVYEGEDRILINSPKVATYDLKPEMSAYEVTDKVLECINKKEYDVIILNYANPDMVGHTGVFEAAKAAIEAIDECLGKVVPAVLEQNGVVLITADHGNSEQMIDYETGGPFTAHTTNPVPLIVIGLGDVKLREGRLADLAPTMLDILGFEKPKEMTGESLIVK

SEQ ID NO: 32668 - protein, 430 aa, marine gamma proteobacterium HTCC2143
MAEIVDIKAFEVLDSRGNPTVEADVILASGAVGSACAPSGASTGSREALELRDGDKSRYLGKGVLKAVNNINTTIKHLLVGKDAENQRALDQLMIDTDGTDNKGTLGANAILAVSLAAAKAVAIEKGIPLYQHIADINGTPGQYTMPVPMMNIINGGEHADNNVDIQEFMVQPVGASSFAEALRTGAEIFHSLKNVLKSKGLNTAVGDEGGFAPNLASNAEALAVIKQAVADAGYELGKDVTLALDCAASEFYKDGQYDLAGEGQVFSANGFSDYLAALCEQYPIISIEDGMDESDWDGWKYQTEILGDKIQLVGDDLFVTNTKILQEGIDKSIANSILIKFNQIGTLTETLEAIKMAKAAGYSVVISHRSGETEDTTIADLAVATSAGQIKTGSLCRSDRVAKYNRLLRIEAELAGAAPYRGRAEIRSQ

SEQ ID NO: 32669 - protein, 381 aa, Burkholderia pseudomallei K96243
MLPSFSPALLALADGTVFRGYSIGAAGHTIGEVVFNTAITGYQEILTDPSYARQIVTLTYPHIGNVGVNAEDVEATKVHAAGLIVRDLPALASNFRMARTLGDYLRDEGVVAIAGIDTRKLTRILRDKGAQNGCILTGSDDETKALALARSFPGLAGMDLAKVVSTAKPFEWKQTEWRLGSGYGMQETPRYRVVAFDFGVKYNILRMLAERGCHVSVLPAQSSAADALALNPDGIFLSNGPGDPQPCDYAIAATREFIERGVPTFGICLGHQIMGLALGAKTLKMKTGHHGANHPVKDLANGRVVITSQNHGFAVDADSLPANARATHVSLFDGTLQGFELTDKPAFCFQGHPEASPGPHDIGYLFDRFTALMDAAKARSA

SEQ ID NO: 32670 - protein, 433 aa, Clostridium thermocellum ATCC 27405
MKQYLEIESVFAREILDSRGNPTVEVEVIAEGGFVGRAAVPSGASTGAFEAVELRDNDKNRYLGKGVQKAVENVNNIIAPEVEGMNVFDQAAVDNLMISLDGTPNKSKLGANAILGVSLATAKAAAEALGLSLYQYIGGVNAKTLPVPMMNIINGGKHADNSVNIQEFMIMPVGASSFRHALQMCAEVFHNLKKVLKDKGYSTAVGDEGGFAPNLKTDEEAIQVILEAVEKAGYKPGDDFRLAIDAASTEMYQEDGTYLFWKSGVKKTKEEMINYWEELVNKYPIISLEDGVAEEDWEGWKMLTERLGKRIQLVGDDLFVTNTTRLKKGIELGVANSILIKVNQIGTLTETLDAIEMANRAGYTAVVSHRSGETEDATIADIAVATNAGQIKTGAPSRTDRVAKYNQLLRIEEEIGAVSRYPGLDAWFNLKKK

SEQ ID NO: 32671 - protein, 157 aa, marine gamma proteobacterium HTCC2143
MRIGHGYDVHRFGEGDHIQMGGVTIPHDRGLVAHSDGDVALHALCDALLGACALGDIGSHFPDTDSRYKNINSRDLLKQVYQLVLSQGYRLANADITIIAQSPKMAPFIEPMRIAIAAAIAVDIGQLSVKATTTETLGFAGRKEGIAVHAVVLLLSA

SEQ ID NO: 32672 - protein, 8817 aa, Sorangium cellulosum
MNNDEKLVSYLQQAMNELQRAHQRLRAVEEKEHEPIAIVAMSCRFPGDVRTPEDLWKLLLDGKDAISDLPPNRGWKLDALDVHGRSPVREGGFFYDADAFDPAFFGISPREALAIDPQQRLLLEISWEAFERAGIDPASLQGSQSGVFVGVIHNDYDALLENAAGEHKGFVATGSTASVASGRIAYTFGFQGPAISVDTACSSSLVAVHLACQALRRGECSLALAGGVTVMATPAVFVAFDSESAGAPDGRCKSFSVEANGSGWAEGAGMLLLERLSDAVQNGHPVLAVLRGSAVNQDGRSQGLTAPNGPAQERVIRQALDSARLTPKDVDVVEAHGTGTTLGDPIEAQAILATYGEAHSQDRPLWLGSLKSNLGHAQAAAGVGSVIKMVLALQQGLLPKTLHAQNPSPHIDWSPGTVKLLNEPVVWTTNGHPRHAGVSAFGISGTNAHVILEEAPAIARVEPAASQPASEPLPAAWPVLLSAKSEAAVRAQAKRLRDHLLAKSELALADVAYSLATTRAHFEQRAALLVKGRDELLSALDALAQGHSAAVLGRSGAPGKLAVLFTGQGSQRPTMGRGLYDVFPVFRDALDTVGAHLDRELDRPLRDVLFAPDGSEQAARLEQTAFTQPALFALEVALFQLLQSFGLKPALLLGHSIGELVAAHVAGVLSLQDGCTLVAARAKLMQALPQGGAMVTLRASEEEVRDLLQPYEGRASLAALNGPLSTVVAGDEDAVVEIARQAEALGRKTTRLRVSHAFHSPHMDGMLDDFRRVAQSLTYHPARIPIISNVTGARATDHELASPDYWVRHVRHTVRFLDGVRALHAEGARVFLELGPHAVLSALAQDALGQDEGTSPCAFLPTLRKGRDDAEAFTAALGALHSAGITPDWSAFFAPFAPRKVSLPTYAFQRERFWPDASKAPGADVSHLAPLEGGLWQAIERGDLDALSGQLHVDGDERRAALALLLPTLSSFRHERQEQSTVDAWRYRITWKPLTTAETPADLAGTWLVVVPAALDDDALPSALTEALTRRGARVLALRLSQAHLDREALAEHLRQACAETAPIRGVLSLLALDERPLADRPALPAGLALSLSLAQALGDLDLEAPLWFFTRGAVSIGHSDPLAHPAQAMTWGLGRVIGLEHPDRWGGLVDVCAGVDESAVGRLLPALAERHDEDQLALRPAGLYARRIVRAPLGDAPPARDFTPGGTILITGGTGAIGAHVARWLARRGAQHLVLISRRGAEAPGASELHDELSALGARTTLAACDVADRNAVATLLEQLDAEGSQVRAVFHASGIEHHAPLDATSFRDLAEVVSGKVEGAKHLHDLLGSRPLDAFVLFSSGAAVWGGGQQGGYAAANAFLDALAEHRRSAGLTATSVAWGAWGGGGMATDQAAAHLQQRGLSRMAPSLALAALALALEHDETTVTVADIDWARFAPSFSAARPRPLLRDLPEAQRALETSEGASSEHGPAPDLLDKLRSRSESEQLRLLVSLVRHETALVLGHEGASHVDPDKGFLDLGLDSLMAVELRRRLQQATGIKLPATLAFDHPSPHRVALFLRDSLAHALGTRLSVEPDAAALPALRAASDEPIAIVGMALRLPGGVGDVDALWEFLAQGRDGVEPIPKARWDAAALYDPDPDAKTKSYVRHAAMLDQVDLFDPAFFGISPREAKHLDPQHRLLLESAWQALEDAGIVPPTLKDSPTGVFVGIGASEYALREASTEDSDAYALQGTAGSFAAGRLAYTLGLQGPALSVDTACSSSLVALHLACQALRQGECNLALAAGVSVMASPEGFVLLSRLRALAPDGRSKTFSANADGYGRGEGVIVLALERLGDALARGHRVLALVRGTAINHDGASSGITAPNGTSQQKVLRAALHDARITPADVDVVECHGTGTSLGDPIEVQALAAVYADGRPAEKPLLLGALKTNIGHLEAASGLAGVAKIVASLRHDALPPTLHTGPRNPLIDWDTLAIDVVDTPRSWARHEDSSPRRAGVSAFGLSGTNAHVILEEAPAALSGEPATSQTASRPLPAACAVLLSARSEAAVRAQAKRLRDHLLAHDDLALIDVAYSQATTRAHFEHRAALLARDRDELLSALDSLAQDKPAPSTVLGRSGSHGKVVFVFPGQGSQWEGMALSLLDSSPVFRAQLEACERALAPHVEWSLLAVLRRDEGAPSLDRVDVVQPALFAVMVSLAALWRSLGVEPAAVVGHSQGEIAAAFVAGALSLEDAARIAALRRKALTTVGGNGGMAAVELGASDLQTYLAPWGDRLSTAAVNSPRATLVSGEPAAVDALLDVLTATKVFARKIRVDYASHSAQMDAVQDELAAGLANIAPRTCELPLYSTVTGTRLDGSELDGAYWYRNLRQTVLFSSATERLLDDGHRFSVEVSPHPVLTLALRETCERSPLDPVVVGSIRREEGHLARLLLSWAELSTRGLALDWKDFFAPYAPRKVSLPTYPFQRERFWLDVSTDERFRRRLRRPDLGRPIPLLGAAVAFADRGGFLFTGRLSLAEHPWLEGHAVFGTPILPGTGFLELALHVAHRVGLDTVEELTLEAPLALPSQDTVLLQISVGPVDDAGRRALSFHSRQEDALQDGPWTRHASGSLSPATPSLSADLHEWPPSSAIPVDLEGLYATLANLGLAYGPEFQGLRSVYKRGDELFAEAKLPEAAEKDAARFALHPALLDSALHALAFEDEQRGTVALPFSWSGVSLRSVGATTLRVRFHRPKGESSVSIVLADAAGDPLASVQALAMRTTSAAQLRTPAASHHDALFRVDWSELQSPTSPPAAPSGVLLGTGGHDLALDAPLARYADLAALRSALDQGASPPGLVVAPFIDRPAGDLVPSAHEATALALALLQAWLADERLASSRLVLVTRRAVATHTEDDVKDLAHAPLWGLARSAQSEHPDLPLFLVDIDLSEASQQALLGALDTGERQLALRNGKPLIPRLAQPRSTDALIPPQAPTWRLHIPTKGTFDALALVDAPEAQAPLAHGQVRIAVHAAGLNFRDVVDTLGMYPGDAPPLGGEGAGIVTEVGPGVSRYTVGDRVMGVFGAAFGPTAIADARMICPIPHAWSFAQAASVPIIYLTAYYGLVDLGHLKPNQRVLIHAAAGGVGTAAVQLARHLGAEVFATASPGKWSALRALGFDDAHLASSRDLGFEQHFLRSTHGRGMDVVLDCLAREFVDASLRLMPSGGRFIEMGKTDIREPDAIGLAYPGVVYRAFDVTEAGPDRIGQMLAELLSLFERGVLRLPPITSWDIRHAPQAFRALAQARHVGKFVLTIPRPIDPEGTVLITGGTGTLGVLVARHLVAKHSAKHLLLTSRKGARAPGAEALRSELEALGASVTLVACDVADPRALRTLLDSIPRDHPITAVVHAAGALDDGPLGSMSAERIARVFDPKLDAAWYLHELTQDEPVAAFVLFSAASGVLGGPGQSNYAAANAFLDALAHHRRAQGLPAASLAWGYWAERSGMTRHLSAADAARMRRAGVRPLDTDEALSLFDVALLRPEPALVPAPFDYNVLSTSADGVPPLFQRLVRARIARKAASNTALASSLAEHLSSLPPAERERVLLDLVRTEAASVLGLASFESLDPHRPLQELGLDSLMALELRNRLAAAAGLRLQATLLFDYPTPTALSRFFTTHLFGGTTHRPGVPLTPGGSEDPIAIVAMSCRFPGDVRTPEDLWKLLLDGQDAISGFPQNRGWSLDALDAPGRFPVREGGFVYDADAFDPAFFGISPREALAVDPQQRILLEITWEAFERAGIDPASLQGSQSGVFVGVWQSDYHASLVNATGEYKGLVATGSAASVASGRIAYTFGLQGPAISVDTACSSSLVAVHLACQALRHGECSLALAGGVTIMATPGIFIAFDSESAGAPDGRCKAFSAEADGSGWAEGAGMLLLERLSDAVQNGHPVLAVLRGSAVNQDGRSQGLTAPNGPAQERVIRQALDSARLTPKDVDVVEAHGTGTTLGDPIEAQAVFATYGEAHSQDRPLWLGSLKSNLGHTQAAAGVGGIIKMVLALQHGLLPKTLHAQNPSPHIDWSPGIVKLLNEAVAWTTSGHPRRAGVSSFGVSGTNAHVILEEAPAATRAESGASQPASQPLPAAWPVVLSARSEAAVRAQAQRLREHLLAQGDLTLADVAYSLATTRAHFEHRAALVAHDRDELLSALDSLAQDKPAPSTVLGRSGSHGKVVFVFPGQGSQWEGMALSLLDSSPVFRTQLEACERALRPHVEWSLLAVLRRDEGAPSLDRVDVVQPALFAVMVSLAALWRSLGVEPAAVVGHSQGEIAAAFVAGALSLEDAARIAALRSKASPPSPATGMAAVELGASDLQTYLAPWGDRLSIAAVNSPRATLVSGEPAAVDALIDSLTAAQVFARRVRVDYASHSAQMDAVQDELAAGLANIAPRTCELPLYSTVTGTRLDGSELDGAYWYRNLRQTVLFSSATERLLDDGHRFFVEVSPHPVLTLALRETCERSPLDPVVVGSIRRDEGHLPRLLALLGRALWPGLTPEWKAFFAPFAPRKVSLPTYAFQRERFWLDAPNAHPEGVAPAAPIDGRFWQAIERGDLDALSGQLHADGDEQRAALALLLPTLSSFHHQRQEQSTVDTWRYRITWRPLTTAATPADLAGTWLLVVPSALGDDALPATLTDALTRRGARVLALRLSQVHIGRAALTEHLREAVAETAPIRGVLSLLALDERPLADHAALPAGLALSLALVQALGDLALEAPLWLFTRGAVSIGHSDPLAHPTQAMIWGLGRVVGLEHPERWGGLVDLGAALDASAAGRLLPALAQRHDEDQLALRPAGLYARRFVRAPLGDAPAARGFMPRGTILITGGTGAIGAHVARWLARKGAEHLVLISRRGAQAEGAVELHAELTALGARVTFAACDVADRSAVATLLEQLDAGGPQVSAVFHAGGIEPHAPLAATSMEDLAEVVSGKVQGARHLHDLLGSRPLDAFVLFSSGAVVWGGGQQGGYAAANAFLDALAEQRRSLGLTATSVAWGVWGGGGMATGLLAAQLEQRGLSPMAPSLAVATLALALEHDETTLTVADIDWARFAPSFSAARSRPLLRDLPEAQRALEASADASSEQDGATGLLDKLRNRSESEQIHLLSSLVRHEAALVLGHTDASQVDPHKGFMDLGLDSLMTVELRRRLQQATGIKLPATLAFDHPSPHRVALFLRDSLAHALGARLSVERDAAALPALRSASDEPIAIVGMALRLPGGIGDVDALWEFLAQGRDAVEPIPHARWDAGALYDPDPDAKAKSYVRHAAMLDQVDLFDPAFFGISPREAKYLDPQHRLLLESAWLALEDAGIVPSTLKDSPTGVFVGIGASEYALRNTSSEEVEAYALQGTAGSFAAGRLAYTLGLQGPALSVDTACSSSLVALHLACQALRQGECNLALAAGVSVMASPGLFVVLSRMRALAPDGRSKTFSTNADGYGRGEGVVVLALERLGDALARGHRVLALVRGTAMNHDGASSGITAPNGTSHQKVLRAALHDAHIGPADVDVVECHGTGTSLGDPIEVQALAAVYADGRPAEKPLLLGALKTNIGHLEAASGLAGVAKIVASLRHDALPPTLHTTPRNPLIEWDALAIDVVDATRAWARHEDGSPRRAGVSAFGLSGTNAHVILEEAPAIPQAEPTAAQLASQPLPAAWPVLLSARSEPAVRAQAQRLRDHLLAHDDLALADVAYSLATTRATFEHRAALVVHDREELLSALDSLAQGRPAPSTVVERSGSHGKVVFVFPGQGSQWEGMALSLLDTSPVFRAQLEACERALAPHVDWSLLAVLRGEEGAPPLDRVDVVQPALFSMMVSLAALWRSMGVEPDAVVGHSQGEIAAACVAGALSLEDAAKLVALRSRALVELAGQGAMAAVELPEAEVARRLQRYGDRLSIGAINSPRFTTISGEPPAVAALLRDLESEGVFALKLSYDFASHSAQVESIRDELLDLLSWLEPRSTAVPFYSTVSGAAIDGSELDAAYWYRNLRQPVRFADAVQGLLAGEHRFFVEVSPSPVLTLALHELLEASERSAAVVGSLWSDEGDLRRFLVSLSELYVNGFALDWTTILPPGKRVPLPTYPFQRERFWLDASTAPAAGVNHLAPLEGRFWQAIESGNIDALSGQLHVDGDEQRAALALLLPTLASFRHERQEQGTVDAWRYRITWKPLTTATTPADLAGTWLLVVPAALDDDALPSALTEALARRGARVLAVRLSQAHLDREALAEHLRQACAETAPPRGVLSLLALDESPLADHAAVPAGLAFSLTLVQALGDIALDAPLWLFTRGAVSVGHSDPIAHPTQAMTWGLGRVVGLEHPERWGGLVDVGAAIDASAVGRLLPVLALRNDEDQLALRPAGFYARRLVRAPLGDAPPARTFKPRGTLLITGGTGAAGAHVARWLAREGAEHLVLISRRGAQAEGASELHAELTALGARVTFAACDVADRSAVATLLEQLDAEGSQVRAVFHAGGIGRHAPLAATSLMELADVVSAKVLGAGNLHDLLGPRPLDAFVLFSSIAGVWGGGQQAGYAAGNAFLDALADQRRSLGQPDTSVVWGAWGGGGGIFTGPLAAQLEQRRLSPMAPSLAVAALAQALEHDETTVTVADIDWARFAPSISVARSRRSCATCPSSAPSKTEKARPPPSTARPPDLLDKLRSRSESEQLRLLAALVCDETALVLGHEGRFPARPRQGFFDLGLDSIMTVELRRRLQQATGIKLPATLAFDHPSPHRVALFMRDSLAHALGTRLSAEATPPRSGRASSDEPIAIVGMALRLPGGVGDVDALWEFLHQGRDAVEPIPQSRWDAGALYDPDPDADAKSYVRHAAMLDQIDLFDPAFFGISPREAKHLDPQHRLLLESAWLALEDAGIVPTSLKDSLTGVFVGICAGEYAMQEASSEGSEVYFIQGTSASFGAGGLAYTLGLQGPRSSVDTACSSSLVSLHLACQALRQGECNLALAAGVSLMVSPQTFVILSRLRALAPDGRSKTFSDNADGYGRGEGVVVLALERIGDALARRHRVLVLVRGTAINHDGASSGITAPNGTSQQKVLRAALHDARITPADVDVVECHGTGTSLGDPIEVQALAAVYADGRPAEKPLLLGALKTNIGHLEAASGLAGVAKMVASLRHDALPPTLHATPRNPLIEWEALAIDVVDTPRPWPRHEDGSPRRAGISAFGFSGTNAHVILEEAPAALPAEPATSQPASQAAPAAWPVLLSARSEAAVRAQAKRLRDHLVAHDDLTLADVAYSLATTRAHFEHRAALVAHNRDELLSALDSLAQDKPAPSTVLGRSGSHGKLVFVFPGQGSQWEGMALSLLDSSPVFRAQLEACERALAPHVEWSLLAVLRRDEGAPSLDRVDVVQPALFAVMVSLAALWRSLGVEPAAVVGHSQGEIAAAFVAGALSLEDAARIAALRSKALTTVAGNGAMAAVELGASDLQTYLAPWGDRLSIAAVNSPRATLVSGEPAAIDALIDSLTAAQVFARKVRVDYASHSAQMDAVQDELAAGLANIAPRTCELPLYSTVTGTRLDGSELDGAYWYRNLRQTVLFSSATERLLDDGHRFFVEVSPHPVLTLALRETCERSPLDPVVVGSIRRDEGHLARLLLSWAELSTRGLALDWNAFFAPFAPRKVSLPTYPFQRERFWLDASTAHAADVASAGLTSADHPLLGAAVALADRDGFVFTGRLSLAEHPWLEDHVVFGIPCPARRRLLELALHVAHLVGLDTVEDVTLDPPLALPSQGAVLLQISVGPADGAGRRALSVHSRRHDALQDGPWTRHASGSLAQASPSHCLRCSANGPPSGATQVDTQGFYAALESAGLAYGPEFQGLRRRLQARRRALRRSQAPGRRRRGRRSFCPPPRPARQRLAGARLCRRPGKGLQDALLVERSIAALRSEPPPCACVSTVLRANPRARSSSPTPEANPSPRCKRSPCAPRPPSSSADPGASHLDALFRIDWSELQSPTSPPIAPSGALLGTEGLDLGTRVPLDRYTDLAALRSALDQGASPPSLVIAPFIALPEGDLIASARETTAHALALLQAWLADERLASSRLALVTRRAVATHAEEDVKGLAHAPLWGLARSAQSEHPERPLVLVDLDDSEASQHALLGALDAREPEIALRNGKPLVPRLSRLPQAPTDTASPAGLGGTVLITGGTGTLGALVARRLVVNHDAKHLLLTSRQGASAPGADVLRSELEALGASVTLAACDVADPRALKDLLDNIPSAHPVAAVVHAASVLDGDLLGAMSLERIDRVFAPKIDAAWHLHQLTQDKPLAAFILFSSVAGVLGSSGHSNYAAASAFLDALAHHRRAQGLPASSLAWSHWAERSAMTEHVSAAGAPRMERAGLPSTSEERLALFDAALFRTETALVPARFDLSALRANAGSVPPLFQRLVRARTVRKAASNTAQASSLTERLSALPPAERERALLDLIRTEAAAVLGLASFESLDPDRLLQELGLDSIIALDLRNRLAAATGVRLPATLLFEHPTPAALAALLLARLEPGMRRGPAKDGASPTDTESDGALLGMVQPANEIGAIEEARNLIAAALKVRLAVEDASKRSAVAIAEEPPTRLARGQATPQLICFPAFVVPSAPIQYARFASHLRDRRDIWFIPHPGYRHKTPLTRSLDELVSSHARTTLACARNSPFVLFGHSSGGNIAHMVAEHLESIGHGPAGVVLLDSYDYASPAVEAGLKIFHVEQLQTWGASDAGLTAEAWYYEHIGLETWKPRQLAAPTLHVRATEPMKQFVGSEGAPAEWRASWKLPHVAIDAPGDHATVVDHPFLAQAVDDWLSSLSNEPSNQ

SEQ ID NO: 32673 - protein, 6315 aa, Sorangium cellulosum
MTKEYTRPQSAPLTEGDLLTLIVAHLAERLRMDARFIDVHEPFSRHGLDSRGAVDLVVDLRTALGRPLSPVVVWQHPTPDALARHLAGGADAREGQARADSAYERPGAPNEPIAIVGMACRFPGAPDVDSYWRLLSGGVDAVTEVPAGRWDMDAFYDRDPRSLGDVSTLRGGFIDDVDRFDAMFFGISPREAVSMDPQQRLMLELAWEALEDAGIVAERLKESLTGVFFGCIWDDYVTLIHQRGRGAIAQHTVTGNHRSIIANRVSYTLDLRGPSMTVDSACSSALVTIHMACESLRSGESTLALAGGVNLNIAPESTIGVHKFGGLSPDGRCFTFDARANGYVRGEGGGVVVLKRLSSAIADGDPIICVIRGSAVNNDGASNGLTGPNPLAQEAVLRTAYERAGVNPADVQYVELHGTGTQLGDPVEASALGAVLGKRRPAERPLLVGSAKTNVGHLEGAAGIVGLLKAALCLKHKQLAPNLNFETPNPHIPFAELNLKVQGALGPWPDMDRPLVCGVSSFGLGGTNAHVVLSEWASLEAELHPLAAESPEALREEVQRRLLTMTSLVGRAPLSFLCGRSAAQRSAKEHRLAVTARSFEELKQRLLGFLEHEKHVSVSAGRVDLGAAPKVVFVFAGQGAQWFGMGRALLQREPVFRTTIEQCSSFIQQNLGWSLLDELMTDRESSRLDEIDVSLPAIISIEIALAAQWRAWGVEPAFVVGHSTGEIAAAHVAGVLSIEDAMRTICAYGRIIRKLRGKGGMGLVALSWEDAGKELTGYEGRLFRAIEHSADSTVLAGEPDALDALLQALERKNVFCRRVAMDVAPHCPQVDCLRDELFDALREVRPNKAQIPIVSEVTGTALDGERFDASHWVRNFGDPALFSTAIDHLLQEGFDIFLELTPHPLALPAIESNLRRSGRRGVVLPSLRRNEDERGVMLDTLGVLYVRGAPVRWDNVYPAAFESMPLPSTAGGGKPLPPMPLLISARTDAALAAQAARLRAHLDSHLDLELVDVAYSLAATRTHFERRAVVVARDRAGILDGLDALAHGGSAALLGRSAAHGKLAILFTGQGSQRPTMGRALYDAFPVFRGALDAAAAHLDRDLDRPLRDVLFAPDGSEQAARLDQTAFTQPALFALEVALFELLQSFGLKPALLLGHSIGELVAAHVAGVLSLQDACTLVAARAKLMQALPQGGAMVTLQASEQEARDLLQAAEGRVSLAAVNGHLSTVVAGDEDAVLKIARQVEALGRKATRLRVSHAFHSPHMDGMLDDFRRVAQGLTFHPARIPIISNVTGARATDQELASPETWVRHVRDTVRFLDGVRTLHAEGARAFLELGPHPVLSALAQDALGHDEGPSPCAFLPTLRKGRDDAEAFTAALGALHAAGLTPDWNAFFAPFAPCKVPLPTYTFQRERFWLDASTAHAASATPAAALEGRFWQAVESGDIDTLSSELHVDGDEQRAALALVLPTLSSFRHKRQEQSTVDAWRYRVTWKPLTTAATPADLAGTWLLVVPSALGDDALLATLTEALTRRGARVLALRVSDIHIGRSALVEHLREALAETAPLRGVLSLLALDEHRLADRSALPAGLALSLALVQGLDDLAIEAPLWLFTRGAVSIGHSDPITHPTQAMIWGLGRVVGLEHPERWGGLVDVSAGVDESAVGRLLPALAQRHDEDQLALRPAGLYARRIVRAPLGDAPPAREFRPRGTILITGGTGALGAHVARWLARQGAEHLILISRRGAEAPGASELHAELNALGVRTTLAACDVADRSALQALLDSIPSDCPLTAVFHTAGARDDGLIGDMTPERIERVLAPKLDSALHLHELTKNSALDAFVLYASLSGVLGNPGQANYAAANAFLDALAEHRRSLGLTATSVAWGGWGGGGMATERVAAQLQQRGLLQMAPSLALAALAQALQQDETTITVADIDWSRFAPAFSVARQRPLLRDLPEAQRALQASEGASSEHGPATGLLDELRSRSESEQLDLLATLVRGETATVLGHAEASHVDPDKGFMDLGLDSLMTVELRRRLQKATGVKLPPTLAFDHPSPHRVAFFLRDSLARAFGTRLSAERDGAALPAPGATSDSDEPIAIVGMALRLPGGIGDVDALWDFLHQGRDAVEPIPPTRWDAGALYDPDPDAKAKSYVRHAAMLDQVDLFDPGFFGISPREAKHIDPQHRLLLEAAWQALEEAGIVPSTLKDSPTGVFVGIGASEYAPREPGAEDSEAYIVQGTYASFAAGRLAFTLGLQGPALSVDTACSSSLVALHLACQALRRDECNLALAAGASVMVSPETFVLLSRLRALAPDGRSKTFSASADGYGRGEGVIVLALERLRDALAQGRRVLAVVRGTAVNHDGASSGITAPNGTSQKKVLRAALHDARIAPADVDVVECHGTGTSLGDPIEVQALAAVYGEGRSAEKPLFLGAVKTNVGHLEAAAGLAGVAKIVASLLHNALPPTLHTTPRNPLIAWDALAVAVVDATRPWVRHADGRPRRAGVSAFGLSGTNAHVILEEAPAIARVEPAASQPASEPLPAAWPVLLSAKSEAAVRAQAKRLRDHLLAKSELALADVAYSLATTRAHFEQRAALLVKGRDELLSALDSLAQGHSAAVLGRSGAPGKLAVLFTGQGSQRPTMGRALYDAFPVFRDALDTVAAHLDRDLDRPLRDVLFAPDGSEQAARLDQTAFTQPALFALEVALFQLLQSFGLKPALLLGHSIGELVAAHVAGVLSLQDACTLVAARAKLMQALPQGGAMVTLRASEEEVRDLLQPYDGRASLAALNGPLSTVVAGDEDAVVEIARQAEALGRKTTRLRVSHAFHSPHMDGMLDDFRRVAQSLTYHPARIPIISNVTGARATDHELASPDYWVRHVRHTVRFLDGVRALHAEGARVFLELGPHAVLSALAQDALGQDEGTSPCAFLPTLRKGRDDAEAFTAALGALHAAGLTPDWSAFFAPFAPRKVSLPTYAFQRERFWLDASKAHAADVASAGLTSTDHPLLGAGVPLADRDGFLFTGRLSLSEHPWLADHVVFGTPILPGTAFLELALFVAGRVGLDTVEELTLETPLALPSEGALLVQVSVGPLDDAGRRPLSLHSRPQGAPQDAPWTRHASGSLAPATPSPSFDLHDWPPSGATQVDTQGLYATLESAGLAYGPQFQGLRSVWRRGDELFAEAQLPDAAKKDAARFALHPALLDSALHALALDDERAPGVALPFSWGGVSLRAVGATTLRVRFHRPKGETAGSLVLADAAGGPIASVQALATRITSAEQLRTPGASHHDALFRVDWSELPSPTSPSGAPSAVLLGIGGLDLAPEVPLARVADLAALQSALDQGASPPGLVVVPFMARTADDLIQSAHSITARALALLQAWLADERLASSRLVLLTRRAIAARADEDVKDLAHAPLWGLARSAQSEHPELPLFLVDLDLSEASQHTLLAALETGERHSRLRNGKPFIPRLANARSKDELIAPDASNWRLHIPTKGNFDALTLVDAPLARAPLAHGQVRVAVHAAAFNFRDVLDTLGLYPGDAGPLGGEGAGIVTEVGPGVSRYTVGDRVMGIFGAACGPTAIADARMICPIPHAWSFAQAASVPIIYLTAYYGLVDLGHLKPNQRVLIHAAAGGVGTAAVQLARHLGAEVFATASAGKWSALRALGFDDAHLASSRDLDFEQHFLRSTHGRGVDVVLDCLAREFVDASLRLMPSGGRFVEMGKTDIREPDAVGVAYPGVVYRAFDLIEAGPDRIEQMLAELLSLFERGALRPPPITSWDIRHAPQAFRALAQARHVGKFVLTIPRPIDPEGTVLITGGTGTLGALVARHLVARHGAKHLLLTSRQGAHAPGAEASRTELEALGASVTLRACDAADPRALQALLDSIPSAHPLTAVVHAAGALDDGLLGAMSPERIDRVFAPKLDAAWHLHELTQDKPLAAFVLFSSAAGVLGSPGQSNYAAANAFLDALAHHRRAHGLPASSLAWGYWAERSRMTEHLSAADVSRMRRAGVRPLATDEALSLFDAALLRPEPALVPARFDVNALGANADEVPPLFQRLVRARVARKAASNTALASSLSQRLSSLPPAESERFLLDLVRTEAATVLGLASFESLDPHRPLQELGLDSLIALELRGRLAAATGLRLQPTLLFDYPTPAALSRFFTTQFFGETTDRPAAPLTPAGSEDPIAIVSMSCRFPGDVRTPEDLWKLLLDGKDAISSFPQNRGWSLDALDAPGRFPVREGGFVYDADAFDPAFFGISPREALAIDPQQRLLLEISWEALERAGIDPASLQGSQSGVFVGIIHNDYGAWLMNGTDEHKGFAATGSTASVASGRIAYTFGFQGPAISVDTACSSSLVAVHLACQALRHGECSLALAGGVTVLATPAVFVAFDSESAGAPDGRCKAFSAEANGAGWAEGAGMLLLERLSDAVRNGHPVLAVLRGSAVNQDGRSQGLTAPNGPAQERVIRQALDSARLTPKDIDAVEAHGTGTTLGDPIEAQAILATYGESHSQDSPLWLGSLKSNMGHTQAAAGVGSVIKMVLALQHGLLPKTLHAKNPSPHIDWSPGTVKLLDEPVVWKTNGHPRRAGVSSFGFSGTNAHVILEEAPAIARAESAAAQPASEPLPAAWPVLLSAKSEAALRAQAARLRDHLQAHPDLELADVAYSLATTRAHFERRAVVVAKDRDEATFALDAFEQGSPAHHVAHGEARVAGKLVFVFPGQGSQWPGMAQQLLTTSDAFRAQVEACARAFAPHLGWSLLAVLRGDEGAPSLERIEVVQPALFTVMVSLAALWRSRGIEPDAVVGHSQGELAAAYVAGALSLDDAAKVVARRSRLLSTLSGQGAMAAVERPPAALEPYLARFGRRLSIAAINSPSATTVSGEPDAIDHLLRLLKAEQIFALKLRVDVASHGAQIEGMREQLLEELREIEPRESRIPFYSTVRGEKLAGTELGAAYWYDNLLRPVRFADATQLLLDDAHRFFVEVSPHPVLMLPLEETLEASGLPTAVLGSLWQDEGDLSRFLASLGELYARGYAVDWRAFFEPLRPRRVALPTYAFQRERFWLDAPTAHADVASAGLTSADHPLLGAAVRLADTDAFLFTGRLSLQSHPWLAEHAAFGIPILPGTAFLELALLAADRVGLDTVEEVTLEAPLALPSQGTILIQISVGPMDEAGRRSLSLHGRTEDAPQDAPWTRHASGSLAKAAPSLSFDLHEWAPPGGTPVDTQGSYAGLESGGLAYGPQFQGLRSVWKRGDELFAEAKLPDAGAKDAARFALHPALFDSALHALVLEDERTPGVALPFSWRGVSLRSVGATTLRVRFHRPNGKSSVSLLLGDAAGEPLASVQALATRITSQEQLRTQGASLHDALFRVVWRDLPSPTSLSEAPKGVLLETGGLDLALQASLARYDGLAALRSALDQGASPPGLVVVPFIDSPSGDLIESAHNSTARALALLQAWLDDERLASSRLVLLTRQAIATHPDEDVLDLPHAPLWGLVRTAQSEHPELPLFLVDLDLGQASERALLGALDTGERQLALRHGKCLVPRLVNARSTEALIAPNVSTWSLHIPTKGTFDSLALVDAPLARAPLAQGQVRVAVHAAGLNFRDVLNTLGMLPDNAGPLGGEGAGIVTEVGPGVSRYTVGDRVMGIFRGGFGPTVVADARMICPIPDAWSFVQAASVPVVFLTAYYGLVDVGHLKPNQRVLIHAAAGGVGTAAVQLARHLGAEVFATASPGKWDALRALGFDDAHLASSRDLEFEQHFLRSTRGRGMDVVLNALAREFVDASLRLLPSGGSFVEMGKTDIREPDAVGLAYPGVVYRAFDLLEAGPDRIQEMLAELLDLFERGVLRPPPITSWDIRHAPQAFRALAQARHIGKFVLTVPRPIDPEGTILVTGGTGTLGALIARHLVANRGAKHLLLTSRKGASAPGAEALRSELEALGAAVTLARCDAADPRALQALLDSIPSAHPLTAVVHAAGALDDGLISAMSPERIDRVFAPKLDAAWHLHQLTQDKPLAAFVLFSSASGVLGGMGQSNYAAANAFLDALAHHRRVHGLPASSLAWGHWAERSGMTRHLSGVDTARMRRAGLRSIASDEGLALFDMALGRPEPALVPARFDMNALGAKADGLPSMFQGLVRARVARKVASNNALAASLTQRLASLPPTDRERMLLDLVRAEAAIVLGLASFESLDPRRPLQELGLDSLMAIELRNRLAAATGLRLQATLLFDHPTPAALATLLLGKLLQHEAADPRPLAAELDRLEATLSAIAVDAQARPKIILRLQSWLSKWSDAQAADAGPILGKDFKSATKEELFAAFDEAFGGLGK

SEQ ID NO: 32674 - protein, 355 aa, Saccharomyces cerevisiae YJM789
MVTKHQIEEDHLDGATTDPEVKRVKLENNVEEIQPEQAETNKQEGTDKENKGKFEKETERIGGSEVVTDVEKGIVKFEFDGVEYTFKERPSVVEENEGKIEFRVVNNDNTKENMMVLTGLKNIFQKQLPKMPKEYIARLVYDRSHLSMAVIRKPLTVVGGITYRPFDKREFAEIVFCAISSTEQVRGYGAHLMNHLKDYVRNTSNIKYFLTYADNYAIGYFKKQGFTKEITLDKSIWMGYIKDYEGGTLMQCSMLPRIRYLDAGKILLLQEAALRRKIRTISKSHIVRPGLEQFKDLNNIKPIDPMTIPGLKEPAGLRDGCVGATSQAWSTRCSNTEYTHRATKSCSSLALLTTR

SEQ ID NO: 32675 - protein, 169 aa, Polaromonas sp. JS666
MNSVPSTPANPLPHFRIGEGWDTHALVAGRKLIIGGVEIPHPVGLLGHSDADVLLHAITDALLGAAGLGDIGSHFPDTDVRFKGADSMVLLAEAGRLLADRGYSIGNIDSTVIAQAPKLAPHILAMRARIAQALGLEPGQVNVKAKTAEKMGPVGEGRSMEARAVVLLY

SEQ ID NO: 32676 - protein, 476 aa, Ricinus communis
MVQPSSLLSLSFFLLVLFHGSLARREFQQGNECQLNKLYALEPDKRIQTEAGLVESWNPNRDQFQCAGVAVVRRTIHPNGLLLPSYSNAPQLLYVVQGRGMTGVLLPGCAETLQESQQSGGSSRVRDQHQKIRHFRKGDVIALPAGVAHWCYNDGNEPVVTISVLDTANIGNQLDRNPRDFYLAGNTEDVFPRLPRGDYERGQHQFSRRPSQPPHVSCNNLFCGIDSRVLAEAFNVDEQLARKLQGQSDFRGSIVNVEGRLLVVRPPRTQQEREEQREREQEGRPGRYNGVEETFCTMRMKENIADPSRSDVFVPEVGRVSTVNSHNLPILRWLQLSASHVVLRNDAVRLPHWHINAHSVIYAVKGQARIQVVDENGNSVFDGNVREGQVLTVPQNFVVVKRSESDRFEYVAFKTNDNAMTSDLSGRTSAVRGMPVEVIANAFRVSIEEARRIKFAREETTLGSSRFQSGRRHYDA

SEQ ID NO: 32677 - protein, 521 aa, Triticum aestivum
FGLGSAQVLVTTAAVGLAAHRFAALPGPAAIVVGSGLALSSTAVVLQVLQERGESTSRHGRATFSVLLFQDLAVVVLLILIPLISPNSSKGGVGFQAILEAMGMAAVKAIAAITAIIAGGRLFLRPIYRQIAENRNAEIFSANTLLVIFGTSLLTARAGLSMALGAFLAGLLLAETEFSLQVESDIAPYRGLLLGLFFMTVGMSIDPKLFLSNFPAVSLILGLLIIGKTLLVTFIGRVFGVSTIAAVRVGLLLAPGGEFAFVAFGEAVNQGLLSPQLSSLLFLVVGLSMAMTPYLAAGGQFLASKFEQHDVRSLLPVESETDDLQGHIIILGFGRVGQIIAQLLSERLIPFVALDVRSDRVAVGRALDLPVYFGDAGSREVLHKVGAERACAAAITLDTPGANYRAVWALSKYFPNVKTFVRAHDVDHGVNLEKAGASAVVPETLEPSLQLAAAVLAQAKLPMSEIATTINEFRNRHLSELTELCSTSGSSLGYGFSRVMSKTKPVVSDDESDTIDGALAI

SEQ ID NO: 32678 - protein, 293 aa, Sorangium cellulosum
MDRSAELQYPVVGVVGAGVMGVGVAQSLAQTGHDVVLVDVSEAALARARMGIRNGLRAVTLFGSAEDKKRAGDPKAVLERVAFTTDYGRLAGADFVVENVTEKWDIKREVYARLEGVCRPEIIFAADTSAISITRIGSVTKRPSQVVGMHFMNPVPLKPMVEVIRGFHTSPETLGAAKRFLAEMGKTCVVVEDAPGFVSNRVLMLTINEAIFLVQDQVASAADVDRIFKGCFEHKMGPLETADLIGLDTILYSIEVLYESFNDDKYRPCPLLKKMVDAGLHGRKSGRGFYTYE

SEQ ID NO: 32679 - protein, 195 aa, Picea sitchensis
MGQIFRKLFDSFFGSREMKVVMLGLDAAGKTTILYKLHIGEVLSTVPTIGFNVEKVQYKNVQFTVWDVGGQEKLRPLWKHYFSTTDGLIYVVDSLDRERIRKATAEFQAIVNDPLMRNSIILVFANKQDMKGAMTPAEVCEALGLFSLRNRRWHIQGTCATKGEGLYEGLDWLASTLKELQAAGTPTSVGHSAIQ

SEQ ID NO: 32680 - protein, 196 aa, Arabidopsis thaliana
  misc_feature (74)..(74): Xaa can be any naturally occurring amino acid
  misc_feature (119)..(119): Xaa can be any naturally occurring amino acid
  misc_feature (132)..(132): Xaa can be any naturally occurring amino acid
  misc_feature (167)..(167): Xaa can be any naturally occurring amino acid
EREREREFSIPPPPPEIEEEEEILVSYMISSDAELTSPAQDTMLAPFTVLKTSASFQVSRKANNDITSITTNVXTVSCMNERPPLGKKKFETISYLPDLTDSELLKEVDYLLRNQRIPXVQFDLYQGFEYRXEHRNTLVYYYGLYWNMWKIPLLRCSDSAQVLKEIXLCKKEYPVAFIMIIVFENNRQVQCISLIV

SEQ ID NO: 32681 - protein, 401 aa, Ralstonia metallidurans CH34
MLRLNSHPSGRHFLQIPGPTNVPDRVLRAMDYPTIDHRGPEFQQLGKKVLADIRKIFQTTQPVVIYPASGTGAWEAALVNTLSPGDKVLMYETGHFASLWKKMADKLGVHAEFIVGDWRHGVDAAAIGARLAEDRNHEIKAVCVVHNETSTGVTSDIAAVRRAIDAAGHPALLLVDTISSLGSVDYRHDEWGVDVTVSGSQKGLMLPPGISFNAVSAKAIAASAKARLPRAFWGWDEIIEANKNGFWPYTPATNLLYGLSEACDMLLEEGLQNVFARHRRHAEATRACVNAWGLEILCQNPSEYSPALTAVVMPEGHSADTFRKIVLEHFNMSLGQGLSKLSGKVFRIGHLGDFNDLTLMGTLAGVEMGFALAGVPHHAGGVLAAMDSLRAAASQPSLRAA

SEQ ID NO: 32682 - protein, 433 aa, Ashbya gossypii ATCC 10895
MTDKDSRKEDMGENLTSDGEVASVKDKVATNPNGDPRLLEDSKVYNFVVRTIWTLIMIAGFFITLAMGHFWCVILILGCQIATFQECIAVTAESGREKNLPLTRTLNWYFLFTTIYYLDGKSLYKLFRHYTINYRVLGFIAANHKFISYCMLVFGFVVFVCSLRKGFLKFQFASLCVTHMVLLLVVFQAHLIINNVLNGLIWFLLPCGLVIVNDIFAYLCGITFGRTKLIAISPKKTLEGFLGAWFFTGLAALVLTRLLTPYTYMTCPVQNIHTNVFSPLNCETNPVFIPQTYRLPPIIFDRFNVSTITFKPIYMHAFNLATFASLFAPFGGFFASGLKRTFKVKDFGHSIPGHGGITDRVDCQFMMGSFMNLYYETFISEKRITVETVLSTILMNFDERQILQLIAALNRVLWENGKMAGDNYERISELYNI

SEQ ID NO: 32683 - protein, 289 aa, Allium tuberosum
MPCSTVPFPTFPPPESESDESWVWNQIKAEARRDAESEPALASYLYSTIISHPSLARSLSFHLANKLCSSTLLSTSLYDLFLNALSTFPTILSATVADLIAARHRDPACIGFSHCLLNFKGFLAVQTQRIAHVLWSQSRRPLALALHSRVADVLSVDIHPAARIGKGILLDHATGVVIGETAVIGNNVSILHHVTLGGTGKAGGDRHPKIGDGVLIGAGATILGNIRIGAGAKIGAGSVVLIDVPPRTTAVGNPARLIGGKEKPSMHEDVPGESMDHTSFISEWSDYII

SEQ ID NO: 32684 - protein, 216 aa, Porphyra purpurea
AGGIAEMTELPNFVDGRITKRKSDRLHTDAFGNTTSAVGKGFAIASAALTALAFYAAFQKHAGVDAMDVYQPKILAGLLVGGMLPFVFSALSMHSVGRAAMAMMKEVRRQFRDIPKIKPALEVMRAVDFEMTKAFQEQRPILDQPEGIRDYGKCIEFSTKAFLFKEMVLPGLLAILFPVAVGFLFGAEMIGGLLAGVTVSWGLNAISNTGGAWDNA

SEQ ID NO: 32685 - protein, 325 aa, Allium tuberosum
MGEVGPAIAKDVTELIGKTPLVYLNKVTAGCKARIAAKLEMMEPCSSVKDRIGYSMITEAEKQGLITPGVSVLIEPTSGNTGIGLAFMAAAKSYKLILTMPASMSLERRIILKAFGAELVLTDPVKGMKGACEKAEEIAAKTPNSYVLQQFENPSNPKIHYETTGPEIWKATDGKIDGLVSGIGTGGTITGSGKYLKEQNPSVKLYGVEPVESAILSGGKPGPHKIQGIGAGFIPGVLDVNLIDETLQVSSEEAIEMAKQLALQEGLLVGISSGAAAIAAIRVAQRPENEGKLIVVVFPSFGERYLSTVLFQSIKKEAESMVFEP

SEQ ID NO: 32686 - protein, 540 aa, Magnetococcus sp. MC-1
MIQWFKKHNAGTQKRVGQILAHADAERRSLLRRLLENGSGNRTKNDLLSGLTVALALVPEAVAFAFVAGVAPLVGLYSAFMISLITAIVGGRPGMISGATGALAVVMVALVLDHGIEYLFATVVLMGILQIGVGWLRLGKFIRMVPHPVMLGFVNGLAIVIFLAQLKSFQVADAAGVSHWLSGPPLWRMLGLVALTMGIIYLLPKLTKAIPSALAAILITSLLVILLGIESRTVGDMASIAGGLPQFHLPMVPLNLETLRIILPYSVILAAIGLIESLLTMSLIDELTQTRGRGNRECVGQGVANVVTGFFGGMGGCAMVGQSMINVKSGGRGRLSGITAGIMVLMFILFAAPLIELIPIAALTGVMFMVVIGTFEWSSFRIMGRIPKADAFVLVLVSGMTVATDLAIAVITGVIVSALVFAWEHARQIRIHAYVDDTGSKIYELEGPLFFASTSTLLERITPAQDPEQVVIDFYGSRVMDHSAIEAIDTLASRYIKEGKSLKLRHLSPECQQLLAEARGLVEIDLEKDPHYWVAADKLA

SEQ ID NO: 32687 - protein, 212 aa, Navicula pelliculosa
AGGIAEMMAEIPEEDGSREITDKLDAAGNTTAAIGKGFAIISAALTAAAVFTASTKAANESFIDMAPHGIIMGRIVAVMFPAVFTAFVINTVVRDPMPIIVEVRRQFTDIPQVQAVVEEIRGEVSNKAKGTPAEKRHILNAACGKPEYDKCVDISTEASIREMVSPGILAIVVPVAVGLISGAESVGGILVGAISGVLMALTSQSGGAWDNA

SEQ ID NO: 32688 - protein, 334 aa, Mesoplasma florum L1
MSKKNITIIGTGAYGTALANVLADNDNNVIMYGIVEQQVDDINIYHQNSVFFDNKKINKTIRATNSMAAALENTDILILGVPTAAIKHVVNDIIKYAKKPMDIINTAKGLDEENLGLLSDKIKKYFEGSNVISTYSALYGPSIAIEVVDRQPTAIMIASETIEKAKELCNVFSNEYFYMYPTTDIAGCEISAALKNAIAIGGGILKAYNAGDNAHATLLTLGLNEMYEFGKHFGAKLETFLNFAGLGDLILTASSKKSRNFRLGERIVELNDAKKALESFNLTVEGVETARIAHEIGVKYQISMNFFEIIYNILYNNVKPISLLNNVFRDVKLV

SEQ ID NO: 32689 - protein, 184 aa, Navicula pelliculosa
AGGIAEMSELPEEVRERTDILDSVGNTTAAIGKGFAIASAALTALALFAAYVEFTGIDGINIYKADVLAALFIGGMVPVVFSALAMNSVGKAAMEMVKEVRRQFKEIPGIMEGTGTPEYGKCVDISTKAALREMMLPGAITIVAPILIGFLMGPEALGSYMAGVAVSGVLLAIFQNSGGAWDNA

SEQ ID NO: 32690 - protein, 287 aa, Glycine max
MAKDVEQVTKRGEYSAKDYHDPPPAPLIDPDELTKWSLYRAAIAEFIATLLFLYITVLTIIGYKRQSDTKIPGNTECDGVGILGIAWAFGGMIFILVYCTAGISGGHINPAVTFGLFLGRKVSLVRALLYMIAQCAGAICGAGLAKGFQKSYYNRYGGGVNTVSDGYNKGTALGAEIIGTFVLVYTVFSATDPKRSARDSHVPVLAPLPIGFAVFMVHLATIPVTGTGINPARSFGPAVIFNNDKAWDDQWIYWVGPFVGAAVAAFYHQYILRAAAIKALGSFRSNT

SEQ ID NO: 32691 - protein, 208 aa, Rhodomonas salina
AGGIAEMAELEGSVRETTDTLDAVGNTTKAVTKGYAIGSAGLGALVLFAAYTEDLAYFASKPDVYPFFAGIEVDFALSNPYVVVGLLFGGLLPFLFAGMSMTAVGRAAQAVVEEVRRQFKEKPGIMTYEEKPDYGRAVDILTTAAIREMIIPSLLPVLAPIVLFTVLYFIADLNQALAAVGAMLLGVIVTGLFVAISNSSGGGAWDNA

SEQ ID NO: 32692 - protein, 242 aa, Neisseria meningitidis MC58
MTTYRIAPSILSADFARLGEEVESVIAAGADLIHFDVMDNHYVPNLTFGPMVCAALKPYASVPIDVHLMVEPVDDLIQSFAKAGASIITFHPEASRHIDRSLSLIRDMGCQAGLVLNPATPVYLLENVLDRLDMVLLMSVNPGFGGQSFIPHTLEKIRRVRAMLDRYEAQSGRHIAIEVDGGIKTDNIAAVARAGADTFVAGSAIFGKPDYKAVIDAMRAELEKSGRLNLAPMIEIEMPSEN

SEQ ID NO: 32693 - protein, 449 aa, Kluyveromyces lactis
MASNGTGGLPPIDFEKVRNDSDGSVTGMAKGLFNQFIEGNPYFAAGGGLMVLGTSLALLRRGVISTSRLAYHQLIVDLEIPSKDKSYLWFLQWMSRYPHRSSRHLSVETNYLQHNNGSVSTEVNFVPGVGNHLIRYKGAFMLIKRERSGQIANITNGTPFETVKLTTLYRDRHLFQELLMEAKDLAVKRQTGKTVIYTSWANEWRPFGQPKAKRNLKSVILDNGLKESILNDVNDFLQNGKWYYDRGIPYRRGYLLYGPPGSGKTSFIQALAGELDYNSCIMNLADPNLTDDRLNYLMNNLPERSLMLLEDIDAAFVKRSKNDEGFVNGVTFSGLLNALDGVASSEEIITFMTTNHPEKLDPAVMRPGRIDYKTYVGNATEYQIKQMFLRFYPEEKELSEQFVQKAVELDTPISTAQLQGLFDFNKQNPKNAVLMVESLRYPNHVFCCK

SEQ ID NO: 32694 - protein, 83 aa, Zea mays
  misc_feature (19)..(19): Xaa can be any naturally occurring amino acid
  misc_feature (38)..(38): Xaa can be any naturally occurring amino acid
  misc_feature (40)..(40): Xaa can be any naturally occurring amino acid
  misc_feature (42)..(42): Xaa can be any naturally occurring amino acid
  misc_feature (50)..(50): Xaa can be any naturally occurring amino acid
  misc_feature (63)..(63): Xaa can be any naturally occurring amino acid
LCVAAPFTAVLKCAAEEFXVPPQTSAIITNDGIFFNPXQXAXGVWGESFXELRLIPRDGVGAXVMSSGRLSPVQCLLSKTCEK

SEQ ID NO: 32695 - protein, 465 aa, Methanococcus maripaludis S2
MFIDGKWIIREDIDVFDPYTLENIEKITALDREETKNAIEVTEKHKEIMKNLSPSKRYKILMKVAEHLSSKKDFFAKTISIDVGKPIKQSKIEVDRTLTALKLSAFYAKELRGETINSENGLIFTKKEPLGVIGAITPFNFPLNLATHKIGPAIATGNSVVLHPSSKAPIVAIYLTKIIEHVLKQMDIPRGVFNLATGNGEIVGDEISKNDNVNMVSFTGSVEVGESISKNAKMKKVTLELGGNNPMIVLKDSDIKLAAKSAVKSKFLNAGQVCISVGQVLVEEEVVETFTKYVIEETKKLILGNPLDKNTDIGPLISPESALRIENLIKQSVSEGGELLIGGNRQNSLISPAVINIDEENILSKIETFGPILPILTVKDSEEAVNIANNSKYGLQAGLFTNNINNAMKIADELEYGGIMINSSPTFRKDNMPFGGVKKSGLGREGIKYTVEEMSETKTVVIHNI

SEQ ID NO: 32696 - protein, 527 aa, Mycobacterium smegmatis str. MC2 155
MTANITTDKPQGAGAAGLPTADELRQRVRRALDAIGATTALAEPGGASDGDLHASTPITGDVLFTLPAHTAEAADAAIAEAAQAFSVWRTTPAPVRGALVARLGQLLVEHKADLATLVTVEAGKITSEALGEVQEMIDICDFAVGLSRQLYGRTIASERPGHRLMETWHPLGVVGVITAFNFPVAVWSWNTAIALVCGDTVVWKPSELTPLTAIACQALIERAAADVGAPAAVSRLVQGGREVGERLVDDPRVALVSATGSVRMGREVGPRVAARFGKVLLELGGNNAAIVTPSADLDLAVRAIVFSAAGTAGQRCTTLRRLIVHSSVADEVVRRVVSAYQSLPIGDPSAEGTLVGPLIHARAYRDMVGALEQARADGGTVHGGERHELGDEEGAFYVAPAVVVMPAQTEIVHNETFAPILYVLTYDDLDEAIALNNAVPQGLSSAIFTTDVREAERFLAADGSDCGIANVNIGTSGAEIGGAFGGEKQTGGGRESGSDAWKAYMRRATNTVNYSSELPLAQGVHFG

SEQ ID NO: 32697 - protein, 566 aa, Methanococcus maripaludis S2
MDMLEMALNIAKDIEKSVKPLIGWEKSNEVVKIGADGTPTKRIDLIAENVAINSIEKVCSAILISEEIGFKRIGKNKPEYVIVLDPVDGTYNSLKDIPFYSAAVAIGRIDKFADNLEELINNLKMKDLEVGVVRNIATGDTYYAEKGKGAHFLRKGEKKSISISNSSNLKDSSIGLFAHDISIDTLKFIKDRRFRRIRLFGSIALEMCYVAKGALDAFINVNETTRLCDIAAGYVIIKEAGGIVTDKNGQEVNLDLDVNSKVSVICSNEMLHKKLVGIFGNRWRIKPTNFGIISRIDNEESIEVADNVIKYLDSKGIKYELDSSTYNALKNRLTKKCDIISNIEEISHMISIGGDGTVLRASKMIEGNEIPMVCINMGTVGFLTEFNKDEIFSAIDSIICGSYKVEKRTKLMGFAKLSDGKQHILNDSLNEVVITTKNPAKMMHFEVYIDGSLVEDVRADGIIVSTPNGSTAYSLSSGGPIIEPTVEGFVIVPICPFKLSSRPLVVNANSEIKIKLLKKSTYVVIDGNTEFEAKKGDEIILRKSESNAYFVKGDNFYNKLKKLSLM

SEQ ID NO: 32698 - protein, 525 aa, Arabidopsis thaliana
MDEEATSWIRRAKFSQTVSYRLNSSKLASLPFMINQDKFSGLKAIPQRSSSSSSASSSDPKLVSSNSQTTGDTSSLEAADVYVVDSEIQTNPVTHKQRSVSPSPQMAVPDGFKEARSERKRFSTPHPRRVESEKGMKPKLSHKNSFDKRSFNLRSPSGPIRDLGTLRIQERVKSKKDTGWSKLFDNTGRRVSAVEASEEFRVDMSKLFFGLKFAHGLYSRLYHGKYEDKAVAVKLITVPDDDDNGCLGARLEKQFTKEVTLLSRLTHPNVIKFVGAYKDPPVYCVLTQYLPEGSLRSFLHKPENRSLPLKKLIEFVIDIARGMEYIHSRRIIHRDLKPENVLIDEEFHLKIADFGIACEEEYCDMLADDPGTYRWMAPEMIKRKPHGRKADVYSFGLVLWEMVAGAIPYEDMNPIQAAFAVVHKNIRPAIPGDCPVAMKALIEQCWSVAPDKRPEFWQIVKVLEQFAISLERKGNLNLSSSKICKDPRKGLKHWIQKLGPVHAGGGGGSSSSGLGGSALPKPKFA

SEQ ID NO: 32699 - protein, 492 aa, Saccharomyces cerevisiae YJM789
MSKAVGDLGLVGLAVMGQNLILNAADHGFTVVAYNRTQSKVDRFLANEAKGKSIIGATSIEDLVAKLKKPRKIMLLIKAGAPVDTLIKELVPHLDKGDIIIDGGNSHFPDTNRRYEELTKQGILFVGSGVSGGEDGARFGPSLMPGGSAEAWPHIKNIFQSIAAKSNGEPCCEWVGPAGSGHYVKMVHNGIEYGDMQLICEAYDIMKRIGRFTDKEISEVFDKWNTGVLDSFLIEITRDILKFDDVDGKPLVEKIMDTAGQKGTGKWTAINALDLGMPVTLIGEAVFARCLSAIKDERKRASKLLAGPTVPKDAIHDREQFVYDLEQALYASKIISYAQGFMLIREAARSYGWKLNNPAIALMWRGGCIIRSVFLAEITKAYRDDPDLENLLFNEFFASAVTKAQSGWRRTIALAATYGIPTPAFSTALAFYDGYRSERLPANLLQAQRDYFGAHTFRILPECASAHLPVDKDIHINWTGHGGDISSSTYQA

SEQ ID NO: 32700 - protein, 436 aa, Cytophaga hutchinsonii ATCC 33406
MEKVLIIEDDISLRTILEKFLQKNGFEVISTDRGKAGLEIITSQHIDFVLLDLRLPDSNGIEILQSIKKLHSHVSVIMMTFYDDVRSAVTAIKSGARDYLTKPINPEELLSLLKPIQAVKKAVEINKSEFVQGKNEKFAGVLEHARLVAPTMLSVLITGESGTGKEELAKYIHTNSQRKQKDFITVDCGSISEELFGSEFFGHMKGSFTGAVYDKPGLLESANGGTLFLDELGNLTYENQIKLLRVLQEKKVKRIGSNKEIDLDIRLIAATNEEIVLSVQKEKFREDLYHRLNEFKIHVPALRERPEDLNELINHFIAKSNSEFGKHVKQLSESGLAVLAQYAFPGNIRELKNIVRRAVLLATSETIEKDQLPQEIFNTRTLAVDTVDLKSLQEQQERDAIIKALKKTGNNKSEAARILNIDRKTLYNKLKLYQLE

SEQ ID NO: 32701 - protein, 285 aa, Populus trichocarpa
MGKDVEVRGEFIAKDYHDPPPAPLIDAEELTQWSLYRAIIAEFIATLLFLYITVLTVIGYKSQTDTTKNSDACGGVGILGIAWAFGGMIFVLVYCTAGISGGHINPAVTFGLFLARKVSLVRAVLYMVAQCLGAICGCGLVKAFQKSYYTKYGGGANELATGFSKGTGLGAEIIGTFVLVYTVFSATDPKRNARDSHVPVLAPLPIGFAVFMVHLATIPITGTGINPARSFGAAVIYNKDKAWDDHWIFWVGPFIGAAIAALYHQYVLRAAAVKALGSFRSSSNI

SEQ ID NO: 32702 - protein, 183 aa, Oryza sativa Indica Group
MVMMSKRSTRRDLKFSGGLIESKQNEPPHTNGHTLIFSPNPKKKRKSEKEEEEETFPGIRARRIGLAAIHVGVLVEFQLQMKFVPRFQDCWRPQSNASPPMGNGPGLRPAEQGVEEEAGRPLPKFGEWDVNDPASADGFTVIFNKARDEKKGGNGQDTDSPCKETRTERVESYAPKTNSPSVL

SEQ ID NO: 32703 - protein, 117 aa, Zea mays
  misc_feature (107)..(107): Xaa can be any naturally occurring amino acid
  misc_feature (113)..(113): Xaa can be any naturally occurring amino acid
PPPPPLSFPLPFPARGATWRRRHDAEALPALAGKKKEGNAAKYITRTKAVNYLQVSLAIFRKLCILKGVFPRQPKKKGGKGNHKTYYHTKGYCISSPHGPLGSEKFXGELRVXPKEG

SEQ ID NO: 32704 - protein, 482 aa, Rhizobium leguminosarum bv. viciae 3841
MAESYDVIIIGSGPGGYVAAIRASQLGLKTAIVEREHMGGICLNWGCIPTKALLRSAEVLDHANHFKDFGLVLEGTVKPDAKAVVGRSRAVSARLNAGVGFLMKKNKIDIIWGEAKITKPGEIVVGKSSKPVVEPQHPLPKNVKSGEGTYTAKHIIIATGARPRALPGIEPDGKLIWTYFEALKPDLLPKSLIVMGSGAIGIEFASFYRSMGVDVTVVEVMPTIMPVEDAEITAIARKQLEKRGLKIFTSAKVSKVDKATNSVTAHVETADGKVQQITADRLISAVGVQGNIENLGLEALGVKTDRGCVVIDGYGKTNVAGIYAIGDVAGPPMLAHKAEHEGVVCVEKIAGLPNVHPTDKGKVPGCTYCNPQVASVGITEAKAKEQGRDIRVGRFSFAANGKAIALGEDQGMVKVIFDKKTGELLGAHMVGAEVTELIQGFVVAMNLETTEEELMHTIFPHPTVSESMKEAVLDAYGRVLNA

SEQ ID NO: 32705 - protein, 191 aa, Cytophaga hutchinsonii ATCC 33406
METKKIEVYTEATPNPNTLKFITDKTLVEEGSVDFPMASSAESCPLVLDLFRFDFVKRVFMAANFITVTKSEGMEWEEVSGMIKSLIKGYIEEGKPLFKETHKPLSNTAPVEGEPEVVTKIKVVLDEYIRPAVEQDGGAINFESFVDGVVKVQLQGSCSGCPSSTVTLKSGIENLLKRMVPEVTEVVAEGV

SEQ ID NO: 32706 - protein, 479 aa, Bacillus cereus ATCC 10987
MTTSNTYKFYLNGEWRESSSGETIEIPSPYLHEVIGQVQAITRGEVDEAIASAKEAQKSWAEASLQDRAKYLYKWADELVNMQDEIADIIMKEVGKGYKDAKKEVVRTADFIRYTIEEALHMHGESMMGDSFPGGTKSKLAIIQRAPLGVVLAIAPFNYPVNLSAAKLAPALIMGNAVIFKPATQGAISGIKMVEALHKAGLPKGLVNVATGRGSVIGDYLVEHEGINMVSFTGGTNTGKHLAKKAAMIPLVLELGGKDPGIVREDADLQDAANHIVSGAFSYSGQRCTAIKRVLVHENVADELVGLLQEQVAKLSVGSPEQDSTIVPLIDDKSADFVQGLVDDAVEKGATIVIGNKRERNLIYPTLIDHVTEDMKVAWEEPFGPILPIIRVSSDEQAIEIANKSEFGLQASVFTKDINKAFAIANKIETGSVQINGRTERGPDHFPFIGVKGSGMGAQGIRKSLESMTREKVTVLNLV

SEQ ID NO: 32707 - protein, 426 aa, Vitis vinifera
MAIRQDTIVAIRKHDAGESPKLLRIANVSDKYTMCTYPADPEQEIDLKNHKWGHYFICGYKGYYEYAKLKGVDVGVPVGLDVLIDGTVPTGSGLSSSAAFVCSSMIAIMAAYDVSFPKKDVAQLTCECERHIGTQSGGMDQAISIMAKSGFAELIDFNPVRATDVQLPAGGSFVIAHSLAESQKAVTAATNYNNRVVECRLAAIVLGIKLGMKPQQAIAEVKTLSDVEGLCVSFASDHGSSDPVVAVKEFLKEEPYTAEEIEKIIEESLPSVFGNSPTSLDVLKAAKHFKLFQRASHVYSEARRVHAFRDTVLSGLSEEDMLKKLGDLMNKSHDSCSVLYECSCPELEELVKICRDNGALGARLTGAGWGGCAVALVKESIVPQFILNLKDQFYQSRIEKGVINKNDLGLYIFASKPSSGAAIFKF

SEQ ID NO: 32708 - protein, 462 aa, Oryza sativa
  misc_feature (94)..(94): Xaa can be any naturally occurring amino acid
  misc_feature (99)..(99): Xaa can be any naturally occurring amino acid
MAARVPGGGGAAAAAEAEVVPTFSSLEPIYGDGSPLDEARLRLARLADKFHAVYAARPALFARSPGRVNLIGEHIDYEGYSVLPMAIRQDMIVXIRRAXGKEEIDIKNHKWGHYFMCGYKGVYEYCRSKGIDMGGPVGLDVVVDGTVPTGSGLSSSAAFVCSATIAIMGVLEKNFPKAISIMAKPGFAELIDFNPIHATDVQLPPGGTFVIAHCLAESKKAETAATNYNNRVVECRLAAIVLAIKLGMETKKAVSSVTTLSDVEGLCVSFAGKEGSSDPGVAVKKLLHEESYTTEEIEKITGQSLTSIFQSSQTSLDVLRAAKHFKLFQRAFHVYSEARRVYAFRDTVLSKLSAEDMLQKLGDLMNESHYSCSVLYECSCPELEELVKVCRDNGALGARLTGAGWGGCAVALVKEGIVPQFILNLKETYYKSRIDRGVINQKDLGLYVFASKPSSGAAIFKL

SEQ ID NO: 32709 - protein, 189 aa, Yarrowia lipolytica
MSQIIDQVQAALQNIDKELEKYPALKELEKQIPVPKSYILLGFVGFYFILIFLNIGGIGQLLSNIAGLVIPGYYSLLALETPGKADDTQYLTYWVVFATLNVFEFWSKAILYWVPFYYLFKTAFLLYIGLPQYGGAELVYKAIVKPLAQKLVNIQPHGGPSDSLKAQAQSAVDAAESHVPQGHSTGVSH

SEQ ID NO: 32710 - protein, 464 aa, Picea sitchensis
MATFAAASAKPMAVIDNSQLSLCQKKFDGLRVGYAFAKRKSSSSLKVKSVSRINMALATDVSRFEGVTMAPPDPILGVSEAFKADTNDLKLNLGVGAYRTEDLQPYVLNVVKKAENMMLEKGENKEYLPIEGLAAFNKATVELLLGADNDATKQGRVATVQGLSGTGSLRLAAAFIQRYFPGVQVLISSPTWGNHKNIFNDAGVPWSEYRYYDPKTVGLDFEGMIADIKAAPSGSFVLLHGCAHNPTGIDPTPEQWEKIADVIQEKDLTAFFDVAYQGFASGSLDEDASSVRLFVARGMEVFVAQSYSKNLGLYAERIGAINVVCSSSDAAIRVKSQLKRLARPMYSNPPVHGAQIVANVVGNPTLFDEWKSEMELMSGRIKGVRQRLYDNLSAKDKTGKDWSFVLRQIGMFSFTGLNKAQSENMSNKWHIYMTKDGRISLAGLSLSKCEYLADAIVDSYYNVS

SEQ ID NO: 32711 - protein, 246 aa, Magnetococcus sp. MC-1
METGFFERTAILIHQEGMDKLAQLHVLVCGLGGVGSYAAEALCRAGVGHLTLVEHDTIAASNINRQLHATHATVGQKKMQVMLQRMQQINPHGQIDPLDQFLTREQIPDLLETAKPHVVLDAIDSLNCKVGLIVESYHRGIPVFSSMGAGGRLDPTKVQVSDLMQSHTCPLASKVRQRCRREGVRNGVICAWSSEIPAPPLPPEPVTQGRPRAVNGTISYLPALFGLLLAGRMIHQQLNPLAPPAP

SEQ ID NO: 32712 - protein, 317 aa, Deinococcus radiodurans R1
MIESFIGHTPLVQLRRVVTPDMADVFIKLEGQNPGGSIKDRTALGLVQDAERRGVLKPGGTIVEPTSGNTGIGLAQVAAAKGYKLILCMPAQMSEERKRTLRAYGAELILTDPERRMLAAIEEAEKIAAETGAVMMNQFANPANPATHEASTGPELWEQMEGRVDAFVYGTGTGGTITGTGRYLKRQDPNIQVIACEPARSNVLSGGERGNHGFQGMGPGFIPDNLDRSLLDDVIQVWEEDAYPLARRLAQEEGIFIGMSSGAMVWTALEVARRLGPGKRVVTIACDTGARYLTTALFSGEGDTPAGYLPYSRERVE

SEQ ID NO: 32713 - protein, 559 aa, Deinococcus radiodurans R1
MLFLSVLLLAAAFLVGSLPLGHWLLRRAGVSTRLNSAHNLGVENVLRRVGPRLAFGSAALDFLKGLLAVVMASSLGPGYGGVMVLAGLAAYLGHLNPPRFLYGETPPRGRGNLVLLGVLAGYAVTGALPLWLTLVPLVVYAAVAGYWGFISAATLAALAALAGVGALLPLTTGSKVGLLGLGLAAAWRFKENVGRILDGTEARLGEEVPVAGKRDDVVVAAFMIHPMNLHDFWSAPRFAWLRPLVEKRLVTEKSVRRMADEMRPMKVGELRGIRTAQGKEIRCYLLSAPLLPDRFRDNPELATRRAIEGARLAHELGAEVFGLGAFWSVVGNKGVDVQAAVPEITITNGGAYTSGTIKAAIPGILKHFAETGRDLKQATAGIVGANGVVAFGIARTIAPQVGKIIMIGRDAERLERSANTLRRANPNTDIVTTTSYDSLNEADLIFSATSDPNPVIFPQHVKPGAWIFDEGRPADVDESVRNVPGVRIIPGGLVTPPGSMTTGIDLQFGVGNVPACLAETLIIAATGEHQRKSLGPQTLTENINFFVDEAEKLGFKVVD

SEQ ID NO: 32714 - protein, 127 aa, Ashbya gossypii ATCC 10895
MSSTPNPKAFPLADAALTQQILDVVQQASNMRQLKKGANEATKTLNRGISEFIIMAADCEPIEILLHLPLLCEDKNVPYVFVPSRVALGRACGVSRPVIAASITTNDASAIKSQIYAVKDKIETLLI

SEQ ID NO: 32715 - protein, 213 aa, Blastochloris viridis
AGGIAEMSGLPKEVRKATDALDAVGNTTKAVTKGYAIGSAGLGALVLFAAYSEDLKFFSANPTEFPYFKDVVIDFSLSNPYVVVGLLFGGLLPYLFGAMGMMAVGRAASAIVEEVRRQFRENPGIMDYKVKPDYGRAVDMLTKAAIKEMIIPSLLPVLSPVVVYFVIYFVAGGGAAGKSAAFSSVGALLLGVIVTGVFVAISMTSGGGAWDNA

SEQ ID NO: 32716 - protein, 332 aa, Mycoplasma mobile 163K
MSHCNNIEENVIFGTSNSIELATEIAKKTNIPFATFEKVVFADGEIKVKSNVVVRNRIVYIIFSGSSPVNENLMELFLFIDSLKRASAKEINVVLTYFPYARQDRKNKGRESIGAKAIADILERMGSTKIISIDLHNSSIQAFFDIPTDDLKGQFILAKELKKSNEKFTVASPDHGGAVRARQLAELISDSIKIAIVDKRRTGPNKSEIVGVLGEVEGKNIVIIDDIIDTGGTIIKAAEMLKSLGAKKIIVAATHGLFSNGFQIFEESEAIDRVIVTNSVATVNNLAKFKKLTIAGVEDLISSVIEANTKNESISKLYDTWRKTITNFNEDK

SEQ ID NO: 32717 - protein, 85 aa, Oryza sativa
LTESIQAAKDSFAGGWGVMVSHRSGETEDVTIADIVVGLRAGQIKTGAPARSERLAKLNQILRIEEELGDNAIYAGEKFRTAVNL

SEQ ID NO: 32718 - protein, 199 aa, Azospirillum brasilense
AGGIAEMADMPKDIRVTTDALDAVGNTTKAVTKGYAIGSAGLAALVLFAAYVQDLKHYFPNVTVEFRLDDPYVVVGLLIGGLLPYLFGAMGMTAVGRAAGSVVVEVRRQFREISGIMEGTAKPDYGRAVDMLTRAAIKEMVIPSLLPVLAPVVLYIVIAAIAGQAQAFAALGAMLLGTIVTGIFVAISMTAGGGAWDNA

SEQ ID NO: 32719 - protein, 368 aa, Malus x domestica
MGKGGQSCNGVVRDAKPVEQENMAAWLVDVNTIKILPFKLPAIGPNDVRIRIKAVGICGSDIHYLKTMKCGDFQVKDPMVIGHECAGIVDKVGSEVKHLVPGDRVAVEPGISCAHCQQCKGGRYNLCPDMKFFATPPVHGSLANQIVHPADLCFKLPENVSLEEGAMCEPLSVGVHACRRANVGPETTVLIVGAGPIGLVSVLAARAFGAPRIVIVDMDDRRLAMAKSLGADGTVKVSTKMEDLDDEVAKIKEAMGSEVDVTFDCVGFNKTMSTGLNATRPGGKVCLVGMGHGVMTVPLTPAAAREVDVVGVFRYKNTWPLCLEFLRSGKIDVKPLITHRFGFTEKEVEEAFATSARGGNAIKVMFTL

SEQ ID NO: 32720 - protein, 199 aa, Rhodothalassium salexigens
AGGIAEMAELEADVRERTDALDAVGNTTKAVTKGYAIGSAGLAALVLFGAYKADLDLYFADLAVSFELTNPYVVVGLFIGALLPYLFGAMGMTAVGRAGGAVVEEVRQQFRDKPGIMKGTEKPDYAKSVDLLTRTAIREMVVPSLLPVLAPLALYFAIYGVAGQGQAFAALGALLLGVIVSGLYVAISATAGGGAWDNA

SEQ ID NO: 32721 - protein, 288 aa, Rhodobacter sphaeroides
MAFEQRIEAAMAAAIARGQGSEAPSKLATALDYAVTPGGARIRPTLLLSVATRCGDSRPALSDAAAVALELIHCASLVHDDLPCFDDAEIRRGKPTVHRAYSEPLAILTGDSLIVMGFEVLAGAAADRPQRALQLVTALAVRTGMPMGICAGQGWESESQINLSAYHRAKTGALFIAATQMGAIAAGYEAEPWEELGARIGEAFQVADDLRDALCDAETLGKPAGQDEIHARPSAVREYGVEGAAKGLKDILGGAIASIPSCPAEAMLAEMVRRYADKIVPAQVAARV

SEQ ID NO: 32722 - protein, 209 aa, Rhodovibrio salinarum
AGGIAEMGELEDSVRETTDTLDAVGNSTKAVTKGYAIGSAGIGAIVLFASYTEDLSNFAAKPIVYPYFAGIEVDFALSNPYVVVGVVFGGLLPFLFAGHSMTAVGRAAQTVVEEVRLQFKEKPGIMTYQEKPDYGKRVDILTTAAIREMIIPSLLPVLAPVVLFHCGLLQAGHNACDRPALGAMLTGVIVTGLFVAISMTSGGGAWDNA

SEQ ID NO: 32723 - protein, 197 aa, Neisseria meningitidis MC58
MSEMLNHVASCRLPTEWGVFTMHGFEEANGQEHVALTVGNFSDGNPVLTRIHSECLTGDALFSRKCDCGPQLEAAMRAVQTEGRGIIVYLRQEGRGIGLINKIRAYHLQDQGMDTVEANLALGLPVDARDFRLAQSIYEYLGIRSVKLLTNNPEKIQTLKDAGINVVERIPLHVGENLENKRYLQTKADKLGHLMSE

SEQ ID NO: 32724 - protein, 376 aa, Rhodobacter sphaeroides
MSALRPPARGGLGLSRLAPLPSRRFQLIAERVPFLGRIGRREGEELFDIVAGFVHSQVLYALVELRVLHLVAEGPQTVQALAAATLAPERMHLLLQGGAALKLLTRRRDGQFDLAVRGAAFLAVPGLEAMVGHHHVLYRDLADPVAFLKGETEPELARFWPYVFGAGGATDPEVTAKYSRLMTESQGLVAEDALRLVELMGVRRLMDVGGGTGAFLAAVGRAYPLMELMLFDLPVVAEAAPQRLTEAGLAGRFTVHGGSFRDDPLPLGADAISLVRVLFDHSDETVKLLLHRVREALPAGGRVIVAEAMSGGARPHRETDTYMAGDTAAMRTGRVRSAAEIADVLTGQGFSEIKIGPGLRPYVASAVTAVRPSDAP

SEQ ID NO: 32725 - protein, 363 aa, Neisseria meningitidis MC58
MSHISPIPEILADIKAGKMVIITDAEDRENEGDLLMAAQFVTPEAINFMIKHARGLVCLPMDGEMVEKLGLPMMTQKNGAQYGTNFTVSIEAAHGITTGISAADRALTIQTAVSPTAKPEDIVQPGHIFPLRAQKGGVLVRAGHTEAGVDLAQMNGLIPASVICEIINDDGTMARMPELMKFAEEHKLKIGTIADLIEYRSRTESLLEDMGNAPVQTPWGEFQQHVYVDKLSGETHLALVKGTPAADTETLVRVHEPFSVMDFIQANPRHSWSLPKALEHIQQAESGVVILLHRTEDGASLLDRTLPKGANQAYKWDSKSYGIGAQILAGLNVKKLRVLGQPSSFTGLTGFGLEVVGFEEAEK

SEQ ID NO: 32726 - protein, 393 aa, Streptococcus thermophilus LMG 18311
MLFEESDLLKELPEQFFAGLVAKVNAKVAEGADIINLGQGNPDQPTYDHIVEALRVSAKNPANHKYSQFRGNRPFKEAAASFYKNHYGVDLDSEREICVMGGAKIGLVELPLALMNPGDLLLLPDPGYPDYLSGVSLGRVAYETFPLTAENDFLPDLEAIPEGTARRAKFIYINYPNNPTGAVATKAFYEKLVAWAKTYEVGVVSDLAYGALGYQGYENPSFLATPGAKDVGIEFYTFSKTFNMAGWRLAFAGGNAEMIEALNLIQDHLFVGIFPALQEAGIAALLDPKSEEAVAQLNAVYDSRRDAFVQTAANIGWQAFPSRGSFYAWMPVPKGYTSESFADLLLEKAHVAVAPGKGFGPAGDAYVRIGLLVEPERLVEAVNRIADLHLFNN

SEQ ID NO: 32727 - protein, 210 aa, Ustilago maydis 521
MKSIVSLTTLFTLVAALAVLLVSMPSTASTTDPTITHKVYFDISHNNKDIGRIVVGLYGKDVPRTAENFRALATGEKGFGYKGSKFHRVISSFMIQGGDFERGDGRGGYSIYGGKFDDENFKFKHTGPGIVSMANAGRNTNGAQFFICTVKTSHLDGRHVVFGRVLDGMDVVKYIEKVPTGYGDKPVHDVLVKDSGELPVDADEKVKDEL

SEQ ID NO: 32728 - protein, 166 aa, Arabidopsis thaliana
MDPTGSPRTSNGSPPRSYLIFMRIMSKRRTWVCLFVAVYAILLASSWNFLTSVLSWYKLQYTSSPSPSRLPAVYASVVLGAVFGAMSMVAAAAVAVPAVMVIWISVVVLLAFFGKSRRVLVVEARKITREVFGFVFKVLLKEGNAVAAVCAVLGYFILIRKDFDSI

SEQ ID NO: 32729 - protein, 292 aa, Arabidopsis thaliana
MYRYALGYVNKNNSCRSHKVLRFIDHYISSAVNHAPENRFSWYEIYDIETDLWTTLDVPPYWIVSCYQRGVSLKGNTYFCATKSNAINKIDDHIICFDFTSERFGPLLRLPFSAGHDDYVTLSCVREEKLAALLTHNDWNPYEFEIWITTKIEYDKVSWSKILEMDTGPLADMPIAYIHGSFFIDEEKKVSMVFDHHRVNIIGKTGYFRELDLRVHVAGIKCRPHLCPYVPNSMQIKQPPGGKRKRKPILEQRRYDQNMLRVAAFIKRTKQEDNKWKKRVLEGLKKQTNFKA

SEQ ID NO: 32730 - protein, 649 aa, Populus trichocarpa
MMSLNRSIFLSNAGISSSSSPFTGGQRGSVPSVPSSLRVVAVNSNRDRNGSVLTETTRKDVRDGAASSSSVIDVDSKSTVAPGGPHDVYSEDAATEEQVVTPWFVSVASGYSLLRDPHHNKGLAFTDKERAAHYLRGLLPPAVVSQELQVKKLMHIIRQYQVPLQKYMAMMDLQESNEKLFYKLLIDNVEEMLPIVYTPTVGEACQKYGSIFGRPQGLYISLKEKGCIHEVLRNWPEKNIEVIVVTDGERILGLGDLGCQGMGIPVGKLALYTALGGVRPSACLPVTIDVGTNNENLLNDEYYIGLRQRRATGQEYAELLHEFMSAVKQTYGEKVLIQFEDFANHNAFDLLAKYSTTHLVFNDDIQGTASVVLAGLVAALKVVGGTLADHTFLFLGAGEAGTGIAELIALEISKQTNMPVEETRKKVWLVDSKGLIVSSRRESLQHFKKPWAHEHEPVKTLLDAVNDIKPTVLIGTSGVGKTFTKEVIEAMASFNEKPIILSLSNPTSQSECTAEEAYTWSQGRAIFASGSPFAPFEYEGKTFMPGQANNAYIFPGLGLGLIMSGAIRVHDDMLLAASEALAAQVTQENFDKGLIYPPFKNIRKISAEIAAKVAAKAYELGLATRVPPPRDLVKHAESCMYSPAYRSYR

SEQ ID NO: 32731 - protein, 245 aa, Streptococcus thermophilus LMG 18311
MTTEYIVIKIGGVASKQLTPDILAKLSEWQQAGQKIIIVHGGGFAINQLMEEHDITIHKVNSLRVTSQSDMVLIKEALVDIVGKNLAGQLTQAGFPIYQVVDELPDLVHADFLDQEIYGYVGEVKSITNQTLVALLSQGKIPLIPSLGYSEQGDLLNINADYLARAVAISLGAKKLILMTDVKGVLENGQVLNHLNIVDVQKKIDSGVITGGMIPKIQSAVQTVESGVDQVIIGDNLTDGTIIKE

SEQ ID NO: 32732 - protein, 405 aa, Rhizobium leguminosarum bv. viciae 3841
MLQMPSKQPISAGIVIVAAGRGERAGSSKEGPKQYRMIGGKPVIVHTLENFMTWEAATEIVVVIHPDDEALFARAFRHIISATPIETVHGGATRQQSVLAGLRYLKDKQISHVLIHDAVRPFFDHALLDRIAESLDAGAQAVLPAIPVTDTLKRADNAGTVLTTVSREHLYAAQTPQSFAFETILEAHEKAAASGRSDFTDDASIAEWLGIPVTIVEGTADNVKLTVKDDIAMADDKLSASLLPDVRTGNGYDVHQLVAGDGVTLCGVFIPHDQKLKGHSDADVALHALTDALLATCGAGDIGDHFPPSDPQWKGAASRIFIEHAARIVRERGGTIMNADVSLIAEAPKVGPHRDAMRAKLSDYLGIDIERCSVKATTNETIGFVGRREGIAAIATATVVYRGRK

SEQ ID NO: 32733 - protein, 507 aa, Picea sitchensis
MASTTAAAAALGRIASTPNLQAVSSSSTSSPVARLAIGSRSWSASSSPRLRSVASSPLLEVKSRFVFGSASNLLASEHDLASAVAAQVTGANHGRGCRGVVSMAKKSVGDLKESDLKGKRVFVRADLNVPLDENQNITDDTRIRAAVPTIKYLIGNGAKVILASHLGRPKGVTPKYSLKPLVPRLTELLGVNVLKTDDCIGEEVEKAVASLPDGGVLLLENLRFHKEEEKNDPEFAKKLASVADLYVNDAFGTAHRAHASTEGVTKYLKPAVAGFLMQKELDYLVGAVSVPKRPFAAIVGGSKVSSKIGVIESLLEKVDILFLGGGMIFTFYKAQGLKVGSSLVEDDKIELASTLMKKAKEKGVSLLLPTDVVIADKFAADANSKVVPASDIPDGWMGLDIGADSIKTFSEALDTTKTVIWNGPMGVFEFDKFSLGTTSIAKKLAELSGKGVTTIIGGGDSVAAVEKAGLAEKMSHISTGGGASLELLEGKTLPGVLALDDAVPVTV

SEQ ID NO: 32734 - protein, 134 aa, Populus trichocarpa
MATITASTTTTSSLVRAALVHKPSLGVSCSPVLGLPAMAKKGRVSCSMEGKPSVEEKCKGMSASLMAAVCAASMSSPALALVDERMSTEGTGLPFGLSNNLLVWILLGVFALIWALYFTYTATLEEDEESGLSL

SEQ ID NO: 32735 - protein, 189 aa, Oryza sativa Japonica Group
MAFFGLFVEEPVGGGFNGPAAAYYLKLSCDTCGEPTTRDVCLVPGPDSCTNLPGIKNQWRYTCYPTCPDSGHVVVRKCKVCSALGSVALLPGHGKALTTSSRTMVMMLQSKGYTPTNFAPGSRWVATKVTGYRCELELTADHFKGYDGTITIPSTSTKFSVEKLKRAEVCSLGRGLLDTTNGNSEKTSD

SEQ ID NO: 32736 - protein, 355 aa, Photobacterium sp. SKA34
MKKNLICLGILVAGLSFQSSSFAQGTELPNIKILATGGTIAGAGQSATGSAYTSGQVGIDALINAVPEMAKIADISGEQVANIGSQDMNDKVWLTLAKRVNELLAKDDVDGIVITHGTDTMEETAYFLNLTVKSDKPVVLVGAMRPSTAMSADGPVNLYNAVITAADTDSKGRGVLMAMNDVILDARDVTKTNTTAVDTFKSPNFGELGYIHNGDAVYQRSPERHNTKDSKFDISEVKALPKVGIVYNYSNASDLPVKALIDAKFDGIVSAGVGNGNIYKGIFEQLAKASKDGIMVVRSSRVPTGATTLAAEIDDSKYGFVASGTLNPQKARILLMLSLTQTKNYRDVQKMFQYY

SEQ ID NO: 32737 - protein, 357 aa, Ralstonia metallidurans CH34
MAGMQAAVFQGPGKIVLQEKPIPAVGPTDALIRITTTTICGTDIHILKGEYPVERGLTIGHEPVGIIEKLGSGVTGYHEGQRVIAGAICPSFYSYACQDGCASQDGQGHSHGYKPMGGWRFGNTIDGTQAEYVLVPDAQANLAPIPDGLTDEQVLMCPDIMSTGFSGAEHANIKIGDIVAVFAQGPIGLCATAGARLRGASLIIAVDGIDDRLNISRQMGADVTLNFRNTDVVQEILRITGGRGVDASIEALGTQATFESALRVLKPGGTLSSLGVYSSDLKIPLDAFAAGLGDHRIITSLCPGGKERMRRLMNVIETQRIDLGPLVTHRFKLADIEAAYDLFGHQRDGVLKVAITP

SEQ ID NO: 32738 - protein, 465 aa, Deinococcus radiodurans R1
MGLGLSKSQPECPQASPSKSSAKLDAPTAAAPTLGSMTGNEQNPSKWLAAEKKYDSGVYNKHDVVMVRGQGATVWDENGRSYIDCVVGYGVATLGHSHPDVVKAVQEQAGKLMVMPQTVPNDKRAEFLQELVGVLPQGLDRVFLCNSGTEAMEAAKKFAITATGRSRFVSMKRGFSGRSLGALSFTWEPKYREPFGDAVDNKSVDFVTYGNLDELRAAVTEQTAAVIMEPVQGEGGVRPASAEFIQEARRITREKGALLILDEIQTGFCRTGKMFACEHFGVIPDGMTLAKAIAGGTPTAAFAMMSEVADRMPAGGHGTTFGGNPLSMAAGVASLRAMKREGLAEQAREKGAYMMDKLRAIQSPKIREVRGLGLMIGVELKEKSAPYIHAMEHDEGVLCLAATPLVVRFLPPAVISKEQIDQVVAAFERVLNNVNPREERQAELRAQQSEMGQQQVSQGESVQTE

SEQ ID NO: 32739 - protein, 571 aa, Physcomitrella patens subsp. patens
MSSGLALLSLKALLHDPDNYLANWNESDADPCRWSGVRCQLQTSRVEFLALPSKQLRGSISPEIGKLDQLRRLSLHSNELYGPIPKELGNCSSLRQLYLHRNFLTGSIPLELKDLKLLVTLDLASNGLTGSIPSFIGSLSRLGFLNVSSNFLTGEIPTNGILETFTAQSFLENPGLCGSQVGIDCRAAGESTPGTSTKAQKHGYSNALLISAMSTVCTALLLALMCFWGWFLRNKYGKRKLNLSKVKGAEEKVVNFHGDLPYTTVNIIKKMDLLDEKDMIGSGGFGTVYRLQMDDGKVYAVKRIGVFGLSSDRVFERELEILGSFKHRNLVNLRGYCNSPTARLLIYDYLPCGNLEEFLHGPHEVLLNWAARLKIAIGAARGLAYLHHDCTPRIIHRDIKSSNILLDENLDPHVSDFGLAKLLEDKASHVTTIVAGTFGYLAPEYMHTGRATEKGDVYSYGVVLLELLSGRRPSDPSLIAEGMNLVGWVTLCIKENMQSEIFDPEILDGAPKDQLESVLHIAVMCTNAAAEERPTMDRVVQLLEADTLSPCPSELSNFYRSPHSDDEARGR

SEQ ID NO: 32740 - protein, 170 aa, Spiroplasma citri
MDLKKFIVDIPNYPERGVIFRDITPLLNNALAFTTVINQLAAYAVAQKATVIIAPEARGFLFGPAVSYSTNLRFIPVRKVGKLPRPVINVKYSYEYAENQLEIHAGDLQPSDRVLIVDDVLASGGTARAMCQLVNQEQATVAGLAFVIDLTYLNGKKDLDSYPIKTLIEY

SEQ ID NO: 32741 - protein, 399 aa, Bacillus anthracis str. A2012
  misc_feature (143)..(143): Xaa can be any naturally occurring amino acid
  misc_feature (187)..(187): Xaa can be any naturally occurring amino acid
  misc_feature (190)..(190): Xaa can be any naturally occurring amino acid
MDTLIFEVGTALVLVAIAAVIAGKFKFSVIPFLIVLGMLVGPHAPTIGVIDFKFIESASVISFLGRIGVLFLLFYLGLEFSMKKLIKSGRSIAIGGTIYILINFSLGLLYGFIMGFPLLEILIIAGIITISSSAIVAKVLVDXRRTGNNETELILGIIMFEDIFLAVYLSVVSGLVLGDHASFLGAXTSXGIALGYMLLFFIVARKATPLLNKLLNISSDEIFIIVVFASLFFIAGFSETIHVAEAIGALLLGLVFSETEHSDRIEHLVVPFRDFFGAIFFFSFGLSIDPFSLGGAIWLTLGAVLLTIIGNFVAGMIAGRQAGLSHKASTNIGLTIVSRGEFSIIMANIGIAGGLMSVLKPFSALYVLILSILGPLLTKESKNVYKLLNKIFKWDMKKS

SEQ ID NO: 32742 - protein, 211 aa, Rhodopseudomonas palustris
AGGIAEMAGLPKEVRKSTERADAVGNTTKAVTKGYAIGSAGLGALVLFAAYNEDLKFFIAQKSPYFVGVAPDFSLNNPYVVVGLLFGGLLPYLFGAMGMTAVGRAAGAIVEEVRRQFREKPGIMKGTDKPDYGKAVDLLTKAAIKEMIIPSLLPVLSPIFVYFAIYAIAGGGAAGKSAAFSAVGAMLLGVIVTGLFVAISMTSGGGAWDNA

SEQ ID NO: 32743 - protein, 446 aa, Physcomitrella patens subsp. patens
MAPSIQDNFPSTPGKVKMERSNYFGRVTNRWHTSASAKLFLFSVFLLAVTIFICFRITANGMVEGYMSTAYTSTNGGTIRSAFKSDKVWDQKLLQSCTPERDDGLVVLVTGAAGFVGSHVSLALKKRGDGLVGIDNFNDYYEVSLKRARQKLLLKQGIFVIEGDINDAALLKHLFDRIQFTHVMHLAAQAGVRYAMQNPMSYIHSNIAGLVTLFEASKNANPQPAVVWASSSSVYGLNSKVPFSEADRTDQPASLYAATKKAGEELAHTYNHIYGLSVTGLRFFTVYGPWGRPDMAYFSFTRDILKGKVINIYKGPHDRDLARDFTFIDDIVKGCVASLDTSGRSTGSGGKKRGPAPFRTFNLGNTSPVTVPILVEYLERHLKVNAKKEFIKMPRNGDVPFTHANVSLAQTQLGYKPTTNLDTGLKKFVNWYVKYYGVPSTKTRSL

SEQ ID NO: 32744 - protein, 208 aa, Isochrysis galbana
AGGIAEMAELPSSVRDTTDALDAVGNTTKAVTKGYAIGSAGLGALVLFAAYNEDLKYFAATAAEGSFFDGIGVVNFSIANPYVVVGLLFGGLLPFLFGGMSMMAVGRAAQAVVEEVRSQFKNDPGIMEGTSKPNYGKAVDILTSAAIKEMIVPSLLPVLSPIVLFLLIWGIAGPSAALASVGAMLLGVIVTGLFVAISMSSGGAWDNA

SEQ ID NO: 32745 - protein, 276 aa, Oryza sativa
  misc_feature (270)..(270): Xaa can be any naturally occurring amino acid
MGSFASPLDAAPAPPTAKPSPPPAPAPANGLVTQEELKRVAAHRAVEMVEPGMTLGLGTGSTAAHALDRLGDLLRSGELAAVAGVPTSLKTEAHAARVGIPMLPLGEAGGIDLSIDGADEVDPELNLVKGRGGSLLREKMIEGSGGRFVVIVDESKLVPRLGCTGAVPVEVVPFGCDHTLGLVRKVFDGLPGFSARLRTVASKDGEGKEEMFVTDNGNYIVEMFFEDGIRGDLNEISDRLLRITGVVEHGMFLGMATSVVVAKKDGTVAXLLHKKK

SEQ ID NO: 32746 - protein, 600 aa, Mycoplasma mobile 163K
MFKFKFADIGEGLHEGLVAEIYKKEGDMVKEGEALFSVETDKVTSDIPSPATGKIVKVAMAQGDTIHVGQEIYYIDDGSSSQSIEVKPAEIKAEAPKKAGGGASVVGEVAVSDEVMSFGKKTSSTPTSSTSIQPTSFNGKITDKYDVIVLGSGPGGYLAAEEAGKNGKKTLIIEKEYWGGVCLNVGCIPTKALLKSTEVFEQLSHASDYGLDIDVSKLKMNWKKMQERKQKVVNTLVGGVLALMKGNKVKTINGEAKFLAPKVVQVNGEIYEAENIIIATGSKNRKLTLPGFEEAYKSGFAITAEEAIQIESLPKELVIIGGGVIGIEFAQIFAASGSKVTVIQNAPTIIPALDEDVIKVLSDKLISSGIQIVYNAETVKIEKDTLHYKVNGEAKTIKASKIMVSVGRIPVIANAKEVGYQIGEKGEIVINEFCQTNIPGAYAIGDVTFKTMLAHVAYQHAHIAIKHLLGNGDLSYTGKTVPACIYTHPEIASVGMSERQAKESGRAYISEKHQMKFIGKAIASDQTMGFSKLIIDKETHEILGAHIIGAHATDLISELVVAIDLETTVHEIANAIHPHPTFSEIIWENARTASHKLKKK

SEQ ID NO: 32747 - protein, 453 aa, Mycoplasma mobile 163K
MFKFKFADIGEGLHEGVVAEIYKKEGDMVKEGEALFSVETDKVTSDIPSPVTGKIIKVAMFKGDTIHVGQEIYQIEDGSSSSSSVGIKTEAPKKAGGGGASVVGEVAVSDEVMSFGRVNSNSSNSQSQVSPREIVQSASISATPENRRALARAKMLGQSVVFETNTLNSSESSNRRALARAKMLGQSPEIVSKPVSIQQIQQNVEKAVSNSQVQPLISLANELKREKVTPIRKAIAKAMKNSWSNVAYTNLVNEINVGSLVSLREKIKDSVQDLTGVKVTFLPFIIKAITLALKEFPVLMAKYDEQASELVYSGTLNIGIAVDTEAGLMVPVIKNADKLNIIEIAKEITRLAVAARDKKIKADELKGSDFTVTNYASVGSLFGIPVINYPDMAIAGIGVIKDEPIVTKNGIVAGKIMNLTVAADHRWVDGATIGRFAQKVKHFLENPELLGVF

SEQ ID NO: 32748 - protein, 223 aa, Mesoplasma florum L1
MQKITIAPSFLSANFADLKNEIKRCKEANIEWIHYDVMDYDFVPNLTFGSKVLKDIVNSSDFKIDIHFMVKVKTKRFEDFFSEYIKCKPTMMTMHVESMSKKEINMFYNICKTNNIMFSLAVSPKTNIKVLNKWIDKLENILIMSVEPGFGGQSFIPEVLEKVKHLAELKKTNGYTYSIEIDGGINDETSKKAIDAGVEMIVAGSYLFESKNFLEKVESLKHD

SEQ ID NO: 32749 - protein, 298 aa, Mycoplasma mobile 163K
MENKIIITPLAKNLALKLKIDITKLKPSKNKLRIYQEDVLNFSKNSATSNSNLQLAKSQFDPTSQTVAKREKVTPIRKAIAKAMTNSWENVAYTNLVTKIDATSLWESRTRIKDAILKDEGVNVTFLPFIIKAINVSLKKFPILTAKYDEQNSELIYPKTLNLGIAVDTEAGLMVPVIKNADKLNIIEIAKEITRLAVAARDKKIKADELKGSDFTVTNYASVGSLYGVPVINYPDIAIAGIGAIVDKAIISDKGIVAGKVLYLTVAADHRWVDGATIGRFAQEVKKLLENPDMLGVY

SEQ ID NO: 32750 - protein, 434 aa, Solibacter usitatus Ellin6076
MSFGGSRVATSTLPVSISLENEKNPWLAAAARFEEAAKRLKLDDGMRKVLGTPSKELTVHIPVQLDDGRIEVFTGYRVQHSVARGPAKGGIRFAPDVTLDEVRALASWMTWKCAVVNIPFGGGKGGVICDPHILSDTELEKLTRRYTAEIIDFIGPERDVPAPDVNTNEKVMAWMMDTYSMHARHTVTAIVTGKPMALGGSRGRPEATGRGCMMVTQRALNRMGKRPEDTSVVIQGFGNVGGMAAKLMSAVGFKIIAIVEYDGAAYNPNGLDIAALQLHRKETGSITGFSGGEDMDKTEAMFLECDVLIPAATENVITSQNAHRVRCRILCEGANGPTTPLADDILAEKKVFVIPDILANAGGVTVSYFEWVQDRQGFFWNEQLVNERLQEIMDESFDAIVAYAEAHQVNNRIAAYMVALDRVAQAIKLRGIYA

SEQ ID NO: 32751 - protein, 376 aa, Streptococcus thermophilus LMG 18311
MTKLFSNYKRAAIDFASAQGNYLTDTTGKTYLDFSSGIGVTNLGYHPRVNQALTDQVGNILHQPNLYYNQLQEDVAGLLTGDKDYLAFFCNSGAEANEAAIKIARKASGKQEIITFQNSFHGRTFGSMSATGQDKIKQGFGEGVPHFSYAIFNDMDSVKALANKETSAIMLELVQGESGVQPADKAFVKALSDYCQETGIYLIVDEVQTGIGRTGKLFACEHYDIEPDIFTLAKGLANGVPVGAMLAKSSLGGAFSYGSHGSTFGGNKLSMAAAKATLEVMLTPDFLDTALENGNKLQVKLQEVLSDKETVTTVRGLGYMIGIETTGNLSELVQAARDKGLIVLTAGTNVIRLLPPITLSDAEIEKGVAILSEIFD

SEQ ID NO: 32752 - protein, 305 aa, Streptococcus suis
PCYPGSELGIVSDDVFAWEEYPLSVAVIGAGYIAVEMAGLIHGLGVQTDLFVRGNRPLRSFDTYIVDALMEEMQRTNLPLHTGKTPVSLEKTDDGQIQINFADGSNHIAQKVLWAIGRKPNIDKLNLKATSVQLTSSGHISVNEYQETAVPGIYALGDVTGEKELTPVAIKAGRLLAERLFNNKPTAKMDYTTIPTVVFSHPAIGTVGLTEDEAITQYGQDNVKVYTSAFTSMYTALENNRQMAKFKLVTVGENEKVVGLHGIGYGVDEMIQGFSVAIKMGATKEEFDAVVAIHPTGSEEFVTMR

SEQ ID NO: 32753 - protein, 170 aa, Populus trichocarpa
MESHDETGCQAPEGPILCINNCGFFGSAATMNMCSKCHKDIILNQQQAQLAASSIESIVNGNSSGNGKEPVVAGAVDVQAAPVEVKIISTEPSIASSKPSEMKAKEGPSRCTACRKRVGLTGFGCRCGNLFCAIHRYSDKHDCPFDYRTAARDAIAKANPVVKAEKLDKI

SEQ ID NO: 32754 - protein, 673 aa, Vitis vinifera
MNSSSYIGITTMKPYCRVLTSCRNSSIFKFPSSKSNHFIADNSSKFQSKLIHSRRFHCCSAQILGKKCGINSNRRAFRLSDPNWGQIRVYRSCSGAHGGRRGVLVISNVASDFRKHSTSVESHVNEKGFESIYINGGLNVKPLVIERIERGHVEEESGLEFKDPDVNFDHSEGLNKEKVEREVPEIEKEAWRLLRSAVVDYCGNPVGTVAANDPGDKQPLNYDQVFIRDFVPSALAFLLKGEGEIVKNFLLHTLQLQSWEKTVDCYSPGQGLMPASFKVRTVPLDGGNGAFEEVLDPDFGESAIGRVAPVDSGLWWIILLRAYGKITGDYALQERVDVQTGIRLILNLCLTDGFDMFPSLLVTDGSCMIDRRMGIHGHPLEIQALFYSALRCSREMITVNDGTKNLVRAINNRLSALSFHIREYYWVDMKKINEIYRYKTEEYSTDAINKFNIYPDQIPTWLVDWIPDQGGYLIGNLQPAHMDFRFFTLGNLWSIISSLGTAKQNEGILNLIEAKWDDLVAHMPLKICYPALENEEWRIITGSDPKNTPWSYHNGGSWPTLLWQFTLACIKMGRPELARKAVALAEERLSVDHWPEYYDTRNGRFIGKQSRLYQTWTIAGFLTSKMLLENPEMASLLAWEEDYELLEICVCALSKTGRKKCSRSAARSQIPVQ

SEQ ID NO: 32755 - protein, 97 aa, Crocosphaera watsonii WH 8501
MTTDVIEKPSSSTSTVRKPAPRYRVLLHNDDFNSMEYVVQTLMQTVPSITQPQAVDIMMEAHSNGTALVITCALEPAEFYSETLKNHGLTSTIEPDE

SEQ ID NO: 32756 - protein, 223 aa, Physcomitrella patens subsp. patens
MNTVEEQVLAEQEALLAECKFYEGEKEPETKDAKLDHYEPAVVDGVPVGPPSTVLGAPVPRSPWSTSLLSCFGSFDEHFTSDLQVCVMGTFAPCVLYGSNMERLYPGEEGISRHHCLMYSYLYIMGANLLNLNLAPCISVGSRVALRRKYNLEGSGDCCFTESGDEESREGFNTFCDVFSHFVCHSCALCQEGRELRRRTRYPYYQPYMPMTPPMEQSMSPQM

SEQ ID NO: 32757 - protein, 393 aa, Picea sitchensis
MAASVIKAGVRLGSSQWTGQSLTQNIDSHKQPKAQRVSMPIRAGSYAEELVQTAKTVASPGRGILAIDESNATCGKRLASIGLENNETNRQAYRQLLLTTPGLGEYISGSILFEETLYQSTTDGRKFVDCLREQNIMPGIKVDKGLVPLPGSNNESWCQGLDGLASRSAEYYKQGARFAKWRTVVSIPNGPSDLAVKEAAWGLARYAAISQDNGLVPIVEPEILLDGDHSIDRTLEVAEKVWAEVFFYLAENNVLFEGILLKPSMVTPGAEHKEKATPQQVADYTLKMLKRRVPPAVPGIMFLSGGQSEVEATLNLNAMNQSPNPWHVSFSYARALQNTSLKTWKGLPENIEAAQRALLIRAKANSLAQLGRYSAEGESEESKKGMFVKGYTY

SEQ ID NO: 32758 - protein, 187 aa, Chlorobium tepidum TLS
MILVIDNYDSFTYNLVQYIGELGAEVAVYRNDELTVEQALALEPEKIVISPGPGTPADAGISIPLINVVKGNIPLFGVCLGHQAIGEALGGKVVRAGQIMHGKTSQIYHDGKGVFRGLPNPFTATRYHSLVVERESLPAELEITAWTEDGVIMGLQSSELGLYGVQFHPESIMTSVGHDLIRNFLEL

SEQ ID NO: 32759 - protein, 792 aa, Arabidopsis thaliana
MSSYNSFSLWILFSLQLCFILDSADRTVSLCQPDCGGIKIPYPFGMGKGCYLEKWYEITCNTSTSGKLVPYLSVINKEVVGISLPTEGRGSRYNNPYQSVNIKNPIASKECSSNGEELGSLLNLTGTPFYVSQHNELVAVGCNNTASLTNVKPSIVQCTSSCSTKPHTHIKDYLAVLNCQNYNGYEKNCNEDSSMDESIMDETSCNGIGCCNAYMRGGSIQQIVGVTIENTITRGCKVAFLTNKAEYLSNKSDPQKLHARGYSTVELGWFIHTTNHSFIKSLGCYSVKEYNNERYTSTQRRINITSCICDDNAYLSYARCSCTRGFQGNPYRLGGCKDINECKEEEGMTYCGTNKCVNLQGHFKCVYNNHRPLAIGLGASFGSLIFVVGIYLLYKFIKKQRKLNQKKKFFKRNGGLLLQQQLISTVGMVEKTIVFSSRELEKATENFSSNRILGQGGQGTVYKGMLVDGRIVAVKKSKVVDEDKLEEFINEVVILSQINHRNIVKLLGCCLETKVPVLVYEFIPNGNLFEHLHDEFDENIMATWNIRLRIAIDIAGALSYLHSSASSPIYHRDVKSTNIMLDEKYRAKVSDFGTSRTVTVDHTHLTTVVSGTVGYMDPEYFQSSQFTDKSDVYSFGVVLVELITGEKSISFLRSQENRTLATYFILAMKENKLFDIIDARIRDGCMLSQVTATAKVARKCLNLKGRKRPSMREVSMELDSIRMPCGDMQLQECVSENEEGEEQNKGLVEDIMRAESRSKEFVTAPASHYNNIAAASSSSWSDVEPLFPLQTR

SEQ ID NO: 32760 - protein, 352 aa, Thermoanaerobacter ethanolicus
MKGFAMLSIGKVGWIEKEKPTPGPFDAIVRPLAVAPCTSDVHTVFEGAIGERHNMILGHEAVGEVVEVGSEVKDFKPGDRVVVPAITPDWRTSEVQRGYHQHSGGMLAGWKFSNIKDGVFGEFFHVNDADMNLAHLPKEIPLEAAVMIPDMMTTGFHGAELAEIELGATVAVLGIGPVGLMAVAGAKLRGAGRIIAVGSRPVCVDAAKYYGATDIVNYKNGPIESQIMDLTEGKGVDAAIIAGGNADIMATAVKIVKPGGTIANVNYFGEGDVLPVPRLEWGCGMAHKAIKGGLCPGGRLRMERLIDLVFYKRVDPSKLVTHVFQGFDNIEKALMLMKDKPKDLIKPVVILA

SEQ ID NO: 32761 - protein, 336 aa, Mesorhizobium loti MAFF303099
MTVRVAINGFGRIGRNILRAIHESGRKDIDVVAVNDLGPVETNAHLLRYDSVHGRFPHEVSVSGDQITVGKEKFKVTAIKDPTQLPWKELGVDIALECTGIFTARDKAASHLTAGAKRVLVSAPADGADLTVVYGINHDKLTKDHIVISNASCTTNCLAPLAAVLHETVGIEKGMMTTIHSYTGDQPTLDTMHKDLYRARAAALSQIPTSTGAAKAIGLVLPDLKGKLDGISIRVPTPNVSVVDFKFIAKRATTVQEINEAVIAASNGKLKGILGVTHHPNVSIDFNHDPRSSIMALDQTKVMDGNFVSVLSWYDNEWGFSNRMGDTAVAFGKTIA

SEQ ID NO: 32762 - protein, 627 aa, Mesorhizobium loti MAFF303099
MEHAIYLVTLVGTALVVAAAFSSLIAFRFGAPLLLLFLCIGLATGTDGLGIEFDNARIAYFAGSLALAVILFDSGFGTPLNALRQAAGPALSLATFGVLLTTGLFGAAAYYLLDLTWLESFLLGAAVASTDAAAVFFLLRAGEINLRERVRSTLEVESGTNDPIAIFLTITLVEVIAAHANPETNVLVTNLILGFLVNMGLGAVVGALGGLAIVRLVDRLNLDHGLLPIFVLTLSLMVFAAAGAIGGSGFLAVYIAGLIAGNSDIRAVTILKRFQDGMSWLAQIIMFLILGLFATPSQFPAIMVPAIALGLFLMFVARPIAVWLCLIPFRLPRPEVAFVSWVGLRGAVSILLAITPLLGGLENGRTIFNAAFIIVLVSLVIQGWTVGPLARRLGLIVPARLGPLDKVELELPGSAHHELLAYRVAHGSPVARGERIPRWARPSLVLRDGRSMRFQDMGRLAAGDQVYIFVPDRYPRLLDKLFASRAVVDPEDADFFGAFAVDPARAAAELEAAYAPGLTEAEQKLTVGALVTARLGGHAEYADRVLIGSIELIVRDVDDKGRITGLGLSFEPTAPVARVPVFLSAGEMGDRLGAFIRNWRKPTETQEAAAQAEDAPKPPVEKATTGS

SEQ ID NO: 32763 - protein, 337 aa, Oryza sativa
QWLLVGDGAAAAAAAEPNLVVSFGEMLIDFVPDVAGVSLAESGGFVKAPGGAPANVACAISKLGGSSAFVGKFGDDEFGHMLVDILKKNGVNAEGCLFDEHARTALAFVTLKSNGEREFMFYRNPSADMLLTEAELNLDLIRRAKIFHYGSISLITEPCRSAHVAAMRAAKSAGILCSYDPNVRLPLWPSEDAARAGILSIWKEADFIKVSDDEVAFLTQGDANDEKNVLSLWFDGLKLLIVTDGEKGCRYFTKDFKGSVPGFSVNTVDTTGAGDAFVGSLLVNVAKDDSIFHNEEKLREALKFSNACGAICTTKKGAIPALPTVAVAQELISKAAN

SEQ ID NO: 32764 - protein, 398 aa, Mesorhizobium loti MAFF303099
MAAFKTLDDIGNISGKRVLVRVDLNVPVADGKVTDATRIERIAPTIAELSGKGAKVILLAHFGRPKDGPSPEFSLEPIARATAEVLGRPVGFASDCVGDMAGSAVAAMNKGDVLLFENTRFYKAEEKNDPAFSERLAANGDIFVNDAFSAAHRAHSSTEGLARLLPSFAGRTMQAELEALEKGLGNPVRPVVAIVGGAKVSTKIDLLMNLVKKVDALVIGGGMANTFLAARGTDVGKSLCEHDLAPTAKQIMIEAAEAGCAIILPVDGVVAKEFKAGAACETVAISDVPADGMILDVGEKTVKTIGEWIDRAATLVWNGPLGAFEIEPFDHATVAAAKHAAARTKAGKLVSVAGGGDTVAALNHAGVADDFTYVSTAGGAFLEWMEGKPLPGVDVLKR

SEQ ID NO: 32765 - protein, 342 aa, Mesorhizobium loti MAFF303099
MMSERLEDIAAAIVANGKGLLAADESSGTIKKRFDVIGVESTADSRRDYREMMFRARDAMTKYISGVILYDETIRQKAADGTPLVDIIKASGAIPGIKVDAGAKPLAGFPGDTVTEGLDGLRERLADYYKLGARFAKWRAVIDIDTGKGVPSANSINSNTHALARYAALCQEAGIVPIVEPEVLMDGAHDIGTCYDVSKATLIKLYDELHAARVVLEGTILKPNMVLSGKKSGTVDSPEKVAEMTIKLFRETVPAAVPGIAFLSGGQEDEEATANLNAINAIGPHPWKLTFSYGRALQAAPQKAWSGKASNVAAGQAAFTHRAHMNYLAALGKWKASLEQAA

SEQ ID NO: 32766 - protein, 479 aa, Zea mays
  misc_feature (200)..(200): Xaa can be any naturally occurring amino acid
MAAPQPVAPASEAPPSAQMVGNAFVQQYYLVLHQSPDLVYRFYQEASRLARPASAAGAAGMDSVTTMEAISEKIMEMDVSKAEIRTVDSQESLGGGVAVLVTGHLTGRDGVRREFSQSFFLAPQEMGYFVLNDIFRFVGDIPASTAVEAQPEAVAVVPPVAAPLANGTATPAVEPATPDDHGAVPQQEHHVVDRSLPQPXEEEAEVYDPPQEEVVDEEQPVPEVINEVPNNVAAVLATTVAPVLQEEAPKKSYASIVKVMKEVSLPAPAPPTRTAPPKPEKQSPALAPVKDVLPFSSNPENGNIQEPEVDAHAIYVRNLPLNATETQLEDEFKKFGTIKQNGIQVRSNKIQGFCYGFVEFEDSTSVQSAIEASPVAIGGRQCYVEEKRAPGSRGSSRGGRFAPGRGNNFRSEGTRGRGNYGGGRGYGRGEFSYRSDYGVRSGGRGGSSRGADVGYQRVDHAGYAGGRGSRTAAAGAPSK

SEQ ID NO: 32767 - protein, 189 aa, Nannochloropsis oculata
AGGIAEMALQDYPEVREKTDALDAAGNTTAAIGKGFAIGSAALVSLALYGAFAVRVGIRNGVNILSPVTFAFLLIGSNLPYWFSALTMKSVGTAAMEMVMEVERQFRECPELLNEGTTLRPDYTRCVDISTKAALREMVPPAALVMLSPLIAGTFFGKYAVAGVLTGGLVSGVQLAVSMCNTGGAWDNA

SEQ ID NO: 32768 - protein, 367 aa, Oryza sativa
  misc_feature (260)..(260): Xaa can be any naturally occurring amino acid
TYTSFDCLGRDSLVMDIPHALFEEKLEAMKAVKGLHNDTDLTATDLKELVAQYKDVYVEAKGEPFPSDPKKQLQLAVLAVFNSWDSPRAIKYRSINKITGLKGTAVNVQTMVFGNMGNTSGTGVLFTRNPSTGEKKLYGEFLVNAQGEDVVAGIRTPEDLDAMRDHMPEPYEELVENCKILESHYKEMMDIEFTVQENRLWMLQCRTGKRTGKGAVKIAVDMVNEGLVERRTALKMVEPGHLDQLLHPQFENPSGYKDKXVFTAEDAEAWHAQGKDVILVRTETSPEDVGGMHAAVGILTARGGMTSHAAVVARGWGKCCVSGCSSVRVNDASKIVVIEDKALHEGEWLSLNGSTGEVIIGQQPLCP

SEQ ID NO: 32769 - protein, 444 aa, Brassica oleracea var. alboglabra
MRGVIPNYHHSYTLFFFVILVLFPHVFSTNTLSPNEALTISSNKTLVSPGDVFELGFFKTTTRNSPDGTDRWYLGIWYKTTSGHRTYVWVANRDNALHNSMGTLKISHASLVLLDHSNTPVWSTNFTGVAHLPVTAELLANGNFVLRDSKTNDLDRFMWQSFDYPVDTLLPEMKLGRNLIGSENEKILTSWKSPTDPSSGDFSFILETEGFLHEFYLLKNEFKVYRTGPWNGVRFNGIPKMQNWSYIDNSFIDNNEEVAYSFQVNNNHNIHTRFRMSSTGYLQVITWTKTVPQRNMFWSFPEDTCDLYKVCGPYAYCDMHTSPTCNCIKGFVPKNAGRWDLRDMSGGCVRSSKLSCGEGDGFLRMSQMKLPETSEAVVDKRIGLKECREKCVRDCNCTGYANMDIMNGGSGCVMWTGELDDMRKYNAGGQDLYVKVAAASLVPS

SEQ ID NO: 32770 - protein, 523 aa, Deinococcus radiodurans R1
MIKVQDYRPQPFTDFTKEENVQAYQAALAKVRKELLGKHYPLIIDGQEVDTEGKIQSINPCDTSEVVGTTAKATIGDAENALQGAWKAFESWKKWDMDARARILLKAAAILKRRRLEACALMSIEVGKNYAEADVEVAEAIDFLEYYARSAMKYAGFGSSETTWFEGEENGLMSIPLGVGVSISPWNFPCAIFVGMAAAPIVAGNCVVVKPAEDAGLIAGFMVDILREAGLPAGVLQFLPGVGKEVGEYLTTHAKTRFITFTGSRAVGLHINEVAAKVQPGQKWIKRVIMELGGKDGLIVDETADIENAITAATQGAFGFNGQKCSAMSRLIVVDSVYDEVVNGFVERAKALKMGTGEENANVTAVVNQMSFNKIKGYLELAPSEGKVLLGGEATGEANGKQGYYIQPTIVGDVDRNSRLAQEEIFGPVVAVLRAKDWQDALDIANSTEYGLTGGVCSNSRERLEQARAEFEVGNLYFNRKITGAIVGVQPFGGYNMSGTDSKAGGPDYLSNFMQLKTVTERW

SEQ ID NO: 32771 - protein, 203 aa, Nannochloropsis oculata
AGGIAEMSQQPEFVRESTDRLDAAGNVTKAITKGYSIGSASLACFLLFGAFMDEFSQFSGKPFRTVDIAVPEVLIGGLIGTMMVFYFVGLTVAAVGKTAGEVVKEVRRQFRDNPDIMTFKARPDYRSCVALVTRAALQEMVWPGLLATGLPVVVGLVFRGVGAFTDRPLLGAEVLAGYLMFGTVTGIMMALFNRTMGGAWDNA

SEQ ID NO: 32772 - protein, 383 aa, Thermus aquaticus
MRGLSQRVKSMKPSATVVVNARALELRRKGVDLVALTAGEPDFDTPHHVKERARRGLAQGKTKYAPPAGIPELREAVAEKFRGENGLEVTPEETIVTVGGKQALFNLFQAILDPGDEVIVLAPYWVSYPEMVRFAGGVPVEVPTLPEEGFVPDPERVRRAITPRTKALVVNSPNNPTGVVYPEEVCEALAEMALQHDFYLVSDEIYEHLIYEGAHFSPRHLAPEHTITVERAANAFAMTGWRIGYACGPKAVIKAMADVSSQSTTSPDTIAQWATLEALTNREASMAFIAMAREAYRKRRDLLLEGLSRIGLEAVRPSGAFYVLMDTSPFAPNEVEAAERLLMAGVAVVPGTDFAAFGHVRLSYATGEENLKKALERFAQALQ

SEQ ID NO: 32773 - protein, 203 aa, Nannochloropsis salina
AGGEISEMSQQPEFVRESTDRLDAAGNVTKAITKGYSIGSASLACFLLFGAFMDEFSQFSGKPFRVVDIAVPEVLIGGIIGTMMVFYFVGLTVAAVGKTAGEVVKEVRRQFRDNPEIMTFKARPDYRSCVALVTHAALKEMVWPGLLATGLPIVVGVVFRGVGAITDRSLLGAEVLAGYLMFGTETGIMMALFLTAGGAWDNA

SEQ ID NO: 32774 - protein, 219 aa, Haemophilus influenzae Rd KW20
MNQLEMKKLAAQAALQYVKADTIVGVGSGSTVNCFIEALGTIKDKIQGAVAASKESEELLRKQGIEVFNANDVSSLDIYVDGADEINPQKMMIKGGGAALTREKIVAALAKKFICIVDSSKQVDVLGSTFPLPVEVIPMARSQVGRKLAALGGSPEYREGVVTDNGNVILDVHNFSILNPVEIEKELNNVAGVVTNGIFALRGADVVIVGTPEGAKVID

SEQ ID NO: 32775 - protein, 189 aa, Skeletonema costatum
AGGISEMAELGPETRAITDGLDEVGNTTAAIGKGFAIGAAGLAALAIIAAFIQVISSQVEGFSLDIGNPKVLMGMFLGGIFPFIVSAMTMRAVGDAAFDMIKEIRRQFKEIPGLMEGKAKPDSKKCVDIATKAALRRMMGPGALAVLAPVVVGFGLGADSLGGMLGGALITCVLLAITMQAGGGAWDNA

SEQ ID NO: 32776 - protein, 618 aa, Clostridium tetani
MINTLDRYKDVYDIKNMSLDELNLLSRELRNFIIESVSQNGGHLASNLGVVELTLSLYNVFDFSYDKLIWDVGHQCYVHKILTGRRSGFQNLRKINGLSGFPKRCESKFDHFETGHSSTSISSALGMARARDLKGENYNVVAVIGDGALTGGMALEALNDVGDNKTKLTIILNDNQMSIGKNVGGLSTYLSSLRIDPNYNKFKRDVEGIIKKIPNIGKGVAKNLERVKDGVKQVLVPGMLFENMGIKYFGPIDGHNIKQLSKVMDKAKNMKEPVIIHVVTTKGKGYKFAEQNPDKFHGIGSFDYMTGCSKKSKGVTYSKAFGKAMVSIASKDKRVVAITAAMKDGTGLNEFSNKFKNRIFDVGIAEQHAVTMAAGMATAGLRPVFSVYSTFLQRAYDQVLHDVCIQNLPVVFAIDRAGLVGEDGETHQGVFDMSYLSHMPNMTIMAPKCVEELEFMLNWALSQESPIAIRYPKGESRLNLKPIKNFQKGKWEVLEDKGKISIIATGRMVEKAFNVKETLKERNIDIGLINATFVKPIDKEMLNKIIDEEKTIITLEDNVILGGFGNSVLNYVRDTNSNIKVVNLGFKDEFIPHGKVDDLFKMYGLDEEAILKEVMKLM

SEQ ID NO: 32777 - protein, 210 aa, Tetraselmis chuii
AGGIAEMAELPSSVRDTTDALDAVGNTTKAVTKGYAIGSAGLGALVLFAAYNEDLKYFIANATEGSFFYGMGAVDFSIANPYVVVGLLFGGLLPFLFGGMSMMAVGRAAQAVVEEVRRQFREKPGIMTYDEKPDYGRAVDILTSAAIKEMIVPSLLPVLSPIVPVLCDLGYCWTHLLHLRTVGAMLLGVIVTGLFVAISNDSVGGAWDNA

SEQ ID NO: 32778 - protein, 232 aa, delta proteobacterium MLMS-1
MEEIAQNLAAIKARIAAAARRAGRDPQTVRLVAVSKKVAPERIARAVAGGQRLFGESYLQEAEAKMARVDPEGRLHWHFIGHLQSNKAKAAATRFAMVESVDRLKLADRLAHHAAAAGRLLPVLVQVNIAGEARKAGVAPAETRALLQELDKLPALRVMGLMTMPPWASTAEASRGHFRQLRQLADAMAEAGLLGRHGPVELSMGMSGDFEVAVEEGATLVRVGTAIFGARD

SEQ ID NO: 32779 - protein, 502 aa, Physcomitrella patens subsp. patens
MPLVLLKITRRPRLKLPPSPPAYPIIGHLHLLGKLPHQSMTNLAKKYGEIYSLRLGSVPAIVISTPEMAKEFLLTNDKIWSSRSVHMTSGYYFSYDYAGIAFAPSTPVWRSLRKICMSELFTQRRLEASKGLREEEMQYMIRSILDDAHQGRLIDLKLKINALTANIVARMVLNKRFTGCIDSTVETEAEAHQFKEMMEEHFLLLGVFMIGDYIPWLSPLDLGGTEKRMKSLRKRLDAFLDDILEVHEVKRAKGPIPEEDQDVIDVLLNEMYQQDSNESKQLDTNNVKSTILNLFAGGTDTSTVTIEWAMSEMLRNPTIMGKLKAELDARIGKDRRVRETDLSDLPYLQAVTKETFRLHPVGPLLIPHVSTHDCEVGGYHIPTGTRLYVNVYAIGRNPKVWDRPLEFDPERFMTGLNAGVDVKGKHFHLLPFGTGRRGCPALPLGLLIVQWTLATLVHALDLSLPQSMEPKDVDMTEAYGLTVPRAQSLYLNAKLRAADHLY

SEQ ID NO: 32780 - protein, 157 aa, Zea mays
NALDRFKEINPTVFGVSTDSHFTHLAWVEKPRKQGGLGPDLELPLIADKSTKISRNYGVLIEDEGIALRGLFIIDPKGVLRQITVNDLPVGRDVEETIRLVKAFQFTDEYGEVCPAGWQEGGKTMKADPKGSLEYFSAQGENDTSNETRIPINTRSQ

SEQ ID NO: 32781 - protein, 468 aa, Streptococcus thermophilus LMG 18311
MSSGKIAQVVGPVVDVAFATGDKLPEINNALVVYTDEEKSRRIVLEVALELGEGVVRTIAMESTDGLTRGLEVLDTGRPISVPVGKETLGRVFNVLGDTIDMEAPFADDAEREPIHKKAPTFDELSTSTEILETGIKVIDLLAPYLKGGKVGLFGGAGVGKTVLIQELIHNIAQEHGGISVFTGVGERSREGNDLYWEMKESGVIEKTAMVFGQMNEPPGARMRVALTGLTIAEYFRDVEGQDVLLFIDNIFRFTQAGSEVSALLGRMPSAVGYQPTLATEMGQLQERITSTKKGSVTSIQAIYVPADDYTDPAPATAFAHLDSTTNLERKLTQMGIYPAVDPLASSSRALSPEIVGEEHYAVATEVQRVLQRYRELQDIIAILGMDELSDEDKTLVARARRIQFFLSQNFNVAEQFTGQPGSYVPVAETVRGFKEILEGKYDNLPEDAFRSVGPIEDVVAKAKAMGY

SEQ ID NO: 32782 - protein, 354 aa, Triticum aestivum
  misc_feature (176)..(176): Xaa can be any naturally occurring amino acid
  misc_feature (246)..(246): Xaa can be any naturally occurring amino acid
  misc_feature (252)..(252): Xaa can be any naturally occurring amino acid
  misc_feature (270)..(270): Xaa can be any naturally occurring amino acid
  misc_feature (275)..(275): Xaa can be any naturally occurring amino acid
  misc_feature (298)..(298): Xaa can be any naturally occurring amino acid
  misc_feature (325)..(325): Xaa can be any naturally occurring amino acid
TAWFNFALCGLVGIITAYAFVWISKYYTDYKHEPVRLLALSSSTGHGTNIIAGVSLGMEATALPVLVISIAIISAFWLGRTCGLVDELGNPTGGLFGTAVATMGMLSTAAYVLTMDMFGPIADNAGGIVEMSQQPESVREITDILDAVGNTTKATTKEFAIGSAALASFLLFSAYXEVAAFAQLPFKEVDIAIPEVFVGGLLGSMLIFLFSGWACSAVGRTAQEVVTEVRRQFIERPGIMDYKEKXPDLWSXVLQLWASASLREMIKPGXLLAIXSPMAVGIIFRILGHATGQPLLGXKVVASMLMFATVTGILMALFLNTSGGXWDNAKKYIETGALGGKGSEAHKAAITGDT

SEQ ID NO: 32783 - protein, 330 aa, Yarrowia lipolytica CLIB122
MSLENPNTLPFNDPETSPKTALVTGASSGIGWYTTLHLYMHGWDVFLGVRNVLKGQKAIDDIKAEAQKRQLDGSIPATAKFGQLAIVEMDLLDIKSLDKVEAQLQNTEKLDLLIHNAGIMAVPRENSKDGWEVQMQTNYVAPFVLTDRLLDLLQKAPKPRIVYLSSIGHHFAMKPAPLDKRQDGFPGLYYGFVRYGYSKTAGMQLINQLAKDYPHILSMSVHPGFVMETELYRHWNSLPLVGPLFNLGFRSFGVVFGVSKEEGCYSTLVAALSPNLTAPTDSGEFLWTKGSEGNPSSLVKDEKYALKNWNWTVDQMEQKNVRIRHFQHKR

SEQ ID NO: 32784 - protein, 982 aa, Bacillus cereus ATCC 10987
MSKYLKRISVICFIFTVLIGQIFMPIIGHAQELNTTGFVDSFSFEKTKLNYGEKNTIHVNFSEKPGKKMKSGDTLTLALPPELKGYSGTIPLKDDSGRIFGTCQINASNVVCTFNDTVEKLENIRGNFNFTVQGTNVEAGKTKDVQTNLGTDLEKQMVSITHPKGEGTEPGIFFYKSGDIQPDKSNEVRWFLNINLKKQYLHDNIVLKDTLQEGQTLNKDSFTITINNKEYLSLKQFQDRGYGYIKLISDNSFEVVIYRHMANATSFTVFYTSTITDSGKKLKYLQNDYKLDYQILYEKPSTESNSVKVENISFGGGAEGVLPAKGTLQIVKHIEGDEKKFIPGVSFKLFTESGQQIGDSYTTNQDGIVEAPNLTPGNYYVQEISAPNYVEFDSQAKIPFTIKTDATNGIKLMVPNKLKTTSVAGTKTWEGDKVNDRPKTIKVDLLQNGKVIATKEVTAENDWKYEFGKLPAVDSEGKAHTYEVKEQPVSGYQSKVNGYDITNIKIQEAIEVEEQNKEETTEELEDLEKPEEPKVTEEPNVLEKPEVKEKPEIWVKPIEEENKEETTEELEDLEKPEEPKVTEEPNVLEKPEVKEKPEIWVKPIEEENKEETTEELEDLEKPEEPKVTEEPNVLEKPEVTEKPEIWVKPEEEENKEETTEELEDLEKPEEPKVTEEPNVLEKPEVKEKPEIWVKPIEEENKEETTEELEDLEKSEEPKVTEEPNVLEKPEVKEKPEIWVKPIEEENKEETTEEMEDLEKPEEPKVTEEPNVLEKPEVKEQPEILVTPIEEENKEETTEEMEDLEKPEEPKVTEEPNVLEKPEVKEKPEIWVNLEEVENKEGTTEEITEELEGLLKPEELKVKEEPNVLEKPEVKEQPEILVTPIEEENKEETTEEMKDLLKPEEPKVKEEPNVLEQPEVSSKPEVQNKQDVQDKSEVTSNEEDNKQLKVLPQTGGASTEATSVIAGMLTLILGARLFRRSKN

SEQ ID NO: 32785 - protein, 376 aa, Saccharomyces cerevisiae YJM789
MSNVTTPWWKQWDPSNVTLTDETPDDVWKLCVLEEVYFGGNEYSGNLGARISSVFVILFVSTFFTMFPLISTKVKRLRIPLYVYLFAKYFGSGVIVATAFIHLMDPAYGAIGSSTCVGQTGNWGLYSWCPAIMLTSLTFTFLTDLFSSVWVERKYGLSHDHTHDEIKDTLVRNTAAVSTENDNENGTANGSHDTKNGVEYYEDSDATSMDVVQSFQAQFYAFLILEFGVIFHSVMIGLNLGSVGKEFSSLYPVLVFHQSFEGLGIGARLSAIEFPRSKRWWPWALCVAYGLTTPICVAIGLGVRTRYVSGSYTALVISGVLDAISAGILLYTGLVELLARDFIFNPQRTKDLRELSFDVICTLFGAGIMALIGKWA

SEQ ID NO: 32786 - protein, 540 aa, Oryza sativa Japonica Group
MATGPRRWPAGDHDDPWDVTVTLAELRGTLVVAHDDHRAGVLDLWFLLAGDGDGGKVGPQHWTKLYTVTMPYHALGLPLPWDAESAEPAVVLVDDGRVVFWVWANGSSEHGRGVIRVYDPATGGQTDVAAMVPVGGCYRLIDIPMSNCINSKINKIYVLTQFNSQSLNRHIARTYNIGEGVGFGDGFVEVLAATQTTGESGKRWFQGTADAVRQFLWLFEDARLKRIENILILSGDHLYRMDYMDFVQKHVDKGADISVACVPVDESRASDFGLMKTDKNGRITDFLEKPKDESLKSMQLDMGTFGLRPEVADTCKYMASMGIYVFRTDILLRLLRGHYPTANDFGSEVIPMAAKDYNVQAYLFDGYWEDIGTIKSFFEANLALTDQSPNFYFYDPVKPIFTSPRFLPPTKVENCKVLNSIVSHGCFLTECSVDRSVIGVRSRLEPGVQLKDTMMMGADYYQTEAERFSELSDGKVPVGVGENTIIRNCIIDKNARIGKNVMIMNSQNVQEAERPLEGFYIRSGITVVLKNAVIPDGTVI

SEQ ID NO: 32787 - protein, 498 aa, Bacillus cereus ATCC 10987
MFQKIAKECLAGFTVAIVALPLAIAFGIAATGTSEGALVGLYGAIFAGLFAALFGGTPGQVTGPTGPITVIATGVIATHGLEASFIVFMMAGLFQILFGVCKLGSYVRYIPYPVVSGFMNGIALIIILGEMKHVQNSFLLVVLTIIVMIVSGKWIKAIPSSLVALVGVTAMLPLFSSALEGLTVKLPVIGNLSLNKVIEKIGTIPEAMPTLHIPSLSGTGIAELILPALSIALLGSIDSLLTSVVMDNVTGTRHKSNKELVGQGIGNVMSGLFGGLAGAGATVRSIVNIRSGGKTALSASMHSVILFIFIMGLGSVVQYIPLAVLSGILILTGIGMFDWESMKKMHVAPKGDVVVMLVTMIVTVKFDLMIAVAFGIILAFIIYMVKCKERKASIVKEKEAIYKIKGPLSFLTVDRVFYALQDVKSPVVLRMKDTRYMDVSGAMALLNFIEQSGKSGLSVTLEQVPAHIEKILVTMASSEQKDKLLFTEADVMQGNALV

SEQ ID NO: 32788 - protein, 444 aa, Brassica oleracea var. alboglabra
MRGVIPNYHHSYTLLFFVILVLFPHVFSTNTLSPNEALTISSNKTLVSPGDVFELGFFKTTTRNSPDGTDRWYLGIWYKTTSGHRTYVWVANRDNALHNSMGTLKISHASLVLLDHSNTPVWSTNFTGVAHLPVTAELLANGNFVLRDSKTTALDRFMWQSFDYPVDTLLPEMKLGRNRNGSGNEKILTSWKSPTDPSSGDYSFILETEGFLHEFYLLNNEFKVYRTGPWNGVRFNGIPKMQNWSYIDNSFIDNNKEVAYSFQVNNNHNIHTRFRMSSTGYLQVITWTKTVPQRNMFWSFPEDTCDLYKVCGPYAYCDMHTSPTCNCIKGFVPKNAGRWDLRDMSGGCVRSSKLSCGEGDGFLRMSQMKLPETSEAVVDKRIGLKECREKCVRDCNCTGYANMDIMNGGSGCVMWTGELDDMRKYNAGGQDLYLKVAAASLVPS

SEQ ID NO: 32789 - protein, 509 aa, Magnaporthe grisea 70-15
MVGTNLCVGVTGMYHSGIGGGGFMLVRGSDGEYEVIDYRETAPAAAYEDMYRGNVHGSIHGGLSVGVPGELRGLEYLHSKYGLQLNQASRTSSWRTQLGHKNSHQMVGGTQTSFWGTHAHIADANTGTLVGLGDIIKRGRLASTLEKIAHHGANVFYEGDIAKSMIDVIQANNGTMTLDDLKDYQVSRPRPVSVNFRGYKLWSTPSPSSGAVCLSIMKTLEQYPPEELSATPENINLTTHRLDEALRFGYGGRTSLGDPAFVPHIDELESRLLSEKSAAARRARILDNTTQPVEAYDPNTEDSSNDGRHFYANPGHGTSHIVTADGTGMTITSTTTINLLFGSLLITPDTGIILNNEMNDFSIPGVRNEFGFEPSVPNYIRPGKRPLSSITPLIAERIADGSLALSVGAAGGSRILSSTCQVAWRVLEQGLGVKEAVAEPRIHDQLMPNESWFEWAFDNSTVAGLAARGHNVSWVPPIYSAVQAVQMLEDGTLVAAREIRQKNSGGLSI

SEQ ID NO: 32790 - protein, 154 aa, Yarrowia lipolytica CLIB122
MFGLFLSAELQGVTELGPTLPYEFSFKIECNSCHEVHENWVTMNAQDKSDISGSRGDANFVFKCRFCKRESSATLTETGKTLNADDKKPAEILQIDCRGLELKEFRADGDFQCKGESGTPFKEMDLSEGEWFDYDEKNSEEVSVTDVKWDIKRV

SEQ ID NO: 32791 - protein, 310 aa, Bacillus cereus G9241
MKKVLFLGDPGIDDSLAIMYGIMHPDIDIVGVVTGYGNVTQEKATSNAAYLLQMAGREDIPVINGAKIPLSGDVTTYYPEIHGADGLGPIKPPKTFSPNIKPFCSFFDILEKYKGELIIVDAGRSTTLATAFILEKPMMKYVKEYYIMGGAFLMPGNVTPVAEANFHGDPIASQLVMQNAKNVTLVPLNVTSEAIITPEMVKYITKHSKTSFNKLIEPIFTYYYKAYKKLNPKITGSPVHDVVTMMVAANPSILDYVYRRVDVDTVGIAKGESIADFRPQPDSKALKNWVRIGWSLHYKKFLEDFVKIMT

SEQ ID NO: 32792 - protein, 253 aa, Mesembryanthemum crystallinum
MPIRDISVGRAEEAAHPETLKQALAEFISTLIFVFAGEGSGMAFAKLTAGAAATPAGLVAASVAHAFALFVAVSVGANISGGHVNPAVTFGAFIGGNISLLRGIVYWIAQLAGSSVACLLLKFATGGLETSAFALSADVTVWNALVFEIVMTFGLVYTVYATAIDHKRGNLGIIAPIAIGFIVGANILVGGAFTGASMNPAVSFGPALVSWTWNNHWVYWVGPLIGGGLAGVIYETIFIHHEPASADYQRLSA

SEQ ID NO: 32793 - protein, 211 aa, Ashbya gossypii ATCC 10895
MSSSKRRIETDVMKLLMSDHDVELVDDNMQEFHVKFHGPKGTPYERGVWRLHVELPDNYPYKSPSIGFVNKIFHPNIDAASGSICLDVINSTWSPLYDLLNIVEWMIPGLLKEPNGSDPLNNEAATLQLKNPQMYEEKIQEYIDKYATEERYVQQFGGAGGDAGDGSEDDEDADENPSDGMDYDEDDEELSEIEVEEEDEEVHISDSDLLD

SEQ ID NO: 32794 - protein, 262 aa, Bacillus anthracis str. A2012
LVRLGVFKVEEGPELVEAVKSAIKAGYRSIDTAAIYGNEKAVGEGIRAGIEATGISREDLFITSKVWNADQGYEETIAAYEESLKKLELDYLDLYLVHWPVEGKYKDTWRALETLYKEKRVRAIGVSNFQVHHLQDVMKDAEIKPMINQVEYHPRLTQKEVQAFCKEQGIQMEAWSPLMQGQLLDNETLQEIAEKHGKTTAQVILRWDLQNGVITIPKSTKEHRIIANADVFNFELTKEDMEKIDALNQNHRVGPDPDNFDF

SEQ ID NO: 32795 - protein, 210 aa, Phaeodactylum tricornutum
AGGIAEMAECEPEVRERTDKLDAVGNTTAAIGKGFAIASAALTALALFSAFMKVANVSSIDVSQPKIMAGLLVGAMLPFVFSALSMNAVGRAAMAMIEEVRRQFRDIPQLKAALEVMRAVDSDMSKATPAQREIFDAADGYAEYDKCVDISTKASIREMVLPGLLAIVVPVAVGFIGGAEMLGGLLAGVTSAGVLMAIFQSNAGGAWDNA

SEQ ID NO: 32796 - protein, 103 aa, Glycine max
MASSADPWVREYGEAARLADDVASMVADRAALPQSGPEVMRHTSAIRRKITILGTRLDSLEGMLARLPPKSITDKELNKRRDTLSNLKSRAKQMAESFNMSTF

SEQ ID NO: 32797 - protein, 343 aa, Mycoplasma mobile 163K
MPFHFMKGLMIIKENNFKKFFLKLSLNEKYSDLVFTELKKYENQESEKTATYKFKISKKIILIEGKEDRILLRTLKWIDDIVDKILREFNLSFGININFKNRFTSNENNNLIIFNFYSNDLKIALEELDDLILDLNISEKQNLISFRFDFDSVFQESKSILMETSDGFFNMKSFEVPSHNKEFVIKWNGDLKKIVNARIHYKCMTSEVFGSIMCDCKDQLESFNELMKKEGGLLLYAYEEGRGFGMLHKLNAYYNTEKEGLDTVDAMIKETGKTEARKFDMAGEIIRKLGIKEVNLYTNNPRKIIPLLDRRIKVNRKKHWTETKSKEAKKYTEDKIKKMEHLE

SEQ ID NO: 32798 - protein, 447 aa, Ashbya gossypii ATCC 10895
MGRSWGLLWMACLLYGVFTECRRSSQHAHTGKMSLSSKLTVKDLSLAGKRVFIRVDFNVPLDGKTITSNQRIVAALPTIKYVLEQGPKAVVLASHLGRPNGERNEKYSLAPVAAELEKLLGQKVNSWTLRGQHVTAAVNGAAAGSVFLLENLRFHIEEEGSRKVDGEKVKASAEDVQKFRQGLMSLADVYVNDAFGTAHRAHSSMVGFELPERAGGFLLSRELEYFSKALENPTRPFLAILGGAKVADKIQLIDNLLDKVDSIVIGGGMAFTFKKVLENMEIGNSIYDKAGAEIVPKLAEKAKKNGVKIVLPVDFVIGDDFSQDANTKIVSASEGIPSGWEGLDCGPESRKLFSETIASAKTIVWNGPPGVFEIPKFSEGTQAMLAAAVKASEAGSTVIIGGGDTATVAKKYGVVEKISHVSTGGGASLELLEGKDLPGVTFLSSKQ

SEQ ID NO: 32799 - protein, 638 aa, Desulfovibrio desulfuricans G20
MSQTGMTIDNVLDSIQHPTDVAKLDADQLRQLADELRERIIGTVSQNGGHLAPSLGVVELTLALLSVFNPDKDKFVWDVGHQAYAWKLLTGRRDEFSTLRQYQGISGFPKMAESPYDHFGVGHSSTSISAAAGMAMARDLAGDDNDVIAIIGDGSMTAGLAFEGLNQAGHQGRRLLVILNDNEMSISKNVGALSLFLSRNLSSRWVRRMKRDVETWLKSVPGIGEEMLNYAKRSEHSLKSFFTPGMLFEAFRFNYVGPVDGHDVRNLAKVMQMARALDEPVLLHVLTKKGKGYEPAESNPTYFHGVGRFELETGAACKFVDSDSLPSYTEVFGSTLCSLAEKDERVIAITAAMPEGTGVGEFSRRFPDRFVDVGICEQHAVTFAAGLAAQGFRPVVAIYSTFLQRSYDQIVHDVCLQKLPVTFCLDRGGLVGEDGPTHHGAFDLSYLRHIPNLTIIAPKDEAELQQAMKTALAGEGPVAIRYPRGIGVGACLSADPGVLEHGRGELLKKGADVAVIAVGSRVHPALAVAEEIERSTGKAVSVFNARFVKPLDAEQLVALARSHDSLLLLEENTTTGGFSSGVLELLADHDCLAGVHVRRLGLPDDFVTHGTQKQLRKLTGIDRAAIRRTLLEMLGLQE

SEQ ID NO: 32800 - protein, 428 aa, Neisseria meningitidis MC58
MSAIVDIFAREILDSRGNPTVECDVLLESGVMGRAAVPSGASTGQKEALELRDGDKSRYSGKGVLKAVEHVNNQIAQALIGIDANEQSYIDQIMIELDGTENKGNLGANATLAVSMAVARAAAEDSGLPLYRYLGGAGPMSLPVPMMNVINGGEHANNSLNIQEFMIMPVGAKSFREALRCGAEIFHALKKLCDSKGFPTTVGDEGGFAPNLNSHKEALQLMVEATEAAGYKAGEDVLFALDCASSEFYKDGKYHLEAEGRSYTNAEFAEYLEGLVNEFPIISIEDGMDENDWEGWKLLTEKLGGRVQLVGDDLFVTNPKILAEGIEKGVANALLVKVNQIGTLSETLKAVDLAKRNRYASVMSHRSGETEDSTIADLAVATNCMQIKTGSLSRSDRMAKYNQLLRIEEELAEAADYPSKAAFYQLGK

SEQ ID NO: 32801 - protein, 252 aa, Mycoplasma mobile 163K
MKISIVGYGHVGQAMHKLFKEAIIYDIHKSKYNDIEKIKNSDVVFVCVPTPMKKNGSCDTSFVEDVISKIDSKLFIIRSTVWIGFTDYASEKYKKNIVFQPEYYGETTNHPFSNLENQNWISFGGEQKNIDKAIEVYQEVKNSNVKIIQSSAKEIELAKYMENAFLALKVTFVNEMYDLAEKMNINYNLAREAWISDPRIGSSHTFVYKNNRGFGGSCLPKDIASLIYQADENGEDLDLIKAVVLKNKKYQK

SEQ ID NO: 32802 - protein, 216 aa, Archaeoglobus fulgidus DSM 4304
MEEIRFCPEHGFYRGEKCRCGAEGELILPKEKVEKLGKFISGVLRHFPDKFGLNMDENGWVNLESLARVVKRRYKWANIWLIKALVYSDEKQRYELKGDKIRARYGHSIDVKLSDFPEAKEDVLYYGTSEEEAHRMLEIGIKPVNQRYVHLSTTIEKSKEVASIRTDTPIVLEIDAKKAREDGIRIIKANDLIALAEEIPAKYIKRQIVFNQYSSS

SEQ ID NO: 32803 - protein, 457 aa, Haemophilus influenzae Rd KW20
MSAGKIVQIIGAVIDVEFPQDAVPKVYDALKVESGLTLEVQQQLGGGVVRCIALGTSDGLKRGLKVENTNNPIQVPVGTKTLGRIMNVLGEPIDEQGAIGEEERWAIHRSAPSYEEQSNSTELLETGIKVIDLICPFAKGGKVGLFGGAGVGKTVNMMELIRNIAIEHSGYSVFAGVGERTREGNDFYHEMKDSNVLDKVSLVYGQMNEPPGNRLRVALTGLTMAEKFRDEGRDVLFFVDNIYRYTLAGTEVSALLGRMPSAVGYQPTLAEEMGVLQERITSTKTGSITSVQAVYVPADDLTDPSPATTFAHLDSTVVLSRQIASLGIYPAVDPLDSTSRQLDPLVVGQEHYDVARGVQGILQRYKELKDIIAILGMDELSEEDKLVVARARKIERFLSQPFFVAEVFTGSPGKYVTLKDTIRGFKGILDGEYDHIPEQAFYMVGSIDEVLEKAKNM

SEQ ID NO: 32804 - protein, 366 aa, Mycoplasma mobile 163K
MALKAGIVGLPNVGKSSLFSALTNLHIEMANYPFTTIEPNISVVEVKDKRLDVLANIVKPKKIVHATFEFVDIAGLVAGASKGEGLGNQFLANIKEVDLIVHVVRCFEDKNIIHVANSLDPIRDLEIINLELILADLQSVEKIIQRIQKRALNTGDAALKFEYITLLRVKESLEKSLSLRDIDFSENELRIVKLYQFLSIKPIIYVANVGMEDLKNPNNFLLSLQNYLTKLNQILIPLSVQFELEASQLKSEEEKQDFLEMFEMEKLNIDILIQTTFHTLGLRTYFTAGVQELRAWVFKENMNAQECAGIIHTDFAKKFIKAEIISYEDYVKHGGEKNSKENGKMKLEGKTYLMKDGDICYFHFGK

SEQ ID NO: 32805 - protein, 463 aa, Synechocystis sp. PCC 6803
MVCHSDYIAKIRETCLTKNVVISATTTLLENPLGEPMNIAVVGLSHKTAPVEIREKLSIQEAKLEEALTHLRSYPHIEEVTVISTCNRLEIYAVVTDTEKGVVEITQFLSETGNIPLATLRRYLFTLLHEDAVRHLMRVAAGLESLVLGEGQILAQVRTTHKLGQKYKGVGRLLDRLFKQAITAGRRVRTETDIGTGAVSISSAAVELVHRQVDLSSQKTVIIGAGKMACLLVKHLLAKGATDITIVNRSQRRSQDLANQFPQAQLTLCPLTDMFTAIAAGDIVFTSTGATEPILNCENLTGCVINRKSLMLVDISVPRNVAADVHAMEQVRAFNVDDLKEVVAQNQASRRQMARQAEALLEEEIAAFDLWWRSLETVPTISSLRSKVEDIREQELEKALSRLGSEFAEKHQEVIEALTRGIVNKILHEPMVQLRAQQDIEARKQCLRSLKMLFDLEVEEQFG

SEQ ID NO: 32806 - protein, 252 aa, Streptococcus thermophilus LMG 18311
MSRKPFIAGNWKMNKNPEEAKAFVEAVASKLPSADLVEAGIAVPAVDLTTVIAAAKGSNLKVAAQNTYFENSGAFTGETSPQVLKEIGTDYVVIGHSERRDYFHETDEDINKKAKAIFANGMIPIICCGESLETYEAGKAAEFVGAQVSAALAGLTPEQVASSVIAYEPIWAIGTGKSASQDDAQKMCKVVRDVVAADFGQEVADKVRVLYGGSVKPENVAEYMACPDVDGALVGGASLEPESFLALLDFVK

SEQ ID NO: 32807 - protein, 416 aa, Methanococcus maripaludis S2
MESYIQNLFAERIGGKSFGKEDVIYKFEKIKRAKQAAKLKYPDMELIDMGVGEPDEMADESVVEVLCEEAKKHVNRGYSDNGVQALKDEIPIYLEKIFGVKDLDPVNEVVHSIGSKPALAYITSVFINPGDVTLMTVPGYPVTATHTKWYGGSVETLPLLEKNNFLPELDAISKEVRENAKILYLNYPNNPTGAQATKKFYKEAVDFAFENDLIVIQDAAYAALTYGDKPLSFLSVKDAKEVGVEIHSFSKAYNMTGWRLAFVAGNELIVRGFAAVKDNYDSGQFIPIQKAGIHCLRHPEITEKTRAKYERRLSKMVKILKEAGFNAKMPGGTFYLYVKAPIGTKDGAKFANAEEFSQFMIKEKLISTVPWDDAGNFVRMAACFEAFKDGEISIEEEDRILNEVKRRLTEVEFVFE

SEQ ID NO: 32808 - protein, 270 aa, Glycine max
MVRFSNNVIGLLNFLTFLLSIPILVAGVWLSKQGATECERWLEKPVIALGVFLMLVSLAGLVGACCRVSWLLWLYLLVMFVLIVLLFAFTIFAFVVTNKGAGEVVSNRGYKEYRLGDYSNWLQKKVNNTKTWNRISSCLHSGKVCTEFQSKFLNDTVTQFYTEHLSALQSGCCKPAEECLFTYENSTSWTKPGNVTSYNNPDCDAWNNNQTVLCFNCQSCKAGFLQNFKTEWKRVAVVNIVFLVLLIIVYSIGCCAFRNNRRENWKGYSR

SEQ ID NO: 32809 - protein, 268 aa, Methanococcus maripaludis S2
MICCLGPRGSYSEKAAVTFSKAINDSEIQFEDSIYNVFKAVETNPEFFGVVPSENSIGGSVSITQDLLLEFPVKILGEVDISINHCLLGYDIKKVTEVLAHPQALAQCGHYITKNNWNITPVDSNAKAAKIVSEEKDEKLAAICGVENAEIYGLNVLDEYIQDFKNNTTRFFLICNKNKNFKTDLKPKKASIVVELNKNMPGAFYEVLGVFKYRNVNLTRIESRPSKKEIGNYVFYIDYEYYDDNSALLRDLRIWALNVIELGNYFVL

SEQ ID NO: 32810 - protein, 431 aa, Methanococcus maripaludis S2
MLQRTNLTKSRKNGGIIMFLTLDDFELEGKTVALRVDINSPIDVNTGDILDDTRIKACSDTIKSLSEKGAKVVILAHQSRPGKKDFTTLEAHAKKLSEVLNMEVTHVDGLICASAREAILAMDNGEIILLENVRLLAEEVLSDWKSWEEITPEKQAKTVMIKKLHPFFDYFVNDAFAAAHRAQPSLVGFSYYVPMLCGRVMEKELFTLTKVLKNPERPCVFALGGAKADDSIEVLKNVLEKQTADQVLTSGVVANIFLVAKGYKIGPNENVIADMGYTNQIEIAKELISKYGDKIVVPIDAALNVDGERVEKELDLNEEITYPIHDMGEKTMKLYEEILKDAKTVVANGPAGVFENKNFLKGTEELLKSTANSKGFSVIGGGHLSAAAEVVGLAGKMDHISTGGGACIEFLAGKKLPVIEMLSKSYEKHKL

SEQ ID NO: 32811 - protein, 556 aa, Oryza sativa Japonica Group
MAEARATRRRAEEAEMEAEAGTEGDDGDGGGSSDYTSEDEGTEDYRRGGYHAVRVGDSFKQGAYVVQSKLGWGHFSTVWLAWDTGHSRYVALKVQKSAQHYTEAAMDEIKILKQIADGDPDDSRCVVKLLDHFKHSGPNGNHVCMVFEFLGDNLLTLIKYTDYHGIPLPMVKEICRHVLIGLDYLHRTLSIIHTDLKPENILLESTIDPSKDPRKSGVPLVAPSARTDDPPPKAHAPSVNGGLTRNQKKKIRRKAKRAAAATSEGSGTVASGETDGSDDRGNLSTANEGSPNQDGDKKEEGEGSRRGSKGTRKKMALEADLKCKLVDFGNACWTYKQFTSDIQTRQYRCPEVILGSKYSTSADLWSFACICFELATGDVLFDPHSGDSYDRDEDHLALMMELLGMMPRKIALGGRYSREFFNRYGDLRHIRRLRFWPLNKVLVEKYEFSDIDANGMAEFLVPILDFVPEKRPSAAQLLQHPWLDVGPLRRQPKRPSDLTQNSSDDGVSEKQRIENEERDAMAVNLGNIAIDGASSKTTEDPQASTMQNKTNATPAK

SEQ ID NO: 32812 - protein, 172 aa, Butyrivibrio fibrisolvens
MESLTTRIKLNNGTAIPMFGYGTYKIKDQNEAYNSVRLALKNGYRHIDTAAFYENEKFVANAIKDFMEESQTKREDIFVTSKAWKTELGYDKTLAAFEKTMNEMQMDYLDLYLVHWPASYAFDDDWENTNRQTWKAMTEIYKSGRVKAIGVSNFLTHHLDTIIDMEVTPAVD

SEQ ID NO: 32813 - protein, 494 aa, Bacillus cereus G9241
MSQLAVNLHEKVEKFLQGTKKLYVNGFFIESASGKTFNTPNPATGETLAVVSEAGREDIHKAVVAARMAFDEGPWSRMSTAERSRLMYKLADLMEEHKEELAQLETLDNGKPIRETMAADIPLAIEHMRYYAGWATKIVGQTIPVSGDYFNYTRHEAVGVVGQIIPWNFPLLMAMWKMGAALATGCTIVLKPAEQTPLSALYLAELIEEAGFPKGVINIVPGFGESAGQALVNHPLVDKIAFTGSTPVGKQIMRQASETLKRVTLELGGKSPNIILPDADLSRAIPGALSGVMFNQGQVCSAGSRLFVPKKMYDNVMADLVLYSKKLNQGAGLSPETTIGPLVSEEQQKRVMGYIEKGIEEGAEVLCGGSNPFDQGYFVSPTVFADVNDEMTIAKEEIFGPVISAIPFNDIDEVIERANKSQFGLAAGVWTENVKTAHYVASKVRAGTVWVNCYNVFDAASPFGGFKQSGLGREMGSYALNNYTEVKSVWLNLN

SEQ ID NO: 32814 - protein, 68 aa, Populus trichocarpa
MTTSRRLADRKVNRFDKNISRRGAVPETTTKKGNDYPVGPLLLGFFIFVVIGSSLFQIIRTATDGGMA

SEQ ID NO: 32815 - protein, 158 aa, Zea mays
PAPAAEVEVVRELLASSASVLDRAMEWWEAEAKLNLHGFSTVAAYVLVLQWVDAVRGRPRALPLEVSVVWGVGKHSDFRGESRVRELAQEVLGRMGIPLKLSARNRGRFVGKRARGEQWLPSFPVPEDGTAPSPDAAKEEPFVFALFRKLGQFFSTLM

SEQ ID NO: 32816 - protein, 334 aa, Photobacterium sp. SKA34
MKYLITGVSGFIGSAITERLCAQGHQVIGIDNLNDYYDVSLKQARLARIVHPSFTFIELDLADREGIANLFSDQQFNRVIHLAAQAGVRYSIDNPLAYADSNLVGHLTILEGCRHNKVQHLVYASSSSVYGLNHKTPFNTADSVDHPISLYAATKKSNELMAHTYSHLYGVPTTGLRFFTVYGPWGRPDMALFKFTNAIMEGKEIDVYNHGDMRRDFTYIDDIVEGVMRIQDVIPQPNSDWTVEAGSPATSSAPYRVYNIGHGSPVKLMDYIEALEEALGIEAKKNFMDMQPGDVYMTYADTEDLFKATGYKPEVKVKEGVKAFVDWYREFYQK

SEQ ID NO: 32817 - protein, 257 aa, Triticum aestivum
  misc_feature (173)..(173): Xaa can be any naturally occurring amino acid
MADRGGERGVGERGGERGGFGRGFGRGGRGDRGGRRGGRRGPRQEEEKWVPVTKLGRLVKEGRFTKMEEIYLHSLPVKEHQIVETLCPGLKDEVMKITPVQKQTRAGQRTRFKAFVVVGDSNGHVGLGVKCAKEVATAIRGAIILAKLSIVPVRRGYWGNTIGPPRHTVPCSXRLVKKVLQFAGIDDVFTSSRGSTKTLGNFVKATFDCLMKTYGFLTPDFWRETTFTKAPYQEFTDILAKPTKALMLDAPAEKIEA

SEQ ID NO: 32818 - protein, 556 aa, Rhizobium leguminosarum bv. viciae 3841
MYRYDEFDHAFVTERVEQFRDQVERRLSGELAEDAFKPLRLMNGVYLQLHAYMLRIAIPYGTLSSRQLRMLAHIARTYDRGYGHFTTRQNLQFNWPKLCDIPDALADLASVEMHALQTSGNCIRNVTADHFAGAAADEIADPRPYAEILRQWSSVHPEFSFLPRKFKIAVTGAERDRAAIQVHDIGLHVKKNDKGEIGFAVYVGGGQGRTPMIAKLIRDFLPEEDLLSYTTAIVRVYNLHGRRDNKYKARIKILVHETGTEELTRQVEAEFAALKDTELKLPEKDVQSIAAYFAPPDLPQRAEGWENLARWKKADSGFSRWVQQNVQPHKNPDYGMVTISLKPIGGIPGDASDAQMDAIADLAEEYAFDEIRVSHEQNLILPHVALADLEAVYRGLVAINLAEANAGLITDIIACPGLDYCALANARSIPLAQEISRRFGNAERQAEIGELKIKISGCINACGHHHVGHIGLLGVEKKGAELYQITLGGSGDEHTSIGEIIGRGFEPDRVTDAIETIVDTYLGLRLDHSENFLAAYRRVGPQPFKTALYGSAAEAA

SEQ ID NO: 32819 - protein, 257 aa, Streptomyces natalensis
MTHQHGLLSGKVSLITGASSGIGAATARLFAREGAAVVLAARRVDRLRALVSEIRRTGAEAAYIATDVSQEEDVRRAVEFTVEKYGRLDLAFNNAGVGCDHESMHLMQQDTYDDVMGTNVRGVWHCLQHEISAMLHNGVGGSIVNNSSVAGLQAIPAGAPYIASKHAVIGLTKAAAAEYAPQGIRVNSVAPGTTRTEIIAGWFDRNPGLEEQLHRATPQARTAEPEEIAQAVAWLCSDRSSFVTGAVLPVDGGYTLV

SEQ ID NO: 32820 - protein, 466 aa, Physcomitrella patens subsp. patens
MAGPAGAGGGSGQKRGRPATVNAGNNANVSGHLENASGGTAHQPSPGLNLGPSLQVVYNFADQHTKRIVMALQSGLKGELAWAINALTLLSFKEKDDSRKDATPLAKVPGLLDSLLQVISEWRDIAHERVFAKLSRPRLLGADQPYTGFGLEYEIYSPDDAMLHIRAAAEKNVQGGDGCDAVETKEGWCWDEEGIFNLDEIGRHEKQICAVAVSNVLRNFSFMPENEASMAQHRGCLETLITVLEAHETEDEELVTNSIETLLNLATFLCFKIFTNNGNNKASNTGSSMSEKRMIDAIMMMLSCPVISWHCCAAELLGRLVVNPDNEPFLMPFVSQIFPRLVELLSTEASGDALAAAVAALHNFSEINTECRLGLASERWAVARLLRVVGSGNHYPQEVCRKAALTLENLASEPQNRAVMLSYESSIAELAVVDQRMSDVFARILWELSSGISSKMGSLRGVWGSS

SEQ ID NO: 32821 - protein, 386 aa, Archaeoglobus fulgidus DSM 4304
MFKLADRLEKIPPYLFAEIDAMKRKKLQEGVKVIDFGVGDPDLPTPEHIVEALKNAAEKVERQKYPSYEGMLSFRESVARFYRRRKGVNLDPESEVISLIGSKEGIAHLPLAFVNDGDYVLVPEPGYPVYYSSTLLADGVPYEMPLKEENKFLPDFQLIPDEIARKAKIMFLNYPNNPTAAVAPKEFIKEAIDFCIDNKIILAHDAAYSEITFDGYKAPSFLEFEDAFEVCVEFNSLSKTYNMTGWRIGFACGNRDILAGLLKVKTNVDSGVFEAIQEAAIAAMDGPDRVIEENCKVYQRRRDLLVEGLRDVGIDAEKPKATFYVWAKVGGSSIEFVKQLIDKAGIVATPGIGFGKSGEGFVRFALTRGEGVIEEAIDRLKTILHK

SEQ ID NO: 32822 - protein, 305 aa, Mesorhizobium loti MAFF303099
MTNDDEMAFEMALIRRAAAVEVLLRRLLDDRPLSGEIARPDRLMAAMRHGVLNGGKRLRPFLVMESAALFSADGEAALRVAAALECVHCYSLIHDDLPAMDDDDLRRGQPTVHKAFDEATAILAGDALLTLAFDIVASEATVLPADRRAALVLALARAAGAGGMVGGQKLDLEAEQTPPDEAGIITLQAMKTGALIRFACEAGAIIAGAPAEDRERLAEFGSAIGLAFQLADDLLDLTADAGQMGKATGKDAAAGKGTLVALHGANWAHSQLHGLVGQAHALLDPYGDRAALLKEAATFVATRNS

SEQ ID NO: 32823 - protein, 461 aa, Solibacter usitatus Ellin6076
MQKSPRTELKRDLGPWAAASIVVGTVIGSGIFLVPKTMIQKVGTVEAVFAVWVVGGLLSLAGALSYAELAAALPEAGGEYAFLREAYGPMWGFLYSWTQMWVAKSGSIATLATGFFLYLTTFFEPLKGVFYTIPLPIGPNGGPLEIQYGQIFAIFLILALGWLNYFGVRIGGNVQVAVTVIKVGLIAAIIFAGLVFGHAHETAAGPVAPITFSGFIAALVAALWAYDGWNNVSMVSSEIKDPQKNLPRALIGGTLCVIAIYMAANAAYFHVMSPAEVAGSTRVAAEMMRKIFSAPGAAAVSIAAMISIFAALNGSILSGARVPYAAARDGYFFHAIGRVHPKYHTPGVSIIVLNLWACLLVLSGKYDDLFNLVIFASWILYGMTAAAVVVLRIKQPELQRPYRTMGYPVVPVLFIIGAVILLVSTAWERPRESMMGIALILLGLPFYYYWKKRIPATIREV

SEQ ID NO: 32824 - protein, 251 aa, Mesorhizobium loti MAFF303099
MSANLFDLSGRQALVTGSSQGIGLALAKGLAQAGASVILNGRDTAKLAATAAQIPGAQTLAFDATEHDAVRSAIDNFELSGGPIDILVNNAGMQFRTPLEDFPADAFERLLQTNVASVFHVGQAVARHMIRRGRGKIINIASVQTALARPGIAPYTATKGAVGNLTKGMATDWAKHGLQCNAIAPGYFDTPLNAALVADPAFSGWLEKRTPAGRWGKVEELVGACVFLASDASSFVNGHILYVDGGITASI

SEQ ID NO: 32825 - protein, 238 aa, Brassica napus
  misc_feature (220)..(220): Xaa can be any naturally occurring amino acid
MINVVMMILLCLISLLCFFTFFKKPKDSSDLPPRPPSMPIIGHLHLLLSSLIHKSFQKISSNYGPLLHLRIFNVPIVLVSSASVANEIFKSHDVNISSRGLPPIDESLFFGSSGFFSAPHGDYWKFMKKLVVAKLLGPQAIERSRTIRAEELERFYFDLLEKAMKKETVEIRREAMKFTNNSTCKMIIGRRCWEENGEGERVRGLITESIALTKKVYLQXLLRKPLEKLGIPLLRREI

SEQ ID NO: 32826 - protein, 408 aa, Mesoplasma florum L1
MKDLKKYFPFYDKQSNLIYFDSSATSLKIKSVIDAEMKFLSENGSNPHAVDYKKGFEAFEIIKNARQLTQEFINAKKVNEIIFTSGTTHSINLLANGLKKIIKKDDEILVTELEHSANLLPWIALANSVGAKVKKIKLNEDFTIDHESLKLQLSDKTKIVSFASVYNTVGAKNDVKLITKVIKEFNINIIVHVDAAQSIGHTKTDVTDSNIDFMSWSFHKMYGPFGVGCLYGKYELLNQLEPLFYGGGMSLKIEENLIDYSLSSLPEKLEGGTPNISAIAGVVESIKFINLIGLDQIEEHEITLKDYFKIKVKENNLNDHITFYNLDTKSPIILFNVKGVNPQDITNFLDEKYNILVRGGANCARRIEGVIGTKIAIRASFGINNNKAEIDQFIEALKDTNSFLDVLF

SEQ ID NO: 32827 - protein, 129 aa, Physcomitrella patens subsp. patens
MQAEHSLRSVPVQVAHEMMNAGHRCLDVRTQEEYLAGHVEGAINIPYLVKCGPGMKKNHRFLEEVEAEFGKDAEIIVGCQSGRRSMMAAAELQAANFNGVTDMGGGYVAWKESGLPVEVSGRRTQSHSV

SEQ ID NO: 32828 - protein, 256 aa, Physcomitrella patens subsp. patens
MTGTGKFFVGGNWKCNGTTESIKKLVGELNDGKFEESVEVVVAPPFLYIGQVIGSLTDRIAVSAQNSWVGKGGAFTGEISADQLVDAGVKWVIQGHSERRHVIGESNETIGKKSAYALSKGLGVIACVGEKLEERESNRTTDVVFEQLQAYADAISDWSNVVIAYEPVWAIGTGKVASPEQAQEVHAAIRSWLGDKISPDLASATRIIYGGSVNGANCAELAKKEDIDGFLVGGASLKGPEFVTICNAVISKKASA

SEQ ID NO: 32829 - protein, 246 aa, Zea mays
  misc_feature (153)..(153): Xaa can be any naturally occurring amino acid
MKQEAATSIVVTQEDVLHHYKEPPPRREDDPPALAASLSLPSSLSEDDGDAMPQPSSYAVLPRREGELVSAEELLLVPPLNFAMVDHGVYRSGFPDASNLPFLETLRLRSVLCLCPEPYPEANLEFLRAHGIKLFQFGIDGSKLSFGLLILKXQEPFVNIPEDRIREALEVILDASNHPVLIHCKRGKHRTGCVVGCFRKLQRWCLTSIFDEYQRFAAAKTRVSDLRFMELFDVSSIKHLAFESSV

SEQ ID NO: 32830 - protein, 414 aa, Thermus thermophilus HB27
MRLDTRFLSGFPEALSRHGPLLEEARRRLLAKRGEPGSMLGWMDLPEDTETLREVRRYREANPWVEDFVLIGIGGSALGPKALEAAFNESGVRFHYLDHVEPEPTLRLLRTLDPRKTLVNAVSKSGSTAETLAGLAVFLKWLKAHLGEDWRRHLVVTTDPKEGPLRAFAEREGLKAFAIPKEVGGRFSALSPVGLLPLAFAGADLDALLMGARKANETALAPLEESLPLKTALLLHLHRHLPVHVFMVYSERLSHLPSWFVQLHDESLGKVDRQGQRVGTTAVPALGPKDQHAQVQLFREGPLDKLLALVIPEAPLEDVEIPEVGGLEAASYLFGKTLFQLLKAEAEATYEALAEAGQRVYALFLPEVSPYAVGWLMQHLMWQTAFLGELWEVNAFDQPGVELGKVLTRKRLAG

SEQ ID NO: 32831 - protein, 175 aa, Triticum aestivum
MEHKEAGCQQPEGPILCVNNCGFFGSAATMNMCSKCHKEMVMKQEQAKLAASSFDSIVNGGDGGKAPVVAAVAASAEVVVAQVDVKALVVQPAADVAGTSEAVAVSPKRKEGPNRCSTCRKRVGLTGFNCRCGNMYCSLHRYSDKHDCQFDYRTAARDAIAKANPVVKAEKLDKI

SEQ ID NO: 32832 - protein, 213 aa, Clostridium tetani E88
MEMGITLYITRHGQTEWNTERRMQGWNDSPLTKLGMEQAKRLGKRLDNNNIDIIYSSPLGRAIKTAKIVRGERDIPIVCDNRLKEIKLGKWEGMNHDLIDNYYKEEIDNFWNNPKLYKSIGGETFLQLRNRVKDFLEEILKKHKDETILIVTHAITLKGIMNYIEDLTIDNFWGEPHINPTSLTKVEIEDSNRRILLNADISHLDEVKEIKIV

SEQ ID NO: 32833 - protein, 130 aa, Zea mays
ERERERERERERERGRGLPKNMSRKDFPPPQNGVGKRSSDDIDILHTESLIKEVEKVFSVSNPDPQEVEKAKKALKEQEQSLIDAIARLAEASDGESDGLNRGRRNLYAGNQHQANYVDDMPVGDQADAM

SEQ ID NO: 32834 - protein, 481 aa, Burkholderia sp. 383
MSFASLGLIDPLLRNLQDLNYQAPTPVQAKAIPAVLGGKDVMAGAQTGTGKTAGFALPLLQRLVQHGPAVSSNRARVLVLVPTRELAEQVLQSFIAYGKGLDLRFLAAYGGVSINPQMMKLRKGVDVLVATPGRLLDLNRQNAVQFDQVQTLVLDEADRMLDLGFARELNAVFAALPAQRQTLLFSATFSDDIRAMAATILRGPVNISVSPPNATASKIKQWVVTVDKRNKPDLFMHLVAENKWEHALVFVKTRNGVDYLAAMLDEAGYAVDTIHGDKPQPARLRALERFKTGEVQMLVATDVAARGLDIDDLPLVINVDLPIVAQDYVHRIGRTGRAGASGVAVSLVCADEAPQLAAIEALIKQTLRREEEPGFEAEHRVPETSATGEIIKKPKKPKKPKVPPAVAGAMPVPGKKPRPQNGENKRKPAAVHAKPAGNGPDYTIGSPFSVQKPRGKSAAKPAAGARKPAGKPAGGRGKRPS

SEQ ID NO: 32835 - protein, 229 aa, Chromobacterium violaceum ATCC 12472
MKSYGAEFLGTFWLVLGGCGSAVLAAGFPNLGIGFAGVALAFGLTVVTMAYAIGHISGCHLNPAVSIGLWAGGRFPAGQLAPYIVAQVLGAIAAGAVLYVIASGGAGFDVAKGFASNGYAEHSPGGYSLLAALVCEVVMTMFFLLVIMGATDKRAPAGFAPLAIGLALTLIHLISIPVTNTSVNPARSTGVALFVGGWAVQQLWLFWLAPIIGAVLGAKVYRLIAGESE

SEQ ID NO: 32836 - protein, 170 aa, Arabidopsis thaliana
MGDFSIQISSKLINQLAEGNDQPKRRAKKTKPKVSPQSKQKTNQDEEKKPNPVAELPMQPPFFFPIPPQGAASTELESIKSVVKESEKVLEKLELQEKNIVREVTERAKDLREKEFKIPEPKPMPCSSDHEAWMKCYKENIGSPLKCSGFVKSFQDCARRSRQQVNPEEK

SEQ ID NO: 32837 - protein, 349 aa, Bacillus cereus G9241
MITQKQIMNALKHVEDPELHKSIVELNMVRNIQMNGTEVKLEVVLTIQGCPLKAKIQQDIEESLHAIGASKVDVTFSSMTKEERAVLTEKLKKNTRTETGMPSMLRPDSGVRFITVTSGKGGVGKSTVTINLATALARMGKKVGILDADIYGFSIPAMMETNQKPTMIDQTAIPVISHGVKIMSMGFFTEGNNPVMWRGPMLNKWIQNFLANTHWGELDYLLLDLPPGTGDVAIDVAAMIPQAKEIIVTTPHNVASFVASRVGVMAKHTKHEILGIVENMAYYEEQDGSKNYLFGKGGGEMLAEQLQTEVIAQVPFAKREENSGSSVYDEDSLVGEVFTSLAEDIIYKG

SEQ ID NO: 32838 - protein, 47 aa, Fragaria x ananassa
LSGLLNFIDGLWSACRGERLIVFTTNHVEKLDAALIRKGRMDKHIDV

SEQ ID NO: 32839 - protein, 242 aa, Haemophilus influenzae R2846
MQGKIALVTGASRGIGRAIAEELSSKGAFVIGTATSEKGAEAISAYLGDKGKGLVLNVTDKESIETLLGQIKNDFGDIDILVNNAGITRDNLLMRMKDEEWFDIMQTNLTSVYHLSKAMLRSMMKKRFGRIINIGSVVGSTGNPGQTNYCAAKAGVVGFSKSLAKEVAARGITVNVVAPGFIATDMTEVLTDEQKAGILSNVPAGRLGEAKDIAKAVAFLASDDAGYITGTTLHVNGGLYLS

SEQ ID NO: 32840 - protein, 329 aa, Neisseria gonorrhoeae FA 1090
MKITVIGAGSWGTALALHFSQHGNRVSLWTRNADQVRQMQEARENKRGLPGFSFPETLEVCADLAEALKDSGLVLIVTSVAGLRSSAELLKQYGAGHLPVLAACKGFEQDTGLLTFQVLKEVLPDNKKIGVLSGPSFAQELAKQLPCAVVLASENQEWIEELVPQLNTTVMRLYGSTDVIGVAVGGSVKNVMAIATGLSDGLEYGLNARAALVTRGLAEITRLASAMGAQPKTMMGLAGIGDLILTCTGALSRNRRVGLGLAEGKELHQVLVEIGHVSEGVSTIEEVFNTACKYQIDMPITQTLLQLIRKEMTPQQVVERLMERSARFE

SEQ ID NO: 32841 - protein, 355 aa, Physcomitrella patens subsp. patens
MAILPPPPKLAYLISGTKGDGRRMQRLLRALYHPHNYYLLHLDLEAPMRERAELVWHVKKQLVYEEVMNVFVIGKSNLVTYRGPTMVAATLHGAAILLRKAKDWDWFINLSASDYPLVTQDDLLHVFSYLPKDLNFIEHTSALGWKEFQRARPIIMDPGLYQKKKTNIYWTTQKRASPSAFRLFTGSAWIALTRSFMEYCNVGWDNLPRTALMYYTNFLSSPEGYFQTVICNSREFRNTTVNHDLHFIAWHNPPRQHPITLSFTFYRNMTKSGAPFARKFDKGSAVLDKIDREILNRRMNEFTPGGWCIGLNDDPCGVRGDPTLLRPGPGSRRFEELVVRLLAHPNFRSQQCVGT

SEQ ID NO: 32842 - protein, 244 aa, Chromobacterium violaceum
MDKTTHFGYKTVAESEKAGKVAEVFHSVASKYDVMNDLMSGGLHRVWKHFTLTTSGVRAGDKVLDIAGGTGDLSRGWAKRVGKTGEVWLTDINSSMLTVGRDRLLDEGVILPVSLADAEKLPFPDNYFDAVSVAFGLRNMTHKDAALKEMCRVLKPGGKLFVLEFSKVWKPLSPFYDFYSFKALPIMGKLVANDADSYQYLAESIRMHPDQETLKQMMLDAGFGKVDYHNLTGGVVALHKGVKF

SEQ ID NO: 32843 - protein, 513 aa, Photobacterium sp. SKA34
MSAKKPLALVILDGWGYREDNADNAIANAQTPVMDELLAQNPNTLISASGIDVGLPDGQMGNSEVGHTNIGAGRVVYQDLTRITKAISDGEFFENEALVTAIDKAVNAGKAVHIMGLLSPGGVHSHEDHIASAIEMAAKRGAEKIYLHAFLDGRDTPPRSAKNSLVRFNELFAQLGKGRTASLIGRYYAMDRDNNWDRVEKAYDLISAAKAEFTVANAVDGLAAAYERNENDEFVKATEVRAEGQEAAIMEDGDSVIFMNYRADRAREITRAFEPGFTGFERTQRPQLSDFVMLTQYAADIALTTAFKPASLDNTLGEWLSKKGKKQLRISETEKYAHVTFFFNGGKEDEFDGESRQLVASPKVATYDLQPEMSAPELTDKLVAAIKGGEFDMIICNYPNGDMVGHTGVYDAAVKACEALDTCLGKVVAAIKEMDGQLLITADHGNAEMMVDPSTGGIHTAHTNLPVPLIYVGSKDLDLKSGGKLSDLAPTMLSLTDMEIPAEMSGQVLYNLK

SEQ ID NO: 32844 - protein, 550 aa, Vibrio vulnificus
MLKTINPTQTQAWNALTAHFESAQDMDLKDLFAQDAARFDKFSARFGSDILVDYSKNLINEETLKHLFALAKETELSAAIKAMFSGEAINQTEGRAVLHTALRNRSNQPVLVDGEDVMPAVNAVLEKMKSFTDRVIGGEWKGYTGKAITDIVNIGIGGSDLGPYMVTEALAPYKNHLNLHFVSNVDGTHIVETLKKVDPETTLFLIASKTFTTQETMTNAHTARDWFLATAGDQAHVAKHFAALSTNAPAVSEFGIDTDNMFEFWDWVGGRYSLWSAIGLSIALAVGYDNFVELLEGAHEMDNHFVSTELESNIPVILALIGIWYNNFHGAESEAILPYDQYMHRFAAYFQQGNMESNGKYVDRNGNPVTYQTGPIIWGEPGTNGQHAFYQLIHQGTKLIPCDFIAPAVSHNPAGDHHQKLMSNFFAQTEALAFGKNEETVKAELVKVGKNAEEVAAIAPFKVFEGNRPTNSILVKQITPRTLGNLIAMYEHKIFVQGVIWNIFSFDQWGVELGKQLANQILPELADGSEISSHDSSTNGLINAFKAFKA

SEQ ID NO: 32845 - protein, 517 aa, Physcomitrella patens subsp. patens
MVTLLSDTLQTDDGHSRVSKTKIVCTLGPKSREVPILEKLLRAGMNVARFNFSHGTFEYHQYTLDNLRQAQLNTGIMCAVLLDTKGPEIRTGQHKTGKPMKLIRGKEIWITTDYSHLGDEHMICMSYPKLAEHVSPGTEILCSDGTITFTVLECDVARGMVRCRCENTTMLGEKKNVNLPGVVVDLPTITTKDTDDIVQWGIPNKIDFIAASFVRKGEDVKKIRALLGSHAKTIQIISKVENQEGLVNFDDILRETDGIMVARGDLGMEIPTEKIFLAQKMMIYKCNSAGKPVITATQMLESMIKYPRPTRAEATDVANAVLDGTDCVMLSGETANGSYPDLAVAVMSRICQEAEASLDYSAIFKEIMKSVPLPMSPLESLASSAVRCAKKVRASLIIVLTRGGTTAKLVAKYRPSVPILSVAVPVLTTDSLTWEISEESPARHSLVCRGLLSLLAEGSAKATDSESTDAILGAALDHALKRKLCIVGDSVVAIHRIGAASVIKIVEVKEKVVKVAA

SEQ ID NO: 32846 - protein, 519 aa, Kluyveromyces lactis NRRL Y-1140
MSSPNEDRREIASTDEPIQDLFLISEDYIINPHEHKLNTFHTISLIVNRIIGTGIFSTPALIFTLSQQSIGISLILWVLGGIFTFAGLSVYLEFGLKIPKSGGEKNYLSRTLPKPKHLIECIYAFTIVLLGFSSGNSYAFGKYIIYVLGFNSSLSETVIDKASRYIGSLVIISCTLWHIFFPTGAKRVILYLGLVKVLILGVIVFLGSIAIIAPNLIEPHWDNFHNSFSNGSQPLDWYSISVALLQVIYSFKGWENANYVLEELEDPRRTLMIAAPVSVGLTTFLYIAIVFSYYVVIPKAEISDTGILISGVFFERIFERYSKSLAMQIVSRVLPFCIILSNYGNVMAVSFSNARVNQELAKEGIFPLTHLFSKLNYALFLHCFITIVVLLLPPNGNIYQLIIDLYAYPSGWFNLIIGIGLIYIHWTNDGGWNDIYTPWSSWYLVTVIFIISNLFLAVIPFVPPNGSVENDGYSYWVFPVTGISIMGVGALYWLLVVRKSYSRYSSATHNNEVDDYTVR

SEQ ID NO: 32847 - protein, 378 aa, Neisseria meningitidis MC58
MEMKQADSTIKSRAAVAFAPNQPLQIVEIDVEMPRKGEVLIRNTHTGVCHTDAFTLSGSDPEGVFPVVLGHEGAGVVVAVGEGVSSVKPGDHVIPLYTAECGECEFCCSGKTNLCVSVRDTQGKGLMPDGTTRFSYQGQPIYHYMGCSTFSEYSVVAEVSLAKINPEANHEQVCLLGCGVTTGIGAVHNTAKVQEGDSVAVFGLGAIGLAVVQGARQAKAGRIIAIDTNPSKFELAKQFGATDCLNPNDYDKPIKDVLLDINKWGIDHTFECIGNVNVMRQALESAHRGWGQSIIIGVAGAGQEISTRPFQLVTGRVWKGSAFGGVKGRSELPKMVEDSMKGDIELEPFVTHTMTLDQINKAFDLMHEGKSIRAVIHY

SEQ ID NO: 32848 - protein, 141 aa, Neisseria meningitidis MC58
MAIERTISIIKPDAVGKNVIGKIYSRFEENGLKIVAAKMKQLTLKEAQEFYAVHKDRPFYAGLVEFMTGGPVMIQVLEGENAVLKNRELMGATNPSEAAEGTIRADFATSVSINAVHGSDSVENAALEIAYFFSQTEICPR

SEQ ID NO: 32849 - protein, 146 aa, Carboxydothermus hydrogenoformans
PRPSLYRRKTPVGKKSRGIGVSFVELDGDIAVMANGAGITMATLDLIAYFGGRPKNFMDAGGGANAEQMAKALDLLISTNPKAILINIFGGITRCDEVAKAYLTVKQEREITVPVVIRLVGTNEDIGVKMLQEAGVESFSSAGSGD

SEQ ID NO: 32850 - protein, 572 aa, Mycoplasma mobile 163K
MIFQKQQMLTLQAKAFSFLKTLLTKKKKKKNKELKMLEVRNLSKRFTDKILFDSVNLKFIPGHTYGIIGANGAGKSTFLKILSKEIEATSGDILFPKDATISVLQQSWEIFDEIDVTNVVIMGNKKLYEILEKKNAIYNNPDSTEKDYNLASELEETYGNIGGWQADNDAQILLGALGISKKKWNLPLKELKANEKIKVLLAQSLFQNPDILIMDEPTNRLDLKSVKWLEEFLNNYKNIVIVVSHDSDFLDQVCTNIVDIDYSKMKMFTGNYSFWKESSELILDMQKRQNAKKEEKVEQLKQFIARFSANASKSKQATSRKKELEKITIDELVPSTRKYPYIRFEISQLVGKQILKVEDLEYTNEKGEILFSKLSFDLVPGEKMVILGENDIAKSRLLDILVGKLKPTKGKVTWGSTIKHAYFPADNSEYFSKKESILEWISKWPLNNSTQETKDNSDQRMRSFLGRMLFGGESVFKDSTVTSGGEKARLMFSKMMIEESNFLILDQPLDHLDTESIDSVIDGLSQYKSGLIFTTYNNALIKKVSNVILELREDKNILFRGTLEEYEQKIGF

SEQ ID NO: 32851 - protein, 466 aa, Streptococcus thermophilus LMG 18311
MKKMSQKQHHNDDDNQTKNGMVRGLQNRHVQLIAIAGTIGTGLFLGAGRSISLTGPSIILVYMLTGVLMYLMMRAIGEMLYMDPDQHTFINFITKYLGKGWGFFSGWSYWVSLVFLGMAEITAVANYVQFWFPSWPAWQIQIVFLFILSSVNLIAVKIFGEVEFWFGMIKIITILALIATGIFMVATNFETPAGHASLINITQGFQMFPKGWVSFAMAFQMVFFAYQAIEFVGITTSETANPRKVLPKAIKEIPVRIAIFYVGALIAIMAIFPWQKLPVNESPFVMVFQMAGIKWAAALINFVVLTAAASSLNSTLYSTGRHLFQIAKETPNSKVMKSLKLDTLARNGIPSHAIIVSAIVVCISAFINVLPGVSDAFALITASSSGVYIAIYILTMLAHLKYRKSQEFMADGFLMPAYKILNPLTIAFFVFVFVCLFLQKSTVVGAIGSVIWIVVFGIYSNLKYSK

SEQ ID NO: 32852 - protein, 306 aa, Haemophilus influenzae Rd KW20
MRKTLTVLGSINADHVISVPYFTKPGETLTGQNYQIAYGGKGANQAVAAARLGAKVAFISCIGSDSIGKTMKNAFAQEGIDTTHINTVSQEMTGMAFIQVAKSSENSIVLASGANSHLSEMVVRQSEAQIAQSDCLLMQLETPLSGVELAAQIAKKNGVKVVLNPAPAQILSDELLSLIDIITPNETEAEILTGVEVADEQSAVKAASVFHDKGIETVMITLGAKGVFVSRKGKSRIIKGFCVQAIDTTAAGDTFNGGFVTALLEEKSFDEAIRFGQAAAAISVTKKGAQSSIPTRQETLEFLEHA

SEQ ID NO: 32853 - protein, 176 aa, Neisseria meningitidis MC58
MKERIVFLVGPVTDESANLVVAQLLFLESENPDKDIFFYINSPGGSVTAGMSIYDTMNFIKPDVSTLCLGQAASMGAFLLSAGEKGKRFALPNSRIMIHQPLISGGLGGQASDIEIHARELLKIKEKLNRLMAKHCDRDLADLERDTDRDNFMSAEEAKEYGLIDQILENRASLRL

SEQ ID NO: 32854 - protein, 457 aa, Mycoplasma pneumoniae M129
MNYDLIIIGAGPAGYVAAEYAGKHKLKTLVVEKEYFGGVCLNVGCIPTKTLLKRAKIVDYLRHAQDYGISINGQVALNWNQLLEQKGKVVSKLVGGVKAIIASAKAETVMGEAKVLDPNTVEVAGKTYTTKSIVVATGSRPRYLTLPGFAEARQNGFVIDSTQALSLEGVPRKLVVVGGGVIGIEFAFLYASLGSEVTILQGVDRILEIFDTEVSDLVAKLLQTKNVKIITNAQVTRANNNEVFYSQNGQEGSVVGDRILVSIGRIPNTECLDGLNLQRDERNRIVLNQDLQTSIPNIYIVGDANAQLMLAHFAYQQGRYAVNHILNKKQVKPAQKLTCPSCIYTNPEVASVGYTEMELKKQGIPYVKTNLVLAHCGKAIADNETNGFVKMMFDPQTGKILGCCIIAATASDMIAELALAMGAGLTVFDIANSISPHPTINEMIADVCKKALFDHFK

SEQ ID NO: 32855 - protein, 204 aa, Neisseria meningitidis serogroup B
MSFDNYLVPTVIEQSGRGERAFDIYSRLLKERIVFLVGPVTDESANLVVAQLLFLESENPDKDIFFYINSPGGSVTAGMSIYDTMNFIKPDVSTLCLGQAASMGAFLLSAGEKGKRFALPNSRIMIHQPLISGGLGGQASDIEIHARELLKIKEKLNRLMAKHCDRDLADLERDTDRDNFMSAEEAKEYGLIDQILENRASLRL

SEQ ID NO: 32856 - protein, 336 aa, Emericella nidulans
MSTSKSRWADEDPETEALIAQRKREKEEKRRAKAEKQRLEEQAKAQAAAERQAGDSRLNGDPSEAPPKKRRRLSNEQQPGSSGEQAAKQGKPTTLLQFPALEWGPCRHVDNFERLNHIEEGSYGWVSRAKELTTGEVVALKKLKLDNSPDGFPVTGLREIQTLLEARHQNVVYLREVVMGNKMDEVYLVMDFLEHDLKTLLDDMREPFLPSETKTLLLQFISGLDFLHSQWIMHRDLKTSNLLLNNRGELKIADFGMARYYGDPPPKLTQLVVTLWYRSPELLLSAESYGPEVDMWSVGCIFGELLTKEPLLQGKNEVDQVSKVCTVLFFFFSFKI

SEQ ID NO: 32857 - protein, 751 aa, Acetabularia acetabulum
MGQTITYAIPVFGVLALLYTFWRSSWVSKQEVGTERMGRIAKNITDGAMAFLKAEYRVLAIFVIAVAILLGISGNREGTSPLIAVSFILGAICSALAGYIGMIVATKANVRTTNAARSSLGRALEVAFAGGSVMGLGVVGLGVLGLGTLFLAYSNIGWDINRVITVITGFSFGASSIALFARVGGGIYTKAADVAADLVGKVEAGIPEDHPLNPATIADNVGDNVGDVAGMGADLFESYVGSIIGTMVLGATFIGVAGFQETNDFNGLNAVLLPLVLAGTGIITSIVGTFFVKVKEGGNPQKALNTGEFLASGIMLVLTYLIVDWMLPSTWTSATGVSYSSFGVFMAVIFGLVAGLLIGMITEFYTGTGTRPVKGIVSQSLTGSATNIIAGLGVGMQSTAIPIVILAAAIIGAHEFAGLYGIAIAAVGMLSNTGIQLAVDAYGPISDNAGGIAEMGELPKEVRGRTDKLDAVGNTTAAIGKGFAIGSAALTALALFAAFMETAKITEINVADPLVMAGLFLGGMLPFLFSSLAMNAVGRAAMDMIQEVRRQFKTIPELKAALDTMRKNDGKEFAEWSEADQTIFNAADGKAEYSKCVEISTKASIREMVLPGLIAVLTPVVIGFAGGAEMLGGLLAGVTVSGVLMAIFQSNSGGAWDNAKKMFEEGVEIDGQMHYKGSDAHKAAVVGDTVGDPFKDTSGPSPNILLKLMSVVALVIAPFLDQSTKNTLQVLEPHRHIGGAFLLDVRPHSKI

SEQ ID NO: 32858 - protein, 343 aa, Vibrio vulnificus CMCP6
MKIKALSKLKPEEGIWMTEVDKPVLGHNDLLIKIKKTAICGTDVHIYNWDEWSQKTIPVPMVVGHEYVGEVVGIGQEVRGFEIGDRVSGEGHITCGHCRNCRGGRTHLCRNTIGVGVNRTGCFSEYLVIPAFNAFKIPANISDDLASIFDPFGNAVHTALSFDLVGEDVLITGAGPIGIMAAAVAKHVGARHVVITDVNEYRLDLARKMGVTRAVNVAEQKLDDVMAELGMTEGFDVGLEMSGNPSAFNSMLKTMNHGGRIALLGIPPSDMGIDWNQVIFKGLVIKGIYGREMFETWYKMASLIQSGLDLTPIITHHFKVDDFQQGFDIMRSGMSGKVILDWE

SEQ ID NO: 32859 - protein, 196 aa, Yarrowia lipolytica CLIB122
MDQNDLALTQLRCLLNLHPHPPLPYSANTDSFPSATFNYVPETPEIEGNVAACGIPQPFHSDKELAGKKVVFVSVPGAFTPTCTANHIPPYIENVDKLKAKGVDKVVVISANDPFVLSAWGRALKAPKDNFFIFASDGNAAFSKSIGQAVDLASVGFGERTARYAIIVDDGKVTYNEQEPGKEVTVSGFDAVYAKL

SEQ ID NO: 32860 - protein, 338 aa, Photobacterium sp. SKA34
MTKNANNTISMAVLGAGSYGTALAIALSRNGANVILWGHDPEHIAQLEIDRANEAFLPSVRFPESLIVTSNLQDAVEGSRDLLVVVPSHVFGQVLSQVKPFLRSDSRVCWATKGLEPETGRLLKDVAVDALGSDIPLAVLSGPTFAQELAAGLPTAISVASPDAEFVADLQEKIHCDKTFRVYSNNDFTGMQLGGAVKNVIAIGAGMSDGIGFGANARTALITRGLAEMCRLGAALGAQPETFMGMAGLGDLVLTCTDNQSRNRRFGLALGAGKSVEQAQQEIGQIVEGYRNTKEVWQLAKRYGVEMPISEQIYQVLYQGKDAREAAKELLAREKKYE

SEQ ID NO: 32861 - protein, 507 aa, Acinetobacter sp. ADP1
MVMTTSASLPLYDIVVVGGGINGIGIANDAAGRGLSVFLCEKDDFASHTSSASSKLIHGGLRYLEHYEFRLVREALAEREVLMAKAPHLVRPLRFILPYQAHLRSEWLIRSGLFLYDHLGKRKKLTASKKITFDSASPLKSEISKGFEYADCTVDDARLVIINAIQAREKGAELVTHTECLSAEIVDDVWLITLQHRQVPYQIRAKVLINATGPWVESFLKSQLKQHSPYKIRHIQGSHLIVAKLYEDNHAYILQNEDGRIVFVIPYLNDFSLIGTTDQVYLDDLNLVNITQQEISYLLDVVNRHFKTVLTRADIIQTYSGVRPLCDDESDQPSAITRDYTLALTMVSEVAPLLSVFGGKLTTYRKLAGSALEQLKLFFPDMTPSWTEYEPLPGGEYFKGQDKLVNAIQLRIKGIASELAKRWATSYGTRVWKLLQGVYSEEDFGIYFGHGLYQLEVDYLVKVEWVESADDVLWRRTKLGFRFNQNEILVLQDYLISLVVGEQGKIA

SEQ ID NO: 32862 - protein, 273 aa, Photobacterium sp. SKA34
MKQCQQHQLWPAIKQEAREQSEHEQMLASFYHATIIKHDDLAAALSYILANKLATPSMPAMAVREVIEEAYASDCSIVESAARDICAVVERDPAINMYSIPLLYLKGCHALQGYRVANWLWKQDRKALAVYLQNQISVACQVDVHPAAKIGQGIMFDHATGIVIGETAVIENDVSILQDVTLGGTGKESGDRHPKIREGVMIGAGAKVLGNIEVGEGAKIGSCSVVLNHVPPHTTVAGIPAKVVGRPNSDKPSMDMDQQFNGNSQTFIEGDGI

SEQ ID NO: 32863 - protein, 226 aa, Deinococcus radiodurans R1
MDLEALKKEAALRSVALVQSGQRVGLGTGSTAKYAIEELGRKLAAGELSGIVGVSTSEASEKLAREVGIPTEPLDPRPLDIAIDGADEIAPNLDLVKGLGGALVREKMTEVQAKRLIIIADHTKLVTRLGEKAPLPIEIVPFGFLSTIERLREFLPGGRLRQPGAQPYVTDNGNYIFDAQLPAEFDARELERRIKGTLGVVDTGLFLGMAERAFVAAPDGVQELTR

SEQ ID NO: 32864 - protein, 568 aa, Oryza sativa
MGNTCVGPSSAADRHGFFHSVSLAVLWRPGGRAEPSQPPGYPPRESSHSSVTSSTAPERVTIADSDLSSSTPNKGGNKPKVRRVQSAGLLADSVLKRDSERLKDLYTLGKKLGQGQFGTTYQCVEKATGKVLACKSIAKRKLVSEEDVEDVRREIQIMHHLAGHPSVVSIVGAYEDAVAVHLVMELCAGGELFDRIVQRGHYSEKAAAQLARVIIGVVEACHSLGVMHRDLKPENFLFVNHKEDSPLKTIDFGLSIFFKPGENYSDVVGSPYYVAPEVLMKHYGREVDVWSAGVIIYILLSGVPPFWDESEQGIFEKVLKGDLDFSSDPWPAISDSAKDLVRKMLNRDPRKRLTAHEALCHPWVCVDGVAPDKPLDSAVLTRLKQFSAMNKLKKMALRVIAENLSEDEIARLREMFKMLDTDNSGQITLEELKTGLRRVGANLKDSEITTLMEAADIDNSGSIDYGEFIAATMHLNKVEREDNLFAAFSYFDKDSSGYITQDELQKACEEFGIGDAHLEDIIKDIDQDNDGRIDYNEFVTMMQKGNNPLGKKGQGQLSFGLREALKLG

SEQ ID NO: 32865 - protein, 386 aa, Yarrowia lipolytica CLIB122
MADFIRTQIFGTCFEITSRYVDLNPVGMGAFGLVCSAKDQLTDQNVAIKKIMKPFGTPVLSKRTYRELKLLKHLRHENLICLSDIFISPLEDIYFVTELLGTDLHRLLMTRPLEKQFIQYFLYQILRGLKYVHSAGVVHRDLKPSNILVNENCDLKICDFGLARIQDTQMTGYVSTRYYRAPEIMLTWQKYDVEVDIWSTGCIFAEMLEGKPLFPGKDHVHQFSIITELLGSPPEDVIHTICSENTLRFVRTLPRRERIPLASKFRNADPEAIDLMEKMLVFDPKKRITAAEALAHPYLAPYHDPSDEPVAEERFDWSFNDADLPVDTWKVMMYSEILDFHNVDIDVNGQPPQGQFEQVHAQAQAAVAQNEAARAREQEQQQQEQQ

SEQ ID NO: 32866 - protein, 131 aa, Oryza sativa
FPHRCPFSAVVKFSPEGFKFPPQNSAIIPHNGIGINPHPKATQMFFKHGVKLGLIPPDKVWPVGSPFLIFYLFFLDLTGIKLIFGCFFFFLFFKFIIIFLHFFFFFLKKKKKKKKKKKKKKKKKKKKKKKK

SEQ ID NO: 32867 - protein, 1109 aa, Arabidopsis thaliana
MNSQQSTRTKQMLQQSSTHLLCGVVLLQLFAAQVDAQRSTSPWQTLSGDAPLVIARGGFSGLFPDSSLAAYQFAMVVSVADVVLWCDVQLTKDGHGICFPDLNLANASNSEEVYPNRQKSYPVNGVTTKGWFPIDFSLTELQKVLFSLIRGILSRSGKFDENGYSISTVQNVATQMKPALFWLNVQHDEFYEQHNLSMSSFLLSTSRTVSIDFISSPEVNFFRKIAGGFGNNGPSFVFQFMGKEDFEPTTNRTYGSILSNLSFVKTFASGILVPKSYILPLDDKQYLLPHTSLVQDAHKAGLKLYASGFANDVDIAYNYSWDPVSEYLSFVDNGNFSVDGMLSDFPLTASASVDCFSHIGRNATKQVDFLVISKNGASGEYPGCTKLAYEKAIKDGSDVIDCPVQMSSDGIPFCSSSIDLVNSTTVGQTHLRNRSIIVPEISSVAGIFTFSLTWHEIQSLTPAISNPFRENGMSRNPNERNSGNLISLYEFLNLAKNSTSLSGILISLENVVYLREKKGLDVVKVVLNRLTETGYIVGTLKVMIQSTTRLVLVDFKNQSTYKTVYKIKETIGNITDSAIEDIKKFANAVVINKASVFPNSDSFLTGQTTNVLERLQKFQLPVYVELFQNEFVSQPFDFFADETVEINAYIFGAGINGTITEFPYTAARYKRNRCLGREEVPPYMLPVNPGGVLTLISTSSLPPAQDPNPIFTHDDVTEPPLPPVIAKSPTSTLGTPSTIAKPLISWSVAGVVLFLVLLTLVFCFHRKRETRLRQQKLKALIPLEHYTYAQVKRITKSFAEVVGRGGFGIVYKGTLSDGRVVAVKVLKDTKGNGEDFINEVATMSRTSHLNIVSLLGFCSEGSKRAIIYEFLENGSLDKFILGKTSVNMDWTALYRIALGVAHGLEYLHHSCKTRIVHFDIKPQNVLLDDSFCPKVSDFGLAKLCEKKESILSMLDTRGTIGYIAPEMISRVYGNVSHKSDVYSYGMLVLEIIGARNKEKANQACASNTSSMYFPEWVYRDLESCKSGRHIEDGINSEEDELAKKMTLVGLWCIQPSPVDRPAMNRVVEMMEGSLEALEVPPRPVLQQIPISNLHESSILSEDVSVYTEG

SEQ ID NO: 32868 - protein, 334 aa, Haemophilus influenzae R2846
MAFNMKNRHLLSLVHHTEREIKYLLDLSRDLKRAKYAGTEQQKLKGKNIALIFEKSSTRTRCAFEVAAYDQGAQVTYIDPNSSQIGHKESMKDTARVLGRMYDGIEYRGFKQSIVQELADYAGVPVFNGLTDEFHPTQMLADVLTMIEHCDKPLSEISYVYIGDARNNMGNSLLLIGAKLGMDVRICGPKALLPEANLVEMCEKFAKESGARITVTEDIDKAVKGVDFIHTDVWVSMGEPLETWGERIKLLLPYQVTPELMKRTGNPKVKFMHCLPAFHNSETKVGRQIAEKYPELANGIEVTEEVFESPMNIAFEQAENRMHTIKAVMVASLA

SEQ ID NO: 32869 - protein, 121 aa, Brassica napus
MASSMLSSAAVVTSPAQATMVAPFTGLKSSAAFPVTRKANNDITSIASNGGRVSCMKVNISRIIAGLSFITRNWISNMNPLIPYGIHKPKTIYRDLFPHLKGFFEGGPKKLTPTLPLGKES

SEQ ID NO: 32870 - protein, 1370 aa, Aspergillus nidulans FGSC A4
MSGVQPVAVYALRVPADGALVPAVPDAAAMVLEQFRVSMAAIDPDEAPEFDDDSSRRPRATLRIIRAPPGLDEEDSDDDYEDEDDSEDDSEDDEEVNGGPSDKEKARKLKEAAYLKELEDAMSEDDESDEGEEFDLKAAISKLVKGKAPATDDDDEDAESDEGLDLDEMVVCTLDPERNYQQPLDITVAEGERVFFKVTGTHTIYLTGNYVMPIDEPRDDYDEDDDEDEEDYDLSPDEDELDMDELMMGEDDESDDLDGLENPRITEIDTDEEEAPKLVDAKGKKKRGADEAALEAKDDKAKSAANGESKKQQKKLKKNNGEASAVEAKPEQKETKKVQFAKNLEQGPTPSKERKPDEKKPADKAEKTTGTLGVKEVKGVIIDDKKLGKGPAAASGNTVAMRYIGKLENGKVFDSNKKGKPFTFKLGKGEVIKGWDIGVAGMAVGGERRITIPSHLAYGKKGVPGIPAFACASTFRVIKYLANICTMSEDQGQQGQRLSTARGSTCLKQTMTEPALSAGLGTDGPVGAAKDNIRVRIQSRRRSRLLSRLGRKIPTQAVEPVKSHETHSHSSDAEGTSHQDVSDRRNHPCHTPRPSSHSQADSFESVARGQQKEQSRTMREDAVSPVLLDVKRSQSTPVELAKLVSLKLSTSFGSRTVIRRSQPGVRQSVRAAQLQRMMLDRGNPKRERSSGSSTPSSKSSPVDSVSTAPTSVSPGSLAPSGSTNNDPASGFKHIDSQADLPERPLSPVRESPMVSPTIQTTEATAIVKVFLETHFHTLLSGLDARTQRRLELDQYIETFPLSPEEVVRVRKHWVTQERDYLRQYRVLKSRPQDKTSRAGTASLAGFEPLKILGRGSFGVVRLVREKRTDEQTQSGRVPLAPKTNHRQAMTGVKKDVFAMKVIRKSVMIRNCQEAHLRAERDFLVASAKSRWVVPLIASFQDQKHLYLVMDYMVGGDFLGLLIRHNILRESIARWYVAEMILCIEEAHRLRCIHRDVKPDNFLISESGHLKISDFGLAFDGHWAHDQWYFTYQRHSLLKRLGIQIDGDAEDQKLSHDANIQSLGTTREDGSMEDDWIHPPTNGLLHWRDKNQTRTMARSVVGTSQYMAPEVIRGHPYDGRCDWWSLGVILYECLYGFTPFASEDRHQTKLKIHRHLQTLYFPVHRPTDKLVSADAIDVINSLLQEKEFRLSSPKYKQNDAISSKPAKCSFYKPDSSNPSYQGHYVYPDDATDIKSHRFFRGINWEQIHRTSPPFIPMVRGWEDTRYFDDGEHPSDREDDSSDSELDGVQDKWHPLGGKGGLHKPDKPLKADVKPSSYPKGNDGAKDTAIASLKHKKRLKEAKRARDKILRDKRLRRTVLEMLRCLVVVAAT

SEQ ID NO: 32871 - protein, 116 aa, Arabidopsis thaliana
  misc_feature (14)..(14): Xaa can be any naturally occurring amino acid
  misc_feature (61)..(61): Xaa can be any naturally occurring amino acid
  misc_feature (95)..(95): Xaa can be any naturally occurring amino acid
  misc_feature (101)..(101): Xaa can be any naturally occurring amino acid
MVSSMFSSGAVVTXPAQATMVAPFTGLKSSGVLRVTRKNNKDITFIASKGGRVSCMKVWPXIGKKKFETLSYLHDLSEVELAKEVDYLLRKKWLXCVEFEXEQGLVYREHGTTRDT

SEQ ID NO: 32872 - protein, 336 aa, Corynebacterium glutamicum
MTIRVGINGFGRIGRNFFRAVLERNGDLEVVAVNDLTDNKTLSTLLKFDSIMGRLGQEVEYDDDSITVGGKRIAVYAERDPKNLDWAAHNVDIVIESTGFFTDANAAKAHIEAGAKKVIISAPASNEDATFVYGVNHESYDPENHNVISGASCTTNCLAPMAKVLNDKFGIENGLMTTVHAYTGDQRLHDAPHRDLRRARAAAVNIVPTSTGAAKAVALVLPELKGKLDGYALRVPVITGSATDLTFNTKSEVTVESINAAIKEAAVGEFGETLAYSEEPLVSTDIVHDSHGSIFDAGLTKVSGNTVKVVSWYDNEWGYTCQLLRLTELVASQALN

SEQ ID NO: 32873 - protein, 403 aa, Corynebacterium glutamicum
MAVKTLKDLLDEGVDGRHVIVRSDFNVPLNDDREITDKGRIIASLPTLKALSEGGAKVIVMAHLGRQGEVNEKYSLAPVAEALSDELGQYVALAADVVGEDAHERANGLTEGDILLLENVRFDPRETSKDEAERNRFAQELAALAADNGAFVSDGFGVVHRAQTSVYDIAKLLPHYAGGLVETEISVLEKIAESPEAPYVVVLGGSKVSDKIGVIEALAAKADKIIVGGGMCYTFLAAQGHNVQQSLLQEEMKATCTDLLASVDKIVLPVDLVAASEFNKDAEKQIVDLDSIPEGWMSLDIGPESVKNFGEVLSTAKTIFWNGPMGVFEFAAFSEGTRASPRPSSMQHAGNDAFSVVGGGDSAASVRVLGLNEDGFSHISTGGGASLEYLEGKELPGVAILAQ

SEQ ID NO: 32874 - protein, 304 aa, Triticum aestivum
FAIMFGETKPSGKELLIGGLVVPKLSSKTIKQAVGIVGCIIMPHNVFLHSALVQSRKIDTKKKSRVQEAVYYYNIESILALIVSFFINICVTTVFAKGFYGSDKADNIGLENAGQYLQEKYGTALFPVLYIWAIGLLASGQSSTITGTYAGQFVMGGFLNLRLKKWLRAVITRSFAIIPTMIVALFFDTEDPTMDVLNESLNVLQSIQIPFALIPLITLVSSEQLMGSFVVGPITKVISWIVTIFLMLINGYLILSFYTNEVRGAVVRSSLCVVLAVYLAFIIYLILRNTTLYSRLRSSVSKSS

SEQ ID NO: 32875 - protein, 402 aa, Mycoplasma pneumoniae M129
MANEFKFTDVGEGLHEGKVTEILKKVGDTIKVDEALFVVETDKVTTELPSPYAGVITAITTNVGDVVHIGQVMAVIDDGAGAAAPAAPQPVSAPAPAPTPTFTPTPAPVTTEPVVEEAGASVVGEIKVSNSVFPIFGVQPSAPQPTPAPVVQPTSAPTPTPAPASAAAPSGEETIAITTMRKAIAEAMVKSHENIPATILTFYVNATKLKQYRESVNGLALSKYNMKISFFAFFVKAIVNALKKFPVFNGRYDKERNLIVLNKDVNVGIAVDTPDGLIVPNIKQAQTKSVVDIAKDIVDLANRARSKQIKLPDLSKGTISVTNFGSLGAAFGTPIIKHPEMCIVATGNMEERVVRAEGGVAVHTILPLTIAADHRWVDGADVGRFGKEIAKQIEELIDLEVA

SEQ ID NO: 32876 - protein, 177 aa, Mycoplasma pneumoniae M129
MKQKLQALDRAIKRFNDFPTPGILFYDITPIFLNSELFEFVLEQMAQFIQEVKADGIVCPEARGFIFGGALASKTKLPLVLVRKPHKLSGELARETYDLEYRQNSILEMRVDALENCKRCVIVDDLLATAGTVAAIDKLIARLGSQTVGYCFLIELQKLHGKAKLQPNVATKILLHY

SEQ ID NO: 32877 - protein, 351 aa, Burkholderia sp. 383
MRGMVFQGQCKVDVLDFDDPVPGYGEAVIEMKASGMCGTDLHYYRHGMAESLGMLGLRDRMESAHVIGGHEPCGVVAALGPGVDPKSFRVGDRVMVFHYAGCSCCDPCRTGWTQLCDHGARIYGVLSHGGHANYMKVPVSSLVHLPQEVSFKGGAAIACGTGTAYGALLRLDISARDTLAVYGLGPVGLSTAQLAAAMGVEVIGVDINPHRVERAKAFGVAHGIDASQCDPVDTIHRLTGGQGVSCAVECAGGELPRAQAIRSTKVWGRVVLVAVGGNVTVDAMKDLIGKQRTLIGSFTFSEPGMKECAHFIADHGVEVDRLFTDEWRLEQAGDAYAHFNRQTSGKGVIVF

SEQ ID NO: 32878 - protein, 198 aa, Arabidopsis thaliana
MTLESYAGDVHTVPQSENSMEERGGGELFVPPLNFAMVDNGIFRSGFPEPVSFSFLQSLRLKSIIYLCPEAYPEVNREFAKSNGIQVFQFGIERCKEPFVNIPDEVIREALQVLLDTENHPVLIHCKSGKHRTGCLVGCVRKIQRWCLSSIFDEYQRFAAAKARISDQRFMELFDISNLKHTPLSFSCSKRYTNTIDY

SEQ ID NO: 32879 - protein, 132 aa, Dechloromonas aromatica RCB
MPKIEKTDAEWRAQLDENEYRVTRQKGTERAFTGKYWDTHDDGTYRCICCGAPLFRSETKFDSGCGWPSFHTPNDEKLIDEHVDQSFGMIRTEVTCHDCGAHLGHVFDDGPAPTGLRYCINSASLKLEKDGK

SEQ ID NO: 32880 - protein, 180 aa, Triticum aestivum
  misc_feature (26)..(26): Xaa can be any naturally occurring amino acid
  misc_feature (45)..(45): Xaa can be any naturally occurring amino acid
YNPLAHRDGLRPATSLAPFQGLKSTXAGLPVSRRSNGASLGSVSXNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 32881 - protein, 170 aa, Sorghum bicolor
MAAADVEYRCFVGGLAWATNNETLEHAFANFGQVLDSKVITDRETGRSRGFGFVTFSSEQSMLDAIENMNGKELDGRNITVNQAQSRGGGGGGGGYGGGGGGYGGRREGGGYGGGGGGYGGRREGGGGYGGGGYGGGGGGYGGRREGGGGYGGGGGYGGNRGDSGGNWRN

SEQ ID NO: 32882 - protein, 459 aa, Aeropyrum pernix K1
MSSGRVEEVVKRLAEIRAMDARGEGGRLFTYLYETGDPGVKEVSLRAFEMFLDTNALDPTVFKSALFFERELVSFASSLAGGVEGVVGTVTYGGTESIILAAMAAREWYRSLGGSRTPGIVAPQTVHPSVRKAARYLGMRLSIAPVDPGSKRVDIDSLVSLVDDRTAMVVVSAPNYPYGTVDDVRSVAEALSSQRVWLHVDACVGGFILPFMRELGLYSGAFAFDVEGVYSVSMDLHKYGYSPKGASVLLFRDGSLKKHSIFADLRWPGYPFINTTVLSSRSVAPLAAAWAVTNYLGRRGYLELARKAVEARDEIMRGLESIGFRSLAPIESTILSVALDDPADTLRFHANMSRRGWILGLQPGVEGLAPPNIHLTISPIHKLVSPQFLGDARASSSEPLPKELEEAWRLLESRGPLELAGMIGRTQYDQVIIAWILSSIPPDLAEDLARELTVEVYRG

SEQ ID NO: 32883 - protein, 511 aa, Fragaria grandiflora
MEFQAMTFAIPFALAAVSWLFLYYIRVSYFTNNNKSAYAKLPPVPVVPGLPVIGNLLQLKEKKPYKTFTSWAEEYGPIYSIRTGACTMVVLNSSQVAKWAMVTTYSSISNRKLSSALKILSADQCMVALSDYNDFHKMIKRYIRANLLGSRAQKRLRTNRDTLRANVLSQSKSHVKNSPLEAVNFTRVFESELFGLAVKQVYGNDIEDPIYVGGTWCYTFKKLDFSGLVVRDILDGGNRWLIDWRDFFPYLRCILNKTLETKIQRLHSRRKPVMTALINEQKKRIASGEEINCYMDFLLSEGRTLTMDQITMLVWETVIETSDTIMVTTEWAMYEIAKNPKQQDRLYQEIQKVCGSEMVSEEHLSQLPYLTAVFHETLRKHSPAALVPLRYAHEDTQLGGYYIPAGTEIAINIYGCNMNKHQWESPDEWKPERFLDPKYDPMDLYKTMAFGAGKRVCVGSLQGMLIACPTIGRLVQEFEWKLRAGEEENVDTVGLTTHKRDPMHAILKPRS

SEQ ID NO: 32884 - protein, 369 aa, Oryza sativa
MDHEADAYRTDLMTITRYVLNEQSRNPEARGDLTILLSHIVLGCKFVASAVNKAGLAKLIGLAGETNVQASVPGNNCHLSQFLVSEIEIGEEQKKLDVLSNEVFVKALVSSGRTCVLVSEEDEEATFVDPALRGKYCVCFDPLDGSSNIDCGVSIGTIFGIYMIKDKENVTLEDVLQPGKNMVAAGYCMYGSSCTLVLSTGNGVNGFTLDPSLGEFILTHPDIKIPKKGKIYSVNEGNAKNWDEPTAKFVEKCKFPKDGSSPKSLRYIGSMVADVHRTLLYGGVFLYPADKKSPNGKLRVLYEVFPMSFLMEQAGGQSFTGKERALDLVPTKIHERSPIFLGSFEDVEEIKGLYAAQANVIVLRPGTAS

SEQ ID NO: 32885 - protein, 338 aa, Zea mays
  misc_feature (88)..(88): Xaa can be any naturally occurring amino acid
MAKIKIGINGFGRIGRLVARVALQSDDVELVAVNDPFISTDYMTYMFKYDTVHGQWKHSDITVKDSKTLLFGEKPVTVFGIRNPEEIXPWGEAGAEYVVESTGVFTDKEKAAAHLKGGAKKVVISAPSKDAPMFVVGVNEEEYKSDINIVSNASCTTNCLAPLAKVINDKFGIVEGLMTTVHAITATQKTVDGPSSKDWRGGRAASFNIIPSSTGAAKAVGKVLPVLNGKLTGMSFRVPTVDVSVVDLTVRLEKSATYDEIKAAVKAEAEGSLKGILGYVEEDLVSTDFQGDSRSSIFDAKAGIALNGNFVKLVSWYDNEWGYSTRVVDLIRHMNSTN

SEQ ID NO: 32886 - protein, 374 aa, Myxococcus xanthus DK 1622
MTKRAVLALADGTTFEGRAFGAVGETVGEVVFNTTMYGYQEVLTDPSYVGQIVTMSYPEIGNVGANPEDEEGSRVHAVGMVVRALSEQPSNWRAKESLDAYLKRNGVAGIEGIDTRRLVRHLRTHGAQMGVISSEGLSPLALVERARSARGMEGLDLATGVSTKEAYTFTQPSPDVFTGLGEVRVPAEPRFDVVAYDYGLKKSMLHFLVDVGCRVTVVPANTSAEEVLARKPNGVFLANGPGDPAAVKGADRTVAALLGKVPVFGICLGHQIMALALGGRTYKMKFGHRGGNQPVKDLTTGKVEITAQNHGFAVDDASLKGLAVVTHINLNDGTVEGLAVPDARAFSVQYHPEASPGPHDARYLFDRFAKLMAG

SEQ ID NO: 32887 - protein, 591 aa, Neisseria gonorrhoeae FA 1090
MSIVLHGVAAGKGIAVGCAHLIARGTEEVPQYDVAQADTDAEAERFDAAVKATRKELEQLRSAIPENAPTELGAFISLHLMLLTDVTLSREPVDILREQKINAEWALKQQSDKLAAQFDNMDDAYLRERKQDMLQVVRRIHNNLIGQGNELEVADNLFDETVLIANDLSPADTVLFKEQRIAAFVTDAGGPTGHTAILGRSLDIPSVVGLHNARKLITEGETVIVDGINGVLIISPDESVLNEYRRRAREYRSHKRDLNKLKKTAAATADGVCIELVGNIESAEDVKPLHNLGADGIGLFRSEFLYLNRDTMPSEDEQYEVYSAIVKKMKGKSVTIRTVDLGVDKNPRWFGKNSTPNGSLNPALGMTGIRLCLAEPVMFRTQMRAILRAAVHGPVRMMWPMITSVSEVRQCLIHLDTAQRQLAERGDAFGEVGIGCMIEIPSAALTVGSILKLVDFISVGTNDLIQYILSVDRGDDSVSHLYQPGHPSVLKMLQHVIRTANRMDKDVSVCGEMAGDTAFTRVLLGMGLRRFSMNPNNILPVKNIILHSNAGQLEGDIAKVIRCEDEEKSEKLIKQINSVSVAEEAEVKGRK

SEQ ID NO: 32888 - protein, 513 aa, Arabidopsis thaliana
MSILSFPHTFFNISPSLFYTILISSLVLLILTRRSAKSKIVKLPPGPPGWPVVGNLFQFARSGKQFYEYVDDVRKKYGPIYTLRMGSRTMIIISDSALVHDVLIQRGPMFATRPTENPTRTIFSSNTFTVNASAYGPVWRSLRKNMVQNMLSSIRFREFGSLRQSAMDKLVERIKSEAKDNDGLVWVLRNARFAAFCILLEMCFGIEMDEESILNMDQVMKKVLITLNPRLDDYLPILAPFYSKERARALEVRCEQVDFIVKLIERRRRAIQKPGTDKTASSFSYLDTLFDLKTEGRITTPSNEELVSLCSEFLNGGTDTTGTAIEWGIAQLIVNPEIQSRLYDEIKSTVGDREVEEKDVDKMVFLQAVVKEILRKHPPTYFTLTHSVTEPTTVAGYDVPVGINVEFYLPGINEDPKLWSDPKKFNPDRFISGKEEADITGVTGVKMMPFGIGRRICPGLAMATVHVHLMLAKMVQEFEWSAYPPESEIDFAGKLEFTVVMKKPLRAMVKPRV

SEQ ID NO: 32889 - protein, 481 aa, Photobacterium sp. SKA34
MTERLRRTKIVTTLGPATDRDNNLEKIIAAGANVVRMNFSHGSPEDHIQRTKQVREIAAKLGKNVAILGDLQGPKIRVSTFKEDKIQLTIGDKFTLDSDLPKGEGDQFAVGLDYKELPKDVATGDILLLDDGRVQLKVTSVEGNKVHTEVTVAGPLSNNKGINKKGGGLSAEALTDKDKADILTAAAMSVDYLAVSFPRNGEDMKYARRLATEAGLNAKLVAKVERAEAVATTEAMDDIILASDVVMVARGDLGVEIGDPELVGVQKKLIRRARSLNRTVITATQMMESMITSPMPTRAEVMDVANAVLDGTDAVMLSAETAAGQFPEETVKAMASVCLGAEKEPSINVSNHRLDRFFSSPEETIAMSTMYAANHMEGVKAMVAMTESGRTPLMMSRISSGLPIFALSRNENTLNQASLYRGVTPVFFNRDSDAGLEAAKHALDVLRDAGFVNVGDLVIITQGDVMDTVGSTNNMRILTVE

SEQ ID NO: 32890 - protein, 492 aa, Debaryomyces hansenii CBS767
MSKPTLNNPDLIRTKPYINGEWFESKSTKTFKVIDPATETEIVELPDQTPEEIAFAIEKAEEAFKTFKKTNAYDRARWLRKLNDLMLENIEDLAKILTWENGKCLTDATGEIKYAASYFEWFAEEAKRIYGNTIQPSNNNNKVITYKQPIGVVGLLCPFNFPTAMGARKLAPSFAAGCTTILKPDGQTPLSSLALAYLAEKAGFPKGTFNVVLASTENTPKVGLEFCESPRIKKISFTGSTPVGKLLMRQSSSTLKKLSMELGGNAPIIIFDDADLDLAVEQSIASKFRSLGQTCVCANRLYIQSGVYDKFCEKFTEKVKEFKIGNGLEKGITHGCLINDKAITKVEEHIKDAVGKGAKVLVEGGRLPNLGKNFYAPSVVKDVTQEMVVVKEETFGPLAALLKFDTKEQVLDWCNDTPYGLASYVFSENLNTIWFMSEYLESGMVAVNTGLFTDAAMPFGGVKESGFGREGSLYGIDDYTVVKAITLGNMYR

SEQ ID NO: 32891 - protein, 660 aa, Magnaporthe grisea 70-15
MANRTNVARQAGVLPVSAANVKDQAGTSQKSGRGKAPIEGQKIVIRRLPPGISEEEVLKYLEDEWQPNKGKVGWFSFMPGKTSNETEYVMPLMDQVRSAQWEDANGTCSDPCLCGPPAMEMSIYKKIPTSKNRADARQGTIDQDPEFMAFLESLANPTGDKDPETDHVGQEEEQPIVKASSTPLIDYLREKKANKSKDTSVARSGKHSRHDSQPSKNKGSEDSKRKSREAKTEKSTDRPRQNVKILTKKAATAAAVEAANNVASQISASSKDDASAKGGRRAGIAAAARILARDLGISPGNAHRKVRLARQEVEKAESDGKLANAEDAPATKDAKDDAPGNSATTANTNTARQAAPAASKPAAGSSRGPRGKRGASGTTENAQEATEKKGRSRRGAADKPSEASASAPKAPMAILKRKDDAASGNSNPATVPAPSTANTQAGPTVPKSAPTGPKAAQGKGGSGSGPKKATATSGNSNTTRAFVKHANPSQGVTDAVLKEAMQVFGNVTFVEIDRRKGFAYVDFANHEGLAKAIAASPVTVAQATVQVLERKDTNKKAPPAASTGNTGSSKGNTASGSAPAAPKAPGGPKIEAETPAASGSTAASAEKPAGEHKRGGRRRGGRGRGGDTNKDGSGGKGTGGGNKATSGGSGNLPVPASSGS

SEQ ID NO: 32892 - protein, 184 aa, Oryza sativa Japonica Group
MAPPLQVATTASSSTREGKAPALNERILSSMSKRSVAAHPWHDLEIGPEAPTIFNCVIEIPRGSKVKYELDKKTGLVKVDRVLYSSVVYPHNYGFIPRTLCDDSDPLDVLVIMQEPVIPGCFLRAKAIGVMPMIDQGEADDKIIAVCADDPEYKHYNDIKDLPPHRLAEIRRFFEDCILLIYCS

SEQ ID NO: 32893 - protein, 478 aa, Mesorhizobium loti MAFF303099
MRRSRKVKILATIGPASSSEEMLQKLFEAGADVFRINMSHTDHELMRTLVGRIRAVEEKVGRPIGILADLQGPKLRVGKFANGKEVLTPGQTFTLDDNPEPGTSSRVYLPHPEILSSVEPGHRLLIDDGKLELKAVKSDGKSIVCTVVAGTTISDKKGVSLPDTDLPVGALTEKDRKDLDAVLATGVDWIALSFVQRPEDLAEARKIARGRALIMAKIEKPQAVARLAEIIELSDALMVARGDLGVEMPLEAVPGIQKQITRAARRAGKPVVVATQMLESMITAPVPTRAEVSDVSIAVFEGADAIMLSAESAAGAYPVEAVAMMDRIATKVETDPTYAGIINAQRSEPEATGADAISLAAREIAETLKLSAIITYTASGTTGLRAARERPQVPIIALSPILNTARRLSLLWGTHCVVSPDATDLDDMVNRACRIALEEEFGKPGDRVIITAGVPLRTPGSTNMLRIAYVGSEKQGSR

SEQ ID NO: 32894 - protein, 495 aa, Coccidioides immitis RS
MASAAVMSRFPSCRLLVSRPASTLRESRNVYRLRDAARPQLPLYASLARYYASKSYPPHTIISMPALSPTMTAGNIGAWQKKVGDTLSPGDVLVEIETDKAQMDFEFQEEGVLAKILKEAGEKDVSVGNPIAVMVEEGTDIAQFGSFSLEDAGGDKKPSADKTPKETPESSKGPEAEAEGQSLAQDEAKPAAEEPDITGERLQPSIDREPLISPAAKALALERGVPIKTLKGTGPGGRITKEDVEKYQPTTAVGAAAGPTYEDIPASSMRKVIASRLTQSMKDNPHYFVSSTLSVTKLLKLRQALNSSADGKYKLSVNDFLIKACALALRKVPAVNSAWIEQNGQVVIRQHNTVDISVAVATPVGLITPIVKGVEGLGLESISRQVKDLGKRARDNRLKPEEFNGGTFTISNMGMNPAVERFTAVINPPQAAILAVGTTRKVAVPLETEEGTEVQWDDQIVVTGSFDHKVVDGAVGAEFMRELKKVVENPLELML

SEQ ID NO: 32895 - protein, 170 aa, Mesoplasma florum L1
MDLKKHILNVKDFPIDGIDFKDVTPLLNDADAFAYVIDEMAKFVIECGANVVVAPEARGFLFASAVAYKSHTRFVLVRKPGKLPREVIDIEYTLEYGTNHQQMHKGDIKPGDKVVIIDDVLATGGTIEAIVKLVEMQEGKVEGVSFLIDLPALHDENLLQEYKVQKLVKY

SEQ ID NO: 32896 - protein, 72 aa, Arabidopsis thaliana
  misc_feature (4)..(4): Xaa can be any naturally occurring amino acid
  misc_feature (30)..(30): Xaa can be any naturally occurring amino acid
  misc_feature (42)..(42): Xaa can be any naturally occurring amino acid
  misc_feature (45)..(45): Xaa can be any naturally occurring amino acid
  misc_feature (48)..(49): Xaa can be any naturally occurring amino acid
  misc_feature (54)..(54): Xaa can be any naturally occurring amino acid
  misc_feature (56)..(56): Xaa can be any naturally occurring amino acid
MASXMLSSATMVASPAQATMVAPFNGLKSXAVFPATRKANNXITXITXXGGRVXCXQGPEKKGLYFLPVYGE

SEQ ID NO: 32897 - protein, 348 aa, Leptospira interrogans serovar Lai str. 56601
MGIMGMKAAVLESGKKILEIRDVSVPQLRAEQVKVRIKACGICGSDVHLVVHGTLKCKHFPRVPGHESSGIIEEVGENVRRFRKGDRVVIAAGTSCGVCSYCKEGKENLCKDLGVFGFDRDGSFAEFNIVEERYLYSLPDEIPFDQGAILADAVSTPYHAIRYRGNIQESDTVAIFGCGGLGIHAVAIARAMTKGKVIALDVDSGALENATKYGADEVVNLKEVRNSGKVLKEVSKGVDLLADFSGYMSNVEDSIRAMNPGGRIVLVGIGRQPLKFQIPFILIEKMISVSGSYGSDRRAIPELIELYLKGKINLSHSITSHHPLEELNECLEALDQRKGNPIRFIVEP

SEQ ID NO: 32898 - protein, 593 aa, Ralstonia eutropha JMP134
MSVIEVKVPDIGDFDAVELIEVLIKPGDTVEQEQSLIVLESDKASMEVPSPVAGKVVDVRVNVGDKVGQGTVICTVEAEAAAAAPAPAPAPAPAAAPAPAAAPAPAPAAASHAGGADIQCEMLVLGAGPGGYSAAFRAADLGMNTVLVERYATLGGVCLNVGCIPSKALLHNAAVIDEAKALAAHGILFGEAKIDLDGLRHYKNQVVGKLTGGLAGMAKARKVQVVRGIGTFLDPHHLEVDATEGEGKQTTGKKTVIRFEKAIIAAGSQAVKLPFIPEDPRIVDSTGALELPEVPNKMLVVGGGIIGLEMATVYSTLGADIDVVEMLPGLMSGADRDLVKVWEKKNKDRFGKVMLNTKTVAVEAKPDGIYVKFEGEQAPAEPQRYDLVLVSVGRSPNGKRIGAEKAGVAVTDRGFINVDSQMRTNVPNIFAIGDVVGQPMLAHKAVHEAHVAAEAAHGEKAYFDAKQIPSVAFTDPEVAWAGLTEDQCKEQGIKYSKGVFPWAASGRAIANGRDEGFTKLIFDEETHRIIGGGIVGTHAGDLISEVCLAIEMGADAVDIGKTIHPHPTLGESIGMAAEIYEGTCTDVPPPRKR

SEQ ID NO: 32899 - protein, 329 aa, Alteromonadales bacterium TW-7
MKAMIINEFGASDVFKAADIAKPVVKEGHVVVKVMATSVNTVDMMIRQMGDALAPLAPALPGVLGMDFAGIIDEVGDGVTGFAVGDEVYGCAGGLAELQGALAEYMLADIKLIAHKPKTLSMREAAAIPLVGITAYEGLTRAAVKSGQKVLVHGGAGGVGHIALQLAKYLGADVFATGGGDKQSALIEKLGGTAINYKTQAVADYVQTHTQGAGFDVVYDSIGGANLLKSFDAAALNGQIATTVSLAEIDLTPAHFKGLSLHVVFMLIPMLHNHKRQQHGEILAKLATIIDEGHLVPVLDNIEFNLEDTGKAHDRLASGEGMGKVVITI

SEQ ID NO: 32900 - protein, 557 aa, Aspergillus nidulans FGSC A4
MIEELVSKTTPGQAVVYLLGAFFLACLARKIQVQWQLSRLGSRAPKIPFRLPYGLLIPSISRNSHADRRLSSAMDFIYKSMQANKSDQDLEYFTDVMRNAKGAPLAEDKKTVELDAGISSRIIFTRDPENIKAILTGQFSDYGKGESFHRDWREFLGDSIFVTDGEQWSASRHLIRPMFVRDRLVDTEIFEKHVQHLIPLLAGNNESKIVDVTSLFFRYTLDAATNYLLGQGTDSLQNPETEFAEAFRYVQRRQAQYFRLGVFKFVLSRTEFRRQLKVMDDFIKPYIDRVLAMSPAELDQKLSKSDTFLHALARFTRDRRTLRDQLVAILLAGRDTTAATLSFCLFELARNPEVTAKLREEIASRLGLGASAQKPSYTDLKEMKYLNAVLNESMRLYPVVPFNVRFSLKDTTLPRGGGPDGLAPVAVRAGTRVVYSTMIMQRSPENYDPPSAPNYFDPAQWNPERWLSGWQPKPWQFIPFNGGPRICIGQQFAMIEMGYTVVRILQAFERIQAVPEAGKSVVEDPRLRFEVTLTPASELNCVFVRDGEGREDEKISR

SEQ ID NO: 32901 - protein, 386 aa, Haemophilus influenzae Rd KW20
MSVIKMTDLDLAGKRVFIRADLNVPVKDGKVTSDARIRATIPTLKLALEKGAKVMVTSHLGRPTEGEFKPEDSLQPVVDYLKNAGFNVRLEQDYLNGVDVKDGEIVVLENVRVNKGEKKNDPELGKKYAALCDVFVMDAFGTAHRAQASTYGVAEFAPIACAGPLLAAELDALGKALKEPARPMVAIVGGSKVSTKLEVLNSLSKIADQIIVGGGIANTFIAAAGHNVGKSLYEADLIPVAKELAANTDIPVPVDVRVGLEFSETAAATEKVVNEVKDDESIFDIGDKSAEQLAEIIKNAKTVLWNGPVGVFEFPHFRKGTEIISHAIANSDAFSIAGGGDTLAAIDLFGIADKISYISTGGGAFLEFVEGKVLPAVEILEKRAKN

SEQ ID NO: 32902 - protein, 286 aa, Zea mays
MQRAVQAVRSHGNVLKYAVLQHISAPKPAMLPAAFSRFMSVSSARLEDRGFETATVADVLKSKGKSADGSWLWCTTEDSVYDAVKSVCPHFPMIVLTPSESMVMHQMIRLPFGTLNFLQMTQHNVGALVVVKPGQNKSIAGIVTERGDEQISVLLASNFWPVAVHHSTFGIKESQLFRALYSRYNRNCIKLKYTYYLRKIIVQGRSSKSTKVGDIMTEENKLITVNPDTKVLQAMQLMTENRVRHIPVIDGTGMLGMVSIGDVVRAVVAEHREELNRLNDYIQGGY

SEQ ID NO: 32903 - protein, 302 aa, Brassica napus
NGVLNIVHGTNDTVNAICDDDDIRAVSFVGSNTAGMHIYARAAAKGKRIQSNMGAKNHGVVLPDAHVDATLNALLAAGFGAAGQRCMALSTVVFVGNSKSWEDKLVERAKALKVSCGTEPDADLGPVISKQAKERICRLIQSGVDDGAKLLLDGRNIVVPGYEKGNFIGPTILSGVTPDMECYKEEIFGPVLVCMEASSFDEAIDMLNRNKYGNGAAIFTSSGAAARKFQMEIEAGQIGINVPIPVPLPFFSFTGNKASFAGDLNFYGKAGVDFFTQIKTVTQQWKDIPTSVSLAMPTSQKQ

SEQ ID NO: 32904 - protein, 197 aa, Triticum aestivum
  misc_feature (42)..(42): Xaa can be any naturally occurring amino acid
RSRIQARVPPPSKLYPYIVQPWPPPVRASSATSLAPFPGAQXSPAGLLVSRRSNGASLGSVSNGGRIRCMQVWPIEGIKKFETLSYLPPISTEALLKQVDYLIRSKWVPCLEFSKVGFIFREHNASPGYYDGRYWTMWKLPMFGCTDATQLINEVEEVKKEYPDAYVRIIGFDNMRQVQCVSFIAFKPPGCEESGKA

SEQ ID NO: 32905 - protein, 303 aa, Pantoea stewartii
MMVCAKKHVHLTGISAEQLLADIDSRLDQLLPVQGERDCVGAAMREGTLAPGKRIRPMLLLLTARDLGCAISHGGLLDLACAVEMVHAASLILDDMPCMDDAQMRRGRPTIHTQYGEHVAILAAVALLSKAFGVIAEAEGLTPIAKTRAVSELSTAIGMQGLVQGQFKDLSEGDKPRSADAILLTNQFKTSTLFCASTQMASIAANASCEARENLHRFSLDLGQAFQLLDDLTDGMTDTGKDINQDAGKSTLVNLLGSGAVEERLRQHLRLASEHLSAACQNGHSTTQLFIQAWFDKKLAAVS

SEQ ID NO: 32906 - protein, 181 aa, Populus trichocarpa
MAQRTEKEETECKVPENLTLCINNCGVTGNPATNNMCQKCFNASTSTSNPSSSTTTTTTTITFAATTNGVSTNEILKFTSEKSLRSSISRSPAKDHQRQPKTASDKERSDSSSVAKKEVNRCSGCRRRVGLTGFRCRCGELFCWEHRYSDRHDCSYDYKTVGREAIARENPVVKAAKIVRV

SEQ ID NO: 32907 - protein, 711 aa, Bacteroides fragilis YCH46
MHWFDLSLQLPITDPTWVFFLVLIIILFAPMILGRLHIPHIIGMILAGVVIGEYGFNVLERDSSFELFGKVGLYYIMFLAGLEMDMEDFKKNRTKGLVFGWFTFIIPMALGVWSSMELLGYGFTTAVLLASMYASHTLIAYPIISRYGLSRLRSVNITIGGTAVTVTLALIILAVIGGMYKGTVDGMFWVLLVVKVAFLSFLIVFFFPRIGRWFFRKYDDSVMQFVFVLAMVFLGSGLMEFVGMEGILGAFLAGLVLNRLIPHVSPLMNRLEFVGNALFIPYFLIGVGMIIDVRTLFTGGEALKVAVVMTVFATLSKWLAAWITQKIYHMQPNERSMMFGLSNAQAAATLAAVLIGHEIIMENGERLLNDDVLNGTVVMILFTCVISSLVTERSARRFALHEEMQFEDNKEKTEQEQILIPVANPDTIEDLINLALVIRDTKQKRELIALNVINDNNNSENKELQGKRNLEKAAMIAASADVSVNMVSRYDLNIASGIIHTIKEYDATDVVIGLHRKANIVDSFFGNLAESLLKGTHREVIIAKFLMPVNTLRRIIIAVPPKAEYETGFSKWVEHFCRMGSLLGCRVHFFANEQTLMRLQQLVKKKHGSTPTEFSRLDEWDDLLLLTGQVNFDHLLVVISARRGSISYDPSFERLPNQLGKYFSNNSLIILYPDQFGEPQEIVSFSDPRGYNESQHYDKVGKWFYKWLKKN

SEQ ID NO: 32908 - protein, 439 aa, Chromobacterium violaceum ATCC 12472
MTFSDLGIAPTILRALQAAGYENPTAVQAEAVPAAIAGRDLLVSAQTGSGKTAAFLLPALTKLSERSTAKGQGPRVLVLTPTRELAQQVEKNALEYGKDLRWMRTACLVGGSSFGYQIRALSRPIDLIVATPGRLMDHMRSGRIDFSRLEMLVLDEADRMLDMGFIDDIEAIVKATPETRQTVLFSATLDGIVGRMAEKMTRDPQRIEIARTETSGGTIEEHLLYADDLNHKHRLLDYILKESGFDQCVIFSATKAYSEELADKLSDQGYSAACLHGDMPQSWRNRTLNDLRRGRIKVLVATDVAARGIDVPTITHVVNFDLPKQAEDYVHRIGRTGRAGRDGTAITLAESKEFHKVRRIEQYLKRQITEGVIDGLEPTRRPPKGPRRNNNGKGGYGDRRHGSGNGRGGYGNNRREGGYQGQRREGGYQGNRGPRSSAQ

SEQ ID NO: 32909 - protein, 242 aa, Bacteroides fragilis YCH46
MVKEELMENWQQRTELLLGAEKMERLRKSHVLVVGLGGVGAYAAEMICRAGVGRMTIVDADIVQPTNINRQLPATHATLGMEKAKVLEARFRDINPEIELTVLPVYLKDDNIPELLDAARYDFIVDAIDTISPKCYLIYHALQRRIKIISSMGAGAKSDITQVRFADLWDTYHCGLSKAVRKRLQKMGVKRKLSVVFSTEQADPKAVLLTDDERNKKSTCGTVSYMPAVFGCYLAEYVIKRL

SEQ ID NO: 32910 - protein, 101 aa, Zea mays
PSFHTVGAPIGWETQRGPKNFFKNWDPPGFGAPPPKGLGKCWPPKGKNGEELPPPLETALGEKKASLFFFKVFGPKDPPPKKLLEWGFRVFPPNSRPPNPQ

SEQ ID NO: 32911 - protein, 414 aa, Oryza sativa Japonica Group
MNPPCNGKLPPGSMGFPVVGETFQFFRASPSVDMPSYYKQRLEYGPLFKTSLVGQPLVVSLDPEVNRFIFQQEPHHVQWNRSQVHPELCVQALWAENLKESLLPELENSMRESFASWASKPRIEVQDGVSDMIFDLVAKKLIGLNVTQSRELRKNFQEFFQGMVSFPIYFPGTSFYRCMQGRKNVRNTLTDVMKERLSAPEKKYGDLVDLIVEELQSEKPVIDENFAIDALAALLFTSFATLSSTLTVALKFLNDNPKIVEELKEEHDVILKKREVMNSGFTWEEYKSLKFTTQVTNEITRISNVAPGVFRKTLTDVQVNYTIPSGWLVMISPMAVHLNPELFEDPLKFDPWRWTEEKRSSLLRNYMPFGGGIRLCLGADFSKLFIALFLHILVTEYRYIRMLVFTHCLLSSLK

SEQ ID NO: 32912 - protein, 1236 aa, Saccharomyces castellii
MSFSTDSTSTRDELPLVENNSLDHPYMGFDKTAQDQIRDLARTLTQLSVAHPSESAIDQGSDVQSIYSTGLPGINPVYTNPDTPGYDEKLDPASDNFSSTAWVKNMANIAKSDPDFYKPYSLGCVWKNLSASGDSADVSYQATILNMPWKIITYVYRKVTPTREIDTFQILKSMDGILNPGELLVVLGRPGSGCTTLLKSISSNTHGFDISKDSIISYNGLTPKDIRRHYRGEVVYNAESDIHLPHLTVYQTLLTVARLKTPSNRIKDVTREDYANHLTQVTMATYGLLHTRDTKVGDDLVKGVSGGERKRVSIAEVSICGSKVQCWDNATRGLDSATALEFIRALKTQATILNTTATVAIYQCSQDTYDLFDKVCVLDDGYQLYYGPSDRAKKYFQDMGYVCPPRQTTADFLTSVTSPTERILNQDMLKNGKKIPQTPREMGEYWLESPDYQQLMQQIDAELSSNQDEQRDVIREAHIAKQSKRARPSSPYVVSYMMQVKYLLIRNYWRIKQRASVTIFQVVGNSVIAFILGSMFYKVQKKADSSTFYFRGAAMFFAILFNAFSSLLEIFTLFEARPITEKHRTYSLYHPSADAFASVLSEVPAKLVTSVCFNIIYYFLVNFKRDAGIFFFYFLISIVSTFALSHLFRCNGSLSKTLPGAMVPASMLLLAISMYTGFAIPETKMLGWSKWIWYINPLAYLFESLMINEFHDRRFPCAQFIPAGPPYQNATGTERVCAAVGSVPGQDFVNGDIFLLESYGYQHKHKWRGFGVGMAFVVFFFFGYLILCEYNEGAKQRGEMLIFPQNIVRKMKKQGKLKGKHPNKDDIEAAASSMECNTTEKSILNSSSINYDDMESEVGLSKSEAIFHWRNLCYEIPIKKEIRHILNNIDGWVKPGTLTALMGASGAGKTTLLDCLAQRVTVGTITGDVFVNGCLRDESFPRSIGYCQQQDLHLKTSTVRESLRFSAYLRQPFDVPVEEKNKYVEEIIKTLEMETYADAVVGVPGEGLNVEQRKRLTIGVELAAKPKLLVFLDEPTSGLDSQTAWATCQLMKKLAQNGQAILCTIHQPSAILMQNFDRLLFLQKGGETVYFGDLGSGCQTMIDYFEKEGAEKCPPEANPAEWMLQIIGAAPGSHAIKDFHKAWRNSEEYKAVQKELDWMEQELPRRASETTPEEHKRFATSVWYQFKLVSVRLFQQYWRSPEYLWSKYLLTVFNETFIGFTFFKADRTMQGLQNQM

SEQ ID NO: 32913 - protein, 359 aa, Xanthomonas campestris
MGSSHHHHHHSSGLVPRGSHMSLKHFLNTQDWSRAELDALLTQAALFKRNKLGSELKGKSIALVFFNPSMRTRTSFELGAFQLGGHAVVLQPGKDAWPIEFNLGTVMDGDTEEHIAEVARVLGRYVDLIGVRAFPKFVDWSKDREDQVLKSFAKYSPVPVINMETITHPCQELAHALALQEHFGTPDLRGKKYVLTWTYHPKPLNTAVANSALTIATRMGMDVTLLCPTPDYILDERYMDWAAQNVAESGGSLQVSHDIDSAYAGADVVYAKSWGALPFFGNWEPEKPIRDQYQHFIVDERKMALTNNGVFSHCLPLRRNVKATDAVMDSPNCIAIDEAENRLHVQKAIMAALVGQSRP

SEQ ID NO: 32914 - protein, 104 aa, Triticum aestivum
  misc_feature (10)..(10): Xaa can be any naturally occurring amino acid
  misc_feature (71)..(71): Xaa can be any naturally occurring amino acid
  misc_feature (74)..(74): Xaa can be any naturally occurring amino acid
MADEQNGSAXWPVADAALRQEILDIVQQASHYRQLKKGANEATKTLNRGIAELIILAADTAPLAILLHLPXLCXEDKNVPYCYVPSKTASRDELGGCARGPLIW

SEQ ID NO: 32915 - protein, 353 aa, Saccharomyces cerevisiae
  misc_feature (182)..(182): Xaa can be any naturally occurring amino acid
MPKRIVYNISSDFQLKSLLGEGAYGVVCSATHKPTGEIVAIKKIEPFDKPLFALRTLREIKILKHFKHENIITIFNIQRPDSFENFNEVYIIQELMQTDLHRVISTQMLSDDHIQYFIYQTLRAVKVLHGSNVIHRDLKPSNLLINSNCDLKVCDFGLARIIDESAADNSEPTGQQSGMTEXVATRWYRAPEVMLTSAKYSRAMDVWSCGCILAELFLRRPIFPGRDYRHQLLLIFGIIGTPHSDNDLRCIESPRAREYIKSLPMYPAAPLEKMFPRVNPKGIDLLQRMLVFDPAKRITAKEALEHPYLQTYHDPNDEPEGEPIPPSFFEFDHYKEALTTKDLKKLIWNEIFS

SEQ ID NO: 32916 - protein, 500 aa, Oryza sativa
  misc_feature (163)..(163): Xaa can be any naturally occurring amino acid
  misc_feature (225)..(225): Xaa can be any naturally occurring amino acid
  misc_feature (233)..(233): Xaa can be any naturally occurring amino acid
MDLTITSLVAACLSMAVLFVATKMIQQRPRTLCLYEKENKEEELLLPPVMSVVSVLTAYLPTLIAKGLPAVIHDLHSRLGSVFTVSVFGLKKVTLLVGPEVTAHFFQASESEIRQSNIYKVTVPVFGRGVLYDVDLATRSRQISFCTDSIKPINLRGHVDSMXHEVEGWLGQWGEDGVVDIKYEMGNLILLIANRCLLGKQFGESKLEQVSTLLHELFDNGFHLXISLFFPYXLPTPQHRRGDKARAMLGEMIHEAVRSRRNSGVAEGDVLQKFLDFKYINGRCMTENEIAGLLICMMFAAQHTSSSTSTWTGACLLSHGHRSYLAAAIQEQKRIIQQHGDRINWGILLQMTTLTHCIKEALRLHPPANLLIRHASKSFSVQTRQGHRYQIPKGHTLATCTTVGNRLPYIYKDPNVYDPSRFGPGREEDKVGGKFSYTPFSAGRHVCLGEDFAYMQIKVIWSHLLRNFELELISPFPEEEWEKFIPGPKGKVMVTYKRRR

SEQ ID NO: 32917 - protein, 355 aa, Coprinopsis cinerea okayama7#130
MCGRKFSIKTVCMAAKQMTIHEKNLIYRDIKPDNFLIGRPGTKGANVIHVVDFGMAKQYRDPKTKQHIPYRERKSLSGTARYMSINTHLGREQSRRDDLEALGHVFMYFLRGSLPWQGLKAATNKQKAMRRISRQVASELGFHPNPTHTLESPEEFGIYLNYVRKLGFEETPDYDFLRELFTKVLKSNGDVEDNVFDWNLLNDGRGWEASLNQSQILPPMQPTNDRRRGDGREDRRRSQQGVVPPSPALVRTGSKQRKGPGAGQMTPHMNVPAANRMSGAQHPYANAGGYDYGAVDDPYRNQPYGRASPMVPNASAAPPTMTNARASATPGDYNQQGGEEPAPKPSLLRILTCRC

SEQ ID NO: 32918 - protein, 709 aa, Shewanella sp. MR-7
MEKTFNLTRREDGIAILTMDVPGETMNTLKAEFGPEISEILSEIKRDSSIRGLVLISGKKDSFVAGADISMLDACQTAGDAKALSQQGHVVFNELEALNIPVVAAIHGACLGGGLELALACHQRVCSDDGKTMLGVPEVQLGLLPGGGGTQRLPRLVGITTALDMMLTGKQIRPKQALKMGLVNDVVPQTILLQTAVEMALAGKRTAKPVKKSLVNQLLEGTGFGRNIIFDQAAKQVAKKTQGNYPAPAKIIDCVRQGMAKGMQKGLEVEASHFAELVVSKESEALRSIFFATTEMKKETGAEGATPRKVKKAVILGGGLMGGGIASVTTTKAKIPARVKDINEKGLSNALSYAYKLLDKGVKRRHMTPAVRDNLMALMTTTTEYKGVKDADIVVEAVFEDLALKHQMVKDIERECGEHTIFASNTSSLPIGQIAQAASRPENVIGLHYFSPVEKMPLVEVIAHAKTSPETIATTVAFARKQGKTPIVVQDGAGFYVNRILALYMNEAAQLLLEGQSIEHLDKALVKFGFPVGPITLLDEVGIDVGAKIAPILETELGERFKAPAAFDKLLSDDRKGRKNGKGFYQYAAGNKASSKKKVVDESVYGVLGIKPGIDKEMSAVAERCVVQMLNEAVRCLDDGIIASPRDGDIGAIFGIGFPPFLGGPFHYIDTLGADNLVKILERYQAQYGDRFEPCPRLKEMAAEKTRFF

SEQ ID NO: 32919 - protein, 314 aa, Bifidobacterium longum DJO10A
MLADAGNTVTMWAKEQQIVEGIRDHHHNAVRLPSVEKLPDNMTATGDRAEAVKNADIVVVAIAAQFARVALVEFKGLIPDHAIVVSLMKGIERGTNKRMDEVVRESLDLPADRFAAISGPNLSKEIADRHPAATVVACTNLDNATKVAEACTTSYFKPFVTTDVIGLEMCGSLKNVTALAVGMARGAGYGENTAAMIETRGLAELTALGVAAGADPKTFFGLAGVGDLIATCGSSLSRNYTFGANLGKGLTVEEATKVSNGVAEGVPTTDAVVALGNQLDVPTPLAYQMSRVLNEGISCSEMLAGLFGHEVTGE

SEQ ID NO: 32920 - protein, 334 aa, Geobacillus stearothermophilus
AVKVGINGFGRIGRNVFRAALKNPDIEVVAVNDLTNADGLAHLLKYDSVHGRLDAEVVVNDGDVSVNGKEIIVKAERNPENLAWGEIGVDIVVESTGRFTKREDAAKHLEAGAKKVIISAPAKVENITVVMGVNQDKYDPKAHHVISNASCTTNCLAPFAKVLHQEFGIVRGMMTTVHSYTNNQRILDLPHKDLRGARAAAESIIPTTTGAAKAVALVLPELKGKLNGMAMRVPTPNVSVVDLVAELEKEVTVEEVNAALKAAAEGELKGILAYSEEPLVSRNYNGSTVSSTIDALSTMVIDGKMVKVVSWYDNETGYSHRVVDLAAYINAKGL

SEQ ID NO: 32921 - protein, 140 aa, Physcomitrella patens subsp. patens
MADSLVQHRGGCHCGGVRFEVMAPASVVAWNCNCSNCAMRGNIHFIVPNGDFKLEESSKDYLTLYTFNTHIAKHYFCKVCGITSFYIPRSNPDGVAVTVKCVDPGTLASVEIKTFDGQNWEASYAKSGIAAASEPCQTKP

SEQ ID NO: 32922 - protein, 627 aa, Brucella suis 1330
MLILDDISVRIAGRLLIDHASVTLPAGSKTGFVGRNGTGKSTLFRVITGDLAPETGSISFPKNTRIGQVAQEAPGTEEPLIEIVMKADKERAALLEEAATATDPHRIAEIHTRLADIDAHSAEARAGAILSGLGFDAQAQRQPASAFSGGWRMRVALAAVLFAEPDLLLLDEPTNYLDLEGVLWLVDYVKRYPHTVIIISHDRDLLNSATSSIMHLDQKKISFWRGNYDQFERQRHEMLELQQKAHARQEAHRKHMESFVERFRAKATKARQAQSRLKALQKLKPIELYVESHVQPFRFPDAEKKAASPIIALDGADVGYVPGKPVLRNVTLRIDNDDRIALLGSNGNGKSTLAKLIAGRLAPEKGTLTISPNLKVAFFAQHQLDDLVPEDNAIEHVRKLMPAEPEARVRARVAQMGLSTEKMLTPAKDLSGGEKARLLMGLATFHGPNLLILDEPTNHLDIDSREELVHALNAFNGAVILIAHDRHLIEATMERLWLVREGGVKPFEGDLDEYRQIVLADAKGEPAADRDEGPKVNKAEQRKLAAQKREALAPLQKKIKETESLIQKLQKQIQDFSMQLEDPALYEKEPQKAIRINKDMSDAKSTLAEAEDKWLELSAEYEEAMAE

SEQ ID NO: 32923 - protein, 480 aa, Bacteroides fragilis YCH46
MEDLNFRKGDAKTEAFGSNRMLQPSPVEKIPDGPTTPEIAYQMVKDETFAQTQPRLNLATFVTTYMDDYATKLMNEAININYIDETEYPRIAVMNGKCINIVANLWNSPEKDTWKTGALAIGSSEACMLGGVAAWLRWRKKRQAQGKPFDKPNFVISTGFQVVWEKFAQLWQIEMRQVPLTLDKTTLDPEEALKMCDENTICVVPIQGVTWTGLNDDVEALDKALDAYNAKTGYDIPIHVDAASGGFILPFLYPDTKWDFRLKWVLSISVSGHKFGLVYPGLGWVVWKGKEYLPEEMAFSVNYLGANITQVGLNFSRPAAQILGQYYQFIRLGFQGYKEVQYNSLQIAKYIHSQIAKMTPFVNYSEDVVNPLFIWYMKPEYAKNAKWTLYDLQDKLAQHGWMVPAYTLPAKLQDYVVMRVVVRQGFSRDMADMLLGDIKNAIAELEKLEYPTSTRIAQEKNLPVEAKVFNHTGKPQAAKK

SEQ ID NO: 32924 - protein, 321 aa, Bacteroides fragilis YCH46
MDKKISISQIKEVVQQAYEQVKGNTGGKNADYIPYLANIDKNLFGISVCLLNGQTITVGDFDYRFGIESVSKVHTAILILRQYGAQKVLEMIGADATGLPFNSIIAILLENDHPSTPLVNAGAISACSMVTPIGNSDKKWDAIVQNITDLCGSAPQLIEELYKSETATNFNNRSIAWLLKNYNRIYDDPNMSLDLYTRQCSLGVTAQMLSVAAGTVANGGVNPVTKKQVFDSELTPKITSMIATVGFYEHSGDWMYTSGIPAKTGVGGGVMGVLPGVFGVSAFAPPLDGSGNSVKAQLAIKYIMNKLGLNVFNGARVTIVD

SEQ ID NO: 32925 - protein, 574 aa, Aeropyrum pernix K1
MGSEDLERLLLGYALRDAVKHGGRASVGSVMSMLLGDHPELRSRAREIASLAARVVEQVNSMPAGEQKRLLSEQYPELARFEEQREKGDKGLPPLPGAVEGRVKLRFAPNPDFVIHMGNARPAIVNHEYARMYKGRMVLRFEDTDPRTKTPLREAYDLIRQDLKWLGVSWDEEYIQSLRMEVFYSVARRAIERGCAYVDNCGREGKELLSRGEYCPTRDLGPEDNLELFEKMLEGEFYEGEAVVRMKTDPRHPNPSLRDWVAMRIIDTEKHPHPLVGSRYLVWPTYNFAVSVDDHMMEITHVLRGKEHQLNTEKQLAVYRCMGWRPPYFIHFGRLKLEGFILSKSKIRKLLEERPGEFMGYDDPRFGTIAGLRRRGVLAEAIRQIILEVGVKPTDATISWANLAAANRKLLDERADRIMYVEDPVEMEVELAQVECRAAEIPFHPSRPQRKRRITLCTGDKVLLTREDAVEGRQLRLMGLSNFTVSQGILREVDPSLEYARRMKLPIVQWVKKGGEASVEVLEPVELELRRHQGYAEDAIRGYGVDSRLQFVRYGFVRVDSVEDGVYRVIYTHK

SEQ ID NO: 32926 - protein, 416 aa, Staphylococcus aureus subsp. aureus NCTC 8325
MNEVAEHSFDVNEVIKDFPILDQKVNGKRLAYLDSTATSQTPVQVLNVLEDYYKRYNSNVHRGVHTLGSLATDGYENARETVRRFINAKYFEEIIFTRGTTASINLVAHSYGDANVEEGDEIVVTEMEHHANIVPWQQLAKRKNATLKFIPMTADGELNIEDIKQTINDKTKIVAIAHISNVLGTINDVKTIAEIAHQHGAIISVDGAQAAPHMKLDMQEMNADFYSFSGHKMLGPTGIGVLFGKRELLQKMEPIEFGGDMIDFVSKYDATWADLPTKFEAGTPLIAQAIGLAEAIRYLERIGFDAIHKYEQELTIYAYEQMSAIEGIEIYGPPKDRRAGVITFNLQDVHPHDVATAVDTEGVAVRAGHHCAQPLMKWLNVSSTARASFYIYNTKEDVDQLINALKQTKEFFSYEF

SEQ ID NO: 32927 - protein, 1035 aa, Saccharomyces castellii
VAKQSKRARPSSPYTVSYGLQVKYLLERNFWRIRNNASISLFMIFGNSSMAFILGSMFYKVMRKGDTSTFYFRGAAMFFAILFNAFSCLLEIFSLYEARPITEKHRTYSLYHPSADAFASIISEIPTKFCIAVCFNIIFYFLVNFRMNGGVFFFYLLMNVVGVFCMSHMFRCVGSLTKSLSEAMVPASMLLLALSMYTGFAIPKKKMLRWSRWIWYINPLSYLFESLMINEFHDVKYPCAQYIPFGPAYANISGTERVCSAVGAVPGQAYILGDDYIKESYGYKHSEKWRSLGIGLAYAIFFLGVYLFLCEYNEGAKQAGEILVFPRSVIKRLKKEGKLREKNTAEDIEMAADTSVTDKQLLSSDEMAEESGANIGLSKSEAIFHWRNLCYDVQIKDETRRILNNVDGWVKPGTLTALMGASGAGKTTLLDCLAERVTMGVITGDVLVNGRPRDQSFPRSIGYCQQQDLHLKTSTVRESLRFSAYLRQPADVSIEEKNQYVEDVIKILEMEAYADAVVGVAGEGLNVEQRKRLTIGVELTAKPKLLVFLDEPTSGLDSQTAWSICQLMKKLADHGQAILCTIHQPSAILMQEFDRLLFMQRGGRTVYFGDLGKGCQTMIDYFERNGSHPCPADANPAEWMLEVVGAAPGSHANQDYHEVWRNSAEYKAVQEELDWMAQELPKKQVEESAADQREFATSVPYQAKIVSIRLFEQYWRSPEYLWSKFILTIFNQLFIGFTFFKADTSLQGLQNQMLSIFMFVCIFNPILQQYLPSFVQQRDLYEARERPSRTFSWKAFIFSQIVVEVPWNLLAGTLAFFIYYYPIGFYANASAAGQLHERGALFWLFSCAFYVYVGSMGLAAISFNQLAENAANLASLLFTMSLSFCGVMTTPGAMPRFWIFMYRVSPLTYFIDATLAVGVANVDVHCSDYELLRFTPASRMTCGEYMTPYMEMMGTGYLKDSSATDQCEFCTVSHTNEYLSQVNSSYSRRWRNYGIFICYIAINYIFAVLFYYMARVQRIRVRVPVRAFYPSSRNN

SEQ ID NO: 32928 - protein, 240 aa, Vibrio vulnificus CMCP6
MKKTVIAAVLATGLTAMGCHAAEWGYEGKHGPEHWGEIAKECAMGKNQSPIDIRQPTQADLKGLDLHYSGQVIALSNNGHTLQGSLSGENVLDIDGKSFELKQFHFHTPSENLIQGKQYPLEAHFVHADKAGNLAVVAVMFESGSQNQALNSLIAKVPKAGEEVKLAQAFDVNDLIPAHSEYYRFNGSLTTPPCSEGVRWLVIKEASELSPTQTHVLMQAMGQNNRPVQPLNARVVLSKE

SEQ ID NO: 32929 - protein, 522 aa, Neisseria gonorrhoeae FA 1090
MKHRTFFSLCAKFGCLLALGACSPKIVDAGTATVPHTLSTLKTADNRPASVYLKKDKPTLIKFWASWCPLCLSELGQAEKWAQDAKFSSANLITVASPGFLHEKKDGEFQKWYAGLNYPKLPVVTDNGGTIAQNLNISVYPSWALIGKDGDVQRIVKGSINEAQALALIRNPNADLGSLKHSFYKPDTQKKDSAIMNTRTIYLAGGCFWGLEAYFQRIDGVVDAVSGYANGNTENPSYEDVSYRHTGHAETVKVTYDADKLSLDDILQYYFRVVDPTSLNKQGNDTGTQYRSGVYYTDPAEKAVIAAALKREQQKYQLPLVVENEPLKNFYDAEEYHQDYLIKNPNGYCHIDIRKADEPLPGKTKAAPQGKGFDAATYKKPSDAELKRTLTEEQYQVTQNSATEYAFSHEYDHLFKPGIYVDVVSGEPLFSSADKYDSGCGWPSFTRPIDAKSVTEHDDFSFNMRRTEVRSRAADSHLGHVFPDGPRDKGRLRYCINGASLKFIPLEQMDAAGYGALKGKVK

SEQ ID NO: 32930 - protein, 305 aa, Saccharomyces castellii
MSTEKPQSNFAIDFLMGGVSAAVAKTAASPIERVKLLIQNQNEMLKQGTLDTKYKGIVDCFRRTAQQEGIISFWRGNTANVIRYFPTQALNFAFKDKIKLMFGFKKEDGYGKWFAGNLASGGAAGGLSLLFVYSLDFARTRLAADSKSSKKGGSRQFNGLIDVYKKTLKSDGVAGLYRGFLPSVVGIIVYRGLYFGLYDSIKPVLLTGSLEGSFLASFLLGWVVTTGASTCSYPLDTVRRKMMMTSGQAVKYKGAFDCFKKIVAAEGVASLFKGCGANILRGVAGAGVISMYDQLQMILFGKKFK

SEQ ID NO: 32931 - protein, 308 aa, Saccharomyces castellii
MSSKEEVKKESNFAIDFLMGGVSAAVAKTAASPIERVKLLIQNQDEMIKQGSLDSKYKGIIECFQRTAKTEGIIAFWRGNTANVIRYFPTQALNFAFKDKIKAMFGFKKEEGYGKWFAGNLASGGAAGGLSLLFVYSLDYARTRLAADAKSSKKGGSRQYKGLIDVYKQTLATDGMAGLYRGFLPSVVGIIVYRGLYFGLYDSLKPAVLTGSLEGSFLASFLLGWIVTTGASTASYPLDTVRRRMMMTSGQAVKYDGAFDCFRKVVAAEGVSSLFKGCGANILRGVAGAGVISMYDQLQMIMFGKKFK

SEQ ID NO: 32932 - protein, 767 aa, unidentified eubacterium SCB49
MSTPSKRREALLYHAKPKPGKIEVVPTKKYATQRDLSLAYSPGVAVPCLEIAKDVENVYKYTAKGNLVAVISNGTAVLGLGNIGPEASKPVMEGKGLLFKIFADIDVFDIEVDTEDIDAFIETVKNIAPTFGGINLEDIKAPEAFEIERRLKEELDIPVMHDDQHGTAIISAAALLNALEISEKNISEVKIVISGAGAAAVSCTRLYKAFGASADNIVMIDSKGVIRKDRDNLTPEKAEFATSRKIDTLTEAMKDADVFVGLSIADIVTPEMLKSMAQKPIVFAMANPDPEIEYNLAIKTRKDIIMATGRSDHPNQVNNVLGFPFIFRGALDVRATKINEAMKMAAVKALADLAKEAVPEQVNIAYGETKLNFGRDYIIPKPFDPRLIAKVPPAVAKAAMESGVATAPITNWQKYEDELNERMGSDNKIIRLLMNRAKTNPKRIVFAEADHLDVLKAAQIVHDEGIGIPILLGRRDVIEELMEQIEYDREVTIIDPKSDEEAAHRDRYAEKHFKNRQRSGITYYDAQSMMRERNYFASMMVNEGDADAMISGYSRAYPSVVRPVLETIGSYDGVDKVATTNMMLTKRGPLFISDTSINIDPSAKELAKIAQMTNYTMKMFGLNPVIAMISYANFGSSKDPHATKVKDAVKYLHRTNPDMHVDGELQTDFALNSELLQKKFPFSKLAGKKVNALIFPNLDSANSNYKLLKELNNVESIGPIMLGMRKPVHILQLGASVEEMVNMAAVAVVDSQQKEKREKEASKFRAM

SEQ ID NO: 32933 - protein, 227 aa, Saccharomyces castellii
HVIRYFPTQALNFAFKDKIKAMFGFNKERDGYTKWFMGNVASGGCAGALSLLFVYSLDYARTRLAADAKSIKSGAPRKFNGILDVYKKTLFTDGVLGLYRGFLPSVVGIMVYRGLYFGLYDSLKPVLLTGSFENAFLPSFLLGWAVTISASTTSYPLDTVRRRMMMTSGQAVKYKGAIDCFQQIVSQEGVYSLFKGCGANIFRGVAAAGVISLYDQLQLLLFGRKFK

SEQ ID NO: 32934 - protein, 442 aa, unidentified eubacterium SCB49
MEQKKQIPQVPLARFLKHSLAILNNPLPFHKDNFERLGDTFRLNISFTESVLFSRDAGLLQYVLQKNQRNYSKSNIQTEDLAKYVGKGLLTAEGEHWQKQRKLIQPAFHKKQLILLLDNIKAAITSEILKIETSVDFDVFPIMNDLAFQTVAKSLFSSAIEEDEIKKIQYITEAAQKMLVKELRQPYLGWWFKASGKIEKHLALTREARVILKKLISERKQSGERFDDLLDMLLDARYEDGKPMEEEQLVDELLILFTAGHETTSNALTFAAQLIAKHPEVQEKIINEIDAFTTQDLMQSLKESPYTQAVVEESMRLYPPAYFIDRVNIEDEYFAGMSFPKGSSLLFSIYEIHRDPTFWEDSLQFKPERFIGVPKNQYSSHYFPFGAGPRMCIGNNFAMYEMVIAIQTLVSNFKIMHKTSAIEITPLITLKPKNAILQFEER

SEQ ID NO: 32935 - protein, 509 aa, Coccidioides immitis RS
MRGVQIFSGTSHPALTEAICERLGTVPAKCELRKFSNGETCVNIGVSVRNQDVFIVQSGSSKINDSVMELLIMISACKGGSAKSITAVLPYFPYSRQSKKKSHRGAITARMLANLLSIAGVDHVITVDLHASQMQGFFGKPVDNLFAESLIARWIRINVPRWHEAVVVTKNAGGSKRVTSLADALKLNFGIVTTDRRRQKYNQNSMTDSAIFFDSVDHNLANVRNAEFQPRNVSHRASLPTRPRPQDINLNSSSLPDPFIDAQPNTLATLPEESRTPQSGFGEASHDDDDTTNEYTDERAREVVTARLVQGHLVDDDYPSPNLSSTAASVSGLNVTVERTEIYDGASLDPTSESAVSTLSSFQPEHALGGSFDAAASSDEEDGKAQNSNHERTITLVGDVRDKTVFIVDDMIDRAGSWIAAAETVVKKGGANKVYCIATHGLFGENSLEQMERCDCIDYVVITNTFPIDPQRARRMKKLVVLDVSALLSESIRRHHYGESISSLFELRD

SEQ ID NO: 32936 - protein, 124 aa, Aeropyrum pernix
PIYVRFEVPEDLAEKAYEAVKRARETGRIKKGTNETTKAVERGLAKLVVIAEDVDPPEIVMHLPLLCDEKKIPYVYVPSKKRLGEAAGIEVAAASVAIIEPGDAETLVREIVEKVKELRAKAGV

SEQ ID NO: 32937 - protein, 141 aa, Triticum aestivum
  misc_feature (102)..(102): Xaa can be any naturally occurring amino acid
MASGAVRPKLAYIVCYVDDVVKAAAFYADAFGYSVRRVDDSHKWAELDTGSTTIAFTPRHQRETDALTGEVQLPKSPRERGPVEICFDYDDVDAAYRRAAAXVENGAVPVSAPEQKNWGQKVGYIRDCDGITLRLGSHVRE

SEQ ID NO: 32938 - protein, 140 aa, Brucella suis 1330
MAIERTFSMIKPDATRRNLTGAIIAKLEEAGLRVVASKRVWMSRREAEGFYAVHKDRPFFGELVEFMSSGPTVVQVLEGENAIAKNREVMGATNPANADEGTIRKTFALSIGENSVHGSDAPETAAEEIAYWFSGTEIVG

SEQ ID NO: 32939 - protein, 497 aa, Vitis vinifera
MVVLQRAVDAETSLEKIKRQLASGSGRNLLQGPLLKRSETLRKWNERWVILDPTTGKMEYKIRRNEVAVKGTIIFDAYSTITLSPVNFHGLPKYDGCCFYIGTPQKKDYFLCAETPGAARAWVSTLHATQLVLKAHKEAVNSLSGNGSAKLGTVATVVAAANSTALECSKEIEAAMQISMRNALGVMMNKTSDGPMDDLTIMKETLRVKDEELQHLARDLRARDSTIKEIAEKLSDTAEAAEAAALAAHTMDEQRRMACAEIDRLRKDSEKQLGSSMLKLKEFEEKVMALCKERDQLVKQRDSAIQEAHLWRSELAKARERVVILEGAVVRADEKVRVAEADAEARIKEAAQKESAAVKEKQELLAYVNMLQAQLQRQQIDTKKQVFEEKTESCSDIGNTRPLTKHVDLSDENVDKACLSVSRAVPVGENVVHLAMDQVNLRPVGDGEWSDIQATEARIADVREIAPETEGSSLDIPVVSLPVNNHHEQGANSFHQP

SEQ ID NO: 32940 - protein, 285 aa, Coprinopsis cinerea okayama7#130
MSRPELIAPPEIYYGDTEAKKYTQNTRNQQIQADMTYRALELLNLPPDQPAFLLDIGCGSGLSGEILDEEGYIWAGVDIAPSMLEVALEREVEGDLFLQDIGQGFGFRPGSFDGAISISVLQWLLNAETSHPTSSPPHRLTRFFTTLFSALRNPSRAVLQFYPSSDDQIQLITSIAQKAGFGGGIVVDYPNSKKAKKVFLCLFVGRSENNQQVPKGLEGDGSEEVDAKAQFERRRERERARSKSKRKSVKDRDWILKKKELYRKRGKESVPNDSKYTGRKRRAVF

SEQ ID NO: 32941 - protein, 415 aa, Coprinopsis cinerea okayama7#130
MGVGLTVLRQATVVGTTALQRRLLVSLEINNKDRAYEWFLTWMAHQSNAPSTMRNRAASWIRSHQLSVETTVEQRKNGSSSAAFRLVAGPGNHYFRYKGAWMQVKRERETKSMQLMSGTPWETVTLTTLSRDRNLFTELLSEARDMAMRTQQGKLVIHTAWGIEWRPFGQPREKRPIQSVVLADGVAEKIESDVKAFLDRRKWYADRGIPYRRGYLLYGPPGSGKTSFIQALAGSLSYDICVLNLSERGLTDDKLFHLLSNVPERSFILMEDVDAAFNKRVQTSEDGYQSSVTFSGFLNALDGVASGEERIIFLTTNHLEKLDPALIRPGRVDLAELIDDAHPNQARTLYERFYGGGEAVTGLPDEKVKSLARKLESIVETEWSAGRKVSMAALQGHFIQSDAQAAVDTCHILFK

SEQ ID NO: 32942 - protein, 256 aa, Pseudomonas fluorescens PfO-1
MTDQRKGSDAEPTTHFGFKNVPESQKAEKVAEVFHSVAAKYDLMNDLLSGGMHRLWKRFAIELSGVRAGNRVLDIAGGTGDLTKKFSHLVGPTGQVVLADINESMLKVGRDRLLDVGVSGNVEFVQADAEKLPFPDNHFDCVTIAFGLRNVTHKEDALRSMLRVLKPGGRLLVLEFSKPTNALMSKAYDAYSFAFMPLMGKLITNDSESYRYLAESIRMHPNQETLKSMMVDAGFDRVTYHNMTAGIVALHRGIKP

SEQ ID NO: 32943 - protein, 426 aa, Arabidopsis thaliana
MQNQRLIKQQQQQQQQQHQQAMIQQAMMQQHPSLYHPGVMAPPQMEPLPSGNLPPGFDPTTCRSVYAGNIHTQVTEILLQEIFASTGPIESCKLIRKDKSSYGFVHYFDRRCASMAIMTLNGRHIFGQPMKVNWAYATGQREDTSSHFNIFVGDLSPEVTDAALFDSFSAFNSCSDARVMWDQKTGRSRGFGFVSFRNQQDAQTAINEMNGKWVSSRQIRCNWATKGATFGEDKHSSDGKSVVELTNGSSEDGRELSNEDAPENNPQFTTVYVGNLSPEVTQLDLHRLFYTLGAGVIEEVRVQRDKGFGFVRYNTHDEAALAIQMGNAQPFLFSRQIRCSWGNKPTPSGTASNPLPPPAPASVPSLSAMDLLAYERQLALAKMHPQAQHSLRQAGLGVNVAGGTAAMYDGGYQNVAAAHQQLMYYQ

SEQ ID NO: 32944 - protein, 505 aa, Bacillus sp. SG-1
MSTVKEQNFEVLETKREHYGMIINGERTDSASGETFTTYNPATGEAIATVAKATTEDAERAVQAARDAFDKGKWKKFPVNKRQRVMMKIAGIMRSRFNELVSLEIMDSGKSLSAAQGQVMQAIEDFEFYAGAIVGHRGSVNNVPGQFSNVAEKEPVGVCAQIIPWNYPMMMAAWKIAPAIAVGCSVVVKPASLTPLTAIVLGEICIEAGVPQGVVNVIPGSGSTIGNYLVEHDQVDKVAFTGSTPIGKNIMERASQTLKRVTLELGGKSPNIVFDDADVDAAVDGSLFGIFYNTGQSCEARSRLYVHEDIYDEFMEKFVAKTKQLSLGDPFDKGTHIGAIIDDSQVKTIDGYVQSAKEEGATILTGGKPATVEGFENGHWYEPTIITDVNHEMKAVREEIFGPVVVVMKFSDEKEAIKLANDTVYGLGSALWTKDHAKATRVSKAIQAGIVMVNCPFSAFPGTPFGGYKQSGFGRELCIETLDLYTETKSIISYFGSRPLNPFGL

SEQ ID NO: 32945 - protein, 266 aa, Zea mays
  misc_feature (59)..(59): Xaa can be any naturally occurring amino acid
  misc_feature (108)..(108): Xaa can be any naturally occurring amino acid
FSRGLFGRQVEAIFLAAGGMDSHAAGSSSGGSGDGGAQPRRSSRKPTYSKFTQQELPAXEPILTPKWGISVFVLVGVIFVSIGIVSLRASRQVVEIVDRYDDACVPCXVTDKLAYIRNDSIPKSCTRNLTITKDMKQPIFVYYQLDDFYQNHRRYVKSRNDAQLRDKSKASDFTNCDPEAKTVDGKPIVPCGLIAWSLFNDTYKLIHNNVTLRVEKKDISWKSDRDHKFGSDVFPTNFQKGASGPVQVRLETDRMLVIFYSRQTWL

SEQ ID NO: 32946 - protein, 458 aa, Pseudomonas putida GB-1
MSSGRIVQIIGAVIDVEFPRDVVPSVYNALKVQGAETTLEVQQQLGDGVVRTIAMGSTEGLKRGLDVVDTGAAISVPVGKATLGRIMDVLGNPIDEAGPIGEEERRGIHQPAPSFADQAGGNDLLETGIKVIDLVCPFAKGGKVGLFGGAGVGKTVNMMELIRNIAMEHSGYSVFAGVGERTREGNDFYHEMKDSNVLDKVALVYGQMNEPPGNRLRVALTGLTMAEKFRDEGNDVLLFVDNIYRYTLAGTEVSALLGRMPSAVGYQPTLAEEMGVLQERITSTKEGSITSVQAVYVPADDLTDPSPATTFAHLDATVVLSRDIASLGIYPAVDPLDSTSRQLDPNVIGNEHYDTARGVQYVLQRYKELKDIIAILGMDELSEDDKQLVARARKIQRFLSQPFFVAEVFTGSPGKYVSLKDTIAGFSGILKGDYDHLPEQAFYMVGSIDEAIEKAKKL

SEQ ID NO: 32947 - protein, 320 aa, Mycoplasma pneumoniae M129
MSVIDLLKQRVQSAGKKPVIIFPEGWSPTVMEAVNQLQQAGILTPPVIFRTRSEVPAGFNTAIKHYVIEEMDLTKYANFVYEKRKHKGMEMREAQKFVRDASSLAATLVALNEVDGEVCGKEYATKDTLRPALQLLGTGNFVSSVFIMEKNEERLYFTDCAFAVYPSPQELAVVAENTFKFAQSMGEPELKMVFLSYSTLGSGKGEAVDKVVSATQIFLEKHPELKANVCGELQFDSAFVEKVRKQKAPNLTWNGSANIYVFPNLDAGNIGYKIAQRLGGYEAIGPIVLGLARPFNDLSRGASVSDVFNVGIITAAQTLK

SEQ ID NO: 32948 - protein, 409 aa, Mycoplasma pneumoniae M129
MVDFKTVQAFDFQGKTVVLRADLNVPMKDGVITDNERILASLDTIKYLLGHNCKIVLLSHLSRVKSLDDKKGKKSLQPVASALQNLLKNTKVHFCPENTGDKVKVAVNQLPLGEILVLENTRYCDVNEAGEVVKHESKNNAELAQFWASLGDIFVNDAFGTAHRRHASNAGIAKYIKNSCIGLLMERELINLYRLINNPPKPFVVVLGGAKVSDKLQVVNNLFKIADHILIGGGMVNTFLKALGNEVGTSLVEEDLVQTAKQILDSDKDKKIVLGVDQMLHASFKDEPGVECVVAPQWPAELQGFMSLDVGSKTVALFSSYLAKAKTIFWNGPMGVFEFSNYAQGTLAIGKAIAQNQQAFSVIGGGDSAAAAKQLQIADQFSFISTGGGASLALIGGEELVGISDIQKK

SEQ ID NO: 32949 - protein, 337 aa, Mycoplasma pneumoniae M129
MLAKSKTIRVAINGFGRIGRLVFRALLSQKNIEIVAVNDLTHPDTLAHLLKYDSAHGEFKKKVVAKDNTLMIDKKKVLVFSEKDPANLPWAEHNIDIVVESTGRFVSEEGASLHLQAGAKRVIISAPAKQKTIKTVVYNVNHKIINAEDKIISAASCTTNCLAPMVHVLEKNFGILHGTMVTVHAYTADQRLQDAPHSDLRRARAAACNIVPTTTGAAKAIGLVVPEATGKLNGMALRVPVLTGSIVELCVALEKDATVEQINQAMKKAASASFRYCEDEIVSSDIVGSEHGSIFDSKLTNIIEVDGNKLYKVYAWYDNESSYVNQLVRVVNYCAKL

SEQ ID NO: 32950 - protein, 435 aa, Burkholderia xenovorans LB400
MNALASAMNSDAPSLFSGINVIQTMTVFQITGALLAVVAVFGVINYRFIKLPDTLGITAVGLVVCLGISALGFYYPTMAVVARKIVTQIDFADIVFHGLLGFLLFAGALHVDLSRMRTQRRAVLLLATIGVLISVALVGLGFFYVTQWLGHPVSLLWCLAFGALISPTDPIAVLSVLKGAGAPESLETKITGEALFNDGTAVVAFVTLVGLASGANEFSATAVAIDLLREIAGALILGVSLGFAASLLLRGIDSYPVEILITLALATGGYSLAETLHVSAPLAVVIMGLVIGNHGALTSMSEKTREHLFSFWELLDELLNLVLFGLIGLEIIALSLHQHIVRLGLAAIPVVLVARGISVSIPLFALQNFRRVNPHSALMLTWGGLRGGISIALALSLPDFHGRDMFIGVTYLVVVFSLLIQATTLGPLVRRLNRR

SEQ ID NO: 32951 - protein, 456 aa, Candida glabrata CBS 138
MASAIYFCDNKGRPLLSRKYRDDIPFSAIDRFPILLSNFEEETNLIPPCIEHNGIQFLFIQHNDLYLVAIATSISCNAALIFSFLHKVIEVLSEYLKAVEEESIRDNFVIIYELLDEMMDYGIPQITEPKMLKQYITQKSFKLKKAAKKKRNAARPPTSLTNSVSWRPEGIKHKKNEAFLDIIESINMLMTQKGQVLRSEIIGEVKVKSKLSGMPDLKLGINDKGLFSKYLEGDENGVPIAPDDSSVDESKPKKKRSNNMELEDLKFHQCVRLSKFENEKQITFIPPDGDFELMSYRLSTAIKPLIWCDVNIKTHSKSRIEIFCRAKAQIKKKSTATNVEILIPVPEDADTPVFKYSHGSIKYVPEKNAILWKIRTFPGDKEYSMAAEMGLPSTNAGEESEKLKRPVQVKFQIPYFTTSGIQVRYLKIEEKNLQYKSYPWVRYITKSGDDYTIRLS

SEQ ID NO: 32952 - protein, 93 aa, Haemophilus influenzae R2846
MTRSDDRAIIHVLLVGKMSNEERVKKIIVEQLGVKEEDVKPEASFVEDLGADSLDTVELVMALEEEFDIEIPDEEAEKITTVQSAIDYVQNNQ

SEQ ID NO: 32953 - protein, 265 aa, Ralstonia eutropha JMP134
MRPLKVFLTGASSGLGQALAREYAQQGAILGLVARREDALRDLAQSLPNPGAVHVYAADVRDADAMQRAAQDFLDRYGVPDVVIANAGVSVGTVASEREDLEAFRMVMDTNWFGVLTTFQPFLQPMRDRDPGVGGWRGTLVGIASVAGVRGLPGGGAYSASKSAVIKLLESLRLEERRHGIRVVTIAPGYIRTPMTAHNPYRMPFLTDADVFARKAVKAIGAGSRFKVIPWQMGMVASLMHLMPRWLYDALAASAPRKPRNGEGD

SEQ ID NO: 32954 - protein, 305 aa, Penicillium cyclopium
MRLSFFTALSAVASLGYALPGKLQSRDVSTSELDQFEFWVQYAAASYYEADYTAQVGDKLSCSKGNCPEVEATGATVSYDFSDSTITDTAGYIAVDHTNSAVVLAFRGSYSVRNWVADATFVHTNPGLCDGCLAELGFWSSWKLVRDDIIKELKEVVAQNPNYELVVVGHSLGAAVATLAATDLRGKGYPSAKLYAYASPRVGNAALAKYITAQGNNFRFTHTNDPVPKLPLLSMGYVHVSPEYWITSPNNATVSTSDIKVIDGDVSFDGNTGTGLPLLTDFEAHIWYFVQVDAGKGPGLPFKRV

SEQ ID NO: 32955 - protein, 660 aa, Gluconobacter oxydans
MSKKTSTIPTYGRYPELDRVRFPADMRNLSVDQLKQLADELRSETVDAVSTTGGHLGASLGVVELTVALHAVFNTPDDRIIWDVGHQAYPHKILTGRRDRIRTLRQPEGLSGFTRRAESEYDPFGAAHSSTSISAGLGMAVAHHLRAEEDPSYHERNVIAVIGDGSISAGMAYEAMNNAAVAGPGANRLIVVLNDNEMSIAPPVGSMSDYLSRLMSSRQFFSLRDLAGKVAKRLPGKIERTAKRAEEYARGMITGGTLFEELGFYYVGPVNGHDMSQLVPILRNLRDADDQGPILLHIITEKGRGYKPAEAAGDKYHAVSKFNVVTGEQKKAPAGPPSYTSIFSRELMRRAKTDDKLITITAAMPSGTGLNAFAKAYPDRFFDVGIAEQHAVTFAAGIASEGLRPFCAIYSTFLQRAYDQVVHDVALQNLPVRFAIDRAGLVGADGATHAGAFDLNYLCCLPNMVVMAPSDEVELLHATATACEYDAGPIAFRYPRGNGIGLDLPEKGEVLEIGKGRIVREARRAPNARGGVAILSLGPRMHESLRAADQLAAQGVPVTVADARFAKPIDKALVEDLARQHEVFITIEEGAIGGFSSLVVQHLAETGLLDKVKFRPMALPDRYIDHNTQDAQYEDAGLTAPHIVRTAADALGVEVAQQSA

SEQ ID NO: 32956 - protein, 838 aa, Kluyveromyces lactis NRRL Y-1140
MDTDRSSVGISPAEHSVPLEASKRDADATGTIVPEEDLKLEHIPDNLEHADFSKLLELDEKNDDDLFHGIDILDQQMKSDQGKEDIELRVEEPKREMKEDESSNVRNEDKQKLEAPESPKSMPAIHNDEKSVKQVYPLVKHEENTPAAIIQERLAHNLQRHNSLTPMMFPLKQLNELKSDMQNLKLKTEDGAKNSPQSDQNTSQKNAESPENGQQVTQLHPQLLQAADVNTPTSNTVPGASDEQSKISAYARLDFQDFTFYVQTLQVIIGRRSENDYSHKVDVNLGPSKSISRRHAQIFYNFGTGRFELSIMGKNGAFVDDNFVERGSTVPLKNKTKIQIGQIPFQFVLPDHEGNISKELASKSKNSTANASQPPKKKNKKEKEVKEVKEKKAPKPPKPPKKVYTLQEIPPEYRTKPTCSYSNLITSCLRKFSTEKGMSLSEIYSGIRELFPYYKYCPDGWQSSVRHNLSLNKSFCKVSKEGKGWLWGLDEEYIAERERQKKKQAEAQAAKAKVAELKQQQQQEQRLKKQQQQSSNSKQPNMAQTLAANRSDKKTTSMDDNQRTMKYLQEQLMILTKDRKGLDKSLMAQILTQALAMTINQVTQAAKQKGISGNPLTALIDKNPQHLNLILAAAVNAATAKVTKGKVNQLVNMPPPTVKDQQPSAKKEIPIKRAVTPKPPTPSVVNPVHANSSNKDQSFDPTSLSKFFQPKQQQGSRPSSGMAKTPTPPVTVGTPKSGVVSNGSSVPATSPQATSTVVPKKRPASDTESSDSDDSNSSDSDEQNKNGDSSGESSGDSSSSSDSDGDSGSESETDGSDSDSNSDDSDNNGHDNDDGQSD

SEQ ID NO: 32957 - protein, 524 aa, Dechloromonas aromatica RCB
MINAPLKREDGLAKLRDTAPWDVLIIGGGASGLGAAVDAAARGYRTLLIEARDFASGTSSCSTKLIHGGVRYLRQGDIGLVRNALHERSHLLRNAAHLVHPLAFIIPAWRNIDRVFYGAGLKLYDLLAGRQGLAASRSLNRQDVIDALPGLRRASLCGGIRYWDGQFDDARLAITLMRTATDLGASCLNYLPVTRLIKTGGRVAGAVLCDAESGEEFEVRARAVINATGVHADSVRRFDDSAAVPLLTPSQGIHLVVDADFLPGQQAILVPKTEDGRVMFAIPWQGKVLLGTTDTPRPELSQLDDPQPLDEEIDFLLRTAASVLSRPPTRSDIRSAFAGLRPLIHPDNKDGKSTAALSREHAVLVSTSGLITVAGGKWTTYRLMAEQVIDRTIEVAGLPAVPCPTRTLKLHACPAQPGNDVYGTEAPLLATLPGHDQPLHPELPYNAAMVRFAIRYEMARTIEDVLARRTRALFHDAAAAEKMIDRIAGIFAEELQLTEERLASLIEAAHESARRFMAAQNSGA

SEQ ID NO: 32958 - protein, 335 aa, Zea mays
MRAVAAAASPPLRALLLLSRHPRRAGFTNWPSLPRGQNAGPTAPPAATAPKPAAPSRRQGRGLTASLPRQVARISTPHLRPPATPPRCPDRRHQSHGVRALAGCPRKTVRHLPAPTSHLRFTMNPSSSSSSSGGYHSRAAAFASPQPRGGGGRRRGGGRVQDGSDRIDALGRLLTRVLRHMAAELRLDMRTDGYVRVRDLLKLNLQTFAKVPLKSHTVDEIREAVRRDNKQRFSLLEEDGELLIRANQGHTVTMEMIFAITSTGTMVSGPLSFYCLLLESAYLLWVFIPVFSVAACCAAPIFLMKTSRPGIPDSPDLGYVARSRRPSSPVGVMPP

SEQ ID NO: 32959 - protein, 264 aa, Coprinopsis cinerea okayama7#130
MIGSILSNILLVLGCSFVAAGWERAESSFQVTAAQASSSLMTLACITFSALVIPAAYHMTMPETASSEHGLVVISRGTAIVLLLVYGAYLLFQLKSHHFLFQSESEEGDEPPTMNVAAAAFALLGVTVVTSFCADYLVASIEETAERYHISKTFIGLILLPIVANAAEHVTSIWMAMKNKMELAITICVGSSIQIASFVVPLMVIIGWCTNHELTLYFEDFETIILFVSVLLVNTLIQDGKSNYMEGLLLLALYFVIALAYYVS

SEQ ID NO: 32960 - protein, 484 aa, Haemophilus influenzae Rd KW20
MSVKGDIGVIGLAVMGQNLILNMNDHGFKVVAYNRTTSKVDEFLQGAAKGTNIIGAYSLEDLAAKLEKPRKVMLMVRAGDVVDQFIEALLPHLEEGDIIIDGGNSNYPDTNRRVKALAEKGIRFIGSGVSGGEEGARHGPSIMPGGNQEAWQYVKPIFQAISAKTEQGEPCCDWVGGEGAGHFVKMVHNGIEYGDMQLICEAYQFLKEGLGLSYEEMQAIFAEWKNTELDSYLIDITTDILGYKDASGEPLVEKILDTAGQKGTGKWTGINALDFGIPLTLITESVFARCVSSFKDQRVAANQLFGKTITPVEGDKKVWIEAVRKALLASKIISYAQGFMLIREASEQFGWDINYGATALLWREGCIIRSRFLGNIRDAYEANPNLVFLGSDSYFKGILENALSDWRKVVAKSIEVGIPMPCMASAITFLDGYTSARLPANLLQAQRDYFGAHTYERTDKPRGEFFHTNWTGRGGNTASTTYDV

SEQ ID NO: 32961 - protein, 478 aa, Acidovorax sp. JS42
MQIRRATKIVATLGPASSDPQLLEQMIAAGVNVVRLNFSHGKAQDHVERAAMVREAAQRAGREVAIMADLQGPKIRVGKFAEGRVMLEPGQPFVLDASRSEPGDLQGVGLDYKELPRDVKPGDVLLLNDGLIVLQVDAVRGEAVYTTVKIGGELSNNKGINKQGGGLTAPALTAKDMEDIKTAMSFQADYVAVSFPKNATDMEMARQLCNVAAAEFRHKPGLIAKIERAEAVPLLEEILRVSDGIMVARGDLAVEVGNAAVPALQKKMIRMARDMNKVVITATQMMESMIANPVPTRAEVSDVANAVLDGTDAVMLSAETAAGKYPLDTVREMAAICAAAEAAEDLERDSDFIGQTLGRIDQSIAMGALFTAHHLGAKAIVAMTDSGSTALWMSRHRIHIPIYALTPKVATQRRMAMFRNVCPLLMDTSADRDTALDQAESHLKMRNIVQQGDLYVITCGEPMGAPGGTNMLKICRAR

SEQ ID NO: 32962 - protein, 466 aa, Pseudomonas putida GB-1
MKSYDVVIIGGGPGGYNAAIRAGQLGLSVACVEGRSTLGGTCLNVGCMPSKALLHASELYEAASGDEFAHLGIEVKPTLNLAQMMKQKDESVTGLTKGIEYLFRKNKVDWIKGWGRLDGVGKVVVKAEDGSETALQAKDIVIATGSEPTPLPGVTIDNQRIIDSTGALSLPQVPKHLVVIGAGVIGLELGSVWRRLGSQVTVIEYLDRICPGTDTETAKTLQKALAKQGMVFKLGSKVTQATASADGVSLTLEPAAGGTAESLQADYVLVAIGRRPYTKGLNLESVGLETDKRGMLGNEHHRTSVPGVWVIGDVTSGPMLAHKAEDEAVACIERIAGKPHEVNYNLIPGVIYTRPELATVGKTEEQLKAEGRAYKVGKFPFTANSRAKINHETEGFAKVIADAQTDEVLGVHLVGPSVSEMIGEFCVAMEFSASAEDIALTCHPHPTRSEALRQAAMNVDGMAMQI

SEQ ID NO: 32963 - protein, 158 aa, Triticum aestivum
AAPRLRDASRNSARDLLAWTKQGSGLRAILVISVGTITMISLTGLLIFMSFLLVATANAIIVSVLMSLAAAGGFLALFFACLVAVYVGAVSIAIFVVSATVISAIVGVMIATGWIGFFWMIWFAARKSLDLTKHSIGMTTSAMQSYSASRSVGQKLTD

SEQ ID NO: 32964 - protein, 523 aa, Oryza sativa Indica Group
MYVPQPSRSDAAGRDAGDQPRVYQVWRGSNGEAGAGSVLSGALCAVIVSMVRMSMLVENVSSSQNRNEASICAQFEVIQLTLKIYAGLHAKYFDELCHHTNSEIIQWNFEMPSGPALEFFLRGRFIFGPDVRSIFLTMFLIVAPVVAFCVFVARHLIDDFPGDWGISVMVVVVVFTVYDLTLLLLTSGRDPGIIPRNTHPPEPEGFDGSNDSGVQTPQQLRLPRTKDVIVNGISVRIKYCDTCMLYRPPRCSHCSICNNCVEQFDHHCPWVGQCIGLRNYRFFYMFVFSTTLLCLYVFAFCWVYIIKIRNAESLSVWKAMLKTPASIVLIIYCFLCVWFVGGLSVFHCYLMSTNQTTYENFRYRYDRRANPYNRGVLNNFLEIFCSRIPPSKNNFRARVTVEQGLQQTRVASRGFMSPNMGKPVGDLEMGRKPVPWDEPRTAADIRDLEAGLGGFLDEKEGRLTHASPDLSRDDLPADLMEGRAGTHSRRSSWVNRTGTSESVDSMNAQIIAAWEAIQSDPVH

SEQ ID NO: 32965 - protein, 333 aa, Acidovorax sp. JS42
MTIKIGINGFGRIGRNVLRSAVQNFSDIEVVGINDLLEPDYLAYMLRYDSVHGRFKGEVSVEGNTLIVNGKKIRLTQERDPANLKWNEVGADIVIESTGLFLDKASAEKHIAAGAKKVLMSAPSKDDTPMFVFGVNHATYAGQAIISNASCTTNCLAPVAKVLHDKWGIKRGLMTTVHAATATQKTVDGPSNKDWRGGRGILENIIPSSTGAAKAVGVVIPSLNKKLTGMSFRVPTSDVSVVDLTVELEKEASYDEIKAEMKAQSEGALKGVLAYTEDKVVATDFVGETHTSVFDADAGIALDKTFVKVVAWYDNEWGYSNKCLEMVRVMAGK

SEQ ID NO: 32966 - protein, 265 aa, Anaplasma marginale str. St. Maries
MVSAGGITIHSEKDFEGMRRAGRLAAETLDFITPYVKPGVSTNALNDLCHRFIIDAGAVPAPLGYRGYPKSICTSKNCVVCHGIPDDVALKDGDILNIDVTVILDGWHGDTSRMYWVGENTAVKAKRLCEASYEAMWAAIGHVKPGQKLNRLGMAIEETIAKYGYSIVRDYCGHGLGKVFHAAPNVVHYYDEEDETVLQEGMFFTVEPMINAGKHHTTVSKKDGWTVTTRDFSLSAQFEHSLGVTKDGAEVFTMSPKNWNFPPYQ

SEQ ID NO: 32967 - protein, 437 aa, Anaplasma marginale str. St. Maries
MVWCLDWRSIRPAYSSFIGQAACMSDNVEIKVDNLGGESISEAPVRVLKKVGDAVSAEEAVFIVETDKTSLEIASPVAGVITELRVSDEEIVTRGQVLAIISKHEGAPQDAAAREHKQAEVATPDAELAPQVEQRDAQAQVADKEKPVKPVTGPRIPGIDEFVAGGCSSPADRAAGKITKPVGDVGKSPVPQQRVYDEVDGVISVPGERRVKMSKIRQVIASRLKESQNTAATLSTFNEVDMSAVMALRGKYKEGFEKKYEVKLGFMSFFIRAVVLALREIPVINAEISGDEIIYRDYCNIGVAVGTDKGLVVPVIRGAETMSFAALEQELVMLSKKARGGTLTVADMSGATFTITNGGVYGSLLSTPIINPPQSGILGMHAIQERPVVVNGNIEIRPMMYLALSYDHRIVDGQGAVTFLVRVKQYIEDPNRMSLEI

SEQ ID NO: 32968 - protein, 480 aa, Burkholderia xenovorans LB400
MSQFANYIDGQWVDGASVSRNVNPSNLDDVIGEFAQADAEQTQRAIRAARNAFAQWSLSTPQQRFDLLDQAGSTILARKAELGRLLAREEGKTLPEAIGEVGRAGQIFKFFAGEALRIGGEIVPSVRPGMTVEVTREPLGVIGLITPWNFPIAIPAWKIAPALAYGNTVVVKPADLVPASTWELVRIIAEAGAPAGVINLVMGQGAVVGEALVSSPQVDAVSFTGSVATGRAIGAKCFASGKKFQLEMGGKNPMVVLDDADLDVAVEACINGGFYSTGQRCTASSRFIVTEGIHDRFIDAMKARMQALKVGDALADGTHIGPVVDDKQLQQDERYIAIAREEGGTIFGGERIERDTRGYFLAPALITDTTPDMRINREEVFGPVASVIKVKDYNEALAVANDTEFGLSAGICTTSLKYSSHFRRHVQAGMVMVNTATAGVDYHVPFGGRKGSSYGPREQGSYAREFYTTVKTAYVSPGAV

SEQ ID NO: 32969 - protein, 129 aa, Anaplasma marginale str. St. Maries
MLGSQGDVGKIVVGEGSNIQDNTVVHTDQEYGDTEIGKFVTVGHGCILHACSLMDKTFVGMGCVIMDRALMEECSMLAAGSLLTRGKVVKSGELWGGRPAKYMRMLSDQELAYLQQSADGYIELSRSYL

SEQ ID NO: 32970 - protein, 268 aa, Zea mays
MGWSAGLWWLLAAVWVVVAAAATAEGEVAVGAAPRRHAYASMMYMGTPRDYEFYVATRVMMLSLRRLSPNADRVVIASLDVPPLWVQALKNDGVKVVSVENLKNPYEKQENFNRRFKLTLNKLYAWSLVSYERVVMLDSDNIFLQNTDELFQCGQFCAVFINPCIFHTGLFVLQPSMNVFKNMLHELSVGRENPDGADQGFLASYFPDLLDQPMFHPPANGTKLQGTYRLPLGYQMDASYYCECLQQNGYSTLSNILLVQTNRLDFQI

SEQ ID NO: 32971 - protein, 339 aa, Bacteroides fragilis YCH46
MLNLINSIVARAQANRQRIVLPEGTEERTLKAANQILTDEVADLILLGNPEEINAAAAKWGLGNINRATIIDPENHPKKEEYAQLLCELRKKKGMTIEEARKLVLDPLYLGCLIIKSGDADGQLAGARNTTGDVLRPALQIIKTSPGITCVSGAMLLLTHAPECGQNGLLVMGDVAVTPVPDASQLAQIAVCTARTAQAVAGIAEPKVAMLSFSTKGSAKHENVDKVVEALKLAKEMAPDLNIDGEMQADAALVPSVGASKAPGSPVAGEANVLIVPSLEVGNISYKLVQRLGHADAVGPILQGIARPVNDLSRGCSIEDVYRMIAITANQAIAAKNGK

SEQ ID NO: 32972 - protein, 68 aa, Picea sitchensis
MTTSRRLADRKSAKFQKNILKRGGVPETTMKKGNTYPVGPIVLGFFVFIVIGSSIFQIIRTASSGGTA

SEQ ID NO: 32973 - protein, 216 aa, Synechococcus sp. WH 7803
MTSIESRWHQLTSALPSGVNLLAVSKGHPADAIRDLVACGQLDFGESRVQEALPKQNALADLPQIRWHFIGRLQANKVRAVVKAFRWIHSIDSLALAERTSRIALEEQQQPTALLQVKLRDDPAKGGWEIDALKDAWPELQALQGLQISGLMTMAPLGVGAEDRSALFRECRHLADALGLEHCSMGMSGDWREAAAAGATWVRLGSVLFGPRQLPT

SEQ ID NO: 32974 - protein, 523 aa, Yarrowia lipolytica CLIB122
MSNALNLSLALGVFLLAYYGFSVIQYHIKTRKLEKKWKCGKPKDISRFPFSASFFIPFLVESKKNRLLEFVQWMFESQVYPGYTCKTTVFGVDMYHTVDPENLKAVLATQFKDFCLGERHAQFLPVLGNGIFTLDGQGWQHSRAMLRPQFARDQVSDVEMIEEHIQYMTSRIPKDGSAFDAQELFFNLTLDTATEFLFGQSVGSQTVETNPTAVPTDMPVHLRKSFQEDFNTAQEHLGQRARLQMFYWAWRPRELYSSGERVHAFVDHYVKKALEESEKHVDDGKYVFLRELAKETKDPIVLRDQALNILLAGRDTTASLLSWCLYLMARRPEVYAKLREEVIENLGDGEDLSTITFESLKRCDYLRYVLNEVLRLYPSVPANMRYATRDTTLPRGGGPDGMQPIVVRKGNLVSYHVFTTHRLKEFWGEDAEEFRPERWYEDGASQAKGWEYLPFNGGPRICLGQQYALTEAGYALARIAQLYDTIENADDKPEPPVKFHALTMCHHTGVLVKLYNSKTTKAQ

SEQ ID NO: 32975 - protein, 332 aa, Glycine max
  misc_feature (53)..(53): Xaa can be any naturally occurring amino acid
  misc_feature (137)..(137): Xaa can be any naturally occurring amino acid
MEVVSDEEAFLFGMELAGASAVSMVLKSALELGILETIAKAGPGAYLSPSHIXYNILTYSLHQLPHGKAERHYGLHPKAKYLVNNEGGVSVAAYFLMEHDKVLKDMWFHLTDSVKEGGHPFSNAYGMTAFEFHDTNXFNKLFNKGLSDISSITMKKILETYNGFEGVGSVVDVGGGTGAIINMVASKYPTTKCVNFDLPHVIKEAPAYTGVEHISGDMFVSVPKGDVIFMKWVCHDWNDEQCLKLLKNCYDSLPDDTGKVILAEGISPETPDSNLAARCEFQMDVIMLCHSPNGKEKTEKEYKALAKGAGFHGFRIASCVLNTHVMEFLKKA

SEQ ID NO: 32976 - protein, 272 aa, Synechococcus sp. WH 7803
MSFAVGVIGMGRMAQALVRPLVEGGSLRGSDLIAVVGREPSVAHLQSQLQSEITVISSSDPRMHEAWEAPVQLLAVKPQQLDQVAASVPTPPAGAAPLLISVLAGVTLERLQSTFPGRVCVRAVPNTPCLVAEGLCGLAWGCDVTSEQQAWVRRMFEPVSEVLELPESQLDAFLALTSSGPAYVALMAEAMADGAVAAGLPRDQALRLAQRTLAGTAALLDQQQLHPAQLKDMVASPGGTTIAALRVLEKAGLRSALIEAVVAATERGRALR

SEQ ID NO: 32977 - protein, 505 aa, Oryza sativa Japonica Group
MEAFVPGGAGAAAAAVGGFVAAAALAERAGVIAPRKRPNAPPAVPGLPIIGNLHQLKEKKPHQTFAKWAEIYGPIYTIRTGASSVVVLNSTEVAKEAMVAKFSSISTRKLSKALTVLTRDKSMVATSDYCDFHKMVKRYVMSSMLGTSAQKQFRDIRDMMIHNMLSTFHKLVKDDPHAPLIFRDVFKDELFRLSMIQSLGEDVSSVYVDEFGRDISKEEIYNATVTDMMMCAIEVDWRDFFPYLSWVPNKSFETRVFTTETRRTAVMRALIKQQKERIVRGEAKTCYLDFLLAENTLTDEQLMMLVWEALIEAADTTLVTTEWAMYELAKNPDKQERLYQEIREVCGDETVTEEHLPRLPYLNAVFHETLRRHSPVPLIPPRFVHEDTKLAGYDVPAGTEMVINLYGCNMNRKEWESPEEWVPERFAGGRLEVADMYKTMAFGAGRRACAGSLQATHIACAAVARFVQEFGWRLREGDEEKVDTVQLTAYKLHPLHVHLTRRGRM

SEQ ID NO: 32978 - protein, 328 aa, Artemisia annua
MGRIIVFQVLALCSLLVFPNIAFAQLKQNYYANICPNVESIVQKAVAAKVKQTFVTIPGTLRLFFHDCFVQGCDASVMIQSSGSNTAEKDHPDNLSLAGDGFDTVIKAKAAVDANPSCRNKVSCADILTMATRDVVKIAGGPSYSVELGRLDGLSSTAASVGGNLPKPNQNLDQLNALFAANGLTQADMIALSGAHTLGFSHCNQFSNRIYNFSKQNPVDPTLNPSYATQLQQQCPKNVDPRIAINMDPNTPRTFDNVYYKNLQNGQGLFTSDQVLFTDTRSKQTVISWANSPTAFNNAFITAMTKLGRVGVKTGTKGNIRKDCAAFN

SEQ ID NO: 32979 - protein, 163 aa, Oryza sativa
  misc_feature (25)..(25): Xaa can be any naturally occurring amino acid
  misc_feature (44)..(44): Xaa can be any naturally occurring amino acid
  misc_feature (63)..(63): Xaa can be any naturally occurring amino acid
NEFEDRGPTKDRPSVMVKPDGVPPXGLGGTITQRFEDKGLKLVXMKMVWPTEAHLKERSADLXASRPFFPGLVKYMSSGPVVPMVWEGLNAVKTGRVMLGETNPKDSAPGTIRGDFCVQVGRNIIHGSDSVESATKEIKLWFGDEKKKEVIAWASWAEKWIYE

SEQ ID NO: 32980 - protein, 185 aa, Haemophilus influenzae R2846
MKFNIPIFLTIFRVILIPFFVIAFYLPIESSPFITTLIFFIAGVTDWLDGYLARKWKQTTRFGAFLDPVADKVMVVVALVLIVEHQHTFWITIPAIIMISREIIISALREWMAELGERSKVAVSWWGKWKTTAQMLALGGLLWRYNNYMEIAAIILLYIAAILTIWSMIQYLQVAKGSLLDNIQL

SEQ ID NO: 32981 - protein, 256 aa, Haemophilus influenzae R2846
MARIDNYEQRFGGIGRLYTPDGLARLRQAHICVIGIGGVGSWVVEALARSGIGELTLIDMDDICVTNINRQLPAMSGTIGKLKTEVMSERVKLINSECTVNIIDDFISPENQSDYLNRDYDYVIDAIDNVKTKASLIAYCKRNKINVITIGGAGGQTDPTQIQIADLSKTIQDPLLAKVRSVLRKDYNFSQNPKRKFSIDAIFSTQPLIFPQMTEDCSISATMNCANGFGAATMITATFGFFAVSRVIDKLLKKKS

SEQ ID NO: 32982 - protein, 376 aa, Mycobacterium tuberculosis H37Rv
MSKAVLVLEDGRVFTGRPFGATGQALGEAVFSTGMSGYQETLTDPSYHRQIVVATAPQIGNTGWNGEDSESRGERIWVAGYAVRDPSPRASNWRATGTLEDELIRQRIVGIAGIDTRAVVRHLRSRGSMKAGVFSDGALAEPADLIARVRAQQSMLGADLAGEVSTAEPYVVEPDGPPGVSRFTVAALDLGIKTNTPRNFARRGIRCHVLPASTTFEQIAELNPHGVFLSNGPGDPATADHVVALTREVLGAGIPLFGICFGNQILGRALGLSTYKMVFGHRGINIPVVDHATGRVAVTAQNHGFALQGEAGQSFATPFGPAVVSHTCANDGVVEGVKLVDGRAFSVQYHPEAAAGPHDAEYLFDQFVELMAGEGR

SEQ ID NO: 32983 - protein, 325 aa, Blastopirellula marina DSM 3645
MDVVANKLNVESQAIAEEDLVREKRRKPILRPFLKTVAPWLGGLFLLAAAITIVDWALGWHLQVVARAPTVFAAVYVTNLIRYLVAAGGAFLLFYVLLRRTGWLTPIQKKLAETPDMRREIFYSIASLAIFAGVGVLVYLGKVAGILQFYYGGNPLGQFYFWFSVVAMILFHDAWFYWTHRLLHTKVLYSKVHRIHHLSHNPTPWAAFAFHPVEAFVQAIVLPIAAIFLPMHPLTVVFWMLYMTGMNVFGHLGFELFPSWFLRSRFSNWHNTGVHHNMHHRCVSSNYGLYFNLWDQWLGTNHPDYQAEFERVTAGCAESAIEEAD

SEQ ID NO: 32984 - protein, 120 aa, Brassica napus
  misc_feature (53)..(53): Xaa can be any naturally occurring amino acid
  misc_feature (59)..(59): Xaa can be any naturally occurring amino acid
  misc_feature (68)..(68): Xaa can be any naturally occurring amino acid
  misc_feature (81)..(81): Xaa can be any naturally occurring amino acid
  misc_feature (84)..(84): Xaa can be any naturally occurring amino acid
  misc_feature (89)..(89): Xaa can be any naturally occurring amino acid
  misc_feature (99)..(99): Xaa can be any naturally occurring amino acid
MATITVVKARQIFDSRGNPTVEVDVHTSTGVKVTAAVPSGASTGIYEALEASXKVGLTXLGKGVSKAXGNVNNIIGPALIXKDXTQQTXAIDNFMLHEXLMETQNEVRCSLNPFFGRLTI

SEQ ID NO: 32985 - protein, 378 aa, Archaeoglobus fulgidus DSM 4304
MEEVSSHVKSGKPVMILDSEKSAICIPAEVVSGEILNFMMKNCDEIRLALTWKQILNLGLNRFRFQNGNLIPIDPNLEKISAEERAKFIRELVSGNAGDIKYPGRIFVEETKEMGVLERPGIAEACVDLARMAGFAPSAVYAPLMTAEGGVAGEDYALKFAKEHSMPVFRIKDMIEFRIKSEKIVERVIEATLPTKFYGTFRAVGYKTPLGEIVALVKGRVDEGDVLVRIHSECLTGDVFHSLRCDCGDQLENALKMIDREGKGVAIYMRGHEGRGIGLINKLMAYKLQEEGKDTVDANIELGFPPDMRSYGIAAQILMDLKVKSIRLLTNNPLKIEELKKYGFKIVREPIEVEPCEVNLPYLKAKKDKMGHLICFND

SEQ ID NO: 32986 - protein, 494 aa, Magnaporthe grisea 70-15
MSGLAMQSTQLRMGEGAGAGAGAGPGLAPASSGAPGLGIEALYNNPMFAGGLGLAGIGAAAAVARRGVIRGAQLLRKNLLVNVEISRRDPSYPWVLAWLSQPRPAHGFLMSKLTRIRDLSVATATESSRTDPLGASDDATRASFFLQPGYGRHIIRHSDGTYIAVHREKQSTANHQTGEPHETVTLTTLWSHRHVFEHVFSEAHALAKSAQAGKTPVYNIQGMSWAQLGLPRRKRPLASVVFEKGLKEAIVEDVQDFLSRHQWYADRGIPYRRTYLLHGPPGSGKSSFIHALAGELDYNLAIVNLVERGLTDDKLANMLMRLPPRSILLLEDVDVAFGNRQEMSPDGYSGATVTYSGLLNVLDGMAAGEDRIAFLTTNYVERLDPALIRPGRVDVKVRVGEATPEQAAELWSRFYGDVDTSGSGRERFIAKLYKLGFFAEPAEGRMTLRVSAAAIQGLFLTNKEDMEGAISHMEAHLIPGHSHHGSELHRTTAQ

SEQ ID NO: 32987 - protein, 450 aa, Pseudomonas fluorescens PfO-1
MTGQSCGDFARRVSSLTSLSNSKKRNAKMSDLKTAALEYHANPRPGKLSVELTKATATARDLSLAYSPGVAEPVREIARDPELAYKYTGKGNLVAVISDGTAILGLGNLGPLASKPVMEGKGVLFKRFAGIDVFDIEVDSESPQAFIDTVKRISITFGGINLEDIKAPECFEIERALIEQCDIPVFHDDQHGTAIVTAAGMINALEIAGKTLADAKIVCLGAGAAAISCMKLLVSMGAKVENIFMVDRTGVIHAGRDDLNQYKAVFAHPTEKRTLDDAIEGADVFVGLSGPNLLSAEQLKRMAANPIVFACSNPDPEISPELAHATRNDVIMATGRSDYPNQVNNVLGFPFIFRGALDVRAKRINEEMKIAAANALRELAKLPVPQEVCDAYGGISLEFGREYIIPKPMDKRLITVISDAVAKAAIETGVATLPYPKNYPLKSVDDVFNG

SEQ ID NO: 32988 - protein, 285 aa, Zea mays
MPTSEVWSLSDFEISKYIAEGRFGKVYLAREKQSGYVVALKVIFKAKLKKHRFHAHLRREIEIQQSLDHPNVLRLFTWFHDEERVVLVLEYAARGELYKVLRAAGRFTERTSATYVASLAGALAYCHKKQVIHRDIKPENLLIDIEGRLKIADFGWAARSNAKRHTLCGTIDYLAPEMVEKKAHDHAVDNWTLGILCYEFLYGSPPFEADEQDDTLRRIVRVDLAFPSSPCVSSEAKDLISKLLVKDSSKRLCLEDIMKHPWIKKNADPSGSCIKQKDVTRSKLL

SEQ ID NO: 32989 - protein, 283 aa, Oryza sativa
KTVRLARTASAMAHLATVVLLLVAAARQAPLAAGDHSANPRLPTCAAAPDVAAPQEHGDGGGVGGGRRILDITHAVRAELPVLGSCDGVGALVRLKKSMANGSRSNLSELRMSVHTGTHVDAPGHMWQPHFDAGLDVDTLDLGLLNGPALLVDVPRHSNVTAEVMESLNIPRGVRRVLFRRMNTDKRLMWQKESDLSFVGFTEDGAQWLVGYTDIKLVGVDYLSVASYEHMIPAHVVFLKSKEIVIVEALKLDDVEPGMYMLHCLPLRLAGAEGSPVRCILIK

SEQ ID NO: 32990 - protein, 437 aa, Bacillus sp. SG-1
MNHYENLLNKIENKEAVIGVVGLGYVGLPLAVEKAKAGYKVIGFDVQQSRVDEVNKGVNYIGDVVDEDLVDMVKSGRLIATTDYAQIAEVDAVAICVPTPLDIYQQPDTSYVKSSSTEIAKYAKQGTLVVLESTTYPGTTEEIVKPTLEAKGYKTGEDIFIAYSPERVDPGNKQFKTKNTPKVVGGITEKCTAVAASLYKNVLEGDVFEVSSPAVAEMEKIFENTFRHINIALSNEMAILCEKMGIDVWEVIDAAKTKPYGFMAFYPGPGLGGHCIPIDPFYLTWKAREYNYHTRLIELAGEINNSMPEYVINRTMQILNEDGKALRGAKVTVMGVAYKKDIDDVRESPVLKIIEQLEAQGADYKVVDPYVTSFKAAGKTIETIEANRELLNDSDIVLLTTDHTDFNYEMIAKESNVIFDTRNALQNVEKPNKYIKL

SEQ ID NO: 32991 - protein, 943 aa, Physcomitrella patens subsp. patens
MYPIHCFCMSGGPQDHISRFIEPGASATYRRFYRWVEFPIKEDMKVDSPVLGGGGLGGSMADSFFSEDDSSIVTSSCHFSLCDAQENNLSLFGGDSVDDKADYSWDSCFGNLEDVDNLLSGIHACDLCVAFMLSPGNVFALDCTILGTRVGSDPESTFGRVSCSPATLQWADSASPLDLQSESELSGTKSSSVIDAGPGVNEKVDVFDLEMEFVPINAPLSIPCGGIGQNTTFIEAEFQPATSFESRLPNNHVQAELQSDPHSGAQANSSDCLDDAKIVCVGQVSDSFRSWEMMEVLTGSMATSESTENVSMGMDAPEDESGPSSVSVSDSEKVKVAQAQRARRHAVTRKRLEERSKRQLNHRKGFHGAGYGGPRTLHPMPMHMPAQVAHLNQPSTPNMHSYPVNPSNLSPAMQPMFRPGAPYMHGGYSPMHVMPQVAPPTGPAQLQGQGLYVGYPQPCAFPQPLPPYQHQLRPPGKVSVRPPPSTSTMTPQEKIEKLKLIQQMHARLAVEQQGQQFAAQGVAPLDTSGPRKGVTPMLPCVASKEVDVGVKLSETKMPVTESDTEPSLSVGQTVVDGVSDDEGGSLESAVLDQLQNTIKTHLELGTRICIRDALYRLARSAMRRQASGGRATADDTAKCSQASQDADATSTGLEASTNSDPSSLSRVSRMDMTMVETQTNPIDRSIAHLLFHKMQPQPNSAQVSPSDDGNRAGFQQTNTAGQVNGHAAWNQGTVAQGNWAGQKSQLNQTGDICPGIASSVDMVSAPSLPPPKVLMIPKSISRSQDDSVLRTVGSSEHQSGISSAVMKKSTSSGHLQGNVTGVVGMSVELPSSMGSQLQSRSDGEQLVRPTQNLTSSLRKESSKLKNGFQWKRLQHAVALKELSQVLAEDPDVASGPLCKEESGLAQSAPPVSPSSGSDECQAGGLSNLSKNLGDKDTSMDETV

SEQ ID NO: 32992 - protein, 423 aa, Zea mays
  misc_feature (313)..(313): Xaa can be any naturally occurring amino acid
MATNGYSNGGSTKGKPIKCKAAVAWGPGEPLVMQEVEVAPPARMEVRVKVLYTSICHTDLSFWRGENERQRRFPRILGHEAAGVVESVGEGVEDLAPGDHVVPIFNGECGTCAYCHSSATNLCGTYRVDAFKSTMVSDDGTRFSVVNTSGDTVPVYHFLNTSTFAEYTVLDAACAVKINPAAPLQKMCLLSCGASSGVGAVWNTANVSAGSTVAIFGLGAVGLAVAEGARLRGAARIIGVDINPEKFTKGREMGVTDFVDSRASDKPVHEVIREMTHGGVDYSFECTGINGVLREAFVSTHDVLRSICLLASXLASPLNFSNVLRCATHMQGWGLTVVLGIHATPKMLPLHPMELFDGRRITACVFGDVKGKSQLPAIVDKCVNGDLDINLDGFITHRMPFSDINKAIQLLEEGKSLRCVLNL

SEQ ID NO: 32993 - protein, 334 aa, Acidovorax sp. JS42
MTTALPASPSSVFASSPNPVVVITGASSGIGHATALAFARRGARLVLAARNPDTLAPVALACRAEGGQALGIPTDVTDADAVQALADKAVRHFGRIDVWINGVGVGAVGRFDDVPLAAHRRVIESNLLGHVHGAHAALTRFRAQGHGLLVNLISLGGWVPAPYAAAYTASKFGLRGLSESLRAEVVDLPQVHVCDVAPTFVDSPGLSHGANYTGRRIRPPLPMVDPRAVAQAIVDLAGAAHPRAVTWLGLGAMPGRVAHALAPQGTARAMRWFSDLGLRRAAPAPLTQGNLFAPSHQTSIDGGHRQRMAGSATVVTVLGVVGLAVGWWWGRGRR

SEQ ID NO: 32994 - protein, 202 aa, Brassica napus
MPVSVHSVIATNLATTGFYRNVSRRRIGSSSVNCSVETKEADRWAKLKNGNDSLEICRVLNGMWQTSGGWGKIDRNDAVEAMLRYADAGLSTFDMADHYGPAEDLYGIFINRVRRERPPEYLEKIKGLTKWVPPPVKMTSSYVRQNIDISRKRMDVASLDMLQFHWWDYANDGYLDALKHLTDLKEEGKIKTVALTNFDTKR

SEQ ID NO: 32995 - protein, 261 aa, Mycobacterium avium subsp. paratuberculosis K-10
MTCTPNGAISSHAEVQRWRRRGIPAPGSVKRVSRAELDKNPRDVASMFDGVARRYDLTNTVLSLGQDRYWRKATRSALGIGPGQKVLDLAAGTAVSTVELNKSGAWCVAADFSVGMLAAGAARRVPKVAGDATRLPFADDVFDAVTISFGLRNVVDTQAALREMARVTRPGGRLVVCEFSTPSNALFATVYKEYLMRALPRVARAVSSNPDAYVYLAESIRAWPDQAALADQIAGAGWAGVRWRNLTGGIVALHAAHRPPR

SEQ ID NO: 32996 - protein, 346 aa, Arabidopsis thaliana
MGRFKNNKKSRVIGKPIAKKNQEDVSHVTGDKIPKSFVFSRMKLAGPVKQLQMDLRKLMLPYTALSLKEKKRNTLRDFLNVSGPMGVTHFLMLSKTASSLSLRVARTPQGPTLTFKIHQYSLASDIAQSQLRPRCPQDLFKSPPLIVLSGFGSQELHLKLATIMFQNIFPAIDINTVKLSTCQRLVLLNYNKDTKLIDFRHYSIRLQPVGVSRRIRKFVQNHQVPDLRNLQDVSDFVTKAGYGSESEGDEEAATVTLSSDLGRVNKGATKSAVKLQEIGPRMTMQLVKVEEGLCTGGIIFSEYEDVDGKKEKLKKKQDEEEEEDSEEEGEEGSEEDGEDMDEDFED

SEQ ID NO: 32997 - protein, 462 aa, Bacillus anthracis str. Sterne
MHRENSMYSYIFYCIFLCEKEMKITIIGTGYVGLITGVGLAVLGHSVTCFDINDEKIERIKQGDLPIYEAGLYELIHDACENNRLTFTTSKEEAFKDAEFIFIAVGTPSLLDGTADLTYIQNACVDIGTYATKDIIVVTKSTVPVGTNGAMRGWIEETLQNRHELHIVSNPEFLREGSGIYDFFQGDRIVIGADNEEAARKVENLYSELHLKTYVTDIKSAEMIKYASNAFLATKISFINEISNICEKVGANVLDVAKGMGMDKRIGASFLNAGIGYGGSCFPKDTKALVQIAGNVAHDFRLLKAVIEVNNKQQLLLIEKAKKVINMNKKRIAVLGAAFKPNTDDIRDAPSLIMIQELINLGADIVLYDPKAIQNMKNIFGETIQYSECIDESIRGASAAFIMTEWEDIRTYPLENYVQLMREPILFDGRNCYTNEDVKKQGIDYYSVGRESIYKRDFSVIR

SEQ ID NO: 32998 - protein, 660 aa, Hordeum vulgare subsp. vulgare
MPRTVSDGGEDFDGDVCSQTASQRHTDSTHHHHGYKVGFPPAKGVFAEFAEGVKETFFADDPLREYKDQPRSKKLWLSLVHLFPVLDWSRSYTFGKFKGDLVAGLTIASLCIPQDIGYAKLANLQPHVGLYSSFVPPLIYALMGSSRDIAIGPVAVVSLLLATLLQEEIDPVKNPLEYSRLAFTATFFAGITQAMLGFFRLGFIIEFLSHAAIVGFMAGAAITIALQQLKGLLGIAKFTKKSDIISVMESVWGNVQHGWNWQTILIGSSFLAFLLTTKYIAKKNKKLFWVSAIAPLISVVISTFCVYITRADNQGVAIVRNIKQGINPPSFDLIYWSGPYLAKGFRIGVVSGMVALTEAIAIGRTFAAMKDYQIDGNKEMVALGTMNIVGSMTSCYVATGSFSRSAVNYMAGCKTAVSNVVMAIVVMLTLLLITPLFKYTPNAILASIIINAVVNLVDYETAYLIWKVDKMDFVALLGAFFGVVFASVEYGLLIAVAISLGKILLQVTRPRTALLGNLPRTTIYRNVEQYPEATKVPGVMIVRVDSAIYFTNSNYVKERILRWLRDEEEQQQEQKLSKTEFLIVELSPVTDIDTSGIHALEELLKALEKRKIQLILANPGPAVIQKLRSAKFTDLIGDDKIFLSVGDAVKKFAPKSSLNV

SEQ ID NO: 32999 - protein, 222 aa, Oryza sativa
  misc_feature (62)..(62): Xaa can be any naturally occurring amino acid
  misc_feature (75)..(75): Xaa can be any naturally occurring amino acid
  misc_feature (80)..(80): Xaa can be any naturally occurring amino acid
  misc_feature (82)..(83): Xaa can be any naturally occurring amino acid
  misc_feature (117)..(117): Xaa can be any naturally occurring amino acid
KKKKKKMSTVTRAYLDQKLALAKRCSREATLAGAKAAAVATVASAVPTLASVRMLPWAKANXNPTGQALIICTVXGMAYXVXXDKKILSLGRKRELCPMAHRPDLGEHLFSGYRSSXTQPLSWGIGRKRVGRREEEEEAGSEEGGDRRRAARGEEKVGCDGVRVGHQREQGAVLRLLAGLQRVYEPLPPAHRLRPPPGGLPRVPPPLQGVPAQEQNLQGGAT

SEQ ID NO: 33000 - protein, 180 aa, Anaplasma marginale str. St. Maries
MRKVLPNMLTIFRVLAIPAVVSSFYVGCGCARYVTLAIFLLACATDFLDGYLARMWRAQSKFGRLFDPVADKLIVLSAFIMLVYVGQITGLSVACVVVIVCREVLVSGMREFFIAAGTSLPVSGMGKLKTVMQMTATGVLIVGDGGVVTRIGEFLLWVAAALSVYSMYLYTRTAVEKTGI

SEQ ID NO: 33001 - protein, 564 aa, Prochlorococcus marinus str. NATL1A
MSSTEAMPKTRTFSEFAKQADYSLMDSLEADPQATDDGDDHLTREVFSGHYVPVTPTPISKPEYVTHSKTLFNELGLSQELALDELFRRLFSGDISVATAPMRPVGWATGYALSIYGTEYTQQCPFGTGNGYGDGRAISVFEGLFNGKRWEMQLKGGGPTPYCRGADGRAVLRSSVREFLAQDYMQSLGVPTSRSLTLYASRAETVRRPWYTKDSNSINPDILVETPAAISTRVAPSFLRVGQIELFARRVRNNEHQDAMKELEMIVKHLIVRNYKKEIDPTLSLSNQVVELSNSFRERLTSLVANWMRVGYCQGNFNSDNCAAGGFTLDYGPFGFCELFDPRFQPWTGGGEHFAFFNQQVAAETNFQMFCGALRPLLNGNAESLERLDSIRNGFTTVMNQKMERMWAKKLGLVTYDAPLVNEMLRLMVHTKVDYTIFFRKLSSIPNKLTDLKDSFYLPISEETESKWISWLQRWREQVISKGDQNEISAKMKSINPKYTWREWLITPAYEKAEEGDYGLIKELQAVLDKPYEEQSSKVQKKYDRLKPKKFFGAGGVSHYSCSS

SEQ ID NO: 33002 - protein, 449 aa, Synechococcus sp. WH 7803
MATHDIFMPALSSTMTEGKIVEWLKKPGDKVARGESVLVVESDKADMDVESFNDGFLASVLMPAGSTAPVGETIGLIVESEAEIAEAQAKAPSGGAAAPASAPAAAAAPPAAPSAPTPVPSAPVSSPPPATAPPAPAAVPAPAPTGTGRLIVSPRAKKLAAQMGVDLSSLRGSGPNGRIQAEDVERAAGRPVSVPQVGEGTAPAALAGGAVPAPPSAPAGNSFGRPGETVPFNTLQAAVNRNMEASLAVPSFRVGYTITTDKLDAFYKQVKPKGVTMTALLAKAVAVTLARHPQVNAATTQAGMAYPADVNVAVAVAMEDGGLITPVLRQADRIDLYELSRQWGDLVKRSRSKQLQPEEYSTGTFTLSNLGMFGVDRFDAILPPGTGAILAVAASRPTVVAAKDGSIAVKRQMQVNLTADHRVIYGADGAAFLKDLAELIEMRPESLAL

SEQ ID NO: 33003 - protein, 77 aa, Aeropyrum pernix K1
MLPPVRCFTCGRPLGHLWPRFRELVASGKTPGEALDELGVDRYCCRRTLFTSVTYIEHAAKYRVGIHVPPERLKMWG

SEQ ID NO: 33004 - protein, 417 aa, Oryza sativa Indica Group
MAAAASAPPAPADTLPKGADSFFRTVISNMEKVYLSRNPTAKTILELVRSYDGDHICYDHFAFRTFGVDGYGIKSLAEFFTDFGYVPREELRFPAKKLRALWFSPPTNDGYTGTGVYGPLPRIFISELLVDELSPQSQDIIQKYIRTSGKGNKHATLASTSGELTWEKPIYSDFQVLSRESEYAAWTLVNGYALNHTTISTHRLISDIRSINKFNKFVEDNGFKLNSEGGILKVSPDGLLQQSSTVADSALFTFADGITESIPRSYIEFAERLVLPQFKDLPNDEPIPVLMTTSYHKIVYFRGHPEQQQFKAAFCYLEVQDRCVRWCFPQMLVFDRRIIIWQHQICDLLGGINVAELQPRETLALFRMSILYSCHNPFMNFYRYLHIGSSALMTSSVVPNTYNGHSPQDRGSLVGIG

SEQ ID NO: 33005 - protein, 325 aa, Gibberella zeae PH-1
MQRAAYAQSPPLHHPVPQHVSTVPQLRSPPPPPGSAQSQQGYAANAGGNPYQQQGGNSGNVFGAYGNFMNDPTAQVAAQFGQTAFRHGQEYVEQNLGRYVNVSALKHYFNVSNSYVVNKLFLVLFPWRHKPWSRKQAVGQNGQDGWYLPPRDDINSPDMYIPVMALVTYILLSTLIAGLNHQFQPELLGKTATISLIVVIVEIFFLKLGCYLLSISSQSQLLDLIAYSGYKFVGIIVTVVVAEILNGGKGTGGWVGWLIFFYTYLANSLFLMRSLKYVLLPETAAGVSGGPMQTDSRAKRSQRTKFLFMYSYFVQLFFMWILTRA

SEQ ID NO: 33006 - protein, 546 aa, Ralstonia eutropha JMP134
MTGVTSRKGQTMPTLETKLNARSESFKSNAEAMQALVADLKAKVAKLAEGGGDAARDKHLSRGKLLPRDRVQQLLDPGTPFLELSQLAAYDMYDNAAPGAGIITGIGRVAGQECVIVCNDATVKGGTYYPMTVKKHVRAQEIAEQNNLPCIYLVDSGGANLPNQDDVFPDRDHFGRIFYNQANLSKQGIPQIAVVMGSCTAGGAYVPAMSDESIIVKNQGTIFLGGPPLVKAATGEEVTAEDLGGADVHTRLSGVADYFAQNDHHALSLARNIVQHLNRRKPDQIRLHEPADPLYPVEELYGVIPTDTRKPFDVREVIARIVDGSEFDEFKARYGTTLVCGFARIWGYPVGIIANNGILFSESALKGAHFIELCCQRKIPLVFLQNITGFMVGRKYENEGIARNGAKMVTAVATAQVPKFTVIIGGSFGAGNYGMCGRAYSPRFLWMWPNARISVMGGEQAASVLATVRRDGIEAKGGNWSAEEEEAFKQPIRDQYEHQGHPYYASARLWDDGVIDPAQTRTVLGLGLSASLNAPIDDMKFGVFRM

SEQ ID NO: 33007 - protein, 644 aa, Oryza sativa Indica Group
MADGGEMDEEAMRAFFPMSFGKAPTRAGAAASAHASTLRKPPQNPSAKPSTSSAAAAAAAGDDDDDDDGPMVGPPRPPPQPAGGGEGEDDEEGGGVMIGPPRPPPRSSSRGEGEDADGGMIGPPRPPPVKDDDEEDEDDDDDDDDDGDDSDDEMEDDGERYNRIPLSNEVVLRGHTKVVSALAVDHTGSRVLSGSYDYTVRMYDFQGMNSKLQSFRQLEPFEGHQVRSLSWSPTSDRFLCVTGSAQAKIYDRDGLTLGEFIKGDMYIRDLKNTKGHISGLTGGEWNPKSKETILTSSEDGSIRLWDVSDFKSQKQVIKPKLARPMRIPVTSCAWDHEGKRIVGGIGDGSIQLWTVKTGWGSRPDIHVEKTHTEDITGVKFSTDGQILLSRSMDSTLKIWDLRKMKTPLKVFEDLPNHYAETNVAFSPDEQLIFTGTSIEKDGENGGLLCFFDRRKLELVSRVGISPHYSVIRCLWHPRINQVFATVGDKKEGGTHILHDPSISQRGALVCVGRAPRKKSVDDFEVQPVIHNPHALPLFRDQPSRKRQREKILKDPLKSHKPEAPVNGPGFGGRVGTTKGSLLTQYLLKEGGLIKETWMDEDPREAILKYADAAEKDPKFIAPAYSQTQPKPVFAESDSEGEEKK

SEQ ID NO: 33008 - protein, 103 aa, Candida glabrata CBS 138
MVKQITSVSEFDSAIAVDKLVVVDFFATWCGPCKMIAPMIEKFAAEYSTADFYKLDVDELPEVAQKNEVSAMPTLVLFKNGKEVAKVVGANPAAIKQAIANNV

SEQ ID NO: 33009 - protein, 229 aa, Oryza sativa Indica Group
MADGGEMDEEAMRAFFPMSFGKAPTRAGAAASAHASTLRKPPQNPSAKPSTSSAAAAAAAGDDDDDDDDDDDEGPMVGPPRPPPQPAGGGEGEDDEEGGGLWTVKTGWGSRPDIHVEKTHTEDITGVKFSTDGQILLSRSMDSTLKVFATVGDKKEGGTHILYDPSISQRGALEGGLIKETWMDEDPREAILKYADAAEKDPKFIAPAYSQTQPKPVFAESDSEGEEKK

SEQ ID NO: 33010 - protein, 359 aa, Triticum aestivum
  misc_feature (151)..(151): Xaa can be any naturally occurring amino acid
  misc_feature (174)..(174): Xaa can be any naturally occurring amino acid
  misc_feature (233)..(233): Xaa can be any naturally occurring amino acid
NKFVQKSRLVPVRNSRDIVDPRVRAAAAMAAEEAAASAATNFEVDLGHLLAYDPSHHLAAAAASSRAELREECLRKATELAQAVANALFSLPATEGRDGPVVRLPPPANRLPREKHLPRPKPPTKWEQFAKSKGIIKHKKNKRAWDEQTNXWKRTYGYDRVNDDRDVPIIEAKXPDEPGVDPFAQRREEKKGRVDKQEKNRLGNLKNAAKVGALPSHIQLAGTFRAPPRNLRXSALEKAKKEDLENVAGMASAATASGGKFDKKLPGEKPLKKAGKNRKFLPVVEGKGMGNLEKQQNDKILNSLLAKNFEEPLDVSKAITMYKVKKDNKRRKDKQSSSSGSNKLKPQKKIHKKSSKKSA

SEQ ID NO: 33011 - protein, 559 aa, Vitis vinifera
  misc_feature (195)..(195): Xaa can be any naturally occurring amino acid
  misc_feature (276)..(278): Xaa can be any naturally occurring amino acid
MAAATSLSTPRLTFSSPKLQTLYRNFPISLSLNFSSSLSHSKTLTVAPGSLSQRPSSFSPRRCFAVRAESENGAEPRHYDFDLFTIGAGSGGVRASRFAANFGSSVAVCELPFATISSETTGGVGGTCVLRGCVPKKLLVYASKFSHEFDESGGFGWKFEAEPKHDWSTLMANKNAELQRLTGIYKNILKNAGVXLIEGRGKIVDPHTVDVDGKLYTARHILIAVGGRPFIPEIPGSEHAIDSDAALDLPSKPKKIGIVGGGYIALEFAGIFNGLXXXVHVFIRQKKVLRGFDEDVRDFVAEQMSLRGIEFHTEESPQAILKSADGSLSLKTNKGTVEGFSHIMFATGRRPNTKNLGLETVGVKMTKTGAIEVDEFSRTSVPSIWAVGDVTDRINLTPVALMEGGALAKTLFGNEPTKPDYRAVPSAVFSQPPIGQVGLTEEQAIQKYGDIDVYTANFRPLKATLSGLPDRVFMKLIVCAKTNKVLGLHMCGEDSPEIVQGFAVAVRAGLTKADFDATVGIHPTAAEELVTMRTPTRKIRNSSPPEGKTDPEVKAAAGV

SEQ ID NO: 33012 - protein, 513 aa, Haemophilus influenzae R2846
MKNLLTNPQPSQSDYINAIVKLGSRVYEAAQVTPLQKMGKLSERLHNNIWIKREDRQPVNSFKLRGAYAMISSLSAEQKAAGVIAASAGNHAQGVALSAKQLGLKALIVMPQNTPSIKVDAVRGFGGEVLLHGANFDEAKAKAIELSKEKNMTFIPPFDHPLVIAGQGTLAMEMLQQVADLDYVFVQVGGGGLAAGVAILLKQFMPEIKIIGVESKDSACLKAALDKGEPTDLTHVGLFADGVAVKRIGDETFRLCQQYLDDMVLVDSDEVCAAMKDLFENVRAVAEPSGALGLAGLKKYVKQNHIEGKNMAAILSGANLNFHTLRYVSERCEIGENREALLAVTMPEQPGSFLKFAYVLGNRAVTEFSYRYADDKRACVFVGVRTTNEQEKADIIADLTKNGFDVEDMSDDDIAKTHVRYLMGGRASNDNERLYTFEFPEQKGALLKFLETLQNRWNISLFHYRAHGADYGNILAGFQIEQREQAEFEQVLAQLNYVFEDVTESKSYRYFLR

SEQ ID NO: 33013 - protein, 100 aa, Glycine max
SYMQSISQALQNVESSIHERSSSFNQVGPLVSLQGKIAIRFVFNMYDTMANVEGAQGALLKYLNSICYNGWFMIKILFVLIFFIYGCTFFLLASRHLGVE

SEQ ID NO: 33014 - protein, 56 aa, Brassica napus
MGSYVEQARENHVKKKVEEALRSKMKAKALNECDQYVSKYAECATGRTFSVVWTCR

SEQ ID NO: 33015 - protein, 195 aa, Bacillus cereus G9241
MILMIDNYDSFTFNLVQFLGELGQDLVVKRNDEVTISDIENMKPDFLMISPGPCSPNEAGISMEVIRYFAGKIPIFGVCLGHQSIAQVFGGEVVRAERLMHGKTSLMHHDEKTIFSDIPNPFTATRYHSLIVKKETLPDCLEVTSWTEEGEIMALRHTTLPIEGVQFHPESIMTSHGKELLQNFIRKYSPSVTSC

SEQ ID NO: 33016 - protein, 319 aa, Mycobacterium tuberculosis H37Rv
MTEPTVARPDIDPVLKMLLDTFPVTFTAADGVEVARARLRQLKTPPELLPELRIEERTVGYDGLTDIPVRVYWPPVVRDNLPVVVYYHGGGWSLGGLDTHDPVARAHAVGAQAIVVSVDYRLAPEHPYPAGIDDSWAALRWVGENAAELGGDPSRIAVAGDSAGGNISAVMAQLARDVGGPPLVFQLLWYPTTMADLSLPSFTENADAPILDRDVIDAFLAWYVPGLDISDHTMLPTTLAPGNADLSGLPPAFIGTAEHDPLRDDGACYAELLTAAGVSVELSNEPTMVHGYVNFALVVPAAAEATGRGLAALKRALHA

SEQ ID NO: 33017 - protein, 828 aa, Aspergillus nidulans FGSC A4
MLSSLTAAMTAEFAPDLSSSSCFPPRPSNLLDSPSDSTTSASGARRNSQLSFEQLYRNAYSIVKIQRAEDLYERTKELEKEWLCGEVQKRVVAAITPRLLLAKEAVDMQDQFTEATERRETGERFLSALSEVWEDHQICMKMITDVLMYMDRVVALRKVSIYAAAMALFRDHVLRSPVSSSNNAVVADVLKSTVLFMIQLERSGHMIDRALIHSCIKMLEGLYETEAEEESSKLYLTSFEPDYLEASAAFYRAEGKRLLETVDAATFCAVVSARIAEEKERCQYTISLLSESKIKEIVDNELIRNNLAEVVNFEGTGVRVMLDHDRIDNLSKIYALSARVDPKKTHLTAAVQKRIVEMGNEINNASFALAQAPAQPKSTGTDAGQKKEKEKEKPVNQVTSSAIKWVDDILALKKKFDGIWKDAFGSDQVLQSAITASFSSFLNSTPRSSEFLSLFFDENLKKGVKGKTDNEVDALLENGITLLRYIKDKDRFEAYYKKHLSRRLLMKRSMSMDAERQMISKMKMEVGNQFTQRLEAMFRDMTISEDLTASYKQFVREQGDPDKKRFELDINVLTSTMWPMEIMSSSRDGQVELPCIIPKEVETVKQSFEKFYLDKHSGRKLSWQPSMGTADIKATFHRSNGKVQRHELNVSTYAMFILLLFNDIPIGESLTFEEIQARTRIPDNDLIRNLQSLAVAPKTRVLKKVPMSRDVKPTDKFYFNNDFQSPFMKVRIGVVSGGANKVESQDQRKETEEKMNNERGGSIEAAIVRIMKQRKTLIHSNLISEVLSQLSARFVPDVNMVKRRIESLIDREYLERVSEDPPTYGYVA

SEQ ID NO: 33018 - protein, 320 aa, Mycobacterium tuberculosis H37Rv
MPSLDNTADEKPAIDPILLKVLDAVPFRLSIDDGIEAVRQRLRDLPRQPVHPELRVVDLAIDGPAGPIGTRIYWPPTCPDQAEAPVVLYFHGGGFVMGDLDTHDGTCRQHAVGADAIVVSVDYRLAPEHPYPAAIEDAWAATRWVAEHGRQVGADLGRIAVAGDSAGGTIAAVIAQRARDMGGPPIVFQLLWYPSTLWDQSLPSLAENADAPILDVKAIAAFSRWYAGEIDLHNPPAPMAPGRAENLADLPPAYIAVAGYDPLRDDGIRYGELLAAAGVPVEVHNAQTLVHGYVGYAGVVPAATEATNRGLVALRVVLHG

SEQ ID NO: 33019 - protein, 503 aa, Kluyveromyces lactis NRRL Y-1140
MSVPIVPTDFAHAPKLEQLKNEFVECYDTDDSRKFFITRSPGRVNLIGEHIDYCQFSVLPMAIENDLMLACRLTSESENPSITLTNHDSNFAQRKFDLPLDGSLIEIDPSVSDWSNYFKCGLLVAQQFLQEKYNFKGPVHGMEIYVKGDIPSGGGLSSSAAFICAVSLAIIYSNVPAGTPILKDELTKTTAVAEHHVGVNNGGMDQAASICGIEGHALYVEFKPELKATPFKFPEDLPISFLIANTLVVSNKAETGPVNYNLRVVEVTVAANVLAQKFGVTLQTEGNLGKGTLRNFMDSYYTKYDKSCRKPWDGEIQTGIERLNKMLQLVEETLDPNGYTLDHAVELCGCESISQFTELYLTNFPVRFQRLKLFQRAKHVYSEALRVLKALQLFQKGESNFFEEFGALMNESQESCDKLYECSCPETDSICEIALKNGSFGSRLTGAGWGGCTVHLCSTDTVDSVKSALTEQYYNLRFPELTAEELEDAIIISKPSLGSVLYE

SEQ ID NO: 33020 - protein, 151 aa, Zea mays
MRTSARRRRGTRPRSRACRRGTSPSRRPRTATPTCASTGDTSAALSAYCAAAGIPAIVFLPANRISLEQLIQPIANGATVLSLDTDFDGCMRLIREVTAELPIYLANSLNSLRLEGQKTAAIEILQQFDWEVPDWVIVPGGNLGNIYALYK

SEQ ID NO: 33021 - protein, 112 aa, Bacillus cereus G9241
MEFYGYHGVFPEENKLGQRFKVDLTVELDLKRAGESDDLEHSVNYGELFELCRKVVEDRTYKLVESIAENIATDILKQYESISRCTIKVIKPDPPIPGHYRAVAVEITRERP

SEQ ID NO: 33022 - protein, 472 aa, Pseudomonas fluorescens PfO-1
MAERLNNDFQFIDVGRKDPKKKLLRQRKKEFVEIYEPFKPQQSADQAHRCLGCGNPYCEWKCPVHNFIPNWLKLVAEGNILQAAELSHQTNTLPEVCGRVCPQDRLCEGACTLNDGFGAVTIGSVEKYITDTAFAMGWRPDMSKVKPTGKRVAIIGAGPAGLGCADVLVRGGVTPVVFDKNPEIGGLLTFGIPEFKLEKTVLSNRREVFTGMGIEFRLNTEVGKDVTMEQLLAEYDAVFMGMGTYTYMKGGFAGEDLPGVYDALDFLIANVNRNLGFEKSPEDFVDMKGKKVVVLGGGDTAMDCNRTSIRQGAKSVTCAYRRDEANMPGSRKEVKNAKEEGVKFLYNRQPIAIVGEDKVEGVKVVETRLGEPDARGRRSPEPIPGSEEIIPADAVVIAFGFRPSPAPWFEQFEIQTDSQGRVVAPEQGQYKHQTSNPKIFAGGDMVRGSDLVVTAIFEGRNAAEGILDYLGV

SEQ ID NO: 33023 - protein, 688 aa, Kluyveromyces lactis NRRL Y-1140
MSEDKYCLVTGGAGYIGSHTVVELCEAGYKCIVVDNLSNSSYESVARMELLTGQEIKFAKIDLCELEPLNKLFDDYKIDSVLHFAGLKAVGESTQIPLTYYFNNIVGTINLLECMKSHDVKKLVFSSSATVYGDATRFENMIPIPETCPTGPTNPYGKTKLTIEDMMRDLHFSDKSFSFAILRYFNPIGAHPSGVIGEDPLGIPNNLLPFMAQVAIGRRPKLYVFGDDYDSVDGTPIRDYIHVVDLAKGHLAALKYLEKYAGTCREWNLGTGHGTTVLQMYRAFCDAIGFNFEYVVTARRDGDVLNLTAKCDRATNELEWKTELDVNKACVDLWKWTQDNPFGYQIKGVDSKFFGDKGDFSSRVVSLGKGTSFEVKLANLGATIVDIVVNGCSVVASLDNETEYKDQSNPFFGATVGPYANRIANGTFEINGKRIQLTVSKEDGNVVHSGINSYHSKKFLGPIVKNPEAHIWTADFKYVDEETEFPARLSTLVRYKVDSEKKTLTVEYESKVAGQGSTGANITNHTYFNLNKFNEATIKGSKVQLIDNTGLEVNNKLLPTGNLKKYTQVATFNDSPTEITEKEPVLDFCFVSGLPAKLDTRSSPLTPVFKLSNEDAKLEVEVATTEPTFQVYTGDYVDVKDKYENRAGICCEPGRYIDAVNNPEWKSSVVLPAGETYGHKLSYTFRTL

SEQ ID NO: 33024 - protein, 182 aa, Idiomarina loihiensis L2TR
MADIRSYCEYEPVIGERVYLDPSSVIVGNITIGDDSSVWPMVAARGDVNRITIGKRSNIQDGTVLHVTRKSKANPDGHPLVIGDEVTVGHHCMLHGCKLGNRILVGMSAVIMDDVVIEDDVIIGAGSLVPPGKRLESGYLYVGSPVEKKRRLNSGEENFLSQSAQNYVDLKDDYLLQVSPVS

SEQ ID NO: 33025 - protein, 505 aa, Triticum aestivum
MEIELWLIWATLAVVSLLYYLANPTRRAGTGGGRIPPGPTPLPLVGNLLCLRRGNLHHTLARLARAHGPVMTLRLGLTTAVVVSSRDAAREAFTRHDRRLAARAVPDAARGLGFADRSMLWLPSSDPLWKSLRGIVAAHAFSPRALAAARGVRERKVRDMVSYFRGCAGTEVDVGQAMYAGVLNLVSSALCSVDVVDMGAAESGQGVRELVEDLVAVIAKPNVSDLVPFLRRLDLQGWRRWSAIRIGKIFRILDGIIDSRMAFNTSTEEKHGDFLDVLLELFSTGKIARDSLTTILFDLFTAGSDTMAITVEWAMAELLRNPGVMAKVRAEIDDTLGGKETIVETDVAGLPYLQAVLKEAMRLHPVAPILLPHRAEEEGVEIGGYAVPKGSTVIFNVWAIMRDPAAWERPDEFVPERFLGRAEADQVLDFRGKAFEFIPFGSGRRLCPGVPMAERVVPFILASLLRAFEWRLPDGMSAEELDVSERFTTANVMAVPLKAVPVVVT

SEQ ID NO: 33026 - protein, 480 aa, Pseudomonas putida GB-1
MTIPCDILVFGGTGDLALHKLLPALYHLYREARLNNAVRIIALARRNISRNEYLKLAERHCRAQIARTDFDEDVWQRFAARLDYFPMDASQSADFGRLARYLGEPGGLTRVFYLATAPSLFVPIANHLRISGLADSEARIVLEKPIGHSQHSATAINEAIGAVFEEPQVFRIDHYLGKETVQNLMALRFANALLEPVWRNGQVDHVQISACETLGVENRGGYYDRAGATRDMLQNHLLQLLCLVAMEPPAQFEAEAVRDEKVKVLRALKPITGQDVQDKTVRGQYGAGYIGGQEVPAYYFEKDVDNDSDTETFVAVQAHIDNWRWAGVPFYLRTGKRMARRTSQIVIQFKPVPHELFSGGQVNQLLIQLQPDERISLRMMTKSPGKGMRLEPVDLDLNLAQVFGQTRRWGAYERLLLDILEGDSTLFMRRDEVEAAWAWVDPIIKGWEEHFQAPRHYPAGNNGPEQANSLLARHGRHWHS

SEQ ID NO: 33027 - protein, 367 aa, Aspergillus nidulans FGSC A4
MTPTLIAALLLVLAILITRFLKPNSLRSVAKFKSSQKPSEIISLRVYPIKSCRGFEIKVAKQCMTGLDLDRRWMLVDEKTHVFLTIRQIPEMTLINTGLSENGESLVLSVKPASSEKSETISIPAHPSQTWLAEHTTLATDIKIWDTTTDGYVYGESVGINQLFSKFLNRPVVLVYKGPTPRVLKGNGDPRLLGRVQNTNFPDVLPVLVASQASIDELNERLKAQGHEEITIERFRPNIIIRGHKGDAWVEDSWKTVRIGNSRTAHAGPGVEKSAAGAGLEEEDGLTYDIVARCGRCQVPNVDPETAQKHKTQPWDTMMSYRRVDEGLKYKPCFGMLGVPRSEGEIRVGMKFEVLEETSEHFYIKGF

SEQ ID NO: 33028 - protein, 286 aa, Bacillus sp. SG-1
MIKKAVIPAAGLGTRFLPATKAQPKEMLPIVDKPTIQYIIEEAVKSGIEDIIIVTGRSKRAIEDHFDKSVELEMLLERTGKHEMLEIVESISNLVDIHYVRQKEPLGLGHAVLCAKKFIGDEPFAVLLGDDIIDNEVPALKQMMDQYNIVQSSILGVNEVPRSEVDKYGIVSYQEQQGELYKVDSLVEKPAVEDAPSTQAIVGRYILSPTIFETLETVKPDKKGEIQLTEAIDKLLDKEDIYSYILQGNRYDVGDKFGFLQASIDFALKREDLSEKLKSYLKNIEK

SEQ ID NO: 33029 - protein, 169 aa, Ralstonia eutropha JMP134
MMPFDIRVGQGYDVHALVPGRKLILGGVHIPHDRGLLGHSDADALLHAITDALFGAAGLGDIGRHFPDTDAQFAGADSRVLLREAARRVREAGYEIGNVDASVIAQQPKLAPHIPGMVANIADDLGLPATRCNVKAKTNEKLGFEGRQEGIVAQAAVLIWRGAIADAQD

SEQ ID NO: 33030 - protein, 337 aa, Burkholderia vietnamiensis G4
MSIARRTTLSKFLIEQQRETNNLPADLRLLIEVVARACKAISYNVSKGALGDALGTAGSENVQGEVQKKLDILSNEILLDANEWGGNLAAMASEEMETFFPIPANYPRGEYLLVFDPLDGSSNIDVNVSIGTIFSVLRCPHGKQATEESFLQPGTEQVAAGYAVYGPQSVFVLTTGNGVNCFTLDREVGSWVLTQSNMQIPADTREYAINASNARHWYEPVQRYVSELNAGKEGPRGDNFNMRWIASMVADVHRILNRGGIFMYPADKRTPDRPGKLRLMYEANPMSFIVEQAGGAATTGTQRIMEVQPTGLHQRVPVFLGSKNEVERVTAYHNEGK

SEQ ID NO: 33031 - protein, 249 aa, Dechloromonas aromatica RCB
MFRHLREDIRAVFDRDPAARSSWEVLTCYPGIHALIMHRLAHWLWGHRLRWLARFTAHISRMLTGIEIHPGATIGRRFFIDHGMGVVIGETAVIGDDVTLYHGVTLGGTSWNKGKRHPTLENGVVIGAGAKVLGPITISAGAKVGSNAVVTKPVPEGATAVGNPARIIDQLTREREAQAEKLGFSAYAVARNQDDPLAKAIHALLDHASETDRRLASLVKELEAQGVKCDEEVQQADSFDPKYLSKIVD

SEQ ID NO: 33032 - protein, 355 aa, Lactobacillus plantarum
MNKYLTLADGTQWIGTAIGDCQLEAAGRIVFNTGMTGYQETLTDPSYLNQMIAFTYPLIGNYGIDPTVAQAPTIGAQAIIVHELATFNDHYTSRQSLASFLTIHHVAGIEGVDTRDLTIHIRQTGAQMAILSNHPITDFEAQLATFAPQALTATPLPVATTTIRPRVAILNFGEKAAITAELQARGADVVVLPPTASLKAVAAYHPDGILLSNGPGDPTDYHTYLATIRQLAQRYPLAGICLGHQLIALAYGAQTYQLSFGHHGLNHPVQACADGRIIMTSQNHDYAVDPASIKGTPLIVTHTELNDGSIEGLRLPHQAVMSVQFHPEAHPGPQEAGQFFDDFLLTIQKEAVVNA

SEQ ID NO: 33033 - protein, 182 aa, Ralstonia eutropha JMP134
MKTVGDKLEAFHVVGVKPGFNNHEENGQSAFEDITEKSFEGKWKIIYFYPKDFTFVCPTEIVAFAKLNGDFADRDAIVLGGSTDNEFVKLAWRREHKDLNKLNQWQFADVTGSLIDQLGVRDQAAGVALRATFVVDPHNVIQHVSVNNLNVGRNPDEVLRILDGLQTDELCPCNRAVGGATL

SEQ ID NO: 33034 - protein, 328 aa, Synechococcus sp. WH 7803
MSRVYADNSQAIGNTPLVRLNHVTKGCKATVLAKVEGRNPAYSVKCRIGANMIWDAEKRGALTEGKVIVEPTSGNTGIALAFTAAARGYKLVLTMPESMSIERRRVMAVLGAEIVLTEAAKGMPGAIAKAKEIAASDPAKYFMPGQFENPANPEIHFKTTGPEIWNDCDGAIDVLVSGVGTGGTITGVSRYIKNEAGKAIESVAVEPSHSPVITQTLNGEEIKPGPHKIQGIGAGFIPENLDLSVVDKVEQVTNEESIAMAQRLAKEEGLLVGISCGAAAAAAIRLAQQDAYAGKTIVVVLPDLAERYLSSVMFADVPTGIIEQPVAV

SEQ ID NO: 33035 - protein, 459 aa, Nostoc punctiforme PCC 73102
MGTPDSDALVFFGATGDLAYKKIFPSLQAMVRRGNLNVPVIGVAGRPWTTDQLRERARDSLEHNGGIDRDAFEKLSGLLQYVAGDYNKPETYEKLRQALGDTTHPLYYLAIPPSLFAQVASGLGKSGCAKNARVVIEKPFGRDLKSARELNQILASVFPESSIYRIDHYLGKEPLLNLLYFRFGNSFLEPIWNRNYVESIQIVMAEDFGIQGRGRFYEETGAIRDVVENHMLQVLASVCMDAPASTAADSIRDEKARILKAIPSLQPDDIIRGQFSDYRNEEGVSPDSQVETFVAVRLFINTWRWSGVPIYIRAGKKLPVKTTEVMVKLKCPPLDVFQEGGKENANYVRFLLDPEVIVGLGARTKIPGEDMSGSAVELLAFYGGGDEMEPYERLLGDAMRGDPTLFVREDTVEEEWRIVQPILDNVTPVYEYEPNTWGPPESDKLLSPIDDWYNPLGRE

SEQ ID NO: 33036 - protein, 318 aa, Oryza sativa Japonica Group
MSTTVFVFYRHAIAILFLVPVAFVVERKTAPPLSYKILLKLFVHALYGIAGSVNIYGLGLSYSSATSSSAISNLLPVLAFFLAVLMGMESLNLKRIHGIAKVFGVLFSIVGVIILAFYQGPELKSLNLQHLSSRNVVPTGSTAYTTKAWTSGIFLTVLSTTSWALWTVLQIVLPQGLMLEVYPSKLLNTTIQMVFATIQCFFIALAVERDFSRWKLGLDAGLIAVIYSGALVSGLAYYMQVWVIDKSGPVFLAMTMPITLIVTIVLSSFVLGEAVTLGSIISGVVMVGGLYCVLWAKKAEQAIASKEEATLPVQATQV

SEQ ID NO: 33037 - protein, 382 aa, Halobacterium salinarum
MKLHEYQAKEVFADAGIPTPESALATSVDEAVEVADALDYPVAVKAQVHVGGRGKAGGIKLAENTAEAREAAESILGMDLKGYTVDRVLVEEAVDFTNELYVGVTMDRSEGAPVVMVSERGGVDIESVAEEAPEDIVREHVDPSFGLQAYQARNAVYDAGIEQDVAGDVAKIVQGVYDLWADSDATEVEINPVMVTSERDVVAADAVMKLDEDALFRQPAFADMEEDAAEDDLEAKANEYGFDYVRLDGNTGIIGNGAGLVMTTLDLVDYYGGQPANFLDIGGGAKADRVANALDMVFSDENVDSVVFNIFGGITRGDEVAKGINSALEQFDEIPTPVVVRLAGTNAAEGREILNDDLVTVEETLEGAVQRAVEYADEEDIQ

SEQ ID NO: 33038 - protein, 224 aa, Medicago truncatula
MGILYGMVARGQVVLAEFSVIQSNASVVAKQILNQINQGTNSYNDSNVSFSHDRYVFHVRRTDGLTVLCMADEAFGRRIPFSFLEDIHNRFVKTYAGAILSAPAYTMNDEFSRILSQQMDYYSTDPNADRLNRLKGEMTQVRTVMLDNIEKVLERGGRLEMLVEKTATMNTNSVRFKRQARRYKNNMWWSNVRLTVALIMIFAIVFYIILAFMCHGPFLTSCWR

SEQ ID NO: 33039 - protein, 294 aa, Arabidopsis thaliana
MDQYEKVEKIGEGTYGVVYKARDKVTNETIALKKIRLEQEDEGVPSTAIREISLLKEMQHSNIVKYDDVVHSEKRLYLVFEYLDLDLKKHMDSTPDFSKDLHMIKTYLYQILRGIAYCHSHRVLHRDLKPQNLLIDRRTNSLKLADFGLARAFGIPVRTFTHEVVTLWYRAPEILLGSHHYSTPVDIWSVGCIFAEMISQKPLFPGDSEIDQLFKIFRIMGTPYEDTWRGVTSLPDYKSAFPKWKPTDLETFVPNLDPDGVDLLSKMLLMDPTKRINARAALEHEYFKDLGGMP

SEQ ID NO: 33040 - protein, 470 aa, Arabidopsis thaliana
MLDLQPSDRRHGAPSSSGGVSGGDELIRTYKGWKGNNVFFLGGRLVFGPDARSILITVFLITAPVIVFCIFVGRKFIDDFPHHRGVSVLAVADLVFLLLTSARDPGIIPRNLYPPEPESNEGNGEPRLAHTPQSRLPRTKDMIVNGITVKIKYCDTCMLYRPPRASHCSICNNCVEKFDHHCPWLGQCIGLRNYRFYFMFVLCSTLLCIYVHVFCWIYVKRIMDSENINIWKSFLKTPASIALIIYTFICVWFVGGLTCFHLYLMSTNQSTYENFRYRYDRHENPFNKGIVGNFMEVFCTNVAVSQNSFREKVSKEPAIPPRTVNGGMSSPSLQKVSNDIEMGRKPVWHETVEEELGDIEKDMEAGVASRDLSRMLPPEESEGRGIMHSRESSRGRGIMHSRESSRGRRGGSWELSSRVNEDLRTRDESVSRVGEDSSESSDNDASRDLHVEIYDAVTSRGRTGTGIGRL

SEQ ID NO: 33041 - protein, 159 aa, Brassica napus
  misc_feature (103)..(103): Xaa can be any naturally occurring amino acid
  misc_feature (109)..(109): Xaa can be any naturally occurring amino acid
MEDEEGIGLILARATELRLKIADRIDTSSTDVSSPREGKKDEIAGNQEKDFDSFSSDDADDEEEADEQLLRIRDALESLESQLAALQNLRQRQQYEKQVAPLXRIDYSXRKILLEKLKEYKGKELEVLREASTFAGERVDYENDLLLPPYPIHPPPLSL

SEQ ID NO: 33042 - protein, 232 aa, Mycobacterium tuberculosis H37Rv
MSLMAGSTGGPLIAPSILAADFARLADEAAAVNGADWLHVDVMDGHFVPNLTIGLPVVESLLAVTDIPMDCHLMIDNPDRWAPPYAEAGAYNVTFHAEATDNPVGVARDIRAAGAKAGISVKPGTPLEPYLDILPHFDTLLVMSVEPGFGGQRFIPEVLSKVRAVRKMVDAGELTILVEIDGGINDDTIEQAAEAGVDCFVAGSAVYGADDPAAAVAALRRQAGAASLHLSL

SEQ ID NO: 33043 - protein, 171 aa, Zea mays
MEHKEAGCQQPEGPILCINNCGFFGSAATMNMCSKCHKEMITKQEQAQLAASSIDSIVNGGDGGKGPVIAASVNVAVPQVEQKTIVVQPMLVAETSEAAAVIPKAKEGPDRCAACRKRVGLTGFSCRCGNMYCSVHRYSDKHDCQFDYRTAARDAIAKANPVVRAEKLDKI

SEQ ID NO: 33044 - protein, 127 aa, Dechloromonas aromatica RCB
MSYSVKVIDHYENPRNVGSFAKEDDGVGTGMVGAPACGDVMKLQIKVNKSGVIEDAKFKTYGCGSAIASSSLVTEWVKGKTVDQALSIKNTEIAEELALPPVKIHCSILAEDAIKAAVADYKKKHGE

SEQ ID NO: 33045 - protein, 366 aa, Arabidopsis thaliana
MSSTAASSTVGGGGSSEISGVKKTSKRPKYSRFTQQELPACKPILTPRWVILTFLVAGVVFIPLGVICLFASQGLRFCGFIEDMFHSYLKVVEIVDRYDTDCIPTSSRNNMVAYIQGEGDKICKRTITVTKAMKHPVYVYYQLENFYQNHRRYVKSRNDAQLRSPKEEHDVKTCAPEDNVGGEPIVPCGLVAWSLFNDTYSFSRNSQQLLVNKKGISWKSDRENKFGKNVFPKNFQKGAPIGGGTLNISKPLSEQEDLIVWMRTAALPTFRKLYGKIETDLHAGDTITVLLQNNYNTYSFNGQKKLVLSTTSWLGGRNDFLGIAYLTVGSICLFLAVTFAVLYLVKPRQLGDPSYLSWNRSAGGLQ

SEQ ID NO: 33046 - protein, 151 aa, Vitis vinifera
MHIRKVIHTTSASTSAVSLYSLSKLCLQLCMEDTADNHPLAIGTFQRRERRQKPKSVKGVIRRKREHLKTEHKDDGGGGGGDEEDEEVELEVEKKIMELQRIVPGGEWVGIENLFEQTASYILALQCQVKAMNAVASFLEGLDMEKRKLGG

SEQ ID NO: 33047 - protein, 181 aa, Idiomarina loihiensis L2TR
MLTVGDKLPEFSVIAAKPKFNMPEENGESAFETIDNNSFEGKWKIIFFYPKDFTFVCPTEIVEFAKLNEDFADRDAVVMGGSTDNEFVKLAWRREHPDLDRLNQYSFADDGSLVDGLGVRDKAENVALRATFIVDPHNVIQHVSVNNLNVGRNPAEIVRILDGLQTDELCPCNRALGGDTL

SEQ ID NO: 33048 - protein, 424 aa, Oryza sativa Indica Group
MEGRMQGKAPLSDSNRRIMDADAPPRRVYQAWKGSNIFFLGGRLIFGPDVRSLILTVCLIVIPVILFAAVISGQLDHEYHNQIGGWVASVAIIFTAYIIVLLLLTSGRDPGIIPRNAHPPEPEDVGESSNLSEWPGGQHGSTALPLTKDVLVNGVLVKVKYCHTCMLYRPPRCSHCSICNNCVERFDHHCPWVGQCIGKRNYRFFFMFVSSTTLLCVYVFAFCWVDLRIIMDTHRCKLGRAIMKSPVSGILILYTFIAVWFVGGLTSFHLYLISTNQTTYENFRYRYDRKTNPHNRGLVQNFIEILCSRIPSSRNNFRAKVKEDSATFPSSLGMGRALSPPKMSVDLEMGMKRQTVAMEELEDLHSQIGSAMGLERCGTEPPHIVGRKGCSEIATDIEAFAEEFGLEQRFTERKKIEQRTSHNP

SEQ ID NO: 33049 - protein, 307 aa, Coprinopsis cinerea okayama7#130
MVVAVAQATQGQPSSQRKNRRKLVRKNGSKPGAAAATSTHQQNQHGGDEEMNDITETADLQEGTSSLFPKPTNNVDDDDDEIMIDTDPTTGASSSQAAGVNGSSVGTTAAPLFAPASASAQRTLLKSETRRVPIPPHRMTPLKKDWVSIFGPLTEILGLQVRMNVQRRCVEMRTSKQTKDIGAIQKGADFVKAYSLGFDVNDAIALLRLDDLYLDSFEIKDVKTLHGDHLSRAIGRIAGQDGKTKFTIENTSRTRIVLADTKIHIMGSFQNIKIARDAIVSLILGSPPGKVYAGLRTVSARMKQRAI

SEQ ID NO: 33050 - protein, 369 aa, Oryza sativa Japonica Group
MAASNLDVFEACHERLQHCARATRCTILTKVAFSQGTSTYVLVFYRNIIAAVVLLPVALAVERKTAPPLSLKVSLKLFVHALCGMSAAMNISCIGLNYSSATAASAVQNIMPVLTFFLAVLMGMESFKLKMCHGIVKISGIVFCAVGVSVLALYQGPDLKSFIKHHLFPHTNRVGTHSSRNWILGIFLQFLATLMWALWAVLQGPLLEEYPSKLLNTTLQIVFSAVQSFFMALVLERDFSRWKLGFDIGLVAIIYCGIVVSAISFYMQIWIIDKRGPVFLCMTVPLTLVITIILELLIGEAVTLGSIISGALMVVGLYTVLLGKRIEEEGISSQGGNAEETARSDLEEQETAAPVPASQDVKEKVDATN

SEQ ID NO: 33051 - protein, 225 aa, Oceanobacter sp. RED65
MSKQSPLIAPSILSADFARLGEEVDNVLAAGADIVHFDVMDNHYVPNLTIGPMVCKALRNHGVTAPIDVHLMVSPVDRIIGDFIEAGASYITFHPEASDHIDRSLQIIKDAGCKAGLVFNPATPLHYMDYVMDKLDMVLLMSVNPGFGGQSFIPATLDKLKQARKKIDDSGLDIRLEIDGGVKVDNIAEIAAAGADTFVAGSAIFNADDYQTTIEKMRAEIAKSN

SEQ ID NO: 33052 - protein, 594 aa, Neisseria meningitidis
MALVELKVPDIGGHENVDIIAVEVNVGDTIAVDDTLITLETDKATMDVPAEVAGVVKEVKVKVGDKISEGGLIVVVEAEGTAAAPKAEAAAAPAQEAPKAAAPAPQAAQFGGSADAEYDVVVLGGGPGGYSAAFAAADEGLKVAIVERYKTLGGVCLNVGCIPSKALLHNAAVIDEVRHLAANGIKYPEPELDIDMLRAYKDGVVSRLTGGLAGMAKSRKVDVIQGDGQFLDPHHLEVSLTAGDAYEQAAPTGEKKIVAFKNCIIAAGSRVTKLPFIPEDPRIIDSSGALALKEVPGKLLIIGGGIIGLEMGTVYSTLGSRLDVVGMMDGLMQGADRDLVKVWQKQNEYRFDNIMVNTKTVAVEPKEDGVYVTFEGANAPKEPQRYDAVLVAAGRAPNGKLISAEKAGVAVTDRGFIEVDKQMRTNVPHIYAIGDIVGQPMLAHKAVHEGHVAAENCVGHKAYFDARVIPGVAYTSPEVAWVGETELSAKASGRKITKANFPWAASGRAIANGCDNGFTKLIFDAETGRIIGGGIVGPNGGDMIGEVCLAIEMGCDAADIGKTIHPHPTLGESIGMAAEVALGTCTDLPPQKKK

SEQ ID NO: 33053 - protein, 955 aa, Coprinopsis cinerea okayama7#130
MYGSTSEESESEDSGMEIDLPSAPWHDDSEPADEADEDEHLSDEQHELNSTDDHLLHWATFHQLNKVKKDDLVRLYRAANLPEDPELLTKAEIITVIMDARQDELASLPPSSPPGRTDAASSDYSSDEGNVAGDEETDAGPHYDAPGRSLSMGNVMAPQSNGHQGLKRKASLRIQTEALSRPRTSKDSSPSTSALASSSTQSPPGHRLRSRKVSASTPVDVPTPTSAASKGRGKGKNKQVEFSTEIVQVKSTSRRSSQKEKDRQREQAEALAEESDLTDLDDALPVPTSRPQPSPRRLRSKDRGRTHIDSKSRESDDADHTPTSKSRSAKAMPQSHSKPQPKRVTPMRKAKGKIKSLKESETEASHEEDGSENSEEDEEGQEVEMEMEEDDGEGEMEEDQDADVQGGDTGEEDEVDELVSSASITPPPSNTYARKTPLRQRLRRRPCATTAELDAEENEGDDEHEEDADGDDDDTETVDGHDGDEGEDDESTIAVEPRRLRNGKIVGDEEAHMDEDDGGSAEGGEEEAEESEETEGEPITVDETEEEAEEDTMEDEVDLSVATAKTLVRLRRDDLVKLCETRNLEPIGTKPQLAEALLQWRDRHANGSSCPSSTGTVRPPSTATTSRRRRKKQSSSSSVPVLLRSQKVHDDEPRTPVPGKEAKDKENDELELDLESLGLEDREIPPEKIQKLEKIGSGGFKDVFIGKFRGRRIAISEFRGQLSAMDIKELKLLGGFDHPNIVRFLGVSIPENTKETPVMIVSELCSNGDLFDYIRNVSAPSLHKVLTMMLDIARGLEYLHMRKPSVIHRDCKSSNILITAKGVAKIADFGLAKVKQSTRSMVRSLVGTVNWQAPELWTAHPKYNHKVDVFSCAMVFWEMLQWHLPNKKFPWEGMNEHAIYEQVGAKKQRPSITGLRKQWCPEIVTLIEEMWAQDPSDRPTMSKVVETLEDLVRQY

SEQ ID NO: 33054 - protein, 201 aa, Arabidopsis thaliana
MARGRKLTMSQSERYLGSSYSYGDSNGNSATDESELTEEDIWSHAVDHSPEMLESHGAWNTRDAVVRNGRVGGGLSLAFEDASSSPRIVHQIRGGGEGGGGGGGGGRVERQLASSAPVNVPDWSKIYRVNSVESIHESDEEEEEDSGMMMPPHEYLAKSQQRRSRKSGGGGSVFEGVGRTLKGRELRRVRDAIWSQTGFYG

SEQ ID NO: 33055 - protein, 213 aa, Acidovorax sp. JS42
MPRTASTAAPMPAAGRRIQTRRSGVHGKGVFAVQDIAEGEVLVEYTGEVISWQEAQDRHPHDPAQPNHTFYFHVDEDRVIDAKFGGNSSRWINHSCDPNCFADERDGRIFITALRNIRAGEELNYDYGLIIEERYTPKLKAEYPCWCGSKNCRGTLLAPKRGWAPPGLAPQPPTEKAGKAPKTRKAEEAKGSGKAGKPAKSAKPRQGRRSAQR

SEQ ID NO: 33056 - protein, 490 aa, Escherichia coli O6
MSRMAEQQLYIHGGYTSATSGRTFETINPANGNVLATVQAAGREDVDRAVKSAQQGQKIWAAMTAMERSRILRRAVDILRERNDELAKLETLDTGKAYSETSTVDIVTGADVLEYYAGLIPALEGSQIPLRETSFVYTRREPLGVVAGIGAWNYPIQIALWKSAPALAAGNAMIFKPSEVTPLTALKLAEIYSEAGLPDGVFNVLPGVGAETGQYLTDHPGIAKVSFTGGVASGKKVMANSAASSLKEVTMELGGKSPLIVFDDADLDLAADIAMMANFFSSGQVCTNGTRVFVPTKCKAAFEQKVLARVERIRAGDVFDPQTNFGPLVSFPHRDNVLRYIAKGKEEGARVLCGGNVLKGDSFDNGAWVAPTVFTDCSDDMTIVREEIFGPVMSILTYESEDEVIRRANDTDYGLAAGIVTADLNRAHRVIHQLEAGICWINTWGESPAEIPVGGYKHSGIGRENGVMTLQSYTQVKSIQVEMAKFQSIF

SEQ ID NO: 33057 - protein, 502 aa, Mycobacterium sp. JLS
MADPTGFLKVPKVEAAKRPVDERVGDWHEVYERQSLPERAEEVSQQARRCMDCGIPFCHSGSAGCPLGNLIPEWNDLVRRGRWDAASERLHATNNFPEFTGRLCPAPCEAACVLSISEDHTGGSVTIKRIENTIADQAWALGLVDPQPASIRTGRRVAVVGSGPAGLAAAQQLTRAGHDVTVFERDDRIGGLMRYGIPEYKLEKRTLDQRLAQMRAEGTRFVTECEVGVDLTVEQLRERHDAVVLAVGALRARDNDVEGRHLDGVHLAMEHLVPANKECEGDGPSALSARDKHVVIIGGGDTGADCLGTAHRQGAASVTQLDYNPEPPETRDDTRTPWPMWPLVLRTRLSPAHAEGGQRRYQVAVQRFLGDEQGRVRGMEIAEVKVERDAEGRRQIVPVGETLEIPCDMALLAIGFEGVEHMPLLDGLGLSLNNRGALPCGSDWQTDAPGVFVCGDAHRGASLIVWAIAEGRSAAHAVDAYLMGESDLPAPVRPGALPLAVV

SEQ ID NO: 33058 - protein, 572 aa, Arabidopsis thaliana; identical to SEQ ID NO: 870

SEQ ID NO: 33059 - protein, 119 aa, Zea mays
  misc_feature (49)..(49): Xaa can be any naturally occurring amino acid
  misc_feature (56)..(56): Xaa can be any naturally occurring amino acid
  misc_feature (67)..(67): Xaa can be any naturally occurring amino acid
  misc_feature (83)..(83): Xaa can be any naturally occurring amino acid
MNLNIANPSTERPKKVDIHDAKKLRAFYDRRISQEVSGDALGAVCTGYXFNIIGGXDKQRFPMIQGXVYTSGRVPLLLNRGTXCLPVTIGRRNGHGTRKSVRGCIWSQDLSVINLEIAN

SEQ ID NO: 33060 - protein, 390 aa, Streptococcus pneumoniae R6
MNIAVIGLGHVGLAYALLFASKYKVVAYDIDSVKINNLKKGILPSKNEELMKFFCENNLNITFFDTFSEIKNNIDYYIIALPTDYDEKIGSFNTYEIEQTVSKILRVKPNGKIILKSTVPIGFSNKLKRLFDTKNIIFVPEFLREGCSIYDNLYPSRIVVGDETVEGRKIAELFLSISTHSTANIKNVMLVSPTEAEAIKLFSNTFLALRVAFFNELDSFAERRSLNAEVVIKGVCLDPRIGNFYNNPSFGFGGYCLPKDTKQLKKEFIEINAPVIEAIDISNTNRKQFIVKQILERKPKIVGIYKLGMKYNSDNYKESAILSIINELLIVGIKILVYEPNLNVSIDNVIFEKNFELFTKQSDLIVANRWDRGLEAYKDKVYTRGIWIRD

SEQ ID NO: 33061 - protein, 235 aa, Glycine max
MAKNELRLLGAWFSPYALRVQIALNLKGLDYEVVEETLNPKSDLLLKSNPVHKKIPVLLHGDKVICESAIIVEYIDEVWSNNALSILPQNAYDRANARFWVSYIDDKWYTSIRNTILAEAADQDDEAKKPHFVRMEEALERMEEVFNKCSEGRAYFGGDTIGIIDIAFGSLWGWVRVIEEMNGRKVFDEAKNPALAKWADKFSADPAVKGVLPETQKLIEFAKIRKQKWAAAAAK

SEQ ID NO: 33062 - protein, 89 aa, Zea mays
LYGGVWPGCLRRRFLTFICGRAGVCALGAVIAKHCDDQLRVTQYLSSFDEITITEKVPNELLYGRAGYLWACLFLNKHPSEKTIPLEHI

SEQ ID NO: 33063 - protein, 159 aa, Arabidopsis thaliana
MEKDMAMMGDKLILRGLKFYGFHGAIPEEKTLGQMFMLDIDAWMCLKKAGLSDNLADSVSYVDIYKLCSSDYTFHMLCLKLYHNLFWNGMNNLSVAKEVVEGSSRNLLERVAGLIASKTLEISPRITAVRVKLWKPNVALIQSTIDYLGVEIFRDRATE

SEQ ID NO: 33064 - protein, 575 aa, Lactobacillus brevis
MLKGIAASDGVVCGHVFRYSEPDLSITKRSITNLDHELNRFHQALEAAVSEVEMIKTRATKNLGADSAQVFSAHIAMLQDPEFIKSVEDEIARQRCNAEAALATVVTDYGASLAKLTDNPYMQERITDLHDISKRVTAHLLGIKLPDLALLDRPVIVVTHDLIPSDTVSVDAKYILGFVTDLGGRTSHSSILARSLNIPAVVGTQTATADLATDEMVIINGTTGSVISEPTAAEIATAKQAMADRQANRVRLAKLRHHQTVTKDGIGVTLAANMGTANDIPSVLDNGAEAVGLMRTEFLYMDAERVPTEDEQFAIYRQVVSALAPRPVVIRTLDIGGDKPLPYLHQAPEANPFMGERAIRQSLAHQPLFRSQLRALIRASAYGHLRIMFPMIATLDEFRQAKAIYDDERSKLTTAQVPMGKIDVGMMVEVPAAAMLADRFAQEVDFMSIGTNDLIGYAMADDRTNQDVAYLYQPYHPAVLRLVDRIVRAGHAAGIPVAMCGEMAGDPIAVPILLGIGLDEFSMGAGSILKTRQLMGTLNVHELQSLADTVLNSTSTSQEVITMVQAAVPGILDVR

SEQ ID NO: 33065 - protein, 1188 aa, Methanocaldococcus jannaschii DSM 2661
MLIIQNTKGDSMKFIAWLDELSNKDVDIAGGKGASLGEMWNAGLPVPPAFVVTADAYRHFIKETGLMDKIREILSGLDVNDTDALTNASKKIRKLIEEAEMPEDLRLAIIEAYNKLCEMCGEDEVTVAVRSSATAEDLPEASFAGQQDTYLNIKGAENVVKYVQKCFSSLFTPRAIFYREQQGFDHFKVALAAVVQKLVNAEKAGVMFTVNPISENYDELVIEAAWGLGEGVVSGSVSPDTYIVNKKTLEIVDKHIARKETMFVKDEKGETKVVEVPDDMKEKQVLSDDEIKELAKIGLNIEKHYGKPMDVEWAYEKGKFYMLQARPITTLKKGKKEKKAKEEDIEAKILLKGIGASPGIATGVVKIIHDVSEIDKVKEGDILVTEMTTPDMVPAMKKAAAIVTDEGGLTCIEGDAKILTDRGFLKMKEVYKLVKNGEKLKVLGLNAETLKTEWKEIIDAQKREARRYEIGVYRKNKNTKDTIKITPDHKFPVFVNGELSKVQLCDIIDNNLSVLSIDYIPMIEEKYESLAEVMYLGGAVLSDGHIVRRNGKPIRVRFTQKDTEEKKDFIEKVKGDVKLIGGNFIEISNRNNVIEYQTSRKIPSEILGFIEVNINTIPLYATKDEIADLIAGFVDGDGCLSGKRRVEIYQNSSHIKKIEGLIVGLYRLGIIPRLRYKRSSTATIYFNNNLETILQRTRRIKLDKLKEFKKPVEDKKLIDISQILPELKEFDYKGYLYKTYKEKLFIGINKLEEYLSKIDKDGIERIKQKIKLLKESDIYSIRIKKVGEDYGEVYNITVKAENEFNHNYVVWTKHYTPIVVFNCHAAIVSRELGTPCVVGTKKATKVLKDGMIVTVDGEKGIVYEGEIKKVEEKEKKQEVVVQQAPIITATEVKVNVSMPEVAERAAATGADGVGLLRAEHMILGLGKHPRKILEEEGEEALIEALMEGIRKVADAFYPRPVTYRTLDAPTDEFRGLEGGENEPIEHNPMLGWRGIRRDLDEVDILKCELKAIKRLREEGYKNIEIMIPLVTHPDEVRRVKEIMREVGLEPCKDIPFGIMVETPAAALIIEDFIKEGINFVSLGTNDLTQYTIAIDRNNELVSKYYKEDHPAVLKLVEHVIKTCKKHGIKTSICGQAGSRPHIVEKLVEWGIDSVSANIDAVETIRRVVARTEQKVILNYIRKSYVERE

SEQ ID NO: 33066 - protein, 323 aa, Listeria monocytogenes str. 4b F2365
MRATAIAHTNVALIKYWGKRDEHLILPANSSLSFTVDKFYTKTTVEWDENLAQDTFILNNEQKTDAKVARFIDKMREEFGISAKAKITSENHVPTAAGLASSASAFAALALAGSSAAGRKDTKEYISRLARFGSGSASRSVFGDFVIWEKGELADGSDSFAVPFTNKLCDKMSLVVAVVSDKEKKVSSRDGMRLTVETSPFFEKWVSAAETDLEEMKQAILDEDFIKVGEITERNGMKMHATTLGAEPPFTYFQPKSLEIMDAVRELRENGIPAYFTMDAGPNVKVICERENENIVADKLSGLAKNVLICHAGKEASVVSDEK

SEQ ID NO: 33067 - protein, 425 aa, Mycobacterium tuberculosis H37Rv
MTRLDSVERAVADIAAGKAVIVIDDEDRENEGDLIFAAEKATPEMVAFMVRYTSGYLCVPLDGAICDRLGLLPMYAVNQDKHGTAYTVTVDARNGIGTGISASDRATTMRLLADPTSVADDFTRPGHVVPLRAKDGGVLRRPGHTEAAVDLARMAGLQPAGAICEIVSQKDEGSMAHTDELRVFADEHGLALITIADLIEWRRKHEKHIERVAEARIPTRHGEFRAIGYTSIYEDVEHVALVRGEIAGPNADGDDVLVRVHSECLTGDVFGSRRCDCGPQLDAALAMVAREGRGVVLYMRGHEGRGIGLMHKLQAYQLQDAGADTVDANLKLGLPADARDYGIGAQILVDLGVRSMRLLTNNPAKRVGLDGYGLHIIERVPLPVRANAENIRYLMTKRDKLGHDLAGLDDFHESVHLPGEFGGAL

SEQ ID NO: 33068 - protein, 154 aa, Mycobacterium tuberculosis H37Rv
MPDLPSLDASGVRLAIVASSWHGKICDALLDGARKVAAGCGLDDPTVVRVLGAIEIPVVAQELARNHDAVVALGVVIRGQTPHFDYVCDAVTQGLTRVSLDSSTPIANGVLTTNTEEQALDRAGLPTSAEDKGAQATVAALATALTLRELRAHS

SEQ ID NO: 33069 - protein, 386 aa, Arabidopsis thaliana
MDKASITEGKPIRCKAAILRKAGEPLVIEEIQVDPPQAYEVRIKILCTSLCHTDVTFWKLDSGPLARFPRILGHEAVGVVESIGEKVDGFKQGDVVLPVFHPQCEECKECISPKSNWCTKYTNDYLSNTRRYGMTSRFKDSRGEDIHHFIFVSSFTEYTVVDIAHLVKISPEIPVDIAALLSCSVATGLGAAWKVADVEEGSTVVIFGLGAVGLAVAEGVRLRGAAKIIGVDLNPAKFEIGKRFGITDFVNPALCGEKTISEVIREMTDVGADYSFECIGLASLMEEAFKSTRPGSGKTIVLGMEQKALPISLGSYDLLRGRTVCGTLFGGLKPKLDIPILVDRYLKKELNLEDLITHELSFEEINKAFHLLAEGNSIRCIIWMDK

SEQ ID NO: 33070 - protein, 338 aa, Alteromonadales bacterium TW-7
MAIKLAINGFGRIGRNIVRALYESGLSDEIKIVAINELADPEAIAHLLKYDTSHGRFSFPVKLGEDTISVAGDTIALFCEENPVELPWQTLDVDVVLECTGVYHSREHAQLHITAGAKKVLFSHPADNDVDATIVYGINDDELKSEHTIVSNGSCTTNCVVPVIKVLDDAFGIESGAITTIHASMNDQQVIDAYHHDLRRTRAASQSIIPVDTKLARGIDRILPKFEGRFEAIAVRVPTINVTAMDLSVTVNADVDLKAVNNALKAQAKDRLEGILSYTEEPLVSVDFNHDPHSCIIDGTQTRVSHKRLIKLLVWCDNEWGFANRMLDTARAMVAVTQ

SEQ ID NO: 33071 - protein, 391 aa, Alteromonadales bacterium TW-7
MSVIKMADLDLNGKRVLIREDLNVPVKAGKVTSDARIRAALPTIKLALEKGAKVMVMSHLGRPTEGEYNEEYSLAPVADYLNDALAQTVRLEKDYLNGVDVADNEVVVFENVRFNKGEKKNDEALSKQLAALCDVYVMDAFGTAHRAQASTHGVGLFADVACAGPLLSAELEALGKALDNPARPLVAIVGGSKVSTKLTVLDSLSKIVDQLVTGGGIANTFIAAAGNPVGKSLFEADLMDEANRLCAAAKANDGEIPVPTDVVVGNEFSESAVATLKDVSEVTSDDMIFDIGPDTASQLAKIIANAGTVVWNGPVGVFEFDQFGNGTRAIAQAIANSNAFSIAGGGDTLAAIDKYGIADKVSYISTGGGAFLEFLEGKKLPAVEMLESRAK

SEQ ID NO: 33072 - protein, 594 aa, Neisseria meningitidis
MALVELKVPDIGGHENVDIIAVEVNVGDTIAVDDTLITLETDKATMDVPAEVAGVVKEVKVKVGDKISEGGLIVVVEAEGTAASPKAEAPVAPAQEAPKAAAPAPQAAQFGGSADAEYDVVVLGGGPGGYSAAFAAADEGLKVAIVERYKTLGGVCLNVGCIPSKALLHNAGVIDEVRHLAANGIKYPEPELDIDMLRAYKDGVVSRLTGGLAGMAKSRKVDVIQGDGQFLDPHHLEVSLTAGDAYEQAAPTGEKKIVAVKNCIIAAGSRVTKLPFIPEDPRIIDSSGALALKEVPGKLLIIGGGIIGLEMGTVYSTLGSRLDVVEMMDGLMQGADRDLVKVWQKQNEYRFDNIMVNTKTVAVEPKEDGVYVTFEGANAPKEPQRYDAVLVAAGRAPNGKLISAEKAGVAVTDRGFIEVDKQMRTNVPHIYAIGDIVGQPMLAHKAVHEGHVAAENCAGHKAYFDARVIPGVAYTSPEVAWVGETELSAKASGRKITKANFPWAASGRAIANGCDNGFTKLIFDAETGRIIGGGIVGPNGGDMIGEVCLAIEMGCDAADIGKTIHPHPTLGESIGMAAEVALGTCTDLPPQKKK

SEQ ID NO: 33073 - protein, 183 aa, Escherichia coli
GKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPL

SEQ ID NO: 33074 - protein, 405 aa, Brassica napus
  misc_feature (207)..(207): Xaa can be any naturally occurring amino acid
  misc_feature (331)..(331): Xaa can be any naturally occurring amino acid
  misc_feature (365)..(365): Xaa can be any naturally occurring amino acid
MGTGNSKEKWRQRSSSSCRSSSSPWASHQSYPQYPPPPSYAPPPEFAQPPSPSYTTQPYSQPPPSQSYGNDKKRLERKYSKISDDYSSLDQVTKALAHAGLESSNLIVGIDFTKSNEWTGARSFNRKSLHFIGNTPNPYEQAIAIIGRTLAAFDEDNLIPCYGFGDASTHDQDVFSFNPEDRFCNGFEEVLGRYKEIVPQLKLAGPXSFAPIIDMAMTIVEQSGGQYHVLVIIADGQVTRSVDTENGQLGPQEQKTVDAIVEASKLPLSIVLVGVGDGPWDMMREFDDNIPSRAFDNFQFVNFTEIMSKNKAQSFKETEFALSALMEIPQXYKATLELNLLGRRNGNIPERFPLPPPMHGGSASXQQTKAPRVPSFKPSVPPYPTESYPVRSSPAQPATTTSAFD

SEQ ID NO: 33075 - protein, 216 aa, Ralstonia eutropha JMP134
MTRNDLLDRLATTQASALETQGLGLVPMVVEQSGRGERAYDIYSRLLKERVVFLVGEVNDQTANLVVAQLLFLESENPDKDISLYINSPGGSVSAGLAIYDTMQFVKPDVQTLCMGMAASMGAFLLAAGAKGKRSALPNSRIMIHQPLGGARGQASDIEIQAREILYLRERLNSILSEVTGQPVEKIARDTDRDNFMSGDQAVDYGLIDKVIARRS

SEQ ID NO: 33076 - protein, 593 aa, Neisseria meningitidis
MALVELKVPDIGGHENVDIIAVEVNVGDTIPVDDTLITLETDKATMDVPAEVAGVVKEVKVKVGDKISEGGLIVVVEAERAASPKAAPVAAPAQEAPKAAAPAPQAAQFGGSADAEYDVVVLGGGPGGYSAAFAAADEGLKVAIVERYKTLGGVCLNVGCIPSKALLHNAAVIDEVRHLAANGIKYPEPELDIDMLRAYKNGVVSRLTGGLAGMAKGRKVDVIQGDGQFLDSHHLEVSLTAGDAYELAAPTGEKKIVAFKNCIIAAGSRVTKLPFIPEDPRIIDSSGALALKEVPGKLLIIGGGIIGLEMGTVYSTLGSRLDVVEMMDGLMQGADRDLVKVWQKQNEYRFDNIMVNTKTVAVEPKEDGVYVTFEGANAPKEPQRYDAVLVAAGRAPNGKLISAEKAGVAVTDRGFIEVDKQMRTNVPHIYAIGDIVGQPMLAHKAVHEGHVAAENCAGHKAYFDARVIPGVAYTSPEVAWVGETELSAKASGRKITKANFPWAASGRAIANGCDNGFTKLIFDAETGRIIGGGIVGPNGGDMIGEVCLAIEMGCDAADIGKTIHPHPTLGESIGMAAEVALGTCTDLPPQKKK

SEQ ID NO: 33077 - protein, 283 aa, Coprinopsis cinerea okayama7#130
MTGHEPPIRKPEVVSLGSMLTPQTLVVGSLLFAVVLVVLLILVNRRKSRGQGTALLLVGPSDSGKTAIFSRLVYGRTTPTHTSLQPNASIANITPSKAVRIIDIPGHPRIRDQFTEYLSDAKVIAFVVDSNTISRNGVAVAEHLHHILHAITSLPPSHAVPSLVVVCNKADLLKTSASSGSATTLAVNRVKTILERELEKRRLAQTGGVGVEGLGEEGERSELGGLECGDGNSPFRFDEWDGGDVVFLGTSSRSETSEKSAALDEKREADGLSALQDYLEEQM

SEQ ID NO: 33078 - protein, 594 aa, Neisseria meningitidis
MALVELKVPDIGGHENVDIIAVEVNVGGTIAVDDTLITLETDKATMDVPAEVAGVVKEVKVKVGDKISEAGLIVVVEAEGTAAAPKAEAAAASAQEAPKAAAPAPQAAQFGGSADAEYDVVVLGGGPGGYSAAFAAADEGLKVAIVERYKTLGGVCLNVGCIPSKALLHNAAVIDEVRHLAANGIKYPEPELDIDMLRAYKNGVVSRLTTGLAGMAKGRKVDVIQGDGQFLDPHHLEVSLTAGDAYEQATPTGEKKIVAFKNCIIAAGSCVTKLPFILEDPRIIDSSGALALKEVPGKLLIIGGGIIGLEMGTVYSTLGSRLDVVEMMDGLMQGADRDLVKVWQKQNEYRFDNIMVNTKTVAVEPKEDGVYVTFEGANAPKEPQRYDAVLVAAGRAPNGKLISAEKAGVAVTDRGFIEVDKQMRTNVPHIYAIGDIVGQPMLAHKAVHEGHVAAENCAGHKAYFDARVIPGVAYTSPEVAWVGETELSAKASGRKITKANFPWAASGRAIANGCDNGFTKLIFDAETGRIIGGGIVGPNGGDMIGEVCLAIEMGCDAADIGKTIHPHPTLGESIGMAAEVALGTCTDLPPQKKK

SEQ ID NO: 33079 - protein, 488 aa, Anaplasma marginale str. St. Maries
MCWESMSVPITVAYGDGVGPEIMEAVLFILKEARADVSIETVDIGHNQYKKEWTSGIAPSAWESISRTRLLLKAPTMTPQGSGHKSLNVALRQRLGLYVNVRPCVSYFPVVGTKHPDLDVVIIRENEEDTYSGVEHKLSEDTHECVKISTRSASEKICAYAFNYARAHNRKKVTCFVKDNIMKMTDGILHASFDKVAKGYPDIEANYYIVDVGMAKIASNPEDFDVVVTTNLYGDIVSDIVSLSSGSIGLTGSANIGDYYAMFEAVHGSAPDIAGKNVANPSGLLNAAVQMLVHIGQLDKAGVIRNAFLKTLEDGVHTADIYSEKTSLRRASTMEFAQAIVGNLGTTPQRLKGLSLGKETPSTGSSGYVRSNPKRVLVGVDVTVHWDKGTDIKELVGSLSGLSSELKLQLVYAKGLELWPKAPYSYTYVDLVSCRFYAEGKEEDGVDGREVGNLLLKMEDAGIDTVKMVKLYLYDGGQGFLLRSSFGS

SEQ ID NO: 33080 - protein, 416 aa, Shigella flexneri 2a str. 301
MESKVVVPAQGKKITLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLLKCSEFGDAIIKNM

SEQ ID NO: 33081 - protein, 195 aa, Synechococcus sp. WH 7803
MANLDQAPSRSMPNLLHVLPAFADESELRLNTIVELNSNTINKYELITETGHLKLDRVGYSSLAYPFAYGCIPRTWDEDGDPLDIEIVNVTEPLIPGSIVEARIIGIMTFDDGGEVDDKVIAVLADDKRMDHIKSFEDLGDHWKKETTYYWEHYKDLKKPGTCTVNGFFGTEKAVEIIKTCEARYMAEIDPKLVD

SEQ ID NO: 33082 - protein, 146 aa, Anaplasma marginale str. St. Maries
MMFEKTLSILKPDVVERGIIGRVLSYIEAAGLRIVAQRMCALSHEQAEAFYAVHKARPFFPSLVGFMTSGPVVVQVLVGESAVKTYRDVMGATNPSEAAPGTIRGDLAESIDANCVHGSDSLENAEWEIKFFFKEHEIMSSMPNGK

SEQ ID NO: 33083 - protein, 376 aa, Oceanicola granulosus HTCC2516
MSETYQTPGPVERDWSDAISPIEEIIEDARNGRMFILVDHEDRENEGDLVIPAQMATPDAINFMATHGRGLICLALPGERIDALGLSLMSTHNSSRHETAFTVSIEAREGVTTGISAHDRAHTVAVAIDASKGAADIATPGHVFPLRARQGGVLVRAGHTEAAVDLARLAGLNASGVICEIMNEDGSMARLPELVAFAQRHGLKVGTIADLIAYRRRHDNLVRQMSERDVTSAFGGQWRMRVYSDTTHGDEHVVLIKGDISGDDPVLVRMHALDPLQDVVGLGPEGTANEFATAMRAVAAEGRGVVVLLRDTSMKLRLSGEASPQTLRQYGLGAQILSSLGLSQITLLTNSPKPRVVGLEAYGLEIVGTRRIEEPR

SEQ ID NO: 33084 - protein, 177 aa, Oceanicola granulosus HTCC2516
MAGPTHHSLATPSFDKPVKLLIVVAPYYKDIADQLVAGAVAEAEKAGATTEVIEVPGALEIPTAIGIAGRMSNYDGYVALGCVIRGETTHYETVCNDSSRALTLLGLSGHCIGNGILTVETYDQAAVRAEAAGQNKGGGAAAAALHLVALARRWGKAERGVGFTRELKMAQSEDGQA

SEQ ID NO: 33085 - protein, 1133 aa, Trichodesmium erythraeum IMS101
MAFKSLSLNLGRIFSKLSLKTILIVPYVIQILGAFGALGYIAFLNGQQTVDDLGKKLTNKISDRIQQHVLGYLNQSHQVLRITNDAIESANLDIYNFVALRRYFWEVVKEKDLQDYLFFGNEEGEFIGVEHFAEGEIYLKSCKIPTQSLCETYLLNNQGNISQYLNSKEYDPRDTPWYLVAKKLGEPTWSPILSSFSGQNSSLDIFAVQPIFDSTENLLGVLSNKTTLVKLTNFLKNLYISPNGQSFIIERSGNLIASSEVMEPFVIKGTQENRKIERLPATASENKIVSMTTKHLQQKFSSFAEITHTHEMNFPIEEEWYYASVIPVIDGRGINWLAVVVIPEDDFMEKVNMNIRTTILLSFAALTITVLLGIVTTNWITKPILQLNSAAKEISQGKWETQLKIYREDELGELANSFDQMASQLKKSFETLEAQNKQLTELDRLKDEFLANTSHELRTPLNGIIGIGEFLLEENTKNLNSITTSNLAIIVSSARRLSNLVNDILDFSKIRYHKLELQVRAIDVRIVVESVITLNRVLVGKNKNLQLTNAIPTDLPPVLADENRLQQILYNLIANAIKFTESGKVEISASLYSPKEDQDEATEIIIMVSDTGIGIPPDQLDRIFESFEQGEGSIIRKYGGTGLGLAVTKELVELQGGRIWVESEVGVGSRFNVTLPISNQLVPNSSLNFPSPTVNNIHYLIKNIETTIRSKPLGSKIPNGDFHVLVVDDEPINIQVLNNYLKANNYQVTQALSGKEALAALENNHNFDLILLDVMMPNMSGYEVCSQIREKYPAQSLPVLMLTAKNQIADLVMGFQFGANDYLTKPFAKDELLTRIQTHIKLSKITKAYERFVPHEYVELLSKESIINVKLGDRVSTKMAIFFSDIRSFTTISEQMTSQETFAFVNGYLKEVCPEIRDRNGLIIKFLGDGIMAVFPDGADDALEAAIAQLKRLQEYNQVLLSTGWMPIKIGIGIHWGHIMVGIVGEKGRMSGDAFSNNVNLTSRLEGLTKFYGVSLLISESAFNYLKNPQKYQIRFLDRASVKGIDEPINVYEVLDGEVDEIRELKLQTQVDFALGLESYRVGELVDAKDYFEKVLAVNYSDKTAQLYLERIDDLMVTGVPKNWNGVWAFTQK

SEQ ID NO: 33086 - protein, 737 aa, Aeropyrum pernix K1
MSSSGFGVRRPVKEAILRVAEAKPRDSGRKRVRIDIDIMKELGVEPGDVVEIEGKKKTVAIVMPAYPEDMGLDIIRMDGILRRNADVNIGEKVIVRKTSVRTATKVKLAPVSYTMTVDEGFKRYVKKKLQGVPITEGDVVVVPVIGQAVQLQVVDARPKGAVIVSEETIVDVLEKPVAQSRVPKVTYEDIGGLKEVIEKVREMVELPLRHPEIFKRLGIEPPKGILLYGPPGTGKTLLAKAVANEADAYFISINGPEIMSKYYGESEQRLREIFEEAKKNAPSIIFIDEIDAIAPKRDEVVGEVERRVVAQLLALMDGLEARGNVIVIAATNRPNAIDPALRRPGRFDREIEVPLPDKHGRLEILQIHTRHMPLAEDMDLEKLAEMTKGFTGADLAALAREAAMYALRRYLPEIDLDQESIPVEVLEKMVVTMEDFLKALREITPSGLREIQIEVPEVRWSDIGGLEDVKQELREVVEWPLKHPEAFTRMGIRPPRGVLLFGPPGTGKTLLAKAVATESGANFIAVRGPEILSKWVGESERAIREIFAKARQHAPAVVFFDEIDAIAPVRGTDVGTRVTERIVSQLLTEIDGVSDLHDVVVIAATNRPDMVDPALMRPGRLEKMIYVPPPDFSSRLEILRIHTRKVPLAEDVDLAEIARRTEGYTGADIEALVREASLAALREDINAAEVSMRHFEVALKKVKPSVTPQMVEYYKRWLETVKQRQEEVKREAPTITL

SEQ ID NO: 33087 - protein, 175 aa, Oryza sativa Japonica Group
MASRLLHLRRLLPSARPSAGGGGGGGGAVAAFSTVTPTPRVSALVDEICGLTLIEASSLTDALRGRLGVDQLPPLAILTGGAAPLAGGGAATGAAGEEAKAKEEKMAFDVKLEGFDAAAKLKIIKELRAFTNLGLKEAKELVEKAPAVLKAGVPKEEAESIAEKMRAIGAKIVLE

SEQ ID NO: 33088 - protein, 846 aa, Oryza sativa
MEAAAAFSPPRVSPDARAMFATLPASPSPHLRLAARPRALSASAPTTAAVAATKQRFLAPPRPDPAAPGGCGGGGARDVVAMVVPFLRGTAWQQPPPDLASFLYKNRIVYLGMCLVPSVTELMLAEFLYLQYDDAEKPIYLYINSTGTTKNGEKLGYETEAFAIYDAMRYVKVPIFTLCVGNAWGEAALLLAAGAKAALCSSLPLPREAERPACLPPPRRRRARPVALARRAGIHCVSLTLDPKLASGSAPTLHLGSGDFIHGVNTILRYIARVASVTSFYGQDAIQAAYVDQWLDYAPVILSGSEFEAACSFLDGYLASRTFLVSYGLSIADIVVWSNLAGQRWESLRRSKKYQNLVRWFNSIADYSDTLDEVVSAYVGKRGIGKSPAPSLKEKLPDSKQNISIPEVDLPGAKVGEVCVRFAPEPSGYLHIGHAKAGLLNKYFAERYKGRLIVRFDDTNPSKESNEFVENVLKDVETLGIKYDIVTYTSDYFPQLMEMAENLIKQGKAYVDDTPKEQMRSERMDGVESKCRNNTVQDNLSLWKEMINGTERGMQCCVRGKLDMQDPNKSLRDPVYYRCNTDPHHRIGSKYKVYPTYDFACPFVDALEGVTHALRSSEYHDRNAQYYRILQEMGLRRVEIYEFSRLNMVYTVLSKRKLLWFVQNKKVEDWTDPRFPTVQGIVRRGLKVEALVQFILEQGASKNLNLMEWDKLWTINKKIIDPVCGRHTAVLKDQRVLFTLTNGPEEPFIRVLPRHKKYEGAGKKATTFTNKIWLESADASVISIGEEVTLMDWGNAIIKEIKTQNGIITELLGELHLEGCDAPFIRSSKPIVLFAIPDGRQKSATK

SEQ ID NO: 33089 - protein, 143 aa, Brassica napus
  misc_feature (34)..(34): Xaa can be any naturally occurring amino acid
  misc_feature (93)..(93): Xaa can be any naturally occurring amino acid
  misc_feature (120)..(120): Xaa can be any naturally occurring amino acid
PAQDQLAAPLTGSKRSAGFPDTRKSNTDSYFHVXASRDARSSCMNEWAPHGKKKIETLSYVPDLTDHQSTKQDDYLLHLTGGTPCVEYEMQHXFVGPERGNTPGYYDARYWTMGKLSLIXCTDSAQMLKEVLECKTEYPNAFI

SEQ ID NO: 33090 - protein, 570 aa, Oryza sativa Indica Group
MSAAQQLPASLRAALSYSLGVFALRRPLLHKVLDYEDEFFALLMAVLESHSLRTTDGSFSESLYGLRRRPVKVSVKRSSSGAESNDKAYDSVLRKRQKVLSVVFLVVLPYFKSKLQSIYNKEREARLQASLWGQGDVRFDEADLVSDQGETSQAQVEATTGEVSNVARIKKNFAALIGVCYPWIHATNEGLSFAYQLLYLLDGTAFYSPALHALGLHVCRATGQELMESSSRVSRIRNRELERLRGPPWLKTMQRVLLNCMYTSLDYAQTGLIAAVFFFKMMEWWYQSAEERMSAPTVYPPPPPPPLPKVAKDGLPLPPDRTLCPLCCQKRNNPSVLSASGFVFCYSCIFKSVSQLMALIGEQFDESEEICGVVASVRQRGDKLALWTRTASNEAVQVNIGKKWKEISKPKPGAAWGTSLRKAYTFDTVEEFWGLYDQIFRPSKVTVNADFHLFKAGVEPKWEDPECANGGKWTVPCSRKTTLENMWLETLMALIGEQFDESEEICGVVASVRQRGDKLALWTRTASNEAVQVNIGKKWKEIVDYNDKMVYSFHDDAKREKPSRGGRYNV

SEQ ID NO: 33091 - protein, 309 aa, Ralstonia eutropha JMP134
MSPAMNADNPGAAATAVAAIAPALKAEILAEALPYIRKFHGKTIVVKYGGNAMTEEKLKHGFARDVILLKLVGMNPVVVHGGGPQIDEALKKVGKVGTFVQGMRVTDEETMEVVEWVLGGEVQQDIVMLINQYGGQAVGLTGKDGGLIRAKRLQMPDRENPGAFIDIGYVGDIEAINPAVVKALQDDAFIPVISPIGFSDDGQAYNINADVVAGKMAEILKAEKLVMMTNIPGVMDKKGNLLTDLSAREIEELFADGTISGGMLPKISSALDAAKSGVHSVHIIDGRIEHSLLLEILTEQAFGTMIRSH

SEQ ID NO: 33092 - protein, 101 aa, Zea mays
  misc_feature (25)..(25): Xaa can be any naturally occurring amino acid
  misc_feature (48)..(48): Xaa can be any naturally occurring amino acid
  misc_feature (55)..(55): Xaa can be any naturally occurring amino acid
  misc_feature (69)..(69): Xaa can be any naturally occurring amino acid
  misc_feature (90)..(90): Xaa can be any naturally occurring amino acid
MATKRSVGTLCEADLKGKKVFVRAXDLNVPLYDAHKITDDTRIRACVXAIKLLLXKGAQVILGSHLGRXKGVTPKYRLKPLVPRLSELLXVEVVMGNDCIG

SEQ ID NO: 33093 - protein, 350 aa, Caulobacter crescentus CB15
MATLLLLPGDGIGPEVCAQVRRVAAALTPDLKVDEALYGGASYDTHGTPLTDEVREQALASDAVLMGAVGGPKWADAPRHLRPEAGLLNLRKAMDVFANLRPAYCFEALAGASSLKPELVSGLDIMFVRELVGGVYFGQPRGIEDLADGQKKGFDTQVYTTSEIERVGRVAFELARGRTNKVHSAEKSNVMESGLLWKQVITELHAREYPDVQLEHILADNCAMQLVRAPKQFDVIVTDNLFGDILSDAAAMLTGSLGMLPSAALGAPGKPGLYEPIHGSAPDIAGKGLANPLAAILSFEMALRWSLKQTEAADALLAAVKAALDNGARTRDLGGSLTTTQMGDAVLAAL

SEQ ID NO: 33094 - protein, 489 aa, Aspergillus nidulans FGSC A4
MTEDADFGLIGLAVMGQNLILNAADHGFTVCAYNRTTSKVDRFLENEAKGKSIVGAHSVEEFCSKLKRPRRIMLLVMAGNPVDQFIESLLPHLEEGDIIIDGGNSHFPDSNRRTKYLKEKGIRFVGSGVSGGEEGARYGPSLMPGGNEEAWPYIKDIFQSIAAKSDGEACCDWVGDEGAGHYVKMVHNGIEYGDMQLICEAYDILKRGVGLSSKEIADVFAKWNNGVLDSFLIEITRDILYFNDDDGTPMVEKILDKAGQKGTGKWTAVNALDLGMPVTLIGESVFARCLSALKDERIRASSLLNGPTPEFTGDKEEFIADLEQALYASKIISYAQGFMLIQNAAKEYGWKLNKPAIALMWRGGCIIRSVFLKDITEAYRKDPDLENLLFNDFFNKAIHNAQKGWRNVVSKGALWGIPTPAFSTALSFYDGYRTKALPANLLQAQRDYFGAHTFRIKPEHASEKYPADKDIHVNWTGRGGQVSASTYTA

SEQ ID NO: 33095 - protein, 658 aa, Zea mays
  misc_feature (571)..(571): Xaa can be any naturally occurring amino acid
  misc_feature (591)..(591): Xaa can be any naturally occurring amino acid
  misc_feature (619)..(619): Xaa can be any naturally occurring amino acid
  misc_feature (647)..(647): Xaa can be any naturally occurring amino acid
MGNTCVGPSITKNGFFQSVSTVLWKTSQDGDALPAAGSDANGPGRSQSTPPPALPKPASDVHVAVQSKAPEPVKIAASHSEPAPKAAAPVAANASPSSSPNSSAEALPTRPRPKAPPVKRVSSAGLLVGSVLKRRTENLKDKYSLGRRLGQGQFGTTYLCVERATGKEFACKSILKRKLVTDDDVEDVRREIQIMHHLAGHPNVISIRGAYEDAVAVHLVMELCGGGELFDRIVQKGHYTERKAAELARVIVGVVEACHSMGVMHRDLKPENFLFADQKEEAALKTIDFGLSIFFHPGQIFTDVVGSPYYVAPEVLKKKYGPEADVWSAGVIIYILLSGVPPFWAENEQGIFEEVLHGRLDFESEPWPSVSEGAKDLVRRMLIRDPRKRLTAHEVLRHPWVQVGGLAPDKPLDSAVLSRMKQFSAMNKLKNMALRVIAENLSEDEIAGLKEMFKMIDADNSGQITFEELKVGLKKVGANLQESEIYALMQASDAQADVDNNGTIDYGEFIAATLHLNKVEREDHLFAAFQYFDKDGSGYITADELQVACEEFGLGDVQLEDLIGEVDQGQXYVKPPLLLVPFFSSLLFCVXIVLDLLLQDGRIDYNEFVAMMQKPTVGXSRRRPTCRTASVSGSGRRSGWPRPLCLXLPCCLRVGVDD

SEQ ID NO: 33096 - protein, 545 aa, Ralstonia eutropha JMP134
MPTNLHAWNALQQHHDAIRDHQMADWFAENGADRVRQFSLEAAGLYLDYSKNRITPQTMQLLLQLADEAGVPARRDAMFAGEHINATEDRAALHVALRATAGAGFKVDGVPVVPAIQNVLVRMRAFSEAVRSGAWTGTTGERITDVVNIGIGGSDLGPKMVCRALSHLAHDDGHSGPRMHFVSNVDGTELAEALERLDPRRTLMIVCSKTFTTLETMANAHSARQWYLDNGVAEDQLARHFVAVSTNVDAVRAFGIDPANMFEFWDWIGGRFSLWSSVGLSTALAVGFNAFADLLAGGRAMDEHFRTAPLERNMPVVLGMLGIWYRNFFNLPTSCMAPYSTSLELFPAFLQQLEMESNGKTVQLNGRRVRTHTSPVVWGTAGTNGQHAYFQMIHQGSQIVPVDFVAPLVPPRELPGHHAKLLANCFAQAEALMRGRSAEELRAAGMTDELRIAHMVFEGNRPSNTLLMEDLTPHVLGALIALYEHRTFVQGVVWNINSFDQWGVELGKILARPIESELNGAQAGSHDASTAALIARARGVLARNG

SEQ ID NO: 33097 - protein, 487 aa, Pseudomonas fluorescens PfO-1
MKALDELTFDNRFARLGDAFSAHVLPEPIDNPRLVVASPAALALLDLDPAMADTQEFAELFGGHKLWADAEPRAMVYSGHQFGGYTPQLGDGRGLLLGEVYNAAGEHWDLHLKGAGQTPFSRMGDGRAVLRSSIREFLASEALHALNIPSSRAACVIGSDTPVWREKQERAAMVLRLAPSHIRFGHFEYFYYTKRPEQQKLLGEHVLAMHYPECLEQPEPYLAMFREIVERNAELIAKWQAYGFCHGVMNTDNMSILGITFDFGPFAFLDDFDANFICNHSDDQGRYSFSNQVPVGQWNLSTLAQALTPLISVEALRETLGLYLPLFQAHYLDLMRRRLGFTTAEDDDQMLLEQLLQLMQNSGVDYTLFFRRLGEESAEQAVARLRDDFVDIKGFDAWGERYVARVARDGATDQEQRRARMHAVNPLYILRNYLAQKAIDAAEQGDYSEVRRLHAVLSNPFEEQPGMESYAERPPEWGKHLEISCSS

SEQ ID NO: 33098 - protein, 580 aa, Pseudomonas fluorescens PfO-1
MNATTINSLFLIGALLVGASILVSSLSSRLGIPILVIILAVGMSAGVDGGGIIFDNYPTAYLVGNLALAVILLDGGLRTRVSSFRVALWPALSLATVGVLITTGLTGMAAAWLFDLNLIQGLLIGAIVGSTDAAAVFSLLGGKGLNERVTASLEIESGSNDPMAVFLTVTLIDMLASGQTGLHWSLLTHLIREFGIGGVIGLGGGWLMLQLVNRINLATGLYPILVIAGGLVVFALTNALHGSGFLAVYLCGLVIGNRPVRSRHGILHMLDGMAWLAQIGMFLVLGLLVTPHDLLPIALPALGLALWMILFARPLSVLVGLLPFKAFHGREKAFISWVGLRGAVPIILAVFPLMAGLPNAQLYFNLAFFIVLVSLLVQGTSLPWVAKLLKVTVPPEPAPISRAALEVHVTSEWELFVYKLGAEKWCIGSPLRELKMPEGTRIAALFRGQQLLHPSGSTVLEVDDLLCVIGHEHNLPALGKLFSQAPQRGLDLRFFGDFVLEGDAQLKAVAALYGLPAEGIDPDMTLGHFIAQKVGGAPIVGDQVEWNNTHWTVAVMDGNKIGKVGVRFPEGSRPGPGLFL

SEQ ID NO: 33099 - protein, 271 aa, Mycobacterium sp. JLS
MALDETDLQGLVDEAAAILDAASEPFISGHRADSAVQKKGNDFATEVDLKIERQVVDALTAATGIEVHGEEYGGADIDSPLVWVLDPIDGTFNYAAGLPTAAILLGLLRDGEPVAGLTWLPFMSQRYTAVVGKPLYVNGVEQPALQPGALSDCVVGTGTFNIDSRGRFPGRWRMALLENLSRKCNRIRMHGATGLDLAYAAGGALGGAISFGHHIWDHAAGVALVRAAGGVVTDLAGAEWTPDSKSVLAGSPQVHGEILEIVASVGAPEEF

SEQ ID NO: 33100 - protein, 617 aa, Arabidopsis thaliana
MAASETVLRVPLGSVSQSCYLASFFVNSTPNLSFKPVSRNRKTVRCTNSHEVSSVPKHSFHSSNSVLKGKKFVSTICKCQKHDVEESIRSTLLPSDGLSSELKSDLDEMPLPVNGSVSSNGNAQSVGTKSIEDEAWDLLRQSVVFYCGSPIGTIAANDPNSTSVLNYDQVFIRDFIPSGIAFLLKGEYDIVRNFILYTLQLQSWEKTMDCHSPGQGLMPCSFKVKTVPLDGDDSMTEEVLDPDFGEAAIGRVAPVDSGLWWIILLRAYGKCTGDLSVQERVDVQTGIKMILKLCLADGFDMFPTLLVTDGSCMIDRRMGIHGHPLEIQALFYSALVCAREMLTPEDGSADLIRALNNRLVALNFHIREYYWLDLKKINEIYRYQTEEYSYDAVNKFNIYPDQIPSWLVDFMPNRGGYLIGNLQPAHMDFRFFTLGNLWSIVSSLASNDQSHAILDFIEAKWAELVADMPLKICYPAMEGEEWRIITGSDPKNTPWSYHNGGAWPTLLWQLTVASIKMGRPEIAEKAVELAERRISLDKWPEYYDTKRARFIGKQARLYQTWSIAGYLVAKLLLANPAAAKFLTSEEDSDLRNAFSCMLSANPRRTRGPKKAQQPFIV

SEQ ID NO: 33101 - protein, 360 aa, Burkholderia vietnamiensis G4
MDDELNSRLKPLRDRIDAIDAQLIALLNQRAAVALEVGEVKKHFNAPVFRPERELQVIARLQDMSAGPLAGEHISAIWREIMAASRALEQTIHVAFLGPVGTYSEQAMFEYFGQSIEGLPCPSIDEVFRSVEAGAAAFGIAPVENSTEGAVSRTLDLLLQTQLLISGELALPIHHNLLTQSGTLAGVTRVCAHAQALAQCQQWLAANAPQLERQAVSSNAEAARLAAADPSVAAIAGDRAAAHYGLQVAFSLIQDDPHNRTRFVIVGKQPAGQSGHDQTSLIVSVKNEPGAVFKLLEPLARHGVSMTRFESRPARVGTWEYYFYIDIEGHRDDAAVAAALAELGQKAAFLKILGSYPRAR

SEQ ID NO: 33102 - protein, 544 aa, Vibrio vulnificus YJ016
MLKKCSKITLVLFQGKQGMSPKCRKLLKFDEVITMSAKKPLALVILDGYGYREDTASNAIANAKTPVMDALIANQPNTLISASGMDVGLPDGQMGNSEVGHTNIGAGRVVYQDLTRITKSILDGEFQQTAALVEAIDTAVKAEKAVHIMGLMSPGGVHSHEDHILAAVEMAAERGAEKIYLHCFLDGRDTPPRSAEGSLQRFQDLFAKLGKGRVASLVGRYYAMDRDNNWDRVQVAYDLLTQAKADFTYDSAVAGLAAAYERGENDEFVKATEIKAEGQESAAMQDGDAVIFMNYRADRARQITRTFVADFAGFERAAFPAVNFVMLTQYAADIPLAIAFPPASLENTYGEWLSKQGQTQLRISETEKYAHVTFFFNGGVETEFAGEERQLVASPKVATYDLQPEMSSTELTEKMVAAIKSGKYDTIICNYPNADMVGHTGVYEAAEKAIEALDASVGQVVEAIKEVGGQLLITADHGNAEMMVDPETGGIHTAHTSLPVPLIYVGDKAVEFKEGGKLSDLAPTMLSLAGLEIPAEMTGQVLVK

SEQ ID NO: 33103 - protein, 347 aa, Psophocarpus tetragonolobus
GGELFDRIVQKGHYSERQAATLIKTIVEVVEACHSLGVMHRDLKPENFLFDTLHEDAKLKATDFGLSVFYKPGESFCDVVGSPYYVAPEVLRKLYGPESDVWSAGVILYILLSGVPPFWAETEPGIFRQILLGKIDFQSEPWHSISDSAKDLIRRMLDQNPKTRLTAHEVLRHPWIVDDNLAPDKPLDSAVLSRLKQFSAMNKLKKMALRVIAERLSEEEIGGLKELFKMIDTDNSGTITFDELKDGLKRVGSELMESEIKDLMDAADIDKSGTIDYGEFIAATVHLNKLEREENLVSAFSYFDKDGSGYITLDEIQQACKDFGLDDVHIDDMIKEIDQDNDGQIDY

SEQ ID NO: 33104 - protein, 453 aa, Bordetella petrii
MTTLEVNQIIDNARFTRFHWMVMCLCGLLLIFDGYDLFIYGAVLPVLMKEWGLTPVQAGALGSYALFGMMFGAFVFGPLADRIGRKKGVALSFVLFSVATLLSGFATTPNEFGIYRFIAGLGCGGLMPNAVALMNEYAPKRARSTLVAIMFSGYSLGGVLCAGLGIYMLPRYGWQSMFFAAAVPLVLLPVIVWKLPESVGFLLRKGQHAKAREMLGKVAPDVPLPAGAQLVMADAKGAGVPMLDLFKQGRTVGTLMIWVSFFCCLLMVYALGSWLPKLMANAGYSLGSSLSFLLMLNFGGVMGAIMGGWLGDRFSLPKVVVAFFALGTVSIALLGFNSPMPVLYLLIAIAGATTIGTQILLYANTAQFYPLSMRSTGLGWASGIGRTGAIVGPLLGGSLMAAALSLKMNFLVFAAPGLVAALAIGVFILWYGRDLASTHATAPATRPAASGTV

SEQ ID NO: 33105 - protein, 194 aa, Anaplasma marginale str. St. Maries
MQGLFMFIQIEVTPNPDALRFLLSAEIGAIGSGIEFSDATTAQGSTLARLLFEIQGVSKVFFGGDFVSVTKLPDADWDTLRPEILVVMTDYFSLHNAYSDAAPQAHEESDEREFFDTKDSEVVQRVKELIEHYVRPAVAQDGGDIKFRGYKEGVVFVHLRGACSGCPSAAVTLKDGVYGMLSYYVPEVKAVESV

SEQ ID NO: 33106 - protein, 293 aa, Synechococcus sp. WH 7803
MVSPDHEPMDDALRVSVLSEALPYIQRFAGRRIVVKYGGAAMVHAELQSAVFRDLALLRSVGVQPVVVHGGGPEINHWLKRLDIDPEFREGLRVTDAATMDVVEMVLVGRVNKQIVNGLNRLGARAVGLSGSDGCLVEARAWGDGSHGLVGDVARVNPDVLEPLLDRGYVPVISSVAANAEGVAHNINADTVAGELAAALEAEKLILLTDTPGILRDRESPESLIRQLKLSEARQLIDDGIVAGGMTPKTECCIRALAQGVSAAHIVDGRVAHALLLEVFTDAGIGTMVLGRS

SEQ ID NO: 33107 - protein, 239 aa, Oryza sativa
MSKKQWTAACAGEGVSEHYTSSGKRREKSKREREREMDHHQHHEQQQQRMVEMRMGMAMGEAYVGGGEVVAREAAAQALGAVVQLHFDKTLEKKRAADAQKQELWRLFLAFFLFLAILLSAVAQSPPSRLQCRHLWAPAGLLSLAHLAFYAAVAHHLRCLNGFRYQRRCHKLTLALAADRLRMLKSGGDVVAAADVEVPYQEPPESYLAKFKRSWAIHFAFLITTFAFSVAAAVAILCF

SEQ ID NO: 33108 - protein, 339 aa, Synechocystis sp. PCC 6803
MLKIGINGFGRIGRLVARIAMANPQVTLVGINDLVPASNLAYLFKYDSTHGSYGGTVVAKEEGIVIDDQFIPCFSQRNPAQLPWGDLGADYVVESTGLFTTYATAENHLKAGAKRVIISAPSKDPEKIPTFVVGVNHLNYNADTDKIVSNASCTTNCLAPIAKILDDNFGIVEGLMTTVHAMTATQPTVDGPSKKDFRGGRGAAQNIIPSSTGAAKAAALVLPQLKGKLTGMAFRVPTPNVSVVDLTFKTEKATSYEEICAAMKTAAEGELKGILGYTADDVVSMDFRTDPRSSIFDAGAGIGLNSNFFKVVSWYDNEWGYSCRVIDLMLTMASKDGLV

SEQ ID NO: 33109 - protein, 141 aa, Synechococcus sp. WH 7803
MHAALTRLGRHLKSLTLSLCLGLALLLTACGDSTTSLLSGDYVEDTVAVVHMLQNTLALPADAESLQDSEHEAHDLINDYMSRYRPRPQVNGLSSFTTMQTALNSLQGHYNTYTNRPVPEALKTRVEKELSKAEKAALRGT

SEQ ID NO: 33110 - protein, 341 aa, Chlamydomonas reinhardtii
MSGKIKIGINGFGRIGRLVMRATMLRPDIEVVAINDPFIDAEYMAYMFKYDSVHKTWPGHVNGSKDGFLVEGRKIHTFTESDPSKINWGAAGADIVIESTGVFTDIAKATAHLTGGAKKVIITAPSNDAPMYVMGVNHEKYNPATDHIISNASCTTNCLAPLAKVVNSKFGIKEGLMTTVHATTATQKTVDGPSKKDWRGGRAVNGNIIPSSTGAAKAVGKVLPELKGKLTGMAFRVPTNDVSVVDLTVTLEKATTYEDIMKALKEASEGEMKGVLAYTDEDVVSSDFVTDPASCTVDAKAGIMLSPTFVKLVAWYDNEWGYSNRVVDLALHVAKKAAVKV

SEQ ID NO: 33111 - protein, 363 aa, unidentified eubacterium SCB49
MSAMAVKHDAINLSQGFPDFKSDPKLSALVAKSMTDGYNQYAPMAGDIKLREVICDKVQRLYDANYNAATDIVITAGATQAIFTAIAATISKGDEVIIFTPAYDCYAPTIHLFGGNVIELQLASPHYTPDWDEVKKVITSKTKMIIVNSPHNPSGMVFSEDDMLQLQHISEANDLIVISDEVYEHIIFDGEIHQSAARFLTLAKRTFIVASFGKTFHNTGWKMGYCIGPESLMKEFKKVHQYNVFSVNHPFQKGLAEYLQDENHYLHLGAFYQQKRDLFLDLIKDSRFKIIPSKGTYFQLLDFSEISNESDMVFAERLTKQNKLATIPISVFNKNKMDEKQIRVCFAKREETLKAAAAILKSL

SEQ ID NO: 33112 - protein, 437 aa, Triticum aestivum
HYRTSLYKKAGWYRSGIPGISSTHASGEDGLASLALICSFAKMRSHLGLDAAVKEDGVPKTTVLAVAKVLRCSAALRVSEDGKRVGRANELLKPDEIIVQIDSRSIAVSPLPHNVKLEDVQSFFTQYGKVNSVRLPKHVSDKRQFCGTALVEFSEEDEANNIMNNKLSFAGADLEIKTKKEFDAEMEAKKEAYEKSHPNTHPNKNGHDEGYPKGLILSFKLKRILADGDTEQNGGDKVDNSDNAKKEGASDSAEESGKASEEKAPENTDAKEEKSDDAEELKGSDAQSVKKDDKSLSENDKEPVSREDFKEYFAKFGTVRYVDFSKGDDSGYLRFEESTAAEKARAFAALADEGGLVMKGHLVTLEPVSGQAEKDYWSGIKGGQGRFNNNNRSNRGGRDWKNNRGGGGRHHGGGKRGGRHSDNHERANKVQKLDSSP

SEQ ID NO: 33113 - protein, 127 aa, Aeropyrum pernix K1
MSKPIYVRFEVPEDLAEKAYEAVKRARETGRIKKGTNETTKAVERGLAKLVVIAEDVDPPEIVMHLPLLCDEKKIPYVYVPSKKRLGEAAGIEVAAASVAIIEPGDAETLVREIVEKVKELRAKAGV

SEQ ID NO: 33114 - protein, 339 aa, Mycobacterium tuberculosis H37Rv
MTVRVGINGFGRIGRNFYRALLAQQEQGTADVEVVAANDITDNSTLAHLLKFDSILGRLPCDVGLEGDDTIVVGRAKIKALAVREGPAALPWGDLGVDVVVESTGLFTNAAKAKGHLDAGAKKVIISAPATDEDITIVLGVNDDKYDGSQNIISNASCTTNCLAPLAKVLDDEFGIVKGLMTTIHAYTQDQNLQDGPHKDLRRARAAALNIVPTSTGAAKAIGLVMPQLKGKLDGYALRVPIPTGSVTDLTVDLSTRASVDEINAAFKAAAEGRLKGILKYYDAPIVSSDIVTDPHSSIFDSGLTKVIDDQAKVVSWYDNEWGYSNRLVDLVTLVGKSL

SEQ ID NO: 33115 - protein, 633 aa, Caulobacter crescentus CB15
MENILTQTLVYLGAAVVSVPIAKRLGLGSVLGYLIAGVLIGPFALSLVGDQADVMKFAEFGVVILLFLIGLEVQPSTLWDMRKAIFGLGGAQVVGTALAIAAVALGLGLPWQTALAVGLVLAMSSTAIVLQTLDEKGLRQGPVGRAAFGVLLLQDLAVIPLFALLPLLAISAPQHAAEAGGHGGSLVATLPVWAQTLSVFAAVAAVVGGGRYLVRPLFRFIAKARLREIFTASALLIVVAVASLMQTVGLSPALGAFLAGVVLAESEFRRELETDIEPFRGLLLGLFFMTVGAGVDLPLVARQPLTLVGLVLGLMVLKFLVMYGIARLFGAQKRGALAVATALAQGGEFAFVLLTFTVGAGVIGAQLAALLTAAIAVSMALTPVAMILYERVAALMDAAIPDVTPDTGDFDEGEPDIIIAGFGRFGQVTGRLLAANGFKSTVLDTDIEQIELLRRFGRRVHYGDATRLDLLRQAGADRARMLIVALDDREKTVELVETARKAFPNLTILARAWDRRHAYDLLSNGADAVERETFESALTLGATALQKLGFRAHRAHRAAAFFRRHDRRVFEELRPMWGQEEAYILASRDAAKTMDRLLDADLHRMRPGDVGGAWDTASLDEELRERAQQEGAN

SEQ ID NO: 33116 - protein, 412 aa, Mycobacterium tuberculosis H37Rv
MSVANLKDLLAEGVSGRGVLVRSDLNVPLDEDGTITDAGRIIASAPTLKALLDADAKVVVAAHLGRPKDGPDPTLSLAPVAVALGEQLGRHVQLAGDVVGADALARAEGLTGGDILLLENIRFDKRETSKNDDDRRALAKQLVELVGTGGVFVSDGFGVVHRKQASVYDIATLLPHYAGTLVADEMRVLEQLTSSTQRPYAVVLGGSKVSDKLGVIESLATKADSIVIGGGMCFTFLAAQGFSVGTSLLEDDMIEVCRGLLETYHDVLRLPVDLVVTEKFAADSPPQTVDVGAVPNGLMGLDIGPGSIKRFSTLLSNAGTIFWNGPMGVFEFPAYAAGTRGVAEAIVAATGKGAFSVVGGGDSAAAVRAMNIPEGAFSHISTGGGASLEYLEGKTLPGIEVLSREQPTGGVL

SEQ ID NO: 33117 - protein, 261 aa, Mycobacterium tuberculosis H37Rv
MSRKPLIAGNWKMNLNHYEAIALVQKIAFSLPDKYYDRVDVAVIPPFTDLRSVQTLVDGDKLRLTYGAQDLSPHDSGAYTGDVSGAFLAKLGCSYVVVGHSERRTYHNEDDALVAAKAATALKHGLTPIVCIGEHLDVREAGNHVAHNIEQLRGSLAGLLAEQIGSVVIAYEPVWAIGTGRVASAADAQEVCAAIRKELASLASPRIADTVRVLYGGSVNAKNVGDIVAQDDVDGGLVGGASLDGEHFATLAAIAAGGPLP

SEQ ID NO: 33118 - protein, 560 aa, Pseudomonas fluorescens SBW25
MTTLRIHGMTCASCADRVRDALEGISGVHRADVSYAGGKAEMTADAAVSREQMQAAVEALGYQASFEVASLQPRPGQLDKALGWLRSDTEVGKNGDALHIAVIGSGGAAMAAALKAVEAGARVTLIERGTIGGTCVNVGCVPSKIMIRAAHVAHLRRESPFDDGMPATPPTVLRERLLAQQQGLVDELRHAKYEGILESTPAITVLRGTARFQDGHTLSVELVEGGGREVAFDRCLIATGAGAAVPPIRGLQDTPYWTSEEALASASIPQRLAVIGSSVVALELAQAFARLGSRVTILARNSLFFREDPAIGEALTAAFRMEGIDVLEQTQASQVTHANGEFVLTTNHGELRADQLFVATGRTPNTQSLNLEAAGVLLDERGAIQIDQGMRSSAVDIYAAGDCTNQPQFVYVAAAAGTRAAINMTGGEATLNLDAMPAVVFTDPQVATVGYSEAEAQRAGLETDSRTLSLDNVPRALANFDTRGFIKLVAEAGSGRLLGVQAVAPEAGELIQTAVLAIRNRMTVQELADQLFPYLTMVEGLKLAAQTFTKDVKQLSCCAG

SEQ ID NO: 33119 - protein, 88 aa, Glycine max
MAGGGKVSFKVTLTSDPKLPFKVFSVPEAAPFTAVLKFAAEEFKVPPQTSAIITNDGVGINPQQSAGNVFLKHGSELRLIPRDRVGAF

SEQ ID NO: 33120 - protein, 484 aa, Arabidopsis thaliana
MKLVEKTTTTEQDNGEDFCRTIIEVSEVNRNVFQAPGGEADPFRVVSGEELHLIPPLNFSMVDNGIFRSGFPDSANFSFLQTLGLRSIIYLCPEPYPESNLQFLKSNGIRLFQFGIEGNKEPFVNIPDHKIRMALKVLLDEKNHPVLIHCKRGKHRTGCLVGCLRKLQKWCLTSIFDEYQRFAAAKARVSDQRFMEIFDVSSFSHIPMSFSCSISMTPILQQHAKRILACGYKSSLFRSYATLWSPEASQTLLIRASRYMGKEKVCTLFQKDYAARLYLIETLLGLEEADKFFKSIPSNMIDYSTLLTSYARSDDVKPDNVTANTVLKADVKAIKMFMRMWVDEEGIKLERDRIVEMAKVYVRVCLEIYGNVVWNARELLQTLWDDFKKCEEVYRTAVISLSKLDDVEGAEDIYGEGEKKEQNVREQVTKKAMMLLHVLNLLLILITLSLPFFVCPPNLSIPLVVLSVILTHISITRLLRFVFF

SEQ ID NO: 33121 - protein, 270 aa, Glycine max
FIHAEQGTKLTFLPYVVKALVSALKKYPALNTSFNEEAGEVVHKHYWNIGIAADTDKGLLVPVVKHADRKSIFEISDEINELAVKARDGKLTSEEMKGATCTISNIGSAGGQWFTPVINHPEVAILGIGRIAQKPIVKDGEIVAAPVGKNMVVGDFPIETDTIVIGAGPGGYVAAIRAAQLGQKVTIVEKAQNSENLGVIAESVSLNYQKVQEFKTSVVNKLTGGVEGLLKGNKVEIVRGEAYFVDNNSLRVMDEKSAQTYNFKHAIIAT

SEQ ID NO: 33122 - protein, 520 aa, Ralstonia eutropha JMP134
MSDTHPSQTTPRDAADSVATLSAPFPTMPGFAELGERFFTRLRPTPLPSAYLVSVAPNAAALLGMPVEAASEPDFIEAFVGNSVPDWADPLATVYSGHQFGVWAGQLGDGRAIRLAQAQTDTGPWEIQLKGAGLTPYSRMADGRAVLRSSIREYLCSEAMAALGVPTTRALSIIGSDAPVRRETIETAAVVTRLAPTFIRFGHFEHFAAHEDVAALRQLADFVINNFMPACREAAQPYQALLREVSLRTADMVAHWQAIGFCHGVMNTDNMSILGLTIDYGPFGFLDAFDANHICNHSDTQGRYAYSQQPQVAFWNLHCLAQALLPLWLEPGADEAARDGAVAQAREALDPFRDRYASEFFRHYRAKLGIHMPAGGDKEDEPLLTSLFQLLHEQHVDYTLFWRNLARISSADGSGDAPVRDLFLDRAAWDTWAESYRNRLRAEQSDDAARRVAMLAVNPKYVLRNHLAEIAIRRAREKDFSEVDRLLAVLSRPFDEQPEAEAYAALPPDWAGGLEVSCSS

SEQ ID NO: 33123 - protein, 91 aa, Triticum aestivum
  misc_feature (12)..(12): Xaa can be any naturally occurring amino acid
  misc_feature (40)..(40): Xaa can be any naturally occurring amino acid
MADPVGDFGLIXLAVMGQNLILNTADHGFTVVAYNRTVSXVDRFLENEAKGKSIVGAHSIEEFCAKLKKPRRIMLLVMAGKAVDDFIEEPP

SEQ ID NO: 33124 - protein, 256 aa, Mycobacterium sp. JLS
MLELKTPREIEAMRTTGAFIAGLLDDLQTRARVGVNLLDLEQRARQLIDERGAVSCYWDYAPSFGRGPFRNVICLSVNDAVLHGLPHDYTLRDGDLLSMDIAVSIDGWVADSARSIIVGTPQAADQRLIEATEQALVAGIDAARPGNRLGDISAAIGSVAADYGYPVNTDFGGHGLGRTMHEDPHVPNRGRPGRGLVLRPGLTLALEPWFARGTDRIVYDPDGWTIRSADGSRTAHSEHTIAVTDGDPLVLTRRAA

SEQ ID NO: 33125 - protein, 466 aa, Burkholderia vietnamiensis G4
MKITIIGTGYVGLVTGSCLAEIGHDVFCLDVDPRKIEILNNGGMPIHEPGLLDIIARNRAAGRLRFSTDIEASVAHGEIQFIAVGTPPDEDGSADLQYVLEAARNIGRHMTGFKVIVDKSTVPVGTAQRVRAVVDDALAARGLGGSVAHRFSVVSNPEFLKEGAAVEDFMRPDRIIIGVDHDETGSVAREKMKKLYAPFNRNHERTIYMDVRSAEFAKYAANAMLATRISFMNEMSNLADKVGADIEAVRRGIGSDPRIGYHFLYAGVGYGGSCFPKDVQALIRTAGENGQPLRILEAVEAANSAQKDVLIGKIEQRFGADLSGRTFAVWGLAFKPNTDDMREAPSRRLIAALLARGATVRAYDPVAIDEARRVFALDFEAGADALARLHFVDTQDAAVAGADALVIVTEWKEFRSPDFTRLKAELKAPVIFDGRNLYEPDAMAEIGIDYYAIGRPYVDPQTVSRG

SEQ ID NO: 33126 - protein, 328 aa, Solanum lycopersicum
MASFSYLMSVLVLCVIIGYTNAQLELNFYAKSCPKAEKIIKDFVQQQVPKAPNTAAAILRMHFHDCFVRGCDGSVLLNFTSTNGNQTEKLANPNLTLRGFSFIDAVKRLVEAECPGVVSCADIVALVARDAVVATEGPFWNVPTGRRDGTISNVSEANGDIPAPTSNFTRLQQSFAKKGLDLNDLVLLSGAHTIGVSRCSSFSERLYNFTGVVGTQDPSLDSEYADNLKSRKCRSINDNTTIVEMDPGSFKTFDLSYFKLLLKRRGLFQSDAALTTRTSTKSFIEQLVDGPLNEFFDEFAKSMEKMGRVEVKTGSAGEIRKHCAFVNS

SEQ ID NO: 33127 - protein, 554 aa, Glycine max
ICTTDASSISPWVIGFRGTTTTFPPSAVSTTSKWLGFVAAVWIQCISGNNYTFSNYSDALKSLMHLTQLQLNNLSVAKDVGKAFGLLAGLASDRFPTWAILLIGSVEGLIGYGTQWLVVSQRIQPLPYWQMCVFLCMGGNSTTWMNTAVLVTSIRNFRSNRGPVSGILKGFVGLSTAIFTTLCSALFADDPGSFLIMLSVIPFAVCLTGVFFLREILPVASADADAEEVKYFGVFNVVAVAMALFLLAYGFIPSPSMLVSRVFVAVLVVMLVSPLGIPVYSYLKGSFGEGNDVEGQRVKEPLLQIPEKENEAVAAEIVKRVPVVGEEHTIMEALRSVDFWILFVSFLCGVGTGLAVMNNMGQIGLALGYPDVSLFVSLTSIFGFFGRIISGTVSEFTIKKAGTPRPLWNAASQLLMAVGYILLAMAMPGSLYIGSILVGMCYGVRLAITVPTASELFGLKYYGLIYNILILNLPLGSFLFSGLLAGILYDMEATTTEGGGNTCVGGHCYRLVFVVMTGACIVGFFLDILLSIRTKNIYTKISMSKKSLATSNRQ

SEQ ID NO: 33128 - protein, 506 aa, Azoarcus sp. EbN1
MTAAIPDYLEKTLNARVYDVAEETPLDLAPNLSARIHNRIYLKREDMQPVFSFKLRGAYNKMAHLPPQALKRGVICASAGNHAQGVALSAQKLGVRAVIVMPTSTPQIKVDAVRARGGEVVLAGDSYSDAYAHSLELEKVDKLTFVHPYDDPDVIAGQGTIGMEILRAHPDPIHAIFCAVGGGGLIAGVAAYVKRLRPEIRIVGVETVDADAMTRSLAAGERVVLDQVGLFADGTAVKQIGEETFRLCREYVDEMVLVDNDAICAALKDVFEDTRSILEPSGALAIAGAKEYAKRHNLHGKCLVAVASGANMNFDRLRFVAERAEVGEQREAVFAVTIPERPGSFRKFCSLVGDRHITEFNYRYADAEQAHIFVGVSVHNRAEASRLIEMLGRHELPAVDLTDDEMAKSHVRYMVGGHAPHIDNELVYRFEFPERPGALMNFLTNLHSDWNISLFHYRNHGSDSGRVLVGMQVPPGDKTAFSAFLDRLGYESADESGNPAYRMFLG

SEQ ID NO: 33129 - protein, 506 aa, Ralstonia eutropha JMP134
MSSHSHPHPHQHPVVEHDDLQRKLKARHLTMIAIGGAVGTGLFVASGASIAQAGPGGALLMYALLGFMVYCLMTSLGELAVHMPVAGSFVTYSALYVEEGFGFALGWNYWFSLAVTIAVELTAAQLVMQFWFPGMPGMVWSAGFLLLMFALNAFSVRGFGEAEYWFALIKVITVIVFLGVGLLMIFGIMKGGPQSGWHNFTTGDAPFVGGIPAMIGVAMIAGFSFQGTETVGVAAGEAQDPARTIPRAIRQTFWRILLFYVIAILIIGVLIPYTDPNLLRNDVTDVGVSPFALVFRQAGLAFAAGLMNAVVLTALLSAGTSSMYVSTRILYGLAVSGRAPRWLGKLTVNGVPFNALLVTTAVGALCFFSSLFGDKAVYLWLLNTSAMTGFFAWFGIALSHYRFRRGLVYQGYDINALAYRSPLYPFGPIFAGVLCLVIVAGQNYQAFADIPNRWPEIIATYIGVPVFLALWLGYRIVRKTRLIDYEDMPFELPKTAKVIAGQAAQV

SEQ ID NO: 33130 - protein, 320 aa, Burkholderia sp. 383
MSSHSHDGLMVFTGNANPALAQEVVNILGIPLGKAMVSRFSDGEIQVEIQENVRGKDVFVLQSTCAPTNDNLMELMIMVDALKRASAGRITAAIPYFGYARQDRRPRSARVAISAKVVANMLEIAGVERIITMDLHADQIQGFFDIPVDNIYATPILLGDLRKQNYSDLLVVSPDVGGVVRARALAKQLNCDLAIIDKRRPKANVSEVMNIIGEVEGRTCVIMDDMVDTAGTLCKAAQVLKERGAKQVFAYATHPVLSGGAGDRIAASALDELVVTDTIPLSAESLGCSKIRALTSASLLAETFSRIRRGDSVMSLFAES

SEQ ID NO: 33131 - protein, 289 aa, Pseudomonas putida GB-1
MSDLSVMVVGCGDVGGRLALQMLAKGWQVSGLRRSVEQLPAGVQPVAADLAEPSIPQAWPQGPLDYLVYCVAASQHDEAGYQAAYVDGLRHVLAWLVERGQRPRRLLFVSSSSVYAQKDGEWIEEGAATEPEGYSGRVMLEAEQLARASGIPASVVRLTGIYGPGREWLLSQVRQGYRVAEEPPLYGNRIHAEDAASLLAFLLQADADGMALDECYIGVDDDPAPLADVVAWLRAYMGVTEWSDEQRVRRTGSKRCSNARARALGWAPVYPSYKEGYAAILQGKNQSQA

SEQ ID NO: 33132 - protein, 693 aa, Ralstonia eutropha JMP134
MTAQYQVQDGVAVITLDNPPVNGLGHSTRLGIVDGMTRALDDAAVKAIVITGAGKAFSGGADIREFNTPKATQEPTLHSVIRVIEGSSKPVVAAVHSVAMGGGLELALGCNYRVASKGAQIALPEVKLGLLPGAGGTQRLPRVIGLEAAANMIVSGTAVPSEKFAGTKLFDEIVDGDVLPAAVKFAQNVAAAPGPYPKVRDLKVRHENPEGFLGFAKTTVGAMAKNFPAPLKCLEAVAGSLKPFEQGLKEERDGFLYLVTTPESRALRHAFFGERAASKIPDVPSDTPLRKIEKIAVIGAGTMGGGISMNFLNAGIPVTILETKQEALDRGIGIIRKNYENSAKKGKLTQEKVEQRMGLLSTTLSYDDIKDADMVIEAVFEEMGVKEIVFKKLDEVMKQGAILASNTSTLDVDKIASFTKRPQDVVGMHFFSPANVMKLLEVVRGAKTGKDVLATVMAIGKKIKKTAVVSGVCDGFIGNRMIEQYSRQAGYLLDEGALPEQVDRAIEKFGFAMGPFRMGDLAGNDIGWAIRKRRAVDKPDIQYSKTADLLCEMGRYGQKTGAGWYDYKAGDRKPYPNQQVNDMIVQHSKDLGITRRKISDEEIVERLVFALVNEGAKILEEGIASKASDIDMVYLTGYGFPLFRGGPMLYADQVGLYNVALSMKKYAKGYHGEAWQVAPLLQKLADEGKGFND

SEQ ID NO: 33133 - protein, 516 aa, Arabidopsis thaliana
MKEPLQKKKVVVRHLPPSLSQSDLLSQIDPRFADRYNWVSFRPGKSSYKNQKYSRAYVSFKAPEDVYEFAAFFNGHVFVNEKGAQFKAIVEYAPSQRVPKPSDKKDPREGSISKDPDYLEFLKVIAQPVENLPSAEIQLERREAEQSGASKAAPIVTPLMEFIRQKRATVMGPQGLSDIRRGGRRTRVVSANKPSPRPSKRNSEKKKYVEKESSKNVPRKTTADVSSSKPDYRQSNSSGKELPGNETAAIIDSSPPGIALTMDSGKKKILLLRSKDRDNPDNPPPQPEQHIDTNLSRNSTDSRQNQKSDVGGRLIKGILLRNDSRPSQSSTFVQSEQRVEPSEAENYKRPSRPANTRAGKDYHTSGTISEKQERRTRNKDRPDRVMWAPRRDGSEDQPLSSAGNNGEVKDRMFSQRSGEVVNSSGGHTLENGSARHSSRRVGGRNRKEEVVIGEGKTSRRGSGGGPSSHEASQTKAKYMSHSTGFCPSMGIYRSQSKWGSNIINITWVLETFGPTL

SEQ ID NO: 33134 - protein, 300 aa, Burkholderia vietnamiensis G4
MAYKTIEDTIGNTPLVQLVRLPDDEIRARNNVVLAKLEGNNPAGSVKDRPALSMISKAEARGRIKPGDTLIEATSGNTGIALAMAAAIRGYKMVLVMPEDLSVERRQSMAAYGAEIILTPVKGGMELARDLAEQMQREGKGVILDQFGNPDNPVAHYESTGPEIWRDTEGRVTHFVSAMGTTGTIMGTSRYLKEQNPAIEIIGAQPEDGSRIPGIRKWPEAYMPTIFDRSRVDRVENVSQAASETMARRLAAVEGIFAGISSGGACEVAMRIARQVENATIVFIVCDRGDRYLSTGVFPA

SEQ ID NO: 33135 - protein, 126 aa, Zea mays
  misc_feature (28)..(28): Xaa can be any naturally occurring amino acid
MESVVNPKAYPLADAQLTMGILDIIQQXAANYKQLKKGANEATKTLNRGISEFVVMAADTEPLEILLHLPLLAEDKNVPYVFVPSKQALGRACGVTRPVIACSVTSNEGSQLKLQIQGLKVLNILP

SEQ ID NO: 33136 - protein, 170 aa, Synechococcus sp. WH 7803
MDLRALSPSPSPGLVNLLVEIPAGSRNKYEYFKDCGVMALDRVLHSSVRYPFDYGFIPNTLAEDGSPLDAMVIMEEPTFAGCLIQARPIGVLDMHDMGHYDGKILCVPVADPRQAKIHSIHQIAPNQLEDVAEFFRTYKNLEGRVTEIGGWRDSEAVQPLLQACIEAAHR

SEQ ID NO: 33137 - protein, 191 aa, Zea mays
  misc_feature (179)..(179): Xaa can be any naturally occurring amino acid
  misc_feature (182)..(182): Xaa can be any naturally occurring amino acid
MAGEGDIKLLGMVVSPFVVRVRMALHMKGVSYEYIEQDLFNKSELLLRSNPVNKKVPVLIHGGKPIYESLVIMQYADEVWSGKGASILPADPHERAVARFWAAYVDDKMFPAYIDIMKAATEEARAEKAKEALVGLANLEEAFAQCSKGKPFFAGDSVGYLDLAVGCNLFWLEAIRKMXWGXTFFDVGKTP

SEQ ID NO: 33138 - protein, 210 aa, Anaplasma marginale str. St. Maries
MNVEPLASGVFAPIDEVIEAASQGKAFVLLDDAERENEGDLVVLADKVSVATINMMIRYGSGIICLAISEQHANRLGLALMPRRNAKDGCTAFTTSIDARYGITTGVSAYDRATTILAAVAEHSTADDIVTPGHVFPIIADSGGVTKRAGHTEASVEIAKLAGATSAAVICELMNPDGTMSRLPEIIAFAQAHDVGVTTIKGLVEYLSNS

SEQ ID NO: 33139 - protein, 354 aa, Trichodesmium erythraeum IMS101
MVNTQAREDLHIRLEETQLLDRDCTTLSRHVLQQLHFSPDAQDISSLMNRIGLAGKLIARRLTRAGLLEDTLGFTGTVNVQGESVKKMDIYANDVFISVFKQSGLVCRLASEEMEKPYYIPENCPIGRYTLLYDPLDGSSNLDTNLNVGSIFSVRQQEGNDENGLAQDLLQNGHKQIAAGYILYGPSTMLVYSIGQGVHAFTLDPSLGEFILVNENIKIPEHGPVYSVNEGNFWQWDDSMRDYIRYVHRHEGYTARYGGALVGDFHRILYQGGVFLYPGTVKKPEGKLRLLYESAPMGYLVEQAGGRASTGTEEILDVVADQLHQRTPLIIGSKEDVALVESFIKEQKRISNQG

SEQ ID NO: 33140 - protein, 509 aa, Trichodesmium erythraeum IMS101
MVAVLENPLRVGLQQDRVPEPQIMIIFGASGDLTQRKLVPALYQMKLERRLPPELTIVGVARREWSHDYFREQMKIGVEEFGGGLQSEELWNDFAKGIFYCPGNIDQPEDYQRLKKLLSQLDEERGTRGNRVFYLSVAPRYFGEATQQLGAAGMLVDPKKQRLVIEKPFGRDLSSAQVLNKIVRQVCPEEQIYRIDHYLGKETVQNLMVFRFANAIFEPLWNRQFVDNVQITVAETVGLEGRAGYYETSGALRDMVQNHLMQLFSLTAMEPPNSLDADSIRNEKVKVVQATRLANLERLEYSAIRGQYTQGWMKGKSVPAYREEGGANPNSTTPTYAALKLNIDNWRWKGVPFYLRTGKRMPKKVSEIAIQFKEVPFLMFQSAAKQANPNVLALRIQPNEGVSMRFEVKTPGSSLRTRSVDMDFRYDTAFGKPSTDAYSRLLVDCMLGDQTLFTRGDEVEASWRALTPILSIWDAPAPPEVIPLYEAGTWGPVEAELLLNQDGRRWRRL

SEQ ID NO: 33141 - protein, 120 aa, Trichodesmium erythraeum IMS101
MDSISITGIRCYGYIGFFPEEKVLGQWFEVDLTLGLDLTAASKSDALEDTVDYGSIVNTVQKLVKQSKSALLEKVANTIATDILQQRLVQNVKVRLTKLAAPIPDFGGKVTIEITRVKEK

SEQ ID NO: 33142 - protein, 236 aa, Ostreococcus tauri
MVFFNQFPYSVARRPATATEREKMPGILNERSIPVLAALWTLTLVLIVRGTRVEEGSALGIDWARLWLLFTRINPYFFSALGIAAAVGLSVAGAAWGIFITGSTLLGAAVHVPRITSKNLISVIFCEAVAIYGVIIAIILSTKLSDVPRDPDTGAYHPSTMMAGYAVFASGLTCGLANLVCGICVGVVGSSCALADAANPALFVKILVIEIFGSALGLFGVIVAIILSSNAVFEKV

SEQ ID NO: 33143 - protein, 344 aa, Helicobacter pylori
  misc_feature (101)..(101): Xaa can be any naturally occurring amino acid
  misc_feature (244)..(244): Xaa can be any naturally occurring amino acid
MALLFTGACGYIGSHTARAFLEKTKENIIIIDDLSTGFLEHIKALERYYPNRVAFIQANLNETQKLDTFLNKQQLKDPIEAVLHFGAKISVEESTRLPLEXYTNNTLNTLELVKLCLKHAIKRFIFSFYGRGLWRVCSSLSEESPLNPINPYGASKMMSERILLDISKVADFNCVILRYFNVAGACMHNDYTTPYTLGQRTLNATHLIKIACECAVGKRKKMGIFGTNYPTRDGTCIRDYIHVXDLANAHLASYHTLLEKNKSEIYNVGYNQGHSVKEVIEKVKEISNKDFLVEILDKRQGDPASLIANNSKILQNTPFKPLYNNLDTIIKSALDWEEHLLKFQ

SEQ ID NO: 33144 - protein, 473 aa, Methanocaldococcus jannaschii DSM 2661
MTTVMKFGGTSVGSGERIRHVAKIVTKRKKEDDDVVVVVSAMSEVTNALVEISQQALDVRDIAKVGDFIKFIREKHYKAIEEAIKSEEIKEEVKKIIDSRIEELEKVLIGVAYLGELTPKSRDYILSFGERLSSPILSGAIRDLGEKSIALEGGEAGIITDNNFGSARVKRLEVKERLLPLLKEGIIPVVTGFIGTTEEGYITTLGRGGSDYSAALIGYGLDADIIEIWTDVSGVYTTDPRLVPTARRIPKLSYIEAMELAYFGAKVLHPRTIEPAMEKGIPILVKNTFEPESEGTLITNDMEMSDSIVKAISTIKNVALINIFGAGMVGVSGTAARIFKALGEEEVNVILISQGSSETNISLVVSEEDVDKALKALKREFGDFGKKSFLNNNLIRDVSVDKDVCVISVVGAGMRGAKGIAGKIFTAVSESGANIKMIAQGSSEVNISFVIDEKDLLNCVRKLHEKFIEKTNS

SEQ ID NO: 33145 - protein, 658 aa, Ostreococcus tauri
MNRVFQGADVVPSDIAAGMGLLAIQHRHLIEEQPLGKPFLNDSDALAPYESLGEMYTDAAHYSRFALAAYGWALFAWADPRTGLGMACSAEACANCCGCTSCMKRSNEVEPHDLDRKALKKCAGIESEDLLFVSMVNGIGEPPFFIARDVRRKAIVISIRGTLSVADCITDSMYKPCILNPDVIIETGLQGADLHVHSGVFRATNFILSELAESRILEQAILGEAPTEGCTPLPSTAAGCRGWGLVITGHSLGAGVAANLSLHLRKKFHTLKVWCIEPPGGVLSPKLCEITKEWTYSTVHHCDLFCRLSGPCLLKLRGDMMDALTNSKLNKFSLLMRMTFSGTKLQISDVLDPTQAASESTTLRDDFRRYADEQISVTPLMSAPLHPPGHLIHLQRLPHGEYAPHLVEASEFMARGMMIQYGFFSDHFPDKVAAVLSDLASASTGASQAISSEGTVSEDTLIDKLVSSEGPHAILSLRLYSHASTDDRRLRALGADELHRARVLSRSNARVRQKGASTNEARRRRLTPSSVVEHFDNPRNVGSFDKKDMNVGTGIVGAPACGDVMKLQIKIDEEGNIVDSCFKTFGCGSAIASSSVATEWIKGTHMDEAVTIKNQDIAKHLNLPPVKLHCSMLAEDAIRSAVADVKAKREASAQAKAA

SEQ ID NO: 33146 - protein, 370 aa, Caulobacter crescentus CB15
MSPSFAKEARLDPGVVRGHLRPLRFSLTAFHWACRMTVTVPAEWAPHRAMWVGFPSHAELWQEDLEQAQQEVADLARALAGPGAERVRLMVVGDEAEAAARALLSDTTVEIVRGQFGDIWLRDTGPIFVDDAGKAVAAGFKFNGWGGKYSLEGDDIVAEQIAAASGAPLVRNDFILEGGALDHDGNGTILTTRQCLLNDNRNPGWDEATANAALTEALGAKKVLWLGKGLKNDHTDGHVDNLARFVAPGVVACPMGYGLDDPNADIYGDTAKMLAGMTDSRGSPLQVVRIPSPGKLLDEDGEPIPASHMNFLIANEAVIVPIYAEESGAFAVEVIKGLFPERQVIGLPSTAILTGGGSFHCISQQEPETA

SEQ ID NO: 33147 - protein, 341 aa, Listeria monocytogenes str. 4b F2365
MNKKRDFIDTKDFSKEEILFMIEIGRKMKESIKNGHYPQLLKHKTLGMIFEQSSTRTRVSFETAMTQLGGHAQYLAPGQIQLGGHESVGDTAKVLSRLVDILMARVERHQTVVELANTAAIPVINGMSDYNHPTQELGDAITMFEHLPKGKKIEDCKIVFVGDATQVCASTMFMATKLGMDFVQFGPKGFQLREEHLKIAEENCKVSGGSYLITEDVDIALKDADFIYTDVWYGLYEAELSEEERMKTFYPKYQVNKELISKAAPHVKFMHCLPATRGEEVTDEVLDAPYSVVIDEAENRLTAMRALLVYFMNPYVREAGFAVAEKYDAELELLLRNGAGL

SEQ ID NO: 33148 - protein, 152 aa, Zea mays
  misc_feature (130)..(130): Xaa can be any naturally occurring amino acid
  misc_feature (141)..(141): Xaa can be any naturally occurring amino acid
MEMENGHAKYRVAVIGSGNWGSVASRLIASNTAKLPSFYDEVRMWVFEEILPTGRKLSESINEQNENCKYLPGIKLGTNVIADPDLESAVKDANMLVFVTPHQFVEGICKKLVGKLTPGAEAISLIKGMXEVKMERPCMIXKLIADTLGINC

SEQ ID NO: 33149 - protein, 364 aa, Listeria monocytogenes str. 4b F2365
MRTIDSSSKKDGFRMPGEFEKHAGCYIIWPERPDNWRLGAKPAQKAFVDVATAISRFEPVTVVASSSQYVNARYMLPDEIRVVEMDNDDAWVRDSGPTFVVNDSGDVRGVDWSFNSWGGLVDGLYFPWDKDDQVAQKICELERKDRYRLADFVLEGGSIHVDGEGTLVTTEECLLSEGRNPQLSKQQIEMVLKEYLNLEKIIWLKRGIYLDETNGHVDNIFNYVRPGVVALAWTDDETDPQYEISKECFDILSNETDAKGRKLEVHKINVPKPILITDEESKGVDAVEGTLPREEGDRLAASYINYYTANGGVVFPLFGDPNDELAREKLRQLYPNCEVVGVKAREILLGGGNIHCITQQVPRG

SEQ ID NO: 33150 - protein, 514 aa, Mycobacterium tuberculosis H37Rv
MKPAHAAASWRNPLRDKRDKRLPRIAGPCGMVIFGVTGDLARKKVMPAVYDLANRGLLPPTFSLVGFARRDWSTQDFGQVVYNAVQEHCRTPFRQQNWDRLAEGFRFVPGTFDDDDAFAQLAETLEKLDAERGTGGNHAFYLAIPPKSFPVVCEQLHKSGLARPQGDRWSRVVIEKPFGHDLASARELNKAVNAVFPEEAVFRIDHYLGKETVQNILALRFANQLFDPIWNAHYVDHVQITMAEDIGLGGRAGYYDGIGAARDVIQNHLMQLLALTAMEEPVSFHPAALQAEKIKVLSATRLAEPLDQTTSRGQYAAGWQGGEKVVGLLDEEGFAEDSTTETFAAITLEVDTRRWAGVPFYLRTGKRLGRRVTEIALVFRRAPHLPFDATMTDELGTNAMVIRVQPDEGVTLRFGSKVPGTAMEVRDVNMDFSYGSAFAEDSPEAYERLILDVLLGEPSLFPVNAEVELAWEILDPALEHWAAHGTPDAYEAGTWGPESSLEMLRRTGREWRRP

SEQ ID NO: 33151 - protein, 279 aa, Synechococcus sp. WH 7803
MNLFADLLASAQGSTVTATGPRIQQRRGVEIKSARELKIMAKASRIVATVLREIMDLVEPGQTTGDLDAHAERRIREMGATPSFKGYHGFPASICASINNEVVHGIPSSKRVIKAGDLLKVDTGAFFEGYHGDSCVTICVGDVGEEAATLSRVAQESLLAGLAQIRAGNTLLDIAGAVEDRVREGGFSVVEDYTGHGVGRNLHEEPSVFNFRTDALPNVTLRPGMTLAVEPILNAGSKDCRTLKDRWTVVTRDGSMSAQWEHTIVVTSDGCEILTDRGD

SEQ ID NO: 33152 - protein, 651 aa, Pseudomonas fluorescens PfO-1
MSELIRVPDIGSGEGEVIELFVKVGDRIEADQSILTLESDKASMEVPAPKAGVIKSLKVKLGDRLKEGDELLELEVEGAAQAAPAPAAAPAAKAEAAPAAAPAPAAPAAAPAAASVQQVHVPDIGSSGKAQIIEIQVKVGDTVEADQSLITLESDKASMEIPSPAAGVVKAISVKLNDEVGTGDLILDLEVAGAAAPAAAAPAQAAAPAAAPAPAAAPAAPVADSVQDIHVPDIGSAGKAKIIEVLVKAGDSVEADQSLITLESDKASMEIPSPAAGVVESISIKLDDEVGTGDLILKLKVKGAAPAAAPAPAAAAAPSAPAPAAAPAAAAPAAAAPVAAPAKPGAKVHAGPAVRQLAREFGVELSAVGASGPHGRILKEDVQTYVKAMMQKAKEAPAAAAGATGGAGIPPIPVVDFSRFGEIEEVPMTRLMQVGAANLHRSWLNVPHVTQFDSADITELEAFRTAQKSVAEKAGVKLTILPLLLKSCAHLLKELPDFNSSLAPSGKAIIRKKYVNIGFAVDTPDGLLVPVIKNVDQKSLLQLAAEAASLAEKARTKKLSSDEMQGACFTISSLGHIGGTGFTPIVNAPEVAILGVSKATIQPVWDGKAFQPKLMLPLSLSYDHRVINGAAAARFTKRLSDLLADIRTILL

SEQ ID NO: 33153 - protein, 405 aa, Porphyromonas gingivalis W83
MEEIKLNTIEEALEDFKEGKFLIVVDDEDRENEGDFIIAAEKITPDKVNFMMHHGRGVLCAPISEERAHELELEMQVPDNTSVHETPFTVTVDRLGNGCTTGVSMYDRAQTILALADPNTRPSDLGRPGHICPLRARSRGVLRRAGHTEAAVDLARLCGMQPAAALIEIINEDGTMARLPQLWEVSKRFGLKIIAIKDLIAYRLKQESIVEKGVEVDMPTEYGHFRLIPFRQKSNGLEHIALFKGTWDENEPILVRMHSSCATGDIFGSMRCDCGGQLLQAMEKIEKEGKGAIIYLNQEGRGIGLMEKMKAYKLQEQGMDTIDANLCLGHKADERDYGIGAQILRLLGIKKMRLMTNNPVKRIGLEAFGLEIVENIPLETAPNRYNEFYLRTKKERMGHELHNIK

SEQ ID NO: 33154 - protein, 460 aa, Pseudomonas putida GB-1
MTSVTPCASSSSEMNDFLQAHPDTQYVDLLISDMNGVVRGKRIERASLHKVYEKGINLPASLFALDINGSTVESTGLGLDIGDADRICFPIPGTLSDEPWQKRPTAQLLMTMHELDGQPFFADPREVLRQVVSKFDDLGLDICAAFELEFYLIDQDNLNGRPQPPRSPISGKRPQSTQVYLIDDLDEYADCLQDMLEAAKEQGLPADAIVKESAPAQFEVNLHHVADPLKACDYAILLKRLIKNVAYDHEMDTTFMAKPYPGQAGNGLHVHISLLDKKTGKNIFASDDPLQSDTLRHAIGGVLETMPASMAFLCPNINSYRRFGAQFYVPNAPSWGLDNRTVAVRVPTDSSDNVRLEHRVAGADANPYLMLAAILAGVHHGLTNKVEPQAPIEGNSYEQLEQSLPNNLRDALRALDDSEVLNQYISPDYIDIFVACKESELAEFEVSISDLEYNWYLHTV

SEQ ID NO: 33155 - protein, 351 aa, Symbiobacterium thermophilum IAM 14863
MAETMRALRKLEAGPGATLQEVPIPTIGPRDVLVKVRAASICGTDYHIYTWDPWSAGRVKPPLTIGHELAGEVVAVGREVTACKVGDYVSAETHIVCNRCPRCHMGEYHLCENTKILGVDTDGAFAEYVAVPEQNIWVNDKDIPFELQSIQEPLGNAVHTALNGDLTARSVLITGCGPIGIMSVPVAKMAGAEIVMAMDINEYRLQLAGQLGADVLINPTKQDPVEVVRSYTRGYGADVVLEMSGNPTAIRQGLKAARNGARISLLGLPGRPLELDLAADVIMRGLVLQGITGRRMWQTWYQVRSLYRAGLAERLRPLVTHRMPLEQIDAAMELMGSGQSGKIVLVPDLKA

SEQ ID NO: 33156 - protein, 206 aa, Escherichia coli
KHFAALSTNAKAVGEFGIDTANMFEFWDWVGGRYSLWSAIGLSIVLSIGFDNFVELLSGAHAMDKHFSTTPAEKNLPVLLALVGIWYNNFFGAETEAILPYDQYMHRFAAYFQQGNMESNGKYVDRNGNVVDYQTGPIIWGEPGTNGQHAFYQLIHQGTKMVPCDFIAPAITHNPLSDHHQKLLSNFFAQTEALAFGKSREVVEQE

SEQ ID NO: 33157 - protein, 249 aa, Zea mays
VETVDDYDEYCHYVAGLVGYGLSRLFYAAGTEDLAPDSLSNSMGLFLQKTNIIRDYLEDINEIPKSRMFWPREIWSKYADKLEDFKYEENTEKAVQCLNDIVTNALIHAEECLQYMSALKNHAIFRFCAIPQIMAIGTCALCYNNVHVFRGVVKMRRGLTARIIDETNSMSDVYTAFYEFSSLIESKIDDNDPNAALTRRHVNSIKQTCKSSGLVKRRGYHLDTSPYRPMLIMIVLLLVAILFGALYTK

SEQ ID NO: 33158 - protein, 436 aa, Mycobacterium sp. JLS
MSIPVPALTPEQIRALDAAHVWHPYSTIGAGALPPVVALAAKGVWITIDHPAGGGPVDVIDAMSSWWTAIHGHGHPVLDAAITRQLATMNHVMFGGLTHEPAVRLAQLLVQITPPGLDTVFFSDSGSVSVEVAVKMALQYWRAAGRPGKTRLMTWRGGYHGDTFTPMSVCDPDGGMHSLWTDVLTRQVFAPPVPRDYDPEYVAAFERRLAEHADELAAVIVEPVVQGAGGMRFHDPRYLSDLRTLCDRHGVLLVFDEIATGFGRTGELFAADHVGVSPDIMCVGKGLTGGYLTLAATLCSTEIARVISTGEAGALMHGPTFMANALACAVGVAAVELLLAGDWRTTIATIERGLTEGLAPAREVSGVADVRVLGAIGVVELDRPVDMATATAAALSHRVWLRPFRNLVYVMPPYICTPEEIAQITSAVVGVARALA

SEQ ID NO: 33159 - protein, 402 aa, Zea mays
MADYVYGPGRNHLFVPGPVNIPDPVIRAMNRQNEDYRSPAIPALTKVLLEDVKRIFKTTTGTPFLIPTTGTGAWESALTNTLSPGDRIVSFLIGQFSLLWIDQQQRLGFDVDVVESDWGHGADLDALERKLRDDTLHTIKAVAIVHNETATGVTNDLAAVRTLLDAYAHPALLLVDGVSSICALDFRMDEWGVDVALTGSQKALSMPTGMGIVCASSKALEASKAARSVRVFFDWKDYLRFYEMGTYWPYTPSIQLLYGLRTALDLIFEEGLDNVVKRHNRLGTATRFAVEAWGLKNCCQKEECFSDTVTAVVVPPYIDSAEIVKHAWKRYNLSLGLGLNKVAGKVFRIGHLGNLNELQLLGCLSGVEMVLKDVGYPVKLGSGVAAAAAYLSNSTPLIPSRI

SEQ ID NO: 33160 - protein, 301 aa, Pseudomonas putida GB-1
MTLDRDAASHVAEVLSEALPYIRRFVGKTLVIKYGGNAMESEELKTGFARDIVLMKAVGINPVVVHGGGPQIGDLLKRLSIESHFIDGMRVTDSATMDVVEMVLGGQVNKDIVNLINRHGGSAIGLTGKDAELIRARKLTVSRQTPEMTTPEIIDIGHVGEVVSVNTDLLNMLVKGDFIPVIAPIGVGANGESYNINADLVAGKVAEALKAEKLMLLTNIAGLMDKQGQVLTGLTTEQVNELIADGTIYGGMLPKIRCALDAVQGGVNSSHIIDGRVPNAVLLEIFTDSGVGTLITNRKPR

SEQ ID NO: 33161 - protein, 529 aa, Anaplasma marginale str. St. Maries
MSTVAIVDFGSQVTQLIARRVRELGVYSEVFPPSTDFQAMASRGIKIDAFILSGGPNSVQQLHGVPNAVSDVLNLNLQKGVPVLGICYGFQMLAHYFGADVAQSVAREFGRAWLDVIEPSSITEGVWSLGSKVDVWMSHSDSIVGEVPQGFRVVARSADTGAVAFMCNDERKIYGVQFHPEVAHTPGGREMLDNFLKIAGCTRDWTMGSFLHTQIGAIKSATDGGRVVAAISGGVDSSVASVLVHKAIGERLVCVFVDTGLLRKGEAGVVRDLFVGKLNMHVNVLDKSALFMQRLAGVQDPEVKRKIIGETFIEVFEQEAKSLGDIKFLMQGTIYPDVIESGVGESGTKIKSHHNVGGLPEIMNLSLVEPLRHLFKDEVRLLGKELGLPSAILDRHPFPGPGLAVRIMGEVTAERVELLREIDNIYIDMMRDSGLYDHIWQAFAVLVPVRTVGVMGDGRTYGYVCALRAVTSSDGMTADCFPFGETDERKLEFLAFLQKVSRAIVSNLQGVNRVVYDMTSKPPATIEWE

SEQ ID NO: 33162 - protein, 433 aa, Anaplasma marginale str. St. Maries
MPVRVLMPALSPTMKSGIVARWHKKEGDSVKPGDVIADIETDKAVMEFEYVDEPGVLYKILTQEGTRDVPVNQVIAVVRVGDEDVASVEALCNVAHDADAKGSAADSQGTAAVAAPASPSVVTNTEKPSQPQPERQRPERGVAYPIPDFAEERKIKATPLAKKLASRLSVDITKVAGTGPYGRVVKADVLDAAAGGGFPSTTGAAGGDVVEVSSMRRVIADRLLESKLTVPHFYLAVDCMVGELLKLRVEINDSCADRGTKITVNDFVLKAVALAMREFPEINSSWEGDRIRYHRDINISFAVSIDGGLITPVVENVDAKSLSEISDITKSLATRAKERKLQPHEFQGGGFTVSNLGMFGVREFYAIINPPQSCIMAVGQSEKRAVVVDGCVVPADVMTVTLSVDHRSVDGVLAAKFLNRFKFYIENPLLMLV

SEQ ID NO: 33163 - protein, 369 aa, Listeria monocytogenes str. 4b F2365
MGQLKGLPVEDGFRMPGEYEPHIGCFMIWPERPDNWRLGGKPAQQNYKEVAVAISNFEPVTMFVSPNQYKNARKELPDTIRVIEMSNDDAWIRDYGPSFLVNDKGEMRGVDWGFNAWGGLLDGLYFPWDKDNQIAKKVCDLERLDYYSQKDFILEGCSIHVDGEGTLVTTEECLLSEGRNPNLTKIEIEQTLKKYFHVQKVIWLKHGFYLDETNGHVDNIFNFVAPGEVVLSWTDNKSDPQYEISRECYDILANQTDAKGRTFMIHKLHCPDPVLITQTESEGVEAINGTFPRQAGDRLAASYVNYYTANGAIIFPLFDDPKDKDAQELLEQLYPDRKIVGIKAREILLGGGNIHCITQHLPDKSTIRE

SEQ ID NO: 33164 - protein, 454 aa, Neurospora crassa
MISRSALLRGSQLALRRPAAAKTAQRGFAAAAASPAASYEPTTIAGVKVASRDDSGPTTRLAGVAKAGTRYEPLAGLTVGLEEFAFKNTNKRTALRITRESELLGGQLQAYHTREAVVLQASFLREDLPYFTELLAEVISETKYTTHEFHELVENCIHEKQAKLDSAAIALDAAHNVAFHSGLGSPLYPTVDTPTSSYLNENSVAAFANLAYNKANIAVVADGASQAGLEKWVEPFFKGVPATSSGNLNTAASKYFGGEQRVAKNGKNAIVIAFPGASLGVPHPETSVLVGLLGGVSNIKWSPGFSLLAKATAANPGAEAFAHNYAYSDAGLLAIQITGKGAAVGKVAVEAVKGLKAIAAGGVSKEDLTKAIAKAKFNLLSASEVSGTGLVHAGANLLAGGKPIQVAETLKALEGVTAEKLQAAAKKLLEGKASVSAVGDLHVLPYAEDLGLKV

SEQ ID NO: 33165 - protein, 297 aa, Ostreococcus tauri
MSAITRDPPRRSRPLTNDIESRARIHCEQVTNVAPSAEESNLREFFSTAGEIERVRIFDGSAKTGGRRAVIEFTHKEAVSAAVLLNGCLLLNHPLNIVECAYPVSDDVANEDVKLNTFESKFAGFLGKTLLAGKQALEAVKDFDERNQITAKTKQNIKALDDKLQFTANVKKFDEKAGVTEGVKKTVATVNAQAKEIDRSLKISATTNAVVGMGKDAAGMAVNKAMQNKVISDAAATVSDFSTSASIKMKTVAAEAKATANIGGPTDIQSTETSTTTQTPAVTETPAATEEPVSASI

SEQ ID NO: 33166 - protein, 416 aa, Synechococcus sp. WH 7803
MTPERLGLLWGITVFAGAGARLLAALSGLPGVVLLLLSGLLIGRSGLGLVEPLDLGLGLETTVGLLVSLVLFDGGLNLRLPGDTIKATVLRISLLRLLLSLGAGVLAAHWLAGLGWSVAAVYSAIVLGTGPTVVTPIVQQIRLASPLGDVLEAEGLVLEPVGAVLALLLLELLLGDLHGWRELAIGLMSRLGGGVLIGLAVGWLLSEVLRRLPSEHSVGLRLQLTLGVLFLMFSIAEWLLPESGLPASVAAGVVVGRRPSTQAGQLDELIRELARLAITMLFPLLAADVSWAELSPLGWGGVSCVLVLMVVVRPAAVSVATVGLPLDWRQRLFLGWLAPRGIVTAAVASLFAIRLEQAGVLGAGRLQGLVFLTILMTVGLQGLTAQPLAKVLGLIDQSSEASDGAPLPAEPSEAAP

SEQ ID NO: 33167 - protein, 328 aa, Mycobacterium tuberculosis H37Rv
MHAIEVTETGGPGVLRHVDQPQPQPGHGELLIKAEAIGVNFIDTYFRSGQYPRELPFVIGSEVCGTVEAVGPGVTAADTAISVGDRVVSASANGAYAEFCTAPASLTAKVPDDVTSEVAASALLKGLTAHYLLKSVYPVKRGDTVLVHAGAGGVGLILTQWATHLGVRVITTVSTAEKAKLSKDAGADVVLDYPEDAWQFAGRVRELTGGTGVQAVYDGVGATTFDASLASLAVRGTLALFGAASGPVPPVDPQRLNAAGSVYLTRPSLFHFTRTGEEFSWRAAELFDAIGSEAITVAVGGRYPLADALRAHQDLEARKTVGSVVLLP

SEQ ID NO: 33168 - protein, 539 aa, Caulobacter crescentus CB15
MADLDAAWTRLEAAAKAAGDKRIVEFFDAEPGRLDALTLDVAGLHLDLSKQAWDEAGLEAALDLAHAADVEGARARMFDGEAINSSEGRAVLHTALRAPAGADVKALGQPVMAEVDAVRQRMKAFAQAVRSGAIKGATGKPFKAILHIGIGGSDLGPRLLWDALRPVKPSIDLRFVANVDGAEFALTTADMDPEETLVMVVSKTFTTQETMANAGAARAWLVAALGEQGANQHLAAISTALDKTAAFGVPDDRVFGFWDWVGGRYSLWSSVSLSVAVAAGWDAFQGFLDGGAAMDEHFRTAPLEQNAPVLVALAQIFNRNGLDRRARSVVPYSHRLRRLAAFLQQLEMESNGKSVGPDGQPAKRGTATVVFGDEGTNVQHAYFQCMHQGTDITPMELIGVAKSDEGPAGMHEKLLSNLLAQAEAFMVGRTTDDVVAELTAKGVSDAEIATLAPQRTFAGNRPSTLVLLDRLTPQTFGALIALYEHKTFVEGVIWGINSFDQWGVELGKVMANRILPELESGASGQHDPSTAGLIQRLKR

SEQ ID NO: 33169 - protein, 170 aa, Brassica napus
LISLGLGFEELKEMSYTKACLCEAMRLYPPVSWDSKHAANDDVLPDGTRVKKGDKVTYFPYGMGRMENLWGKDWDEFKPSRWFDSEPGSTRPVLKPVSPFKFPVFQAGPRVCVGKEMAFMQMKYVVGYVLSRFEIVTVNKDKPAFVPLLTAHMAGGLKVKIKRREVMSHP

SEQ ID NO: 33170 - protein, 335 aa, Glycine max
MASSYRDRTSEFRLLSETMKKIGGPVQPENPPSTSRGGESSYSRSEFNRKASRIGLGIHETSQKIARLAQLARKSSMFNDPAVEIQELTVLIKNEITTLNSALSDLQTIQNTDMADGGYSQDTIVHSTAVCDDLKSKLMGATKHLQDVLTARTENIKAHENRKQIFSKNASRENPFQHQPKPANEPPPWSNSSNASESLQQESALPSNGAPVGNQLRRRLAVDNTPSQQMEMSMVQQVVPRHENYAQSRATALHNVESTITELSGIFSHLATMVAHQGELAIRIDDNMDESLANVEGAHSSLLRHLNRISSNRWLLIKIFAILILFLTIFIFFVA

SEQ ID NO: 33171 - protein, 860 aa, Burkholderia sp. 383
MRRAEESQLKSPTHDQIVLLAPLTGPIVALADVPDPVFSGGMFGDGIGIDPLAGRLVAPCAGVVSHLARTGHAVTITTPHGAEVLLHIGIDTVELNGQGFIAHVEAGARVEAGTLLIEFDQDAVARSAHSLVSVIAIANSDAFEVVDRASGFATAGETPLLVLRGKGEAAVQAAQTGAAAQNEVRREIVLAQPGGLHARPAARAREAVRGFDATVDVLFDGRKASIASVVGLLGLGAGEGATVELVGRGAHAQQAVDAVEHELLREAHGEVEEKPARLKSPAPQMVARNVGVPIDPNTLAGVCAAPGIAVGTLVRLDDAEIVPPEQASGTPAAESRQLDQALKAVDGELDETVRNASARGAVGEAGIFAVHRVLLEDPTLIDAARDLISLGKSAGFAWRATIRTQIDTLSKLDDALLAERAADLRDIEKRVLRALGHTNGAARALPDEAVLAAEEFTPSDLSSLDRQRVTALVMARGGATSHAAIIARQLGIPALVAVGDALYAIPDGTQVVVDASAGRLEHAPTALDVERARHERQRLDGVREANRQLAGEAASTVDGRAIEVAANIATLDDANTAVDNGADAVGLLRTELMFIHRQAAPTVVEHQQSYQSIVDALQGRTAIIRTLDVGADKEVDYLTLPPEPNPALGLRGIRLAQVRPDLLDDQLQGLLAVKPLGAVRILLPMVTDAGELVRLRKRIDEFARAQGRTEPIEVGVMIEVPSAALLADQLAQHADFLSIGTNDLTQYTLAMDRCQADLAAQSDGLHPAVLRLIDIAVRGAAKHGKWVGVCGALGGDPLAVPVLVGLGVTELSVDPVSVPGIKARVRRLDYQLCRQRAQDLLALDSAQAVRAASREVWPLD

SEQ ID NO: 33172 - protein, 625 aa, Vitis vinifera
MSNFCRQIKLPSSLIRRLKHRSSNSMLSGRRSFTTTEGHRPSLVHKRSLDILHDPWFNKGTAFSMTERDRLDLRGLLPPTVMSPEMQIERFMVDLKRLEVNARDGPSDPYALAKWRILNRLHDRNETMYYKVLINNIEEYAPIVYTPTVGLVCQNYSGLFRRPRGMYFSAADRGEMMSMVYNWPAEQVDMIVVTDGSRILGLGDLGVQGIGIAIGKLDLYVAAAGINPQRVLPVMIDVGTNNEKLLKDPLYLGLQEHRLDGDEYLAVIDEFMEAVFTRWPHVIVQFEDFQSKWAFKLLQRYRSTYRMFNDDVQGTAGVAIAGLLGAVRAQGKPMIDFPKQKIVVAGAGSAGIGVVNAARKTMARMLGNNESAFDSAGSQFWVVDAEGLITEARDNIDPDALPFARKVKEIDRQGLREGASLAEVVKQVKPDVLLGLSAVGGLFSKEVLEALKDSTSTRPAIFAMSNPTKNAECTPEEAFSIVGDNVIFASGSPFKDVDLGNGHIGHCNQGNNMYLFPGIGLGTLLSGSRIISDGMLQAAAECLAAYMTEEEVLKGMIYPSISSIRDITKEVAAAVVREAIEEDLAEGYRGIDARELCKLNQEELATFVEDNMWDPDYPTLVYKQD

SEQ ID NO: 33173 - protein, 526 aa, Pseudomonas putida GB-1
MCARRPARILTTPVSPQCGVAPKQEEEFRMTTLTRADWEQRAQQLKIEGRAFINGEYTDAASGETFECLSPVDGRFLAKVASCDLADANRAVENARATFNSGVWSQLAPAKRKAKLIRFADLLRKNVEELALLETLDMGKPIGDSSSIDIPGAAQAIHWTAEAIDKVYDEVAPTPHDQLGLVTREPVGVVGAIVPWNFPLLMACWKLGPALATGNSVVLKPSEKSPLTAIRIAQLAIEAGIPAGVLNVLPGYGHTVGKALALHMDVDTLVFTGSTKIAKQLMVYAGESNMKRIWLEAGGKSPNIVFADAPDLQAAAEAAASAIAFNQGEVCTAGSRLLVERSIKDKFLPMVVEALKGWKPGNPLDPQTTVGALVDTQQMNTVLSYIEAGHQDGAKLLAGGKRTLEETGGTYVEPTIFDGVTNAMRIAQEEIFGPVLSVIAFDTAEEAIAIANDTPYGLAAGIWTSDISKAHKTARAVRAGSVWVNQYDGGDMTAPFGGFKQSGNGRDKSLHALEKYTELKATWIKL

SEQ ID NO: 33174 - protein, 250 aa, Saccharomyces cerevisiae
MNPLFFLASPFLYLTYLIYYPNKGSFVSKPRNLQKMSSEPFKNVYLLPQTNQLLGLYTIIRNKNTTRPDFIFYSDRIIRLLVEEGLNHLPVQKQIVETDTNENFEGVSFMGKICGVSIVRAGESMEQGLRDCCSSVRIKILIQRDEETALPKLFYEKLPEDISERYVFLLDPMLATGGSAIMATEVLIKRGVKPERIYFLNLICSKEGIEKYHAAFPEVRIVTGALDRGLDENKYLVPGLGDFGDRYYCV

SEQ ID NO: 33175 - protein, 341 aa, Ostreococcus tauri
MASATTVNENDHDARYEAVNDALLGTGSYGYTKLMRERATGKMYALKYIERGEKITEHVRREITNHRNLSHPNIVKFKEVLVTPTHLAVAMEPVGGGELFGYVQQQGSFTESQARYFFQHLISGVEYLHNMRISHRDLKLENTLVDLTTTPVLKICDFGFSKGGFDSQPKTQIGTPAYISPEVYSGAQPYDGAASDVWACGVLLYVMLVGRYPFSDPQDPNNSHKMMQRVLQARFALPKDMTDECKDLLTKIFNVDPRKRLTVAGIYHHPWFLHDLSPNVPLGPKQPGPLAPDTEGLQSLDDINAVIDVAREPPAKSSSPWGYDEIDGEVIDDGSYLDDDY

SEQ ID NO: 33176 - protein, 540 aa, Oryza sativa Japonica Group
MLMATVSPARREPTPQAVRASPMPSAAAALVRRGGGGSGGTVLGKYELGRVLGQGSFAKVYQARHLETDECVAIKVLDKEKAVKGGMVHLVKREINVLRRVRHPNIVQLFEVMASKTKIYFVMEYVRGGELFSRVSKGRLREDTARRYFQQLVSAVDFCHARGVFHRDLKPENLLVDENGDLKVSDFGLAAGPDQFDPDGLLHTFCGTPAYVAPEVLRRRGYDGAKADIWSCGVILFALMAGYLPFHDHNIMVLYRKIYNGEFRCPRWFSKDFTRLITRLLDANPKTRITVPEIIESDWFKKGYKPVKFYIEDDKLYNLSDDVLNLEPADPVPPPLGLAPPVPPPPQGDDPDGSGSESDSSVVSCPATLSTGESQRVRGSLPRPASLNAFDIISFSKGFNLSGLFEERGNEIRFVSGEPMSDIVKKLEEIAKVKSFTVRRKDWRVSIEGTREGVKGPLTIGAEIFELTPSLVVVEVKRKAGDNEEYEDFCNMELKPGMQHLVHQMLPAPNGTPVSEKVERSSSLQAPLTLKLIGTEGSMS

SEQ ID NO: 33177 - protein, 207 aa, Prochlorococcus marinus str. MIT 9312
MTDTPTKQEITSKNDKVPGAIPGEQKKNNRNNDRKRNRRGDSKNLERDSDWQERVVQIRRVSKTVKGGKKMSFRAIVVVGNEKGQVGVGVGKAGDVIGAVRKGVSDGKKNLVRVPLTPNNSIPTLSKGRDGAANVLIRPAAPGTGVIAGGSIRTVLELAGIKNVLAKRLGSKTPLNNARAAMVALSQLRTHKSASRERGISLEQLYS

SEQ ID NO: 33178 - protein, 329 aa, Ostreococcus tauri
MRACAAPRPSAPTITVSRRSVEPARTQHRIRRRPNITAPSASTDGASDTSSSSATSPQRVLITGSTRGLGLELARSFLTRGDKVFVTSRDAEKVRETVKALREEFGDDFVAGLEADVSRAESVEAVAEAVVDAFGGVDLWINNAGSNGYAYENLEEADPLVLQEIVMTNSLGSLLCTRQAIRTMRKTSGRGHIFNMEGAGSDGSATRKFAAYGHTKAGMAQLSKTMAVELKGSSIGVHTISPGMVFTELISSGRFAFGSQGRMFVNALAEPANVTAEQIVKKIKVATESPESVNKTLAIKILTPDVALKKMFGRFILGENKDRYYPEKE

SEQ ID NO: 33179 - protein, 451 aa, Thermotoga maritima
MKMERKNVWHHRKKEEIEAFSKEYMEFMSKAKTERMTVKEIKRILDESGFVPLEDFAGDPMNMTVYAVNRGKAIAAFRVVDDLKRGLNLVVAHIDSPRLDFKPNPLIEDEQIALFKTHYYGGIKKYHWLSIPLEIHGVLFKNDGTEIEIHIGDKPEDPVFTIPDLLPHLDKEDAKISEKFKGENLMLIAGTIPLSGEEKEAVKTNVLKILNEMYGITEEDFVSGEIEVVPAFSPREVGMDRSLIGAYGQDDRICAYTALRALLSANPEKSIGVIFFDKEEIGSDGNTGAKARFYLKALRQILKMQGAKDSEFVLDEVLENTSVISGDVCAAVNPPYKDVHDLHNAPKLGYGVALVKYTGARGKYSTNDAHAEFVARVRKVLNEQGVIWQVATLGKVDQGGGGTIAKFFAERGSDVIDMGPALLGMHSPFEISSKADLFETYVAYRSLMEKL

SEQ ID NO: 33180 - protein, 217 aa, Arabidopsis thaliana
MDEYVEDEHEFSYEWNQENGPAKWGKLRPEWKMCGKGEMQSPIDLMNKRVRLVTHLKKLTRHYKPCNATLKNRGHDMMLKFGEEGSGSITVNGTEYKLLQLHWHSPSEHTMNGRRFALELHMVHENINGSLAVVTVLYKIGRPDSFLGLLENKLSAITDQNEAEKYVDVIDPRDIKIGSRKFYRYIGSLTTPPCTQNVIWTVVKKVNTHRYFLLFFT

SEQ ID NO: 33181 - protein, 123 aa, Pyrococcus abyssi
MAKPSYVKFEVPKELAEKALQAVEIARDTGKIRKGTNETTKAVERGQAKLVIIAEDVDPEEIVAHLPPLCEEKEIPYIYVPSKKELGAAAGIEVAAASVAIIEPGKARDLVEEIAMKVRELMK

SEQ ID NO: 33182 - protein, 469 aa, Gibberella zeae PH-1
MAPVTKETDYLVIGGGSGGLASARMASNKFGIKATIVENKRLGGTCVNVGCVPKKVTYNAAALAEAIHDSKAYGFSVQETAPFDWSTFKTKRDAYIKRLNGIYERNLNNDKVDYVHGWARLTSKNQAEVTLDDNSKVLINAKKILVAVGGKPTIPPEIPGSEYGTNSDGFFDISTQPKKVAIVGAGYIAVEFAGMFNALGTETHLFIRHDTFLRNFDPMIQEAVTKEYERLGVKLHKRSQASKIEKDSNGKLTVTYKDDQGNESVVSDVDNLIWAIGRTPETKGIGLEEAGVKLAKSGHIIVDEYQNTDVDSIYALGDVTGEVELTPVAIAAGRRLAHRLFGGAEFSTLKLDYSNIPSVVFSHPEVGSIGLTEPEAIEKYGKDNIKVYKTSFTAMYYAMMEPEQKGPTNYKLITTGPEEKVVGLHIMGIGSGEMLQGFGVAIKMGATKADFDSCVAIHPTSAEEIVTLK

SEQ ID NO: 33183 - protein, 618 aa, Gloeobacter violaceus PCC 7421
MRISANTDRIEAFCQDSGSVWNRRGVHRYVTPGSEHFRDRLLNHRTLPLLAAFVIGSAAPVAALDGVVSTAHPLATEAGIEMLRKGGNAVDAAIAASLALGVVEPQSSGIGGGGFALVWLGRTAEARVLDFREAAPGQAAAAMYLDKAGKVIPRLSLDGYRAAGVPGQAAGLVKLQQAYAALPLATLAEPAIRLAREGFSLSDLVRGRIEAAAERLGRDPEASRVFLVEGKAPPAGYRLRQPDLARTLELWVNSGGDSFYRGETAAAMAAAMTERGGLVSRADLESYSPVWRTPLVGSYRGVPVVTMPPPGSGGVLLEMLNTLENFDLAAQTPLLRTHLTAQAMSRAYADRSRFYGDPAFVPVPLAALVAKSYGAAQKKTISLERATPSTQIVPGSLLSPALLAGFQSWEGPRPVENTSHLSTMDADGNTVALTQTINGGFGAAVVAPKTGILLNNEMDDFAVAPGVPNLFGLVGSKANAIAPGKRPLSSMTPTILLKNGRPWIALGSPGGAFITNAVLQTILGVLDYQLSLPEAVNAPRIHHQWQPDRLFVEKAYPVAQETLSALGYGLRAIDAMGNVQAVQYAGRFVGASDGRREGTSAIWQTPARAASPAASPRR

SEQ ID NO: 33184 - protein, 188 aa, Porphyromonas gingivalis W83
MTPILNTVFPEFKLNAYHNGEFKVITNEDLKGKWSLVVFYPGDFTFVCPTELEDLANKYEEFKQLGVEVYSCSCDTHFVHKAWADASPAIKKVQYPMLADPSGALTRDLGILIDDVHMAYRGSFVINPEGIIKIVELNDNSVGRDAEEILRKIKAAQYVAAHDGQVCPAKWREGQQTLKPSIDLVGKI

SEQ ID NO: 33185 - protein, 548 aa, Daucus carota subsp. sativus
MPYHSISSLSLLPIPIRQNLSKHHPPFHQPPHSLPLSIKSSLDNKPPKSNQGSWVSPDWLTSLTKSITLSKDDSNIPIASAKLEDVSELLGGALFLPLFKWMNMYGPIYRLAAGPRDFVVVSDPAIAKHVLRNYGKYAKGLVAEVSEFLFGSGFAIAEGPLWTARRRAVVPSLHKKYLSVMVDRVFCKCAERLVEKLEISALNGSAVNMEEQFSQLTLDVIGLSVFNYNFDSLNADSPVIEAVYTALKEAEARSTDILPYWKIEALCKIIPRQVKAEKAVTVIRTTVEELIEKCKKIVDTEGERISEEEYVNEADPSILRFLLASREEVSSTQLRDDLLSMLVAGHETTGSVLTWTSYLLSKNPSSLVKAQAEVDRVLEGRPPTYDDIKNLKYLTRCINESMRLYPHPPVLIRRAEVADELPGSYKVNPGQDIMISVYNIHHSSKVWDRAEEFIPERFDLDGPVPNESNTDYRFIPFSGGPRKCVGDQFALLEAIVSLAIFLQHLSFELIPDQVINMTTGATIHTTNGLYMKVSKRQIKSAAVSSISR

SEQ ID NO: 33186 - protein, 584 aa, Vitis vinifera
MAEGSSNNANVDTSRSERAVWLMKCPPVVSRSLSSSSASDSLRPVAKVIVSLDPLLANDDDDSPPQGFMIAHEHAFDYELFTMELAGTESGNAPKCYSMDMSQDFIPMAVFSESSQGRTAVEGKILNKFDMKPHNENIQNYGKLCRERTSKYMTKSRQIQVIDNDNGSHMRPMPGMVIASAVSQFLKDLLKDLCVYNNKGTNQGTYELKPEYKRKRKEIGILDLMISTVWGLDLNKGFLTSDSLPSQQDILRCPFLRNINEPTNFSFASPMAFPMPVRGAKGPIFEDGPNFDMAFRVFHGRDGVVPLSGRVFLRSENFEPEQAPPQFNPLAAKAATISLSGFGLGGPFSFDSFSNKWKNQKRESKSSKKEPSSQRGDSKHEAMSNEWLETGNCPIAKSYRAVSHVIPIVAKALQPPPGMKFKCPPAIVAARAALARTAIVKNLRPQPLPAKMLVIGVLGMAANVPLGIWREHTEKFSPSWFAAVHAAVPFIAMLRKSVLMPKTAMAFTIAASILGQVIGSRAERIRMKTVASRRLNLAENSVVGSSQMTQIQVVGVQGGHCGKSVEWDPVALQVAGPSSPNVFC

SEQ ID NO: 33187 - protein, 272 aa, Oryza sativa Japonica Group
MQYQPLDSSGTDDDLPPTYQPRGPRVIFNGNGSLPQPNLHSNVDREIRQIEQQAYTGVLRAFKVQSDAITWEKESLITELRKELQISDKEHRVLLKGVTEEEAVCRIRQSRQTGGTQSSSHHSSVVHTPVPAKRQKKSHSVPVTPQAPVITMHAVVGKKGGRQASDRVLKRLPSNNSPMLGSSRRRGRLHPNELIKGYSPLDGFGIPNTGNVVMEVEKVLSNPNMLEIEKAMKLLRDQEQSLLDAIARLDEASDGENEDIVLVASQLGTTVA

SEQ ID NO: 33188 - protein, 635 aa, Physcomitrella patens subsp. patens
MVEVETAQTRLYPMQRIASLALKSEQRRESISCRVISKSQATTNLKSRNKRRKGVEEEEDVRRGGREGDEDADTEPGAAMELRSGPEAPVWVGLGTGLENEERAVQTVFDGTARHGNCGDWWCVPCFSYGDLRFSSGFGIHSGVKTCFFFVRQEVLKKEELRQTLQSTGGQGMMVECGFSMGAANTLSTVNVHTVQRQSSSSTASVVQSNAGLSFPCQSVQKQGEHHQDSARLHSDSNCGDSKQSRAEFLYAKDASRRKRANRTAKLKQYKLDARREQWLSQGSQGKQGNAELQQQSSQQQHRNCEHQHKAGDGDFRAQDRAGPSGHTRSQVEVSSESTSGQIPAGSPATPSRPSSCGLGNEAKNSKKEVSSRRLDSSSRAPQFFGDGESQVGDEHKQDSANNGRSVSDVSKSRSTSSCASSSYTGSGSEDNGGSHDAEDDWESAFDALHVQSSPHRSDDPHKGPSSDRAQLNEGKELQDKKHVGAHYNLHHSDMQSGQLKPEYKYKNSGFGGRRGNGGRAWRPDDVARPPTLPRLAKQHSYPNHSSNNSYQGWGNMHGNLWADELATPSSCPICTEELDVTDSSYIPCTCGFQLCLFCYHRISSDDGRCPGCRKAYNPDSAVKLSRSSSVWLRV

SEQ ID NO: 33189 - protein, 284 aa, Streptococcus agalactiae A909
MTTFTAKFIDQEWEVPVESGRYHMIVGEFCPYAQRPQIARQLLGLDKHISISFVDDVPSDIGLIFSQPEQVTGAKSLRDIYHLTDPTYKGPYTIPILIDKTDNRIVCKESADMLRLFTTDFSDLHQEDAPVLFSQETASLIDNDIKDINNNFQSLMYKLAFLDKQTDYDTYSKEFFTFLDQKEHLLGQRPFLLGDNLSEVDIHFFTPLVRWDIAGRDLLLLNQKALEDYPNIFSWAKTLYNDFNLKTLTNPQSIKNNYYLGKFGRAVRHHTIVPTGPNMVKWEK

SEQ ID NO: 33190 - protein, 251 aa, Porphyromonas gingivalis W83
MRKNIVAGNWKMNKTLQEGLALAKELDAALKGRTINCDVIIGTPFIHLASIAAAIDTTRIGVAAENCADKESGAYTGEVSAAMVASTGARYVIIGHSERRAYYHETSPILMEKVKLALSNGLTPIFCVGEVLEEREAGKHFEVVARQVEEALFTLDQTDFAKLILAYEPVWAIGTGKTATADQAQEMHAHIRKSIAAKYGKEVANGCSILYGGSCNAANAKELFSRADVDGGLIGGASLSVDKFLPIIEAF

SEQ ID NO: 33191 - protein, 311 aa, uncultured archaeon
  misc_feature (1)..(1): Xaa can be any naturally occurring amino acid
  misc_feature (187)..(187): Xaa can be any naturally occurring amino acid
  misc_feature (211)..(211): Xaa can be any naturally occurring amino acid
  misc_feature (264)..(264): Xaa can be any naturally occurring amino acid
  misc_feature (279)..(279): Xaa can be any naturally occurring amino acid
XPLDPQIKPILERIRALSIAASPQELRRQVEEQSRLLTAAVQEPIAETRDVHIPVSGGSIRARVYFPKKAAGLPAVLYYHGGGFVFGSIETHDHICRRLSRLSDSVVVSVDYRLAPEYKFPTAVEDAYAALKWVADRADELGVDPDRIAVAGDSAGGNLAAVVSILDRNSGEKLVKKQVLIYPVVNXTGVPTASLVEFGVAETTSLPIELXVWFGRQYLKRPEEAYDFKASPLLADLGGLPPALVVTAEYDPLRDEGELYAYKXKASGSRAVAVRFAGXVHGFVSFYPFVDAGREALDLAAASIRSGLQPS

SEQ ID NO: 33192 - protein, 309 aa, Mycobacterium sp. JLS
MSLVVITTGGTIATSTDADGVRRPTRRGADLTAGLDVTVVDVLNKDSSQLTPADWDRIRDAVLAGTADGAADGVVVTHGTDTMEETALWLELTYDGTTPVVLTGAQRGADAPDADGPANLRDAVTVAGDPEARGLGVLVSFAGTVRRPLGLRKVATEDLDGFDGPVVGRVADGRFTVTGPKVRPYLGDVSAERAPRVDIVTTYPGGDAAALSACAAAGARAVVLEALGAGNAPQPVIDGVRRLCADGVLVAVSTRVPGGRVRPAYGPGRDLADAGALMVPTLRPAQARVLLMAALAADVPAAEVLAEWG

SEQ ID NO: 33193 - protein, 346 aa, Synechococcus sp. WH 7803
MFGLIGHSTSFEAARRKASELGFDHIAEGDLDVWCSAPPQLVEHVEVTSATGRTIQGAYIDSCFVPEMLSRFKTARRKVLNAMELAQKKGIDITALGGFTSIIFENFNLLQHQHVRSTTLAWERFTTGNTHTAWVICRQVENNAPALGIDLKKASVAVVGATGDIGSAVCRWLSSRTGVAELLLVARQQKPLEELREELGGGRILSLEDALPEADVVVWVASMPRTLEIDTSRLKTPCLMIDGGYPKNLDARVAAKGIHVLKGGIVEFFTDIGWSMMEIAEMEKPQRQMFACFAEAMLLEFESHHTNFSWGRNNITLEKMDFIGGASVRHGFTTLNLQGLPQAAVA

SEQ ID NO: 33194 - protein, 386 aa, Bacillus cereus ATCC 14579
MNIHEYQGKAVLRSYGVSVPNGKVAFTVEEAVEAAKELGTDVCVEKAQIHAGGRGKAGGVKVAKNLDEVRTYAESILGTTLVTHQTGPEGKEVKRLLIEEGCDIKKEYYVGLVLDRATSQVVLMASEEGGTEIEEVAEKTPEKIFKEYIDPAVGLQGFQARRIAFNINIPKELVGQAVKFMMGLYRAFIEKDCSIAEINPLVTTGEGKVMALDAKLNFDSNALYRHKDILELRDLDEEDSKEIEASKYDLNYIPLDGNIGCMVNGAGLAMATMDIIKHYHGDPANFLDVGGGATAEKVTEAFKIILSDKNVKGIFVNIFGGIMKCDVIAEGVIEATKQVGLELPLVVRLEGTNVELGKKILNESGLNIVAAESMADGAQKIVSLVG

SEQ ID NO: 33195 - protein, 205 aa, Listeria monocytogenes str. 4b H7858
MVVGLGTGSTVYYTIEKLGEMVNNGLHITGVATSEETSKQAQNLGIPLKSLNDVAEIDITIDGADEIDTDFQGIKGGGGALLREKMVASASLKNIWVVSEEKLVRNLGKFPLPIEVIPFGWKQIERTLEKEHVQTILRRQSSGEIYVTNNGNYILDIVNQTFRDAEMWQEKLAQIPGIVEHGLFLHYVDIIVCAKANGEIELIKK

SEQ ID NO: 33196 - protein, 208 aa, Zea mays
MDVDGPAPADASARPATNGEAPSGVLRSFVDGVWYPDEPLLRRLRAASCDAAPRLRGASRNSARDLLEWTRRGSGLRAILVISVGTITLIALTGLLTFMFFLLVATANAIIVSVLMSLAAAGGFLAIFFACLVAVYIGAVSVAIFVISATVISAVVGILVATGWVGFFWMIWFTARKSMVLTKHSFGMTSSAIQSYSASRQVKQKPVD

SEQ ID NO: 33197 - protein, 319 aa, Glycine max
  misc_feature (316)..(316): Xaa can be any naturally occurring amino acid
MATINLSSATTSLFQSKHRTKRIPRLPTIARITNHIEGTHLNSPNGSPILGNANNSLEVPSNNYISLHSSDVRRKTKIVCTIGPSTSSRDMIWNLAQAGMNVARLNMSHGDHASHLQTIDLVKEYNSQFQDKVVAIMLDTKGPEVRSGDVAQPILLKEGQEFCFTTMRGVSTHDTVSVNYDGFVNDVEFGDVLLVDGGMMSLAVKSKTKDLVKCEVIDGGELKSRRHLNVRGKSATLPSITDKDWEDIKFGVDNQVDFFAVSFVKDARVVHELKHYLKSHNADIHVMVKIESADSIPNLHSILSASDGAMVARGDXGAE

SEQ ID NO: 33198 - protein, 166 aa, Zea mays
MLRAGARQLLAPGLRRLGLGTGAAGQVGPAAAAAGMRAYHERVVDHYNNPRNVGSFDKEDPNVGTGLVGAPACGDVMKLQIRVDEDSGKIVDACFKTFGCGSAIASSSVESLTPSFQFAYFWCFEPNWLVGLNFRYVQTDRMLVGGGFHMSRLFEDLFGYTPIHMD

SEQ ID NO: 33199 - protein, 382 aa, Ostreococcus tauri
MLAQTSFTGVKVTAKATSTRRSARTVAVRANKYADELLETAQNMTKPGKGILAMDESNPTCGGRLEALGIENTEENRRRYRELLITTKGLGEYVGGAILFEETLYQSCKDGTTFVDALRAQGIYPGIKVDKGLRPLANSNGESWCQGLDGLAERAAEYYKQGARFCKWRTVVSIPAGPSKMAVTDAAYGLARYAAICQNAGLVPIVEPEILLDGDHDIDRNFEVASMVWAETFKYLADNGVMFDRMLLKPSMVAPGADCPKKSNAKEVAAYTLKMLNDRVPPSTAGIMFLSGGLSELDSTMYLNAMNQQPNPWHVSFSYARALQNTVLKTYATGPEDPAVIAKAQEILLTRARENSEAQRGVFDVTKSSTDGASQYVSGYVY

SEQ ID NO: 33200 - protein, 426 aa, Gibberella zeae PH-1
MSLSKRANDAEKAIEGMDLWEVIPNLFDQETNPDGIVSLGVAENTLMHDVLRKHIHDNLALTNPAFTYGDGTTGTKQVKKSVSRFLTKHLKPFKAIEPAHITMTNGCSAAIEHLSWAVANPGDGILLGQPYYGTFVPDLTARFGAKLLPVAFGEVDPLGEAAVAEYEKVILEAQAQGTRVSGLVISHPHNPLGRCYSRSVLIAFMKLCQKYEMHFISDEIYALSVWTNTVDQHPLSVPFESALSIDTTDIIDTDRVHVLWGMSKDFGANGIRVGTIVSQANMSLHASIVAVGLYSSVSSISDHVTVNILEDDAFVESYIVENQKRLSAQYTRVVSWARKNQIEYAPGVNAAFFLWIDLGKYYMARHPGLETDDITDLIMSKLMAKKIFLASGKGFGSEKPGWFRIVFSHDDAYLDLGLERVINALL

SEQ ID NO: 33201 - protein, 226 aa, Oryza sativa Japonica Group
MDSEHWISRLAAAKRFYAAQLGHADRAGMEEVDMDEEVRPEFACPYCYEDHDVVSLCAHLEEEHPFEPHAAPCPICSDKIAKDMLNHITVQHGYLFKNRRRLRRFVIPGSQALSLLSRDLREAHLQVLLGGGGHRSNNSSNTTNISADPLLSSFGLSFPTSDTEETSKPPISIPDDASVIKETPAQPWDSSIDSSLTREEREQKRKQASVRATFVQDLLLTTLFGD

SEQ ID NO: 33202 - protein, 354 aa, Synechocystis sp. PCC 6803
MTGSFFCYLFPRSFSMLKIGINGFGRIGRLVARIAMANPQVTLVGINDLVPASNLAYLFKYDSTHGSYGGTVVAKEEGIVIDDQFIPCFSQRDPAQLPWGDLGADYVVESTGLFTTYATAENHLKAGAKRVIISAPSKDPEKIPTFVVGVNHLNYNADTDKIVSNASCTTNCLAPIAKILDDNFGIVEGLMTTVHAMTATQPTVDGPSKKDFRGGRGAAQNIIPSSTGAAKAAALVLPQLKGKLTGMAFRVPTPNVSVVDLTFKTEKATSYEEICAAMKTAAEGELKGILGYTADDVVSMDFRTDPRSSIFDAGAGIGLNSNFFKVVSWYDNEWGYSCRVIDLMLTMASKDGLV

SEQ ID NO: 33203 - protein, 435 aa, Methanocaldococcus jannaschii DSM 2661
MELKNKKLSLWEAVSMAVGVMIGASIFSIFGVGAKIAGRNLPETFILSGIYALLVAYSYTKLGAKIVSNAGPIAFIHKAIGDNIITGALSILLWMSYVISIALFAKGFAGYFLPLINAPINTFNIAITEIGIVAFFTALNFFGSKAVGRAEFFIVLVKLLILGLFIFAGLITIHPSYVIPDLAPSAVSGMIFASAIFFLSYMGFGVITNASEHIENPKKNVPRAIFISILIVMFVYVGVAISAIGNLPIDELIKASENALAVAAKPFLGNLGFLLISIGALFSISSAMNATIYGGANVAYSLAKDGELPEFFERKVWFKSTEGLYITSALGVLFALLFNMEGVASITSAVFMVIYLFVILSHYILIDEVGGRKEIVIFSFIVVLGVFLLLLYYQWITNRFVFYGIIATFIGVLIFEIIYRKVTKRTFSNNMYVKS

SEQ ID NO: 33204 - protein, 513 aa, Bacillus subtilis
MTKLVNEMILVLDFGSQYNQLITRRIREFGVYSELHPHTLTAEEIKKMNPKGIILSGGPNSVYDENSFRCDEKIFELDIPVLGICYGMQLMTHYLGGKVEAATQREYGKANIRIEGTPDLFRDLPNEQVVWMSHGDLVVEVPEGFTVDAATSHHCPNSAMSKGDKKWHGVQFHPEVRHSEYGNDLLKNFVFGVCESEGEWSMENFIEIEMQKIREQVGDKQVLCGLSGGVDSSVVAVLIHKAIGDQLTCIFVDHGLLRKGEREGVMKTFSEGFNMNVIKVDAKDRFLNKLKGVSDPEQKRKIIGNEFIYVFDDEADKLKGIDYLAQGTLYTDIIESGTATAQTIKSHHNVGGLPEDMQFELIEPLNTLFKDEVRALGTELGIPDEIVWRQPFPGPGLGIRVLGEVTEEKLEIVRESDAILREEIANHGLERDIWQYFTVLPDIRSVGVMGDARTYDYTIESRRTSIDGMTSDWARIPWDVLEVISTRIVNEVKHINRVVYDITSKPPATIEWE

SEQ ID NO: 33205 - protein, 247 aa, Synechocystis sp. PCC 6803
MTALTAQVALVTGASRGIGKATALALAATGMKVVVNYAQSSTAADAVVAEIIANGGEAIAVQANVANADEVDQLIKTTLDKFSRIDVLVNNAGITRDTLLLRMKLEDWQAVIDLNLTGVFLCTKAVSKLMLKQKSGRIINITSVAGMMGNPGQANYSAAKAGVIGFTKTVAKELASRGVTVNAVAPGFIATDMTENLNAEPILQFIPLARYGQPEEVAGTIRFLATDPAAAYITGQTFNVDGGMVMF

SEQ ID NO: 33206 - protein, 500 aa, Brucella melitensis 16M
MPYCPIALHKETTMKAQPKASHFIGGAFVEDKAGKPLPVIYPATGEEIASLYSATPGIIEAAYAAALKAQGEWAALKPVERGRILRRTAEILREKNRKLSKLETLDTGKALQETLVADAASAADALEFFGGIISGFNGEFVELGGSFAYTRREALGICVGIGAWNYPIQIAAWKSAPALAMGNAFIFKPSENTPLSALALAEAYKEAGLPDGLFNVVQGYGDVGAALVNHRLTAKVSLTGSVPTGRRIMAQAGEQLKHVTMELGGKSPLIVFDDADLESAIGGAMLGNFYSTGQVCSNGTRVFVHKNIRERFIERLVERTRKIRIGDPFDEATQMGPLISAAQRDKVLSYIKKGKAEGATLACGGGVPKLQGFDKGFFIEPTVFADVTDTMTIAREEIFGPVMSVLEFSDEDEVIARANDSEFGLAAGVFTADLSRGHHVIGQIKAGTCWINAYNLTPVEVPFGGYKQSGIGRENGIAALAHYSQIKTVYVEMGKVDSPY

SEQ ID NO: 33207 - protein, 179 aa, Vitis vinifera
MHKGATFHAFILFPTKDPSQLKRASLLEASITYSTPNNDKTSRHKLLVLVGTITLLALTGLLVFMLFFLAATFNAIVISLLMSLAAAGGFLALFFACITAIYIGALSVAVVVISTATISAIIAALITTGWIGFFWTVWLVTKKSAGFAKHSLGMTGSAIAAYSSVRHVRRHHDFDKISD

SEQ ID NO: 33208 - protein, 413 aa, Azoarcus sp. EbN1
MSSIPVPLTLPDLVAARERIRDAVVRTGQWQNDALSDELGVPLQLKLENMQRTGSFKLRGATHKIGRLLEAGARPAGVVAASAGNHAQGVARAAARVGLGAVVVMPANAPLTKIQACRKLGADVRLVGDTLEAASDEARRLADGEGLALIHPYDDWDVIAGQASCGLEMLEDAPDMTVAIVPLGGGGLLSGVALALKLQNPAIRVIGVQTDAVAPWRHFLRDGTLEAVRPDAHTIADGIKVKRPGMLTRQVIARHVDDIVTVDDNAIAEAIVTLLERTRTIGEGAGVVGLAALLQRKVRLGPDDRAVVVISGGNVDMTLVGRSIDYGLASSGRLMSVAVMISDAPGQLLALLATVAELGMNVRHVEHRRGELHVAVGMTEVILQIETRDAEHQHALLTHFAAQGLAVRNLLAG

SEQ ID NO: 33209 - protein, 417 aa, Photobacterium profundum SS9
MDSKVVVPVDGQKITLDSEGKLVVPNNPVIPYIEGDGIGVDVSPAMIKVVDAAVNKAYAGDRKIEWMEIYTGEKSTQVYGEDAWLPQETLEFIREYKVAIKGPLTTPVGGGIRSLNVALRQELDLYICVRPVRYFDGVPSPVKRPDLTDMVIYRENSEDIYAGVEYQAGTAEADKVIKFLQDEMGATKIRFTQQCGIGIKPISEEGTKRLIRAALQYTIDNDRDSLTLVHKGNIMKFTEGAFKDWGYEVALQEFGAELLDGGPWMTLKNPNTGKEIVIKDCIADAFLQQILLRPAEYDVIATMNLNGDYVSDALAAQVGGIGIAPGANIGDGVALFEATHGTAPKYAGQDKVNPGSLILSAEMMLRHMGWLEAADLIISSMEAAINNKTVTYDFERQMEGATLRKCSEFADDMIEHM

SEQ ID NO: 33210 - protein, 462 aa, Thermobifida fusca YX
MLGGGPAIVFAFAEEGPMTTVPIAAEQEVGTTVTLLEPGDGTGLVRRTVLPGGLRVVTETMQGVRSVAFGISATTGSRDEDAEHAGAAHFLEHLLFKGTERRSALDISALLDGVGADYNAYTTKEQTTYYAKVLDRDLPLAIDVISDMVANSVLDPAEVETERGVILEEIAMYEDEPADVVDDVFAAHFFKGSPLGRPILGTNDTIRALTRERILEQYRSAYVPSELIVAAAGNLDHDTVVRQVAEAFRDKLDAAGDARPAAPRIGTEPPATNPGTVLVSRDSEQAHLILGREGVKRTDPRWYALRVLSAILGGGMSSRLFQEVREKRGLAYAVHGYTCSYSDTGLFQVYVGCLPDKIDEVLDVCRTELERAAAHGVDAAELARAKGQIRGSWVLGTEGTNARMSRLTSHELGYRRHLSLSEDLALFDAVTSEDVSEVAAEILTRPEALAVVGPYEEGRSFV

SEQ ID NO: 33211 - protein, 230 aa, Lilium longiflorum
TQPKDLGTTMHPLVFPGGNVANPNVSKCAGNAFDDIDIKGKIVLCERGLVSRTDKGVFVKAAGGVGMILMNDAVNAYHTEADGHVLPASHVSFADGNKVKAYIKSTVNPTANILFNGVVTGSPRAPVVAAFSSRGPNKACPAVLKPDIIGPGVNIVAASPVHVEPASFGNLTGPAFRMASGTSMSAPHLSGIAALVKSYHPDWSPAAIKSAIMTTASVTDNTGSPIVDER

SEQ ID NO: 33212 - protein, 155 aa, Oryza sativa Japonica Group
MPMRVLTVGKKRSRGAQLIVEEYKEKLGYYCDIEDTLIKSNPKLTSDVKVQVEAEDMAMMLQLKPEDFVVVLDENGKDVTSEQVADLVGDAGNTGSSRLTFCIGGPYGFGLQVRERADATIRLSSMVLNHQVALIVLMEQLYRAWTIIKGQKYHH

SEQ ID NO: 33213 - protein, 101 aa, Vitis vinifera
MVSENAVIVFGRRGCCMTHVVKRLLLGLGVNPAVCEVNEEDEIGVLDELGMVGAGEGKQGAVQFPAVFIGGRLFGGLDRVMAAHITGELVPILKQAGALWL

SEQ ID NO: 33214 - protein, 500 aa, Campylobacter coli RM2228
MANLYLMRSRSDELNTLATTKLLKNYSKIYKNIAIYCPVIYVHRIPVLQGWLEEFDIKQTLKNAYSFTFREAMEEFSKDPHSFFNTILEEYEELNRKYDFVLVNSFCEFGILDGFDLSIKLAKNLNTPIAAIINNEDKLIAQKYFDEALDGRDYALINENFNFEEMHKLQAYDFMTPHRFKYELIKKSVKNKKTVVLPESNDERILKAVEILLKSSVVDLILLGDEQDIKQKADELALDLTAVKILNPLHSEYNEEFATLLYEARKSKGMSLEEAKELVKDRTYFGTLLIHSGKADAMVSGASTTTAETIRPALQIIKTQEGVDSVSGIFFMGLDDKVLAFADCAVNPNPNAEQLAASAYVSAMTAKSFGIEPRIALLSYSSGDSGKGESVDLVKEALRIAKEKYPELNIDGPMQFDCAYDPKTAAKKMPNSKIAGNVNVYIFPDLDAANICYKAVQRTANALAIGPILQGLKKPVNDLSRGCLVDDIVDTVILSAIQAQ

SEQ ID NO: 33215 - protein, 80 aa, Bacillus cereus ATCC 14579
MNGMADVLERVTKIIVDRLGVEETEVVPAASFKEDLGADSLDVVELVMQLEDEFEMEISDEDAEKIATVGDAVTYIESHL

SEQ ID NO: 33216 - protein, 1267 aa, Gibberella zeae PH-1
MASCPPELVSESARERESFKYGASILNDITDSPSEGASPPGSNTPTDNVFDEASKQQKAPRDTVLASLAQLGLWKTGTDRALISLFDRNHQYIVAETTQKSSLAPGPIRATNDHGEFWLYPGTFPRQLSVCDRALMAQKNDPFASQTELPLTLIPDLEADARLSQLPHPLSRCPARFYAAVPIRSPAGVDIGVYCVVDPQPREAETWGNSDTQALRDVSLNIMDYLQSKSVGDAYRRSVRMTRGIGSFVERESTMAGWRARADSPAFHDDVTREGALNHEQQALQRFRGLSLQKTLPVHVPAQANTGRETTAVRSGDAGRAKMTSVSSEGPSAREPEANLKEKATAKIFSRAANLIREGIEIEGVLFLDANLEASAVDGVVHDGSHSTPESSSSSDESTSQIADEEESRCCGILGFATSTSSSINSDPGSKLHTGLPMKLLAALLRRYPTGKIFNFDEDGGLLSSGTSEEDIWSSVSKQDELGESSAISVSSKEHRPWSRTSEGQSLSKVFPGARSVAFVPVWDPKRDRWLAGGFAYTLTPTRSFTIEGELSYLRGFGMLAMSEAQRLEALLINKAQSDVLGSLSHELRTPLHGVMLSAELLADTQLDVFQGNLLRTLETCGRTLTETIDHLLYFSKVNQAAVHQKRERRARKTSIAPEPAAIFAANTSTSEVRLDALVEEVMDSVFAGHVFGRNEAHKVWQNSSRSGHLDTGEVQPPNSNDLTGGRADGTIKHEVPLGHKSQVAIFLDIDPYVPYRFLVAAGALRRVVMNLFGNALKYTQRGTITVSLSQKPLYPTEPNSDRRVVRISVIDTGQGISPDFLQNDLFKPFSQENHLSHGTGLGLSLVKKIVGSMGGKISIESAVNVGTTATITFPLTRSNDPSALQGQEKNEADKEAKRLKGLRVRLIGFPSEEEIQSQTASGIPMSAMQTMCHRWLEMDVIHESSSQHVAPDIVLCNEIAVDDPVLISPELARSPIVVICATAITAHKRSSQRDTSEEQRVYEFVSQPIGPHKLARILHIAFRRWGDLQALSPMTPTEAERDLLCNSPDRSERPSRRHLGGGDAGVDVSDNEPAPSDSKPKSAKRPKPPTRAPSAQVFPELTQESTSADETKSFLLVDDNPINLSILCAYMKKLKSKYATAADGLEAVERFQENPDLFSCILMDISMPRMDGIEATKKIRSFEHSKEREPVVILALTGLASASAQQDAYASGVDVFLSKPVKLKELSTILRDRDLVSVDRLLMVRLGVGDAYFGQKDYNTHAVVLF

SEQ ID NO: 33217 - protein, 161 aa, Ostreococcus tauri
MDNPSPKVYVTRARTTGAASRGARGREESREDGRDAFDAREIFEHVRDINDPEHPHSLEALGVVREGDIAVDDSKNRVKVEFTPTVPHCSMATLIGLSIRVRLLRTLPRRFKVDVLIAPGTHTSEKAVNKQLNDKERVAAALENANLLEKVDLCLSGKTAI

SEQ ID NO: 33218 - protein, 150 aa, Rhodococcus sp. DK17
MGSDTVKCPNCGKVNKVPAAGDGKPRCGNCHEPLPWIASAGDGDFAEVAEKSSVPVLVDLWATWCGPCRMVSPALEQLATERAGQIKLVKVDVDAAPKTAERFTVRAVPTLLVMDRGEVLARQAGAAPVPQLRTWLDQALSENAGKEAKS

SEQ ID NO: 33219 - protein, 388 aa, Escherichia coli O111:H-
MKITISGTGYVGLSNGILIAQHHEVVALDIVPTKVEMLNQKKSPIVDKEIEEYLATKQLNFRATTDKYDAYRDGTYVIIATPTDYDPKTNYFNTSSVESVIRDVVDINPNAVMVIKSTIPVGFTNLLKERLGIDNIFFSPEFLREGRALYDNLHPSRIVIGERSERAGRFAALLQEGAVKKDIPTLFTDSTEAEAIKLFANTYLALRVAYFNELDSYAESLGLNSRQIIEGVCLDPRIGNHYNNPSFGYGGYCLPKDTKQLLANYASVPNNIIGAIVDANRTRKDFIADSILARKPKVVGVYRLIMKSGSDNFRASSIQGIMKRIKAKGVPVIIYEPVMVEDEFFHSRVVRDLTAFKNEADIIISNRMTSELADVADKVYTRGLFGSD

SEQ ID NO: 33220 - protein, 459 aa, Gloeobacter violaceus PCC 7421
MAFDYDLLIIGCGVGGHGAALHAVAHKLKVAVVEARDLGGTCINRGCIPSKALLAAAGRLRVLRESEHLGISVGEISFDRAKIAHHAASVVDKIRADLTKSLQKLGVTILHGHARLKGSQTVEIDPGEGGGEVQVLTARDVLIASGSQPFVPPGIVTDGKTVYTSDEGVRLEHLPEHICIIGSGYIGLEFSDVYTALGTKVTMIEALDRLMPGFDPDIARLAARLLVKSRDIDTKVGVFAKKVTPGQPATVELSTGEQLQFDAVLVACGRTPDTKNLGLESVGLETARGFIPVDGRMATSAEHLWAIGDATGKMMLAHAASAQGIVAVDNMLGHERTIDYRSIPAACFTHPEIGFVGLTEPQAKEQGYKVGVVRTYFGGNSKAIAQGDTEGMAKIVYDQTTGELLGCHIIGPEASLLVAEAAQAIAGRDRIERLAHLVHTHPTLSEILDEGYKRAAAVL

SEQ ID NO: 33221 - protein, 197 aa, Brassica napus
MKKLKSCYMQVRRHQQQTSDRRWILPLAIGSICSLFLLLLTTLASSSSQARLIPLSVYGLRSSVFVESKINPLSVSVSPPPPPPRLAYLISGSSGDGQMLKRTLMALYHPNNQYVVHLDRESSAEERLDLSAFVANQTLFGRFRNVRMIVKANFVTYRGPTMVANTLHAAATLLREGGDGDWFINLSASDYPLVTQD

SEQ ID NO: 33222 - protein, 54 aa, Glycine max
TKTGKKVREAPKFQRLVTPFTLQRKRARFAPKKKRIVKAKSKAPGFPKLLASRL

SEQ ID NO: 33223 - protein, 332 aa, Burkholderia sp. 383
MKVAVLGAGAWGTALAGHLAARHDTLLWARDAALIAGLQARHENSRYLDGIALPDALRYDADLGAALAHGAADDALCVIAAPVAGLRTLCHAMRDAGCVPAHVVWVCKGFEADTHLLPHQVIAAELPEQHSNGVLSGPSFAREVGQSLPVALTVASTSAECRERTLAAFHHGAMRIYTGDDVVGVEVGGAVKNVLAIATGIADGLGLGLNARAALITRGLAEMSRLGVALGGRAETFTGLTGLGDLILTATGDLSRNRTVGLQLAAGRTLNDILGALGHVAEGVRCAQAVLAIARAQSIEMPITEAVCGVLFDGIAPRDAVSGLLRRDARAE

SEQ ID NO: 33224 - protein, 533 aa, Physcomitrella patens subsp. patens
MVLSICKSMKETKGHDTIDSMFASRYAQAELPRFEIPTQETPKDVAYQIISDELMLDGNPRLNLASFVTTWMEPECDKLIMAALNKNYIDMDEYPITTELQDRCVNMVARLFNAPIGEGEQAVGAGTVGSSEAIMLAGLAFKRKWQLERKAAGKPWDKPNMVTGANVQVCWEKFARYFEVELREVTLKEDYYVMDPHRAVELVDENTICVCAILGSTYNGEFEDVQLLNDLLEKKNQELGLNVPIHVDAASGGFVVPFIYPDIVWDFRLPLVKSINVSGHKYGLVYAGIGWVVWRNKEDLPEELIFHVNYLGADQPTFTLNFSKGASQVIAQYYQLIRLGFNGYKSIMTNCAMNAKILTQAIENLGRFKILSKEVGVPLVAFSLLDSSNYTEFDISDGLRRYGWTVPAYTMAPDAQHVTLLRVVVREDFSRSLANRLVTDIKRVLDHFDARPPKLIEVVTAAVAQENREANLDLPTTPDAVKATAAFNDIVVEGHHGGKKKQQHGHGHGHHGPIATTTATAKTTTARNPPFTR

SEQ ID NO: 33225 - protein, 482 aa, Prochlorococcus marinus str. MIT 9312
MLETLSHQYLKNFLRDQSNSWEHIYSFGRIISKCIENDSIYLINSEIFSTYDWIPPIMISLFLKEEDSTFILSKEKIQFISQFQIDSLKNLGFNFILKNDQFIFANHHVRLMTIQNLLNDPNSRNLRNHRIVYSGIEDIKEDLKKHFRISLHKKDWTKNFKEFELINQKFIKVYDSFKKKFFMRKVLGTSYINLDEKEISFFSNFFCENSFFSDKFLSVNKALSQGWACWVKLNDTNLDWNLYLQPIDELSQIKEFFSNNKFVFLSSLRKDNFFQMYFKKHSLDIDLVINFKSNFEEKKISLYIPSKQLLPNNPLFTNSIVDKCKKLILFRKGLTLVLSDDIDLKTNLATELASKYGKRVLLETIPSGKNEILCSSFDWWIINSYLIQIPEQIIIPLLPIPNMSEPINAITVSHKNKLSQDWFRDFFLPQARIKLERSISPLRRNSGKLIILDGRANKRNWGRLLLKNIQPSKQINYMLPFE

SEQ ID NO: 33226 - protein, 270 aa, Burkholderia sp. 383
MAGPGRVLLDAPQLPSLPTARSMYKLVLIRHGESTWNKENRFTGWVDVDLTEQGRNEAYQAGELLKEAGYTFDIAYTSVLKRAIRTLWHVQDKMDLMYLPVVHSWRLNERHYGALSGLNKAETAAKFGDDQVLVWRRSYDTPPPALEATDERAPFNDPRYAKVPREQLPLTECLKDTVARVLPLWNESIAPAVRAGKQVLIAAHGNSLRALIKYLDGISDSDIVGLNIPNGVPLVYELDENLKPIKHYYLGDQDAIAQAQAAVAKQGKAG

SEQ ID NO: 33227 - protein, 292 aa, Prochlorococcus marinus str. MIT 9312
MQKLSPIEINEICEELGETYPKSIEQVHGGDIHSAWRIEFSNKKLFLKRNIRNKKFLEFEKYCLQNLRKYINQENLVIPKVIAYKNIKNIEILLIEWINMHNFDQKKLGKGLGELHLKSAESNPKMFGFPVEGFIGTTDQKKGLEEDWIDCFLNLRIIPQLLILKSTILDKEIINKVKEKIKSELLNHKPINALVHGDLWSGNTGMDESGRGVIFDPASWWADNEVDIAMTKLFGGFRKEFYEEYHRIFPIKNGFEKRIIIYNFYHILNHANMFGGGYLKQVKDYVQAILNM

SEQ ID NO: 33228 - protein, 592 aa, Burkholderia sp. 383
MRVSFTLHGIPVSRGIAIGRAYLIAPAALDVAHYLVEANQIDAEVERFRTALEVVHHELEALRADLTDDTPSEVGAFIDVHAMILSDEMLVQETIDLIRTRRYNVEWALTEQLELLTRHFDDIEDEYLRERKADIEQVVERVLKALAGAPSASQALDRAARNGTNEMIVVAHDIAPADMMQFKSQSFQAFVTDLGGRTSHTAIVARSLGIPAAVGVQHASALIRQDDLIIVDGDQGIVIVDPAPIVLEEYSYRQSEKLLEQRKLQRLKFSPTQTLCGTKIELYANIELPDDAKAAVDAGAVGVGLFRSEFLFMHQKEMPEEEEQFAAYKRAVEWMKGMPVTIRTIDVGADKPLEALDEGYETAPNPALGLRAIRWSLSEPQMFLTQLRAILRASAFGQVKILIPMLAHAQEIDQTLDLIREAKRQLDDAGLAYDPNVRLGAMIEIPAAAIALPLFLKRFDFLSIGTNDLIQYTLAIDRADNAVAHLYDPLHPAVLHLIAYTLREAKRAGVSVSVCGEMAGDPALTRLLLGMGLTEFSMHPSQLLVVKQEILRAHLKALEKPTADVLAAFEPEEVQAALQRLSVAEPRADAAA

SEQ ID NO: 33229 - protein, 380 aa, Prochlorococcus marinus str. MIT 9312
MSKDIKFNCLNSDEEERYQKHLTLKEIGYEGQIDIKNSSVLCIGAGGLGSSVLLYLTASGIGEIGIVDNDHVEKSNLQRQIIHETNNIGNLKIDSARERMRKLNPNSKLITFAERINPKNALEIIRQFDIICDCSDNFSTRYLINDACLILKKPLVFGSVQGFEGQVSVFNLHEKSPNLRDLLPESPSKNNVPSCAEYGVVGVSTGLIGILQVNEIIKIILKKGEILDGKILIFDLLNMNMKKLNLKGDQINKRIKNLSQFVDFYCEDECSDKNKINRINANDFNSLYKAKPNKILLIDVRENEEFSNSAIEGSISIPLSHLSQKPDLEFIQKESLIKEVFTICKSGKRSEKASKILSKFKIKSRSIEGGIEKVKKLLCN

SEQ ID NO: 33230 - protein, 214 aa, Bacillus cereus ATCC 14579
MIKIAPSILSADFSKLGEEIKDVEKGGADYIHVDVMDGHFVPNITIGPLIVEAIRPITSLPLDVHLMIENPDNYILTFAQAGADIITVHVEACPHLHRTIQLIKSHGIKAGVVLNPHTPVSVIEHVLEDIDMVLLMTVNPGFGGQKFIHSVLPKIKQVADMVKERNLEVEIEVDGGVNAETARLCVEAGANVLVAGSAVYNQKDRGEAIRVIRG

SEQ ID NO: 33231 - protein, 334 aa, Escherichia coli O111:H-
MKYLVTGAAGFIGFHVSKRLLEAGHQVVGIDNLNDYYDVSLKQARLELLAQPGFQFHKIDLADREGMTDLFASGHFERVFISPHRLAVRYSLENPHAYADSNLTGFLNILEGCRHNKIQHLLYASSSSVYGLNRKMPFSTDDSVDHPVSLYAATKKANELMAHTYSHLYGLPATGLRFFTVYGPWGRPDMALFKFTKAMLEGKSIDVYNYGKMKRDFTYIDDIAEAIIRLQDVIPHADTQWTVETGTPAASIAPYRVYNIGNSSPVELMDYIQALEDALGIEAKKNMLPLQPGDVLETSADTKALYEVIGFTPETTVKDGVKNFVNWYRDFYKV

SEQ ID NO: 33232 - protein, 745 aa, Streptomyces coelicolor A3(2)
MGDGTLIQGRYRLLERIGRGGMGEVWRARDESLGRRIAVKCLKPLGTQHDHSFTRVLRERFRREARVAAALQHRGVTVVHDFGEWDGVLFLVMELLEGNDLSRLLEDNKGHPLPVADVVDIAEQVASALAYTHEQGIVHRDLKPANIVRTADGTVKICDFGIARLGHDAGFTARLTGTGIAMGTPHYMSPEQIGGDEVDRRSDLYSLGCVLYEMATGVPPFDLGDAWAILVGHRDTEPEPPRTHRAELPRYLDRIILDLLAKRPEQRPDDAGELGRRITAGRTAPERVPALATARPRTPRQVGGRAVLPSWTHGMTTGHKATGPGPRATPPDPGAGLSGEWIPRPTGDGTDGGRTVGPVPDEWPEPASEAAAGLAERHNAALSLGRLGRWEEAGRAHRAVAAERERLLGPDHPDTLASRYEAAFTLGRTGRAADALRAYKGVAQARIRTLGADHADTLAVRQEMAYTLGRLGRHTDAHQVYTSVLTARERTMGADHPDTLRCRHNLAFNLGRLGRTEDAHRMAREVAAARARVLGPGHPDTLVTRYEVAYELGRLDRWQEALATYREVAAARARALGPDHPDTFAARYETGVALGRLGRCAEALTAYEALIADRARAQGADHPETLRARHGRGVNLGRLGRWGEALEEARAVCAARGRVLGPDHPDTLVSHREVAVALGWLGRWAAALTEYRLVAAARERVLGPDRPDTLVARDDEAHCLEQLGRAAEAAELYRRVAALRSVAAR

SEQ ID NO: 33233 - protein, 643 aa, Gibberella zeae PH-1
MAAHISNGNSALSPASGYEGATLEDLPKSWHFTESLPADSMFPTPADSHKTPRDQIGPRQVRNAAFTWVRPEEQKDPELLAVSPAALRDLGIKSGEETTENFKQMVAGNKLYGWDEEKLEGGYPWAQCYGGFQFGQWAGQLGDGRAISLFESTNPASGERHELQLKGAGLTPYSRFADGKAVLRSSIREFVVSEALNALNIPTTRALSLTLLPDSKVRRERIEPGAIVLRFAQSWIRLGNFDILRARGDRKLIRQLATYIAEDVFGGWEKLPGQLEDPDKPVDSPAPNRGVAADTIEGADGSEENRFTRFYREVVRRNAKVVAHWQAYGFMNGVLNTDNTSIYGLSIDFGPFAFMDNFDPAYTPNHDDYALRYSYRNQPTIIWWNLVRFGEAIGELMGAGADVDHESFVTEGVKKEQEEEIVARAEKLITQAGEEYKAVFLAEYKRLMTTRLGLKTQKDKDFEVLFSEALDTMEALELDFHHFFRRLSNVKLQDLATEEARKETASVFFHKEGPPTITTEEDARARLAIWLESWRERIIEDWKDEGDNVSDAKDLERIDAMKRVNPNFVPRGWILDELIQRVEKDGERDVLNRVMQMALNPFEDRWDGETFDGKTYTGNKDEELRWTDDPPQSERAMQCSCSS

SEQ ID NO: 33234 - protein, 565 aa, Vitis vinifera
SARARAEFGTSSLSTPRLTFSSPKLQTLYRNFPISLSLNFSSSLSHSKTLTVAPGSLSQRPSSFSPRRCFAVRAESENGAEPRHYDFDLFTIGAGSGGVRASRFAANFGSSVAVCELPFATISSETTGGVGGTCVLRGCVPKKLLVYASKFSHEFDESGGFGWKFEAEPKHDWSTLMANKNAELQRLTGIYKNILKNAGVTLIEGRGKIVDPHTVDVDGKLYTARHILIAVGGRPFIPEIPGSEHAIDSDAALDLPSKPKKIGIVGGGYIALEFAGIFNGLNTDVHVFIRQKKVLRGFDEDVRDFVAEQMSLRGIEFHTEESPQAILKSADGSLSLKTNKGTVEGFSHIMFATGRRPNTKNLGLETVGVKMTKTGAIEVDEFSRTSVPSIWAVGDVTDRINLTPVALMEGGALAKTLFGNEPTKPDYRAVPSAVFSQPPIGQVGLTEEQAIQKYGDIDVYTANFRPLKATLSGLPDRVFMKLIVCAKTNKVLGLHMCGEDSPEIVQGFAVAVRAGLTKADFDATVGIHPTAAEELVTMRTPTRKIRNSSPPEGKTDPEVKAAAGV

SEQ ID NO: 33235 - protein, 445 aa, Saccharomyces cerevisiae
LDAFGDDQAISKPNTVVIQQPQNEPVLVLSSLSQSPCVSSSSSLSTPCIIDAYSNNFGLSPSSTNSTPSTIQGLSNIATPVENEHSISLPPLEESLSPAAADLKDTLSGTSNGNYIQLQDLVQLGKIGAGNSGTVVKALHVPDSKIVAKKTIPVEQNNSTIINQLVRELSIVKNVKPHENIITFYGAYYNQHINNEIIILMEYSDCGSLDKILSVYKRFVQRGTVSSKKTWFNELTISKIAYGVLNGLDHLYRQYKIIHRDIKPSNVLINSKGQIKLCDFGVSKKLINSIADTFVGTSTYMSPERIQGNVYSIKGDVWSLGLMIIELVTGEFPLGGHNDTPDGILDLLQRIVNEPSPRLPKDRIYSKEMTDFVNRCCIKNERERSSIHELLHHDLIMKYVSPSKDDKFRHWCRKIKSKIKEDKRIKREALDRAKLEKKQSERSTH

SEQ ID NO: 33236 - protein, 433 aa, Physcomitrella patens subsp. patens
MKGTPKEHGFYMPAEWELHAQTWMGWPEREDNWREKAVHAQRAFVEVATAISEFEPVTVCATGSQWEAARSQLPPNVRVLEMSMNDAWFRDTGPTFVVLDNVETETESIREVAGVRWTFNAWGGKENGCYDDWTLDALVARKILDAERVPQFSQQFILEGGSIHVDGEGTCLTTEECLLHPNRNPHLNQGEIEEQLKLYLGVEKVIWLPRGLYGDDDTNGHIDNMCCFVKPGVVLLHWVDDENDPQHERSVEAFNVLSKATDAKGRTLEILKIHAPAPLYFKPEEVSGLVQNSAVIRHEGQRLASSYVNFYICNGGVIAPAFGDLAADQAAEDVLRSAFPTHKVVMIQHAREILLGGGNIHCITQQQPAAFSALHPLPDDTVGRKGVEDGKAVEGASFQEFAPAVGEGSSTTVTKTLVDSLLTASMLMSSQKG

SEQ ID NO: 33237 - protein, 187 aa, Symbiobacterium thermophilum IAM 14863
MRHGATAANAEGRYVGWEEHPLSADGLAQAEAAARYLSRFRLTGMRTSDLMRCRQTAERIGRATGLTPAPDPRLRELNFGRFSGLTYEEIARQWPEELAAWLADPEHAPPPGGESLASLRSRALAALPRQDGAVVVTHGGVIRTVLAHLTGRGLWDWRVPPGAVVLLRWDGERAVDEPRVWRPEAGE

SEQ ID NO: 33238 - protein, 399 aa, Prochlorococcus marinus str. MIT 9312
MTPERLGLLWGITVFAGACARLFSSFTGFPSVVILLLSGLFIGRSGLGLVEPLDLGQGLETIVGLLVCLVLFEGGLNLKLPEGNIRNTVLKISLVRLFISLSAGIFIAHWLAGLSWQVAGIYSAIVLATGPTVVSPLVEQIKLASPLSEVLKAEGLLLEPIGAVLALLLLELTLGDLRGINDVFIALMQRLGGGVLIGLTAGWLLSEILKKIKNEASFGIELQVTLGFIFLVYGICEYFLPESGLPASVAAGFIVGKREVIDKDRLDNLIGELAQLAITVLFPLLAADVSWSELSPLGWGGVICVFMLMVIVRPISIWIATMGRELDLKEKVFLAWLAPRGIVTAAVASLFSIRLEQAGILGAGRLQGLVFLTILMTVGIQGLTAKPLVNRLELGQKKN

SEQ ID NO: 33239 - protein, 128 aa, Physcomitrella patens subsp. patens
MSSEAVNPKAYPLADAQLTITITDIVQQAANYKQLKKGANEATKTLNRGIAEFVVMAADTEPLEILLHLPLLAEDKNVPYVFVPSKQALGRACGVSRPVIACSVTTNEGSQLKMQIQQLKDAIEKLLI

SEQ ID NO: 33240 - protein, 340 aa, Oryza sativa
  misc_feature (131)..(131): Xaa can be any naturally occurring amino acid
  misc_feature (267)..(267): Xaa can be any naturally occurring amino acid
  misc_feature (283)..(283): Xaa can be any naturally occurring amino acid
  misc_feature (296)..(296): Xaa can be any naturally occurring amino acid
MAKIKIGINGFGRIGRLVARVALQSDDVELVAVNDPFITTDYMTYMFKYDTVHGQWKHHEVKVKDSKTLLFGEKEVTVFGCRNPEEIPWGETGAEFVVESTGVFTDKDKAAAHLKGGAKKVVISAPSKDAXPMFVVGVNEKEYKPDIDIVSNASCTTNCLAPLAKVINDRFGIVEGLMTTVHAITATQKTVDGPSSKDWRGGRAASFNIIPSSTGAAKAVGKVLPALNGKLTGMAFRVPTVDVSVVDLTVRLEKPASYDQIKAAIKXESEGKLKGILGYVEEXDLVSTDFQGDNRXSSIFDAKAGIALNDNFVKLVSWYDNEWGYSSRVVDLIRHMYNTQ

SEQ ID NO: 33241 - protein, 313 aa, Emiliania huxleyi
MAGARTIHVPDPSWGNHGHIFRSAGLEVQNYAYLDHRTGTTLDFDGMRAALSGLPRGSVVLLHACAHNPTGIDPSGEQWQELAELFAGRGLVALFDSAYQGYASGDLDADAASVRAFEAAGVLPVACQSYAKSLGLYGERIGAVNFVCASREEAEAVLSTVKQTIVRPAYSSPPLHGARLAAEALAPSTASVSAPAGGSTPLSPRRQVLGDAALFAQWRGELRGMANRVHRMRVLLADALRAEGAPSPDGGDWGHVVDQIGMFAYTGLSASHVDSLRERHHVYLTRDGRMSMAAMKPADIEYVARAVRSVLAE

SEQ ID NO: 33242 - protein, 487 aa, Triticum aestivum
  misc_feature (205)..(205): Xaa can be any naturally occurring amino acid
MVISHASSSAGEAVYSTFSSRYVREELPRYRMPEGSIPKEAAYQIISDELMLDGNPRLNLASFVTTWMEPECGKLMMDSVNKNYVDMDEYPVTTELQNRCVNMIAHLFNAPIGEDETAIGVSTVGSSEAIMLAGLAFKRKWANKMKEQGKPCDKPNIVTGANVQVCWEKFARYFEVELKEVKLTEGYYVMDPKKAIEMVDENTIXVAAILGSTLTGEYEDVKLLNDLLVAKNKETGWDVPIHVDAASGGFIAPFLQPELEWDFRLPLVKSINVSGHKYGLVYPGVGWVIWRSKADLPDELIFHINYLGTDQPTFTLNFSKGASQIIAQYYQLIRLGFEGYKHIMENCKLNAAVLKEGIDATGRFDVLSKADGVPLVAIRLKDSTNFSVFDISENLRRFGWIVPAYTMPADAEHVAVLRIVIREDFNRSLAQRLLADINKIVRELDAHAVHAIKLSNAAAAEGASKSTVDAVTEAFKGLAGNKKAGVC

SEQ ID NO: 33243 - protein, 248 aa, Photobacterium profundum SS9
MLEVTFSLASGAASAYNNAVNFSPRHVVLQVLSDMSENSHQCVIIGIAGASASGKSLIASTVYKELKEKVGDHQIGVITEDCYYNNQSHLTMDERVKTNYDHPNALDHNLLCDHLQRLIEGKAVEVPQYSYSEHTRLKETTPMTPKKVIILEGILLLTDPRLRELMHASVFMDTPLDICLLRRLQRDVAERGRTMESVLVQYQKTVRPMFMQFIEPSKQYADIIVPRGGKNRIAIDVLKAHIAKLLKS

SEQ ID NO: 33244 - protein, 120 aa, Arabidopsis thaliana
  misc_feature (10)..(10): Xaa can be any naturally occurring amino acid
  misc_feature (17)..(18): Xaa can be any naturally occurring amino acid
  misc_feature (22)..(22): Xaa can be any naturally occurring amino acid
  misc_feature (26)..(26): Xaa can be any naturally occurring amino acid
  misc_feature (31)..(31): Xaa can be any naturally occurring amino acid
  misc_feature (36)..(36): Xaa can be any naturally occurring amino acid
  misc_feature (40)..(42): Xaa can be any naturally occurring amino acid
  misc_feature (46)..(46): Xaa can be any naturally occurring amino acid
  misc_feature (51)..(59): Xaa can be any naturally occurring amino acid
  misc_feature (62)..(64): Xaa can be any naturally occurring amino acid
  misc_feature (70)..(70): Xaa can be any naturally occurring amino acid
  misc_feature (76)..(77): Xaa can be any naturally occurring amino acid
  misc_feature (80)..(80): Xaa can be any naturally occurring amino acid
  misc_feature (82)..(82): Xaa can be any naturally occurring amino acid
  misc_feature (87)..(87): Xaa can be any naturally occurring amino acid
  misc_feature (89)..(89): Xaa can be any naturally occurring amino acid
  misc_feature (91)..(91): Xaa can be any naturally occurring amino acid
  misc_feature (93)..(97): Xaa can be any naturally occurring amino acid
  misc_feature (100)..(103): Xaa can be any naturally occurring amino acid
  misc_feature (106)..(106): Xaa can be any naturally occurring amino acid
  misc_feature (108)..(110): Xaa can be any naturally occurring amino acid
  misc_feature (112)..(112): Xaa can be any naturally occurring amino acid
  misc_feature (114)..(115): Xaa can be any naturally occurring amino acid
MASSMLSSAXVVTSPAXXTMVXPFTXLKSSXAFPVXRKTXXXITSXASNGXXXXXXXXXPPXXXKKFETXSYLPDXXDVXLXKEVDXLXRXKXXXXXSNXXXXHGXVXXXHXNXXGKPLA

SEQ ID NO: 33245 - protein, 456 aa, Bilophila wadsworthia
MTYDKAELVALDKKYVWHHLTQHKNFEPAIYVKGEGMRITDIDGKTYLDAVSGGVWTVNVGYGRKEIVDAVAKQMMEMCYFANGIGNVPTIKFSEKLISKMPGMSRVYLSNSGSEANEKAFKIVRQIGQLKHGGKKTGILYRARDYHGTTIGTLSACGQFERKVQYGPFAPGFYEFPDCDVYRSKFGDCADLGVKMAKQLEEVILTVGPDELGAVIVEPMTAGGGILVPPAGYYETIREICDKYELLLIIDEVVCGLGRTGKWFGYQHFNVQPDIVTMAKGVASGYAPISCTVTTEKVFQDFVNDPADTDAYFRDISTFGGCTSGPAAALANIEIIERENLLENCTKMGDRLLEGLKGLMAKHPIIGDVRGKGLFAGIEIVKDRATKEPIAEAVANAMVGAAKQAGVLIGKTSRSFREFNNTLTLCPALIATEADIDEIVAGIDKAFTTVEQKFGL

SEQ ID NO: 33246 - protein, 238 aa, Brassica napus
MELDLTPKLPKKVYGGDGGSYFAWCPEDLPMLKEGNIGAAKLALEQHGFAVPRYSDSPKVAYVLQGSGTAGIVLPEKEEKVIAIKEGDSIALPFGVVTWWFNSQETDLVILFLGETHKAHKRGQFTDFYLTGSNGIFTGFTPEFVGRAWDLDEGTVKKLVGSQTGKGIVKLDAGFKMPMPKSEDREGFVLNCLEAPLDVDIKDGGRVVVLNTKNLPLVGEVGFGADLVRIDAHSCVRQ

SEQ ID NO: 33247 - protein, 404 aa, Ostreococcus tauri
MSTATSTSYDLTDEILREQFTRNVQFFGERGQGAVRDAFVVVVGLGGVGSHAAHMILRSGVGKLRVVDFDQVSLSSLNRHAVATRADVGTPKGRRLRSTRGSRCTEADAEDELLGPWGGEGGRMPDFVVDCIDNIDTKVALLAACVRRNLRVVTSGGAGAKCDPTRLRFVDISECAADRLARAVRYRLKKNFKIQRDIPTLVSLEEPRCELVAEMELKEGETLSDYQVIPNFRVRTIPVLGCVPAIFGMALASYVLTHLADAPFEGEPLIVLQQKQYEIQLDRLHERERERGPEVCDIAVDVVGVMYLVREIWRAFSARDDPLKRGKAGNVLHWRNTNDLALTRWNPERPACLDNLVLLTVDECDAHDARCAKPGGFEKLVAEEPDFVAFVESRLARVRSEYGT

SEQ ID NO: 33248 - protein, 885 aa, Oryza sativa
EFWIGVFYPGFISIDCGIPEKSSYQDPTSSIIYVSDYGFISTGANHNISSAYIKPSLAQRNYNVRFFPDGTRNCYTLRSLQEGNKYFVRAVFYYANYDSLNKLPVFDLYLGANYWHEVKFSNADAVNWMDIIVVAPADYLQVCLVNKGTGTPFISGLDLRPLKSTLYPEANTTQSLVLINSNRFNMGPTDNSITRYPLDPHDRLWSTYDTIPDWTEISATSVVQNYLTDVYDVPSAVMQSAATVNSSRINFTWDPSDPSVNISSKYFFVLYFSELQSVPSNGLRQFDIIVNNNTWNTQPYTPPFLFADSLSGTVQGLASYSVSLVATKNATLPPILNAMEMYLVKPLTEFATDPRDARAMMEVQQNYDVKKNWMGDPCAPKAFAWEGLNCSYPPADSSKITSLNLSSSGLAGSIATYFGDLKSLQYPDLSHNNLSGPIPNFLGQLPLLMFLDLSSNDLSGPIPYNLLQKSQNGSLSLRVGYNAKLCGNDTECGSGQKKIKGSLLSAIIITIVATVALIVVLFLLLRRMLKAKDKRRAAGPTYESALLENREFSYRELKHITNNFSQQVGKGGFGAVFLGYLENGNPVAVKVRSESSSQGGKEFLAEAQHLTRIHHKNLVSLIGYCKDKNHLALVYEYMPEGNLQDHLRATTNKPLTWEQRLHIALDAAQGLEYLHVACKPALIHRDVKSRNILLTTNLGAKIADFGLTKVFSESRTHMTTEPAGTFGYLDPEYYRNYHISEKSDVYSFGVVLLELITGRPPVIPIDESVSIHIGEFVHQSLDHGSIESIVDARMGGGGGYDINSVWKVADLALHCKREVSRERPTMTEVVAQLKESLELESHGDRKHLVTGDDDVSVSNLGEETALEVEEQSGEISRVSPGPAVR

SEQ ID NO: 33249 - protein, 794 aa, Ostreococcus tauri
MEGDLPNLGVPRGVRRASSVNPTRTRIFHGAMGVFTESEINPKVVASVPFFGGVLALVMVAVLMMRVKKAPNGDGAQIFIAKQISEGAESFLKTEYAYLLPFVACVAAFIVGILESQDRGPLYMINGAYIQSSKKGGWQTMICFLCGAALSATAGWAGMKVATQTNVKTMEAARLGLNPALQIAFAGGAVMGFSVVAFGLLGMTVLFYIFATAQNNNSLLDMRDAIRYLSGFGFGASAIALFARVAGGIYTKAADVGADLVGKVEANIPEDDPRNPATVADNVGDNVGDVAGMGADLFESFCGSIIACAALSSNTRELALPFWIAGFGILAACIGFWTVSTKDDASQSDLLHALHRGVYSASILVIVFSVACVEILFDGNKQGYRYFGCIILGLVAGILIGEATEFCTSYAYGPTKSITHAGSAGGAATVIIQGLGIGMISVFPPTVIICATVIACFNVAGAGSSGLYGIAIAAVGMLSTLGVTLATDAYGPVADNAGGIAEMSPDVPEEVRERTDKLDALGNTTAATGKGFAIGSAVLTALSLMNAYVQDVPYSMGGNDRALAAAMTLTDPYVLSGIVFGAMLPFLFAALTMLSVRKAAGAIIVEVQRQFRDIPGLLEGKEGVVCDHMACVTMCTKASVDEMILPGVIAVFTPIAVGLLIGAKCLGGLLAGAISSGFMLAVMMSNAGGAWDNSKKYIENEKVYGGKKSDTHKACVVGDTVGDPFKDTSGPALNILIKLMTIFSLTMAPVFRSDWTTWWYGVFVLCAEIFAVMVAYYYVWVRNGEKCIPPEHQK

SEQ ID NO: 33250 - protein, 448 aa, Kineococcus radiotolerans SRS30216
MTTTTLSPSRPCPGAVHGPLLPVVGAGTRVPLAHGGEIPYANLDNAASAPALTAVADRVAQVLPHYASVHRGAGYLSRVSTALFEQARAQVGAFLGAGPDDVVVFTRSTTDALDLLSRAVPTGARVLVADVEHHANLLPWQRSARTTVVRGGADAGETADLLEAELATGRYALLAVAGASNVTGEVLPLRRLARAAHAAGARIAVDGAQLLPHRRVDLGRDGIDWIALSGHKLYAPFGAGALVGRRDWLDAAEPYLAGGGATLDVGHDAVRWASGPDRHEAGSPNVVGAVALAEACATLAALPAGALEAHEAALRERLVTGLGALDGVHVVRPHPEDAVGVVTFTVPGHPASAVAAYLSAEHGVGVRDGRFCAHRFADALGLAEGGLRASTGVGTGSDEVDRLLAAVAQFVTTGPALEYGTTGGHWGPLTDARPAPESFLPSPGGGRG

SEQ ID NO: 33251 - protein, 456 aa, Candida albicans SC5314
MVLPHEPEFQQAYDELVSAVEDSTLFKEEPQYKKVIPVVSIPERIIQFRVTWENDKGEIEVNNGFRVQYNSALGPYKGGLRFHPTVNLSILKFLGFEQIFKNALTGLSMGGGKGGSDFNPKNRSDNEIRRFCVSFMRQLARYIGPDTDVPAGDIGVGGREVGFLFGAYKQMRNNWAGVLTGKGLTWGGSLIRPEATGYGCVYYVEKMIEKATNGKETFKGKRVAISGSGNVAQYAALKVIELGGTVVSLSDSKGSIISKNGITADQVYAIAAAKLKFKSLEEIVADSVQLFSGDHSVEYLAGVRPWTKVGQVDVALPSATQNEVSGEEAKALVDAGCKFIAEGSNMGSTKEAIEVFEANRDSNGVWYAPGKAANCGGVAVSGLEMAQNSQRVQWTNEEVDAKLKEIMYTCFENCYKTAQKYSIEKNENGLPSLLKGANIAGFIKVADAMFDQGDVF

SEQ ID NO: 33252 - protein, 279 aa, Prochlorococcus marinus str. MIT 9312
MKHFADLLLNKNNSKTNNQVPFIQRRRGIEIKSAREINLMKKSSRIVATVLREINDLIKPGMSTKDLDDFAEKRIKSFGAVPSFKGYHGFPSSICSSINNEVVHGIPNKNKIIKNGDLVKIDTGAYLDGFHGDSCISICVGEVSSKVQNLSDVAYKALYAGLSKIKAGNTLLDVAGEIEDVVVKNGFSVVEDYTGHGVGRNLHEEPSVFNFRTKELPNVILREGMTLAVEPIVNEGTKFCKTLNDKWTVITKDGKLSAQWEHTIVVLKDGIEILTDRDF

SEQ ID NO: 33253 - protein, 346 aa, Hevea brasiliensis
MHISPLMLVAIALYAILVGSSRPLAYAQLSPTFYDQSCPNVSNIIRGVIQESLQSDSRIGASLIRLHFHDCFVNGCDASILLDNTDTIESEKQAAANNNSARGFDVVDTMKARLESACPGIVSCADILTVSAQQSVDLAGGPTWTNLLGRRDSLTASRSQANLSIPGPFETLDQLKSKFTAVGLNNNTDLVALSGAHTFGRAQCRTFSPRLYNFNNTNSPDPTLNTTYLQTLQQICPQGGNGSVITNLDLTTSDTFDNEYFSNLLVGEGLLQSDQELFNTTGADTVAIVQNFSANQTAFFESFVESMLRMGNLSVLTGTIGEIRLNCSKVNGNSSAGAETLLVSSM

SEQ ID NO: 33254 - protein, 503 aa, Arabidopsis thaliana
MPYGPYSPAASPLPSEGQLYSPQQFPFSGASPYYQQVVPPSMQYITSPTQPELTSLVGVDQQGDNIGPRQSYHPHPIGPFNGNQPNLGFPEWQQGFDGGIWSDWSKPSDMHRHSSSISPALSPQPLGSYGSYGQNIPMGSQRQRSFYGFGSGSNSYNRGYMHSGGRGQGSNYGSRLISNVGMGNQGWIGVDNSRGRGRVSDPSLGGAYNGTFDILNEQNRGPRASKPKTQVLEELDSAADSKKNNKGSAKEHEESNNADFVTDYTNAKLFIIKSYSEDNVHKSIKYNVWASTPNGNKKLDAAYREAKDEKEPCPLFLLFSVNASSQFCGVAEMVGPVDFEKSVDYWQQDKWSGQFPVKWHIIKDVPNSQFRHIILENNDNKPVTNSRDTQEVKLEQGIEMLKIFKNYDADTSILDDFGFYEEREKIIQDRKARRQPSLPSAGVVAGENEHKPASAALPTDFMKNMSKSFAQVVRLDEGSKEAVKASSSPDAITTAAVSSGQSN

SEQ ID NO: 33255 - protein, 917 aa, Oryza sativa Japonica Group
MAPMYGRVGKGVSVYQTASVPLYEGIPELSRERIWPSILQIRRLTTPHANRTSWARLPLPWRARLLVPLSATASKAMAADGDGDGELVRRVRSPSSRGRMAPTLAFLLVLLLLLAGGGGGGAFLAAAASTDTVVPGKGMAGNQTLVSKNGRFELGFFTPGSGIHYFLGVRLRNMAEYSPTFWIGDRVGVIDLPGVSLEVFGDKLYIKEDGVSLWWSSVAGNGSSSSSDGGAVAVLLDTGDLVVRDQGNPSGVLWRSFDYPGDSLLPGGRLGLDAATGTNVSLTFKGFSHNGSLQVDASRRNGFVLTTDGIDSRGAFPDWMVTSQDNGSSLVLNHPDAPNSTEFLQFNLGLISLMRWSDSTAGWVARWTFPSDCKSGAFFCGDFGACTAGGGGGCECVDGFTPSYPDEWRLGYFVTGCSRSLPLSCEANGQTEHDDSFAILDNLRGLPYNAQDEPVTTDEDCRAACLNKCYCVAYSNESGCKLWYHNLYNLSSADKPPYSKIYVRLGSKLKSNRGLATRWIVLLVVGSLAVTSVMLGLVLLCRYRRDLFASSKFEVEGSLIVYTYAQIRKATGNFSDKLGEGGFGSVFRGTLPGSTTVVAVKNLKGVGQAEKQFRTEVQTVGMIRHTNLVRLLGFCVNGNRRLLVYEYMSNGSLDAHIFSEKSSLLSWHVRYQIALGIARGLAYLHEECEDCIIHCDIKPENILLDYEFCPKICDFGMAKLLGREFNSALTTVRGTMGYLAPEWIYGQPITKKADVYSFGIVLFEIISGRRSTETVKFGSHRYFPTYAAVQMNEGDVLCLLDSRLEGNANVKELDITCRVACWCIQDEENDRPSMGQVVRMLEGVVDMEMPPIPASFQNLMESEDSVSQNDTLGFSVDLLGSADEHKTIRRKHQLISYGNIRAIVPTTVSCMFHIIGT

SEQ ID NO: 33256 - protein, 460 aa, Arthrobacter globiformis
MADQATAQEFDILVLGGGSGGYAAALRAVQLGLTVGLVEKGKLGGTCLHNGCIPTKALLHSAELADHARDSAKYGVNVTLDSIDINAVNAYKDGIIAGKYKGLQGLIKSKGITVIEGEGKLQGTDTVVVNGTAYKGKNIVLATGSYSRTLPGLEIGGKVITSDQALTMDYIPKSAIILGGGVIGVEFASVWKSFGVDVTIVEGLPSLVPNEDATIVKNFERAFKKRGIKFSTGVFFQGVEQNDDGVKVTLVDGKTFEADLLLVAVGRGPVTANLGYEEAGITIDRGFVITNERLHTGVGNVYAVGDIVPGVQLAHRGYQQGIFVAEEIAGLKPVVVEDINIPKVTYSEPEIATVGYTEKAAKEKFGEDQVQTQEYNLAGNGKSSILGTSGLVKLVRQKDGPVVGVHMIGARMGEQVGEAQLIVNWEAYPEDVAQLLHAHPTQNEALGEAHLALAGKPLHG

SEQ ID NO: 33257 - protein, 294 aa, Arthrobacter globiformis
MSESVNLPALGESVTEGTVTRWLKQVGDRVEVDEPLLEVSTDKVDTEIPSPVAGVIEEILVAEDETAEVGAPLVRIGDGSGGGSAPAEEAPAAAPAQEAPAQEAPAEAAPAQEAPAQDAPAAGGESHEVTLPALGESVTEGTVTRWLKAVGDSVEVDEPLLEVSTDKVDTEIPSPVAGTLQEIRVNEDETAEVGSVLAVIGSGAPAAAAPQAAPAAPQQEATKQEAPKQEAPAPAAAPAPAAAPAPAPQAAPAAQEAAPAAGSESGYVTPLVRKLANQHGVDIASLSGTGVGGR

SEQ ID NO: 33258 - protein, 267 aa, Prochlorococcus marinus str. MIT 9312
MSTSFKNVTPTGPGGTATLLIVLSFTGFLLLTQSLFVVPSGQVAVVTTLGKVSGPSRRAGLNLKLPFIQSVYPFDIKTQVQPEKFETLTKDLQVIRATATVKYSVKPQEAGRIFATIASRNSDVYQKIVQPSLLKALKSVFSQYELETIATEFAVISEKVGDTVAQELNSFDYVDVKSLDLTGLEIAEEYRAAIEQKQIAGQQLLRAKTEVEIAEQEALRYETLNKSLDDQVLFKLFLDKWDGSTQVVPGLPGSEGGTPPVIVGGRR

SEQ ID NO: 33259 - protein, 120 aa, Glycine max
MAGSSEEGQVISCHTVEEWNDQLQKGNESKKLIVVDFTASWCGPCRFIAPFLAELAKKFTSVIFLKVDVDELKSVSQDWAIEAMPTFVFVKEGTLLDKVVGAKKDELQQKIQKHVASASA

SEQ ID NO: 33260 - protein, 134 aa, Brassica napus
MNHGQQSGEAKHEDDAALTEFLASLMDYTPTIPDDLVEHYLAKSGFQCPDVRLIRLVAVATQKFVADVASDALQHCRARPAPVVKDKKQQKDKRLVLTMEDLSKALREYGVNVKHPEYFADSPSTGMDPATRDE

SEQ ID NO: 33261 - protein, 484 aa, Oryza sativa
  misc_feature (474)..(474): Xaa can be any naturally occurring amino acid
MNVLASKIFPSRSNVASEQQQSKREKATIDDAKNSSKNKNLDRSVDESVLGIILGGGAGTRLYPLTKKRAKPAVPLGANYRLIDIPVSNCLNSNISKIYVLTQFNSASLNRHLSRAYGNNIGGYKNEGFVEVLAAQQSPDNPNWFQGTADAVRQYLWLFEEHNVMEFLILAGDHLYRMDYEKFIQAHRETDSDITVAALPMDEKRATAFGLMKIDEEGRIVEFAEKPKGEQLKAMMVDTTILGLDDVRAKEMPYIASMGIYVISKNVMLQLLREQFPGANDFGSEVIPGATNIGMRVQAYLYDGYWEDIGTIEAFYNANLGITKKPVPDFSFYDRSAPIYTQPRHLPPSKVLDADVTDSVIGEGCVIKNCKIHHSVVGLRSCISEGAIIEDSLLMGADYYETEADKKLLGEKGGIPIGIGKNCHIRRAIIDKNARIGDNVKIINVDNVQEAARETDGYFIKSGIVTVIKDALLXLAEQLYEVAA

SEQ ID NO: 33262 - protein, 83 aa, Triticum aestivum
GKGLLCQLALILDYPFGDVGTLSNLVWRVCVGIIGSSCALSDAQNSTLFVKILVIEIFGSALGLFGVIVGIIMSAQATWPTKV

SEQ ID NO: 33263 - protein, 1463 aa, Staphylococcus saprophyticus
MAKKKNTYKVPSIVALTLAGTALTTHHAQAASNTQDQTPNKNVLDDEKALNQSEQIKSEISKPTTNISGTQTYQDPTQVKDASSNEDTNYDAQLDELNDQTSEQTSNQDTYNQETDVQEDQQDVSSDNDTKSLDTEQTSVEDNNQENEENNTDSIQSETNSTNEASQTSNDVSSNAEETNTDENSSDVANQNEPVAQNDKAETSNEDVASSDVKQDGTHSDDNASDDLTDQNESETLNDNAVSSNEDVASSDVKQDGTHSDDNASDDLTDQNESVAQNDKAETSNEDVASSDVKQDDTHSDANASDVADQNESETQNDNAESSNEDDVASSDVNQDDTHSDANASDDVKDQNESETQNDKAETSNEDDVASSDVKQDDTHSDANASDIADQNESVAQNDKAETSNEDVASSDKQDDTHSDANASDIADQNESATQDDKATSKEDDVVSNDKQDNAKVSNIIKEASTAENKVQPATFSAKVTPKLRVATTSANTAVATRSAVTKEATTRAALPKYSPKVNSSINNYIRKNNFKAPNYEQDIANYLPQYNYRYGKPEGIVMHDTANDNSTITGEINYMKNNYTSAFVHAYVDGDRIIETANTDYLAWGAGPQANDRFIHVELVHTHDYDSFARSINNYADYAATNLQYYGLVPDSAEYDGVGTVWTHQAVSNYLGGSDHSDPHGYLAAHNYSYDELYDLIYEKYLIKTGQAAAWGTTSSGSTGGTGGSTGSGNTGTTPPSKSGTVKVTENNGVGRINSKNDGLYTTVYDQKGKKTDRVNQTLKVTKSATLGKEQYYLVSDYNKGTLIGWVHQGDVSYNAAKAAAKINKTYKINPGEVIYTVPWGTSSQKAGSVSGKSAQTFKATKQQQIGKTNYIYGTVNNLTGWVSLSKLTAPSTTPSKPSTTAKLVVSNLTNQQGTVAKSNHGVYTSVYDKQGVQKSYVNGQTYKLSKKATLGSNAFYLITDNKTNTNLGWMQTGDITVKETAKKPAATQTQTVSKIGQLNATNSGIKTTVYDPKGKDASKFSGKTFTVTKQRTQGNNTYVLIQNTNQNTPIGWVNTKDINTRNLSKTTAKNGQYTVKATNNGLYAVPWGTKSQQLDTLKNVKNNQFNASKSVYVDKDEYIYGIVNNKTGWIAAKDLNSTTKTPSVTKSAVTPIKYDYIIHNQKGSYYIDPLTGKAAGSLKDFYEGIFTVYEKQVINGVTWYHGKLANGKVVWVKEDDLRKELVKYYKSGLTLDQAVAIQKGLKFKPQIQHTAGKWEDASATEIKNAMDSSKLIKDPTQKYQFLRLDKSQNISSADLDKLLVGKGILEGQGEAFSEAAKAYNINEVYLISHALLETGNGTSKLANGGDVVNGKVVTNGKDKYYNMFGIGAVDSDAVKQGFATAKNNGWNTVKKAIVGGAKFIAGSYINQGQNTLYKMRWNPENPGVHQYATDVAWAAHNATRIKGFYDSMGKLGKYFDVDTYK

SEQ ID NO: 33264 - protein, 519 aa, Photobacterium profundum SS9
MFEFPQVSHQSVKNDVLSGLTVALALIPEAVAFAFVAGVDPMVGLYAAFIVGFITAILGGRPGMISGATGAMAVVMVSLVAEHGVQYLFAAVMLAGIFQILAGIFKLGKFIRMVPHPVMIGFVNGLAIVIFLAQLGQFKVQGATGALEWMQGSQLYIMLGLVLLTMAIIHFLPKLTTAVPSSLVAIITVTVLVHVVGLDSRTVIDFVRTMSGDVNATLAGSLPTFALPDVGFNVETLRIILPYSLILAAIGLIESLLTLTVIDEMTDTRGKGNRECVSQGIANVTCSVFGAMGGCAMIGQSMININSGGRGRLSGITAAVGLLCFILFGSALIEIIPLAALVGVMFMVVIGTFEWASFKMARKVPKHDFFAIILVTCVTVAADLAIAVIVGVIYSALVFAWDHAKHVYAASHTDEKGTKIYEVNGPIFFGSVSHFQELFNAKTDPNDVIIDFAKSRVADHSAIEAIDTVAERYASQGKTLHIRHLSPECRSLLKKAGTLVEVNMLEDPTYKVATDTLGG

SEQ ID NO: 33265 - protein, 210 aa, Campylobacter coli RM2228
MTLEQILEKTKNIRLVAASKYVDANIIEKLFTQGITEFGENQVQALVQKKEILDKKDLNIKWHFIGTLQSNKINLLIKQKPILWHSCNGLKIAKAMDKRLNYKLDTLLEINSANELSKSGLNPDQAIEEYLQIQEECPNLNLCGVMSIGSHSEDQREIEKSFETTYKIYEKLQKHGAKICSMGMSNDFEIAIKCGSNMVRLGSILFKNLK

SEQ ID NO: 33266 - protein, 414 aa, Ostreococcus tauri
MTLASARASTSRPAGARARGRCRPARASGEDHGRVPRGPAVHARGSAKRLDAVDASRCFRLGLFADAQYANRDDETRDDGSGRVKYFRAAEGRLRDAVAAFEREASSLSGVVNLGDLYDGYNEDDKTKRPVLRGVMSAATLERNRHDLGKVASILNASNLRFHHCLGNHDLSVSRDEFLRAVNAERGAYYSERLPRRWLLIVLDTTDLNPRYIAEDTPEYQSALDFATEAYASGREDIAPWSGGIGPIQLAWFDNELKRAKERGERVIVASHNALQANAARPQMSAWNADQVSKIIEDSGCVKICLAGHDHPGMYNYRHGVHYVTLEAMLEAKPAQKTSYAFLDVFEHEAVLTGVGAASSRRMRVSPLGVFTGIATFGAATIGELATSGTSGRAETSSLGLLDWINTYGRDYEG

SEQ ID NO: 33267 - protein, 641 aa, Ostreococcus tauri
MDEVFGRASGASGDGLSMGVRAPTWAEDARAEAEQREERRFEADLAAAISASLGEKQSATDDGGRGESGMMEEERAMLEARRQSLRERFGGSAMAERFYSRYSLNFSERLADGFYSIYPNPVDGTFPKTFDLESLRAFVADDGEGEREVSIVDRSTDLLLQECDASPELARLVAERMGGPAESDETLRERWEVERRRLSKEHGGAVFPIGSIKVGLQRHRALLFKSVADFLEIPSQIVRGKYYCGHDDGVMIIVMCGGMKRMLNLMDSPGRMQQPFNSDSKTPSVYSDSGRMSPDNTADAGHFGVMPQENLPSHETKETPLRLQIAVDLTIDPSQILLGERIGIGSFGEVHRALWRGTEVAVKRFLDQDISRNLLDEVTFEIDIMRRLRHPNVVLLMGAVTVPGNLSIVTEFLHRGSLFKLLHREQPPAVAAALDNRRRMRMAMDVVRGMHYLHSFEPMIVHRDLKSPNLLVDKSFVVKVCDFGLSRMKRNTYLSSKTNAGTPEWMAPEVLRNEASDEKADVWSFGVILWELATVLEPWQGLNPMQVVGAVGFAGKQLEIPSDVDEVIANMCRDCWQTNPRERPSFEHLAESLRSVPLAPSLPSDPPSRERSRLTVPTVPPVPEEASKPNPDDWSDDRFRV

SEQ ID NO: 33268 - protein, 170 aa, Synechococcus sp. CC9605
MAMTGSKPWPDPQIDAAAWVAESAVVIGDVQMAAGSSLWPTAVARGDLEQISIGAGSNVQDGAVLHGDPGQPVRIGADVTVGHRAVIHGATIEDGCLVGIGAIVLNGVTVGAGALVAAGSVVTKDVPPGTLVMGMPAAVKRELSPEAIDQQRCHARRYAQLAASHAQIRP

SEQ ID NO: 33269 - protein, 559 aa, Gibberella zeae PH-1
MGASSRSTPALSRASILTSSSGPSHVAARRIHATTKQLQPVTAALASTASSYPTTHAKVEVVDTPYFIDNKFVASTADKYIDLHDPATNELVTRVPQMTDAEMKAAVESAEKAFKSWKNTSVISRQQIMFRFVQLIRENWDRLAASITLEQGKTFADAKGDVLRGLQVAEAAVAAPELLKGEVLEVAKDMETRTYREPLGVTAAICPFNFPAMIPLWCIPIATITGNTLILKPSERDPGAAMIIAELVEKAGFPAGVVNIIHGAHRTVDFILDEPAIKAISFVGGNKAGEYIFSRGSANGKRVQANLGAKNHAVVSPDANKNQFINSIVGAAFGAAGQRCMALSTLVMVGETKEWLHDVAEQAKNLNVNGGFEQGADLGPVITPQSKERIEKLIDSAEKEGATILLDGRGFKPSKYPNGNWVGPTIITNVTPDMTCYKEEVFGPVLVCLNAESIEDAIDLVNKNEYGNGTAIFTRSGATAEIFRKNIEAGQVGINVPIPVPLPMFSFTGNKKSIAGGGANTFYGKPGINFYTQLKTVTALWQSADAVAKKADVSMPTQQ

SEQ ID NO: 33270 - protein, 232 aa, Nicotiana tabacum
MGCLSVVGASPCVSSSALSSPTSRLSCAPSCKLILNPIKKNHHLAAFQPAVHLFASNQSRSHASKRNHTTRIFLPHLVASMEEVEETYIMIKPDGVQRGLVGEIISRFEKKGFKLTGLKLFHCPKELAEEHYKDLQSKPFFPKLIDYITSGPVVCMAWEGVGVVASARKLIGATNPLNAEPGTIRGDLAVQTGRNVVHGSDSPDNGKREIALWFGEGELCSWTPVQEPWLIE

SEQ ID NO: 33271 - protein, 413 aa, Staphylococcus aureus subsp. aureus Mu50
MAEHSFDVNEVIKDFPILDQKVNGKRLAYLDSTATSQTPMQVLNVLEDYYKRYNSNVHRGVHTLGSLATDGYENARETVRRFINAKYFEEIIFTRGTTASINLVAHSYGDANVEEGDEIVVTEMEHHANIVPWQQLAKRKNATLKFIPMTADGELNIEDIKQTINDKTKIVAIAHISNVLGTINDVKTIAEIAHQHGAIISVDGAQAAPHMKLDMQEMNADFYSFSGHKMLGPTGIGVLFGKRELLQKMEPIEFGGDMIDFVSKYDATWADLPTKFEAGTPLIAQAIGLAEAIRYLERIGFDAIHKYEQELTIYAYEQMSAIEGIEIYGPPKDRRAGVITFNLQDVHPHDVATAVDTEGVAVRAGHHCAQPLMKWLNVSSTARASFYIYNTKEDIDQLINALKQTKEFFSYEF

SEQ ID NO: 33272 - protein, 345 aa, Ostreococcus tauri
MRSTARAPSARVVARRAIGGRRGTDARRARTEASAPATSGASSTSADSEREFNAYIKGVNAKIERALDASVPVHYPERLSESMRYSLLAGGKRIRPALCLAACELVGGDMETAMPTACALEMIHTMSLIHDDLPSMDNDDFRRGKPTNHKVYGEEMAILAGDALLSHAFEYIGRETKGASAEKVLRVIVDVGKCVGSEGLVGGQVVDIMSEGAGPENVTVDTLKYIHAHKTGALLEVSVTAGAILGGASEEQIGKLERYAQNIGLAFQVVDDILDCTASSEELGKTAGKDVAVGKTTYPSLVGMEESKRIAADLISKAKAELEGFDPVKVRPLIGLADYIQNRKN

SEQ ID NO: 33273 - protein, 408 aa, Oryza sativa Japonica Group
VLDCCKGFERPSPIQAYAWPYLLDGRDFIGIAATGSGKTIAFGVPALMHVRRKMGEKSAKKGVPRVLVLSPTRELAQQIADVLCEAGAPCGISSVCLYGGTSKGPQISALKSGVDIVIGTPGRMKDLIEMGICRLNDVSFVVLDEADRMLDMGFEPEVRAILSQTASVRQTVMFSATWPPAVHQLAQEFMDPNPIKVVIGSEDLAANHDVMQIVEVLDDRSRDSRLVALLDKYHKAQRNRVLVFVLYKREATRVETMLQRRGWSAVSVHGDKAQHDRTKALSLFKEGSCPLMIATDVASRGLDIPDVEVVINYSYPLTTEDYVHRIGRTGRAGKKGVAHTFFTQENKGLAGELVNVLREAGQVVPPALTKFGTHVKKKESQIYGSHFKEIKADAPKSTKITFGDSDED

SEQ ID NO: 33274 - protein, 392 aa, Kineococcus radiotolerans SRS30216
MRLAQRARTVQPFHALAFGQQAADLEARGEHVVRLSIGEPDFGAPPAVREAMREVMDGRPLPYTPSTGAPALRRAIAGFYRDRHGVEVDPERIVVTSGASSALLLVLAATVDPGSEVVVADPSYPCNRQLVETFGGVVAAVATTAASRYQLDPASVERAWSERTAAVMVATPSNPTGTSVPPGQLAEICALARARGAWRIVDEIYLDLADPSPGGAAPRTVLAVDPDAVVVNSFSKYFGMTGWRLGWAVLPAELVPAVEKLAMNYFLCASAPAQQAALACFTPESLALCEERRVELAARRRAVLDGLAGLGLPVPVEPDGAFYVYFDVSGTGLGSWEFCERALREAHVALTPGRDFGVDTAETHVRLSYAASRAEIAEGLRRLGAFLAGLRP

SEQ ID NO: 33275 - protein, 799 aa, Physcomitrella patens subsp. patens
MTRKMAACSSYGLSWRLYWACSCVVLVAALTCYVNVVDALPRVQSDGLLKIQELLRTPTAKAIWNIDTDFCKLPPTSHLYINCTGDTLTYLRIVGDKNMKSLPSNFSVNTLVDTLLTFPDLRGLELVSLGMWGSLPEKLSQLSSLQTLNVSSNLFTGTIPKSLHKITGLGTLALDNNALAGIFPYWLSAISLSVSNNLLYGNIPGSLSSLQSLQFLSLAHNRFTGNSPNLENLRSLKTLNLGGNSLGPGFPALGTHLTSVYLGQNKLSESLPDSLKDFGELHTLDISGNALADTPPAFLFNLPRISTLNLARNHFSGVLPLNLTLSKSLSVLDVSNNFLTGQLPLVFLSARNVALYYQNNCMDTLKQKQGSKEYCTITAAKLGIGSSEVHHSHLVLIIAVAAAGGLCLTVGLCGVVLLMARRCSIDKDSVAAPEDRNFGSFRGIPSELLSNARYLSQSMRLGVLPQSQNRVFALEELKVATNNFSPGALVGEGRHGKVYKGLLEDKTVVAIKWLNFKSKEDMAEYKTQLEVLNKLRHRHLVSVLGYCSEEVTSSVDDEEFKSFRLFIVSDFMGNGDLRSHLSKQMGKEPMVWSQRLAAVIAAGRGIHYLHTGVVPPIFYNNLKITSILLDSYMVAQLSDFGLPVRRVSFSMDVVAPEGKAGVPKLNHEESLRRQEHRDKQDVYDYGAILLEIVLGRPPTIRNPFPQKRSELERLTKEKGPSMELIDKDIVGTCGAESLATVLEIAGKCMVDDPTRRPSMEDVLWNLQYALQKEKHIYMFFKHVTTFQQRDIFYTTRLWS

SEQ ID NO: 33276 - protein, 522 aa, Vibrio cholerae O1 biovar eltor str. N16961
MARIAFTAPHHKASETGLDILRQSGTACEAMVAAAAMIAVQYPHMNSIGGDGFWLIAAKDKPPVAIDACGSSAQSIALTDYDPAQGLPQQGGAAALTMAGTISGWQTALQLFSSGISLSTLLSPAIQAAEQGILTTPSLAAASHKTWNRLAKLEPFAQIYLNPFRDTLKVGDIVTQKALAKTLTHLSQFGLDAFYQGELAQQMAKELEEAGSPLRLADFIQHKASIVTPLTHNMSQGQFYNLGAPTQGLASLLILGIYDRLAHQARSQADHVHLLIEATKIAFDIRNRAVTDEKYIPTALQNYLIAERVDKLAEKVNLSQAAAWPQKTQLGDTVWMGAVDRYGTMVSFIQSIYWEFGSGVVLPSSGVLWNIRSQSFSLDPEHINCLASRKKPFHTLNPAYAELKDGRRMVYGTMGGDGQPQTQACLISRYLYQGDSLEQSIAKPRWLLGRTWGDSTTKLQMESSLMGQLGTELSARGHQINSVPDGIELMGHAGAIVVGTDSSLEVASDPRSDGAALQLWLE

SEQ ID NO: 33277 - protein, 815 aa, Euglena gracilis
MAHYRTIPSEAGRPIETNKVLVVLSVTCGAALAALLANENLSQNQWAVTQAPTRPLHLDFSSTSRQMEPREYVQMLPPQQQSTRQTQNTRAPRREASWALATTALGSVAVFLGLYMRNRSPTLDLVEVKLQDPIALFATTGKVELGSTLEDFMKAYVPDPKLRIIMATMAESGRTIDHKVTTASCGGTACTNVFGDEQLAVDMLADKVLFEGLRHCGVCEIACSEENPVPLPMGGQGYSVCFDPLDGSSIVDTNFSVGTIFGVWPGDKIVGTTGRDLAASGIIVYGPRTVLCVAFKGVPGTFDFMLQDDGKWHLVKETTKIGEGKLFSPGNLRCTYDNPEYLNLISFYNNEQYTLRYTGGMVPDVYQLLIKGRGVFTNVTSPTTKAKLRLSFEVAPIALLIESAGGASSCDGKSVSALDVTITGIDQRTQVCFGSRTEVARFEQFMFGQVSPRLAATLSADELAKATAAPKSSKLITDAADPAPAFVPPVWKAQAVPEISAKIGESLEEVLAKAVPDLKLRRVMTTMANSCRIISHKVKTAATTGTAATNVFGDEQLAVDMVADKVLFEGLSHCEACEIACSEENPVPLEMGGSGYSVCFDPLDGSSIVDTNFAVGTIFGVWPGNKIIGSTGRDLAASGICVYGPRTVLCVAFKDYPGTHDFLLGDDGKWTYVKAYTHIGEGKLFAPGNLRCTLDNPEYERLISYYTRQQYTLRYTGGMVPDVYQILVKEKGVFTNVISPSTKAKLRLSFEAAPIALLVEKAGGASSCDGKCVSALDVQINGIDQRTQVCFGSRTEVARFEHYLYGKVSDRLLAA

SEQ ID NO: 33278 - protein, 374 aa, Xylella fastidiosa Ann-1
MTKPVNTTADKVALSDTALANIRTKIDKIDRDIQTLIAERACYAQQVGQAKSKLAAAMDYYRPEREAQVLRMVVERNEGPLSDEVLVRLFREIMSACLAQQEPLKIGYLGPEGTFSQQAVLKHFGHYVLGEPMASIEEVFQEVEAGHTDFGVVPVENSGHGTIQVTLDLFLNSKLKICGEIELRVHQYLMSRSGRLEDIHRIYAHPQSFAQTACWLRANLPHVEKIPVSSNAEGARRASNANDAASIGSESAARVYALSKVFIHSIEDEQDNTTRFLVIGRRIFAPSGCDRTSILVFIRDNPGALFEVLGSFARHGINMNRIESRPSHQVRWEYVFFIDLLGHVEDEPMKQALAELEQHAVKVKILGAYPIALL

SEQ ID NO: 33279 - protein, 470 aa, Pseudomonas fluorescens Pf-5
MPSANALSSSPPASAHNASLDGGFTHSAQGTSLRRILGLPALVFFGLVYMVPLTVFTTYGVVTQLTGGRTAAAYVITLLAMIFTALSYSVMVKKYPIAGSAYSYASLSFGPGIGFLAGWSLLLDYLFLPMINYLVIGLFLNLAFPAVPAWVFVVATISLVTLLNIRGIGSVSSMSNLIVCAQMVFVVVFMALVVRQLAGAESLDLSAPWVGDGSQDGLLPLMAGAAVLCLSFLGFDAVSTLAEETRDPRRDIPRAIVITTLGAGLLFILLAMTSQLAFPGSSFKDADSAASEVMLHAGGRFLEMFFTATYVAGAAGSALASQASVSRILFSMGRDGILPRRVFGTLSERYKTPVVAIVLVSLVSLLAVVIDLTTLASMISFGALVAFSVVNLAVIKSHLGQGQPRSTARLLQYGLLPLIGFALIAWLWTSLSALTLGIGLAWFALGLLYLGIHTRGFRQPAPTVQFSEQA

SEQ ID NO: 33280 - protein, 373 aa, Bacillus cereus ATCC 14579
MAKGECISMKRQLILEDGTVLIGTGFGGEIEKSGEVVFTTGMTGYQETLSDPSYCGQIVTFTYPLIGNYGINRDDFESIHPSVNGLIVNEICNHPSNFRNEISLNDYLKERNIPGLAGIDTRKLTRKIRQYGTLRGRLCNMDADVEYIVSQLKATVFTDHVKRVSTKDPYPSPGRGHRVVLVDFGMKHGILRELNKRDCDVIVVPYNTTAEEILRLSPDGIMLSNGPGDPKDVPEAIEMLKDIIGKVPLFGICLGHQLFALASGANTSKLKFGHRGLNHPVKNLATGKVAITSQNHGYAVEEESVENTDLEITHVALNDGTVEGLRHKKFPAFTVQYHPEASAGPEDANDLFEDFLTMIENFKKEGEELCQNA

SEQ ID NO: 33281 - protein, 252 aa, Propionibacterium acnes KPA171202
MLTTRATLDKHHADVASMFDGVAKRYDLMNQIMTLGAVDTWRDLVVDAVEPEPGQTILDLAAGTGTSSATFAARGAQVYPTDISTGMLAVGKQRQPHLHFVAGDATCLPYADNSFDAVTISYGLRNVEDPHQALREMLRVAKPGGRVVICEFSYPTWAPFRHVYTKYLLAAIPAMARLASSNRQAYDYLAESILTWPDQPHLADMMTETGWQAVAWRNICGGVVALHRGWKGSVSPRSGDHHGDPGEGDGLR

SEQ ID NO: 33282 - protein, 301 aa, Triticum aestivum
  misc_feature (79)..(79): Xaa can be any naturally occurring amino acid
  misc_feature (93)..(93): Xaa can be any naturally occurring amino acid
MSSPTHVRKALHLAAMKAKLQGVAGHRLLLVTALAAFLLLFSARTLFSSSSSSRGPGAASRLSGDGSCSKLPAPVGRGXWVHYATSNVTPQQXTAAEIGVSLRVLQRRSPCNFLVFGLGNDSPMWAALNHGGRTVFLEEDASWIASVRSAHPGLESYHVTYDTRLTEADELIALRDHQGCTAQPDLAAAAEASCRLALRGLPAVFHEVEWDLIMVDAPTGWTPEAPGRMGAIYTAGMAARARRPCDGATDVFVHDVDRTVEDRFSKAFLCDAYLTEQVGRIRHFVIPSHREKPGTPFCPQN

SEQ ID NO: 33283 - protein, 455 aa, Prochlorococcus marinus str. MIT 9312
MYPLLAELSAHDLEVAETLIGVIRFLLIFLAARALAEVLVRLSLPTIVGELLAGVVIGASGFHLLIPPSAGTELNGGLVNVISSLASIPPEAVPDVYFESFPSLQAVATLGLYALLFLTGLESELEELVAVGAQAFTVAMAGVILPFAFGTLGLMFIFQVDLIPAVFAGASMTATSIGITASVFGELGYLKTREGQIVIGAAVLDDILGIVILAVVVALAAGGSLEIAPIVKLVAAAVVFVIAAIALSRTAAPGFDWLLDRLKAPGAVVVASFVILVLCCFVATAIGLEAALGAFAAGLILSSSKNNHAIQQSVLPLVSLFATIFFVLVGAGMDLSVINPLDPTSRSALVVAGFLLVVAIIGKIAAGWVFSSDKPTNRLVVGLGMMPRGEVGLIFLGLGTSAKLLTPSLEAAILLMVIGTTFLAPVLLRIVLKDKPPSDGNKISDDVAADPVGLR

SEQ ID NO: 33284 - protein, 382 aa, Rhodococcus opacus
MHCKTNSDYSMKEQQVQITAAVVRETTKDFSVENVTLSEPAAHEVVVQISGVGICHTDLAVQAGHLPFPLPGVLGHEGSGTVVSVGTDVTKVKIGDKVGLTFNSCGKCAQCSKNEPAYCHEFMPLNLGGVRPDGSSTLSVGDTTLGSNFFGQSSFASHAIANERNIVKVPDDAPLELIGPLGCGIQTGAGAILNSLDCEPGSTLLILGGGSVGLAAVMAAAARGVATIIVVEPHESRRQLALDLGATHGVDPSEGVLSELVRAIVPQGVDYALDTTAIVPVLEQAILSLGHRGTLGTVGVPSDPEAAVSLNLIQSTVTGMTVTGIVEGDSNPDVFIPELLDLHRAGKFPFDKIITVRPFTEINEAVAAQHNGDVVKVVLVHN

SEQ ID NO: 33285 - protein, 244 aa, Photobacterium profundum SS9
MSLEGKVALVTGASRGIGRAIAEILVERGATVIGTATSESGAEAISAYLGDKGKGLALNVTSPDSIADTLKQIKDQFGDIDILVNNAGITRDNLLMRMKDDEWQDIMDTNLTSVFRLSKAVLRAMMKKRNGRIISIGSVVGMMGNAGQTNYAAAKAGLIGFTKSLAREVASRGITVNAVAPGFIETDMTKALNDEQRAATLANVPAGRLGDPREIAAAVAFLASEDAAYVTGETLHVNGGMYMI

SEQ ID NO: 33286 - protein, 78 aa, Photobacterium profundum SS9
MSNIEDRVRKIIIEQLGVDEAEVKNEASFVDDLGADSLDTVELVMALEEEFDTEIPDEAAEKITTVQAAIDYVNSASE

SEQ ID NO: 33287 - protein, 482 aa, Oryza sativa Indica Group
MAKSTPAAAAAAPEEATAAALRLRLRRLVAAVTAGGVGGEEAFDEAASALAALRDAELGPPPKDRPGAGRRGGGVGTRRRRPCRSSSSALSRRRSCGTPSCSRPARYNLRFFPVGDLGRGATYDRRFIQEWLSAGNRTCPQTQQVLSNTILIPNHLVRSMIAQWCTENGIALSPLENQEEDLVTNNERKSFSELFDRISSSSNISEKRQAIKDLRLLTKRNSSFRAVIGENPDSISQMISAVSNPELESNSEVLEDTVTTILNLSIHESNKKIIGDDTKAITFLISALQSGTMEARSNAAAAIFSLSALDSNKAKIGESGAMRPLVDLLEHGSMTAKKDAASAIFSLCKLHENKSRATKSGVIDVVLKAISDESLTDESLTILALLSSDHETVEEIGETGGVPCMLHIIKDDQCKRNKENAVAVLFSICMYDRTKLREVVEDENLNGSLAWLAQNGTSRARRKAAGILDKLKRTIHKTHYSC

SEQ ID NO: 33288 - protein, 356 aa, Physcomitrella patens subsp. patens
MASTRAHSIAWPDWIAGLLFVGWDTLVQRFHARHVPRRLPLPSLSHLTVMITGATSGIGLDTARALALSGAHVVFAVRNTNAANDLISQWQISQPHGQPPLQCEVMELDCLSLQSVRTLGETWEARKLPLNLLINNAGIFCMTGPQKFSKDGCEQHMQVNHLAPALLTVLLLPSLARGAPSRVVMVNSIMHYVGFISPRDLSMKAEGRKYNNTCAYSNSKLAQVMFSNLLQRRLPKEAGIDVVCVHPGEVKSKVARDLPKLIQIAYHKLFFLFNSEEGARSVLFCATDKLVQDHARHLRSLGYPLAPYFGPDLKIWSVAKQALDVEKAHLVWEETLKLVDLPADCIDTALSGSFLT

SEQ ID NO: 33289 - protein, 2214 aa, Saccharomyces cerevisiae
MATIAPTAPITPPMESTGDRLVTLELKDGTVLQGYSFGAEKSVAGELVFQTGMVGYPESVTDPSYEGQILVITYPLVGNYGVPDMHLRDELVEELPRYFESNRIHIAGLVISHYTDEYSHYLAKSSLGKWLQNEGIPAVYGVDTRSLTKHLRDAGSMLGRLSLEKSGSDRTISRSSSWRSAFDVPEWVDPNVQNLVSKVSINEPKLYVPPADNKHIELQTGPDGKVLRILAIDVGMKYNQIRCFIKRGVELKVVPWNYDFTKEDYDGLFISNGPGDPSVLDDLSQRLSNVLEAKKTPVFGICLGHQLIARAAGASTLKLKFGNRGHNIPCTSTISGRCYITSQNHGFAVDVDTLTSGWKPLFVNANDDSNEGIYHSELPYFSVQFHPESTPGPRDTEFLFDVFIQAVKEFKYTQVLKPIAFPGGLLEDNVKAHPRIEAKKVLVLGSGGLSIGQAGEFDYSGSQAIKALKEEGIYTILINPNIATIQTSKGLADKVYFVPVTAEFVRKVILHERPDAIYVTFGGQTALSVGIAMKDEFEALGVKVLGTPIDTIITTEDRELFSNAIDEINEKCAKSQAANSVDEALAAVKEIGFPVIVRAAYALGGLGSGFANNEKELVDLCNVAFSSSPQVLVEKSMKGWKEVEYEVVRDAFDNCITVCNMENFDPLGIHTGDSIVVAPSQTLSDEDYNMLRTTAVNVIRHLGVVGECNIQYALNPVSKDYCIIEVNARLSRSSALASKATGYPLAYTAAKLGLNIPLNEVKNSVTKSTCACFEPSLDYCVVKMPRWDLKKFTRVSTELSSSMKSVGEVMSIGRTFEEAIQKAIRSTEYANLGFNETDLDIDIDYELNNPTDMRVFAIANAFAKKGYSVDKVWEMTRIDKWFLNKLHDLVQFAEKISSFGTKEELPSLVLRQAKQLGFDDRQIARFLDSNEVAIRRLRKEYGITPFVKQIDTVAAEFPAYTNYLYMTYNADSHDLSFDDHGVMVLGSGVYRIGSSVEFDWCAVTAVRTLRANNIKTIMVNYNPETVSTDYDEADRLYFETINLERVLDIYEIENSSGVVVSMGGQTSNNIAMTLHRENVKILGTSPDMIDSAENRYKFSRMLDQIGVDQPAWKELTSMDEAESFAEKVGYPVLVRPSYVLSGAAMNTVYSKNDLESYLNQAVEVSRDYPVVITKYIENAKEIEMDAVARNGELVMHVVSEHVENAGVHSGDATLIVPPQDLAPETVDRIVVATAKIGKALKITGPYNIQFIAKDNEIKVIECNVRASRSFPFISKVVGVNLIELATKAIMGLPLTPYPVEKLPDDYVAVKVPQFSFPRLAGADPVLGVEMASTGEVATFGHSKYEAYLKSLLATGFKLPKKNILLSIGSYKEKQELLSSVQKLYNMGYKLFATSGTADFLSEHGIAVQYLEVLNKDDDDQKSEYSLTQHLANNEIDLYINLPSANRFRRPASYVSKGYKTRRLAVDYSVPLVTNVKCAKLLIEAISRNITLDVSERDAQTSHRTITLPGLINIATYVPNASHVIKGPAELKETTRLFLESGFTYCQLMPRSISGPVITDVASLKAANSVSQDSSYTDFSFTIAGTAHNAHSVTQSASKVTALFLPLRELKNKITAVAELLNQWPTEKQVIAEAKTADLASVLLLTSLQNRSIHITGVSNKEDLALIMTVKAKDPRVTCDVNIYSLFIAQDDYPEAVFLPTKEDQEFFWNNLDSIDAFSVGALPVALANVTGNKVDVGMGIKDSLPLLLAAVEEGKLTIDDIVLRLHDNPAKIFNIPTQDSVVEIDLDYSFRRNKRWSPFNKDMNGGIERVVYNGETLVLSGELVSPGAKGKCIVNPSPASITASAELQSTSAKRRFSITEEAIADNLDAAEDAIPEQPLEQKLMSSRPPRELVAPGAIQNLIRSNNPFRGRHILSIKQFKRSDFHVLFAVAQELRARVAREGVLDLMKGHVITTIFFEPSTRTCSSFIAAMERLGGRIVNVNPLVSSVKKGETLQDTIRTLACYSDAIVMRHSEEMSVHIAAKYSPVPIINGGNGSREHPTQAFLDLFTIREEIGTVNGITVTFMGDLKHGRTVHSLCRLLMHYQVRINLVSPPELRLPEGLREELRKAGLLGVESIELTPHIISKTDVLYCTRVQEERFNSPEEYARLKDTYIVDNKILAHAKENMAIMHPLPRVNEIKEEVDYDHRAAYFRQMKYGLFVRMALLAMVMGVDM

SEQ ID NO: 33290 - protein, 445 aa, Thiomicrospira crunogena XCL-2
MEHSENRTPKYQENSLTLIGAVALGTGVMIGAGIFALTGQMATMTGVLFPLAFLSAALIVSFSAYSYVKMSNAYPSAGGIGMYLYKAYGNSLSTAFNALLMYFSMVIAQSFLARTFGEYTLQLFDTDNNEIWVPVLGVGLLLVAFLINLSTNRLIGGVASFIGFLKIGGIIIFGLVGIWAADNIAMDFTQTTPDSSTLSGFLGATALGILAFKGFTTITNSGSELKDPHHNVGRAITISIIFCVVIYTLVGFAVASNLSLSDIIATQNYSLAAAAKPALGNYGLWFTVVLAMLATAGGIIASIFAVSRMLAMLTEMKLVPHSHFGMSGNIQKHTLLYTVVLGLFLTAFFDLSRIAALGIIFYLIMDIAVQWGILRYLRKEIHANLLILFTAIMLDLLVLGGFLWVKIMSDPMVVGVAIISMAIIAIVEFVFLRNQRLTNSSSLTK

SEQ ID NO: 33291 - protein, 79 aa, Triticum aestivum
MVINGDAPARGSAAAAASLRRRRTTSGAAAGGGGGASTMLQFYTDEAAGRKMSPNAVLIMSIGFVAVVAVLHVFGKLYR

SEQ ID NO: 33292 - protein, 195 aa, Prochlorococcus marinus str. MIT 9312
MANLNQPPSRVTPNLLHILNAFTDNSNSIVNTIVELNSNTINKYELITETGHLKLDRVGYSSLAYPFAYGCIPRTWDEDGDPLDVEIVGVTEPLIPGSIVEARIIGVMKFDDGGEVDDKVIAVLADDKRMDHISSFEDLGEHWIKETKYYWEHYKDLKKPGTCTVNGFFGIKEAVKVIKDCEDRYKKEIDPKLIN

SEQ ID NO: 33293 - protein, 298 aa, Physcomitrella patens subsp. patens
MSSSSGLTFKLHPLVIVNISDHHTRSKAQTGRAGRPPRVYGCVLGVQTGRTVEIFNSFELRYDPVEELLDRAFLETKQEQYKKVFPKYDVLGWYSTGSDVQDSDMLIHKALMDINESPVYVLLNPTINHAQKDLPISIFESELHVIDEVPSLIFVNASYTIETVEAERISVDHVAHIKPSDGSSAATQLAAHLTGMHSAIKMLNSRIRVLYHHLASIQKGDAEYEHSLLRQISSLVRRLPAIDSPKFQDDFLMEYNDTLLMTYLATITKCSSTMNELVDKFNTAYDKQNRRGGRTTFI

SEQ ID NO: 33294 - protein, 348 aa, Triticum aestivum
MPDGDSVPNYLYAVVGRGDRKSQEKDMAEEPGATSRYYCHMCSVIVRPELGVEEVKCPHCRSGFVEEMADGRRSSNAVGDRGPATGAGPDDAGARSELAVPQWPPILMDLLGVSYGLDGGDLATLARRQYRHLAFLQLLNALQEGDADADGDAPDPGLERLVLVSPADAHAMLVPEGGASNSAGAGRGAGLTLGELILGPGLDLLLEYLAETDPSRQGTLPAKMEAVAALPTVKVSEAATCPVCLDDFAAGGEAKEMPCKHRFHDVCLLPWLEANSSCPVCRYQLPTDEATEPAGNGAEETADESSGNARRDVEGDSDGGSSGRRRWLARPFARLFSRRSNGSSSSSR

SEQ ID NO: 33295 - protein, 283 aa, Prochlorococcus marinus str. MIT 9312
MNDSQRVSILSEALPYIQSFSGRKIVIKYGGSVMENDNLKKAFFRDIALLSSVGVCPIVIHGGGPEINNWLKKLEISPKFENGLRITDQKTMDIVEMVLMGRVNKQIVKGVNKTGSLAVGISGLDGNLIQSRELGDGSHGLVGEVTKINPEILDPLISKGYIPIISSIGSTMEGISHNINADFVAGEIAAAINAEKLILLTDTQGILKEKDNKNSLVEKMNLKEARNFIDKKIVTEGMIPKTECCIRALAQGVKAAHIIDGRIEHSLLLEIFTNSGIGTMIVA

SEQ ID NO: 33296 - protein, 153 aa, Zea mays
  misc_feature (38)..(38): Xaa can be any naturally occurring amino acid
  misc_feature (101)..(101): Xaa can be any naturally occurring amino acid
MPLMDNLEVQTYEIFEKDVVKYTQVLMVVGAGRGPLVXASLQAAEETGRKLKVYDVEKNPNAVITLHSLIKLEGWESLVTVISTSDMRCWDAPEKADVLVXELLGSFGDNELSPECLDGAKRFLKPDGISIPSSPLPLSLSIAATSWGWIVPK

SEQ ID NO: 33297 - protein, 710 aa, Burkholderia sp. 383
MNSPASPTSPASTVTRERRDKVLVVTIDHPPVNALSADVRRGLADALDVAQADDAIRAVLIVGAGRNFIAGADIREFGKPIVPPSLPDVCERIESGTKPVVVALHGATLGGGLEVALAAHYRLAVPGAKLGLPEVTLGLLPGAGGTQRAPRLIGAKAALDLMLTGRHVSADEALALGLVDRVAHSDDTLAEGLAYAQELVSLGAPVRRTRDAQGLVDRAAAQAAIDAARAELPKKSRGLFSPAKIVDAVEAALTQSFDAGMAFERSLFLQCIDSPQRAGLVHAFFAEREAAKAPESRRASARPVERIGVVGGGTMGAGIAVSALDAGLPVTMIERDEASLARGRAHVEKVYDGLVAKGRMTPAAHAARLARFKGGTSYDALAQADVVIEAVFEDMAVKKAVFAELARVCKPGAVLATNTSYLDIDELAASIDRPADVIGLHFFSPANVMKLLEIVVPARVSADVVATAFALAKQLKKTPVRAGVCDGFIGNRILAVYRTAADYLMEDGASPYQIDRAVREFGFPMGPFQVVDLAGGDIGWATRKRRAATRDPRARYVEISDRLCERGWFGQKTARGYYLYPDGARVGTPDPEVETIVAEERAKKGVTPRTFTDDEIMRRYLAAMINEGANVVHEKIALRPLDVDAVFLYGYGFPRYRGGPMHYADTVGLANVLADIRTFAKEDPLFWKPSPLLVDLVARGADFASLNRID

SEQ ID NO: 33298 - protein, 81 aa, Brassica napus
VDPRVRKIGTLQTKPNEMPYEKEELLNAAVCRVDALEAELIATKKALYEALMRQEELLAYIDRQEEAQFQKMKKKKHLFCF

SEQ ID NO: 33299 - protein, 625 aa, Burkholderia sp. 383
MFDRIRPHSRSWTLLAAVALVAFNAGCTSPSTPPSGAVVPVAAASGAAVPLPGFHAPELSSGWTDKPGWTSQHFMIAAANPLATQAGYDMLKAGGTAIDAAIATQMVLALVEPQSSGIGGGAFMLYFDGKATQAYDGRETAPAAATDRLFYGPTGQPMSFYEGVVGGRSVGTPGVLRMLDAAHRAHGKLPWRRLFQPAIRLAEHGFTISPRLAMLIANDKYLKNDPAARAYFYNPDGTPKAAGTVLKNPALATVLRQVADRGANAFYSGAIARDIVTKVRKHPTNPGLLSLQDLARYKAKVRTPLCADYRRSVVCGMPPPSSGGLAIAQMLGILEAMPDWQQIGAQKPVRNDVGFEPTPFAAHLFSEAGRLAYADRARYVADPDFVPLPGGSWASLTDKTYLAQRAHLIGDSSMGVAQAGTPQGATLAMADDRSPELPSTSDIAIVDRYGQALSMTTSIEDAFGSRLMVRGFMLNNQLTDFSFVSNDNGRPVANRVQAGKRPRSAMSPELVFDKKTKQVTMVVGSAGGPAIINHVAKTLVGVLDWGMTMQQAIALPNFGSMNGPTQLERGRVSDALADGLKGRGHDVQVVEMNSGLQGIQRLNVQGQTVWFGGADPRREGMAMGD

SEQ ID NO: 33300 - protein, 496 aa, Oryza sativa
MADEATTTPLLASYKAKPAKAPSIDDAIETYIGATGAGQLFKAILLAFAWAFDAQQVFISVFTDAEPRWHCTAGADPSCSPGAASPCALPPGAWAWDRPAETSVVSEWALKCAGPALVSLPASSFFAGCLAGGFLLTTLADSLLGRRKMLLVSLASMSVAGVLTAFSPNVWAYAALRFVCGFGRSMVGTCALVLSTELVGKRWRDTVSVAGFVCFTVGFLSLPALAYTFREASWRSMYLWTSLPSLGYAILLYFLVQESPRWLLVRGRKHDAIETVRQIAALNGGGGITCSFSMLHALAAIMTASFGVGMVYYGMPLNVGNLGSNLYLSVTYNALAEFPSSVLSWLLMGRINRRSSVVALTAAAGVCSLACVAIPEGTGGRMAAEVLSFFATCTAFNIILMYSIELFPTSVRNSAVGMVRQALVLGGVAAPMLVALGRERSFWSFGVFGLAVGCLGLFAVCLPETRGRSMSDTMEEEEHKEAAAAIGDMDSNADLV

SEQ ID NO: 33301 - protein, 884 aa, Methanococcoides burtonii DSM 6242
MADNKFVYIFGNNETEGKNSMKDLLGGKGANLAEMSNLGIPVPVGFTITTEVCTLYLKNGQYPPGFEEHIDNAIKQLESTTKKNFGDLKNPLLLSVRSGARVSMPGMMDTVLNLGLNDDSVVGLAAKTGNERFAYDSYRRFLTMFANVVLDIDHEKFESTLSAMKKDKNVKQDNDLEVEDLKELVEKFKTIIKDEAGKEFPQNAREQLQMAIDAVFGSWNNQRAKTYRKLNGIPGEWGTAVNVQSMVYGNMGETSGTGVAFTRDPATGEKRFFGEYLINAQGEDVVAGIRTPQPIKALKNTMPKVYDQLVDIYMKLEDHFKDMQDIEFTIEKGKLFMLQTRTGKRTAAAAIKIATEMVEEGLIDKHTALLRVEPEQIDRLLHPNIDPTSAYEVMATGLPASPGAAVGEVVFTAEHAEEMAKNGEKTILVRAETSPEDIGGMNASEGILTVRGGMTSHAAVVARGMGKPCVAGCGEITIDIKEKVFNVGDYTVKEGDIISIDGSTGNVILGKVDLILPGVTDELETILTWADEVRTLKVRTNADTPHDAEVARDFGAEGIGLCRTEHMFFGEDRIPAVREMIMAEDIESRKLALKKLLPMQREDFIGIFKAMEGFPVTIRLLDPPLHEFLPNHEEVMEKLWELESSDASQEEMDRVKKIGERIEYLKEINPMLGHRGCRLGITYPEIYEMQAQAIIEAACELSKDGMKIVPEIMIPLVSHVKELEFVKKHITSIFESVMEEMGIKLDYMVGTMIELPRAVLTADQIAKEAEFFSFGTNDLTQTTFGFSRDDAGKFLPFYLESGILEDDPFAVLDQDGVGQLVKIGIEKGRATRPDIKIGICGEHGGEPKSVKFGHNVGLDYVSCSPFRVPIARLAAAHAVLENKQ

SEQ ID NO: 33302 - protein, 376 aa, Glycine max
MPNTSQVISCKAAICWGAGKPVTVEEIQVDPPKATEVRVKMLCASLCHTDISSIQGFPYINFPLALGHEGVGVVESVGDQVRNLKEGDVVIPTYIGECQECENCVSGKTNLCLTYPIRLTGLLPDNTSRMSIRGQRLHHVLSCATWSEYMVSDANYTLKVDPTIDPAHASFISCGFSTGYGAAWKEAKVESGSSVAVFGLGAVGLEAISGAKMLGATKIIGIDKNEMKREKGEAFGMTDFIKAGDSAKSVSELVKEMSGGMGVDYSFECSGVAPLLTESVEATKVGTGKTIAIGTGTEPIIPFGLTSIMYGRTLKGSVFGGLKAISDLSIVANKCQKEEFPLQELFTHEVPLTDINKAFELLKKPNCVKVVIKMSH

SEQ ID NO: 33303 - protein, 442 aa, Rhodobacter sphaeroides
MNALIEGLGHHLAQLPHRQAPQVTGRVVRYDGLLLECAGFPASPGALCRVATEDGREVQGEVIGFAQGRNLLFLDQMRAPVIAGARVRLVPGGQMAAVGSALLGRVIDAEGAPLDGLPAPDCTGEWPLAGRVMNPLARTAVSRPLDVGVRAINAALTVGQGQRIGIVAGSGEGKSVLIEMMTRYTAADVIVVGLIGERAREVGAFAASVMQGEAARKLCMVAVPADRSPLLRLRAARRATAIAEHFRSEGKQVLLIMDSLTRVAHAQREVGLALGEQPTAKGYPPSVVSMIPGLIERTGPGLPGEGAITAIYTVLADGDDTTNDPVVDTARAILDGHFVLSRRQTQMGLYPAIDIPHSVSRTMNDVVDDRHRRAAARLRQLIALYSDNRDLMLMGGYAAGQDADLDQAVQLWPRIRALIGQGPHEPADFEASRAALLELTGL

SEQ ID NO: 33304 - protein, 79 aa, Prochlorococcus marinus str. MIT 9312
MSQEILEKVCSIVSEQLSVEAAEVKSDSNFQNDLGADSLDTVELVMALEEAFDIEIPDEAAEGIATVGDAVKFIEEKKG

SEQ ID NO: 33305 - protein, 355 aa, Stylosanthes hamata
  misc_feature (7)..(7): Xaa can be any naturally occurring amino acid
MGGGTSXTNSLFFSSLLLLSLSLLQLHSQNGVVYAQEKIASSEEEALGIFQERETLEIIIGGGGSPSPAPAPSPPEYTPCPPPPKPPSRLDKARKVLLNFTNYIVDPNGYTNNWCTQTFNTCDFRGIRCATYPNSNELAVAGLDLNQAGIYGRNNKPLSLSGILDRIPELTFFHVNSNNFSSSVPEEIVKYGFFYELDLSNNKLCGQFPMETLQNKQLVFLDLRFNQLTGPIPSQLFEIPLDVIFINNNRFNQYLPENFGNTLARYLTFANNQLCGPIPRSIGKAANTLTEVLFLGNNFDGCLPYEIGSLKKAVVFDVSKNHLTGPIPYSFGCLRQIQFLNLANNKFYGPVPENI

SEQ ID NO: 33306 - protein, 224 aa, Bacillus cereus ATCC 14579
MTVQENLVIVNEAIKESCARAGRSLQDIKLVAVTKTVGIEKTNEVIEAGIIDLGENRNEGFLQKYEHFGSKVNWHFIGSLQTRKVKEIINEIDYLHSLDRLSLAKEIQKRADKKVKCFIQVKTSSEESKQGLAIEEVVSFIQSLQEFDKIEVVGLMTMAPFTEEEEEIRRCFKELRMLQTEVQELELLHAPCKELSMGMSNDYTIAIEEGATYIRLGTILVGKA

SEQ ID NO: 33307 - protein, 406 aa, Polaromonas sp. JS666
MLTLDFHPTGRHFLQIPGPSPVPDRILRAMSLPTIDHRGPEFAALGLKVLADIRKIFQTRQPVIIYPASGTGAWEAALANTLSPGDHVLMYETGHFAALWHKLAARLGLKTEVMSLSGPEAWRHGVRADMIEERLKADTQHAIRAVCVVHNETSTGVTSNIVAVRKAIDAAKHPALLLVDTISGLASADYRHDEWGVDVSISGSQKGLMLPPGISFNAVSAKALEASKTARLPKSFWAWDEIIEMNKTGYWPSTPNTNLLYGLNEACDMLLEHGLDVVFARHLRWAEGVRAAVRAWGLQIQCADPAVYSPVLTGVMTPEGIDADAVRKIIYERFDCSLGTGLGKVKGRMFRIGHLGDCNDLTLMAALSGCEMGLKLAGVKLAGSGVQAAMDHFSSHAAVVPLRKAA

SEQ ID NO: 33308 - protein, 535 aa, Arabidopsis thaliana
MAQIPSLENAPLNLKSIRDKSERELVNLLKDVRGTKCLVIDPKLSGSVSLIIPTSKLKELGLELRHLTAEPVQTECTKVVYLVRSQLSFMKFIASHIQNDIAKAIQRDYYVYFVPRRSVACEKILEQEKVHNLVTVKEFPLYMVPLDEDVISFELELSEKVCRTLMSPILDCLVDGDVSSLWHIAKAIHELEFSFGVISKMRAKGKASVRVADILNRMQVEEPVNSNDVGRPEVDTLILLDREVDMVTPMCSQLTYEGLIDEILHISNGAVEVDSSVMGAQQEGKKMKVPLNSRILFPYLPDAIWSQVLRQKAMTMKEDYTEINSISNGVWLYNAQTQTVSELKDFVKKLNSLPEMTRHIHLAQHLTTFTSKQSFNSQLDMEQTLVEAENYDICYEYIEEMIHKQEPLTNVLRLLVLFSVTNSGLPKKQFDYIRQVKLPMELLHSYGFEHVVTLNNLEKAGLLKKQEFKSNWLTVKRTLKLIVEDTDTSRPNDIAYVYSGYAPLSIRLIQQAIHSGWLASYGRHFEAVTRTPSGD

SEQ ID NO: 33309 - protein, 365 aa, Streptococcus pyogenes SSI-1
MNSLIQYLQERKQIEDKWRASLLKGIQDHVLDGQDGDRGEAGPAGPRGEAGPAGPRGEAGKDGAKGDRGEAGPAGPRGEAGPAGPRGEAGKDGAKGDRGEAGPAGPRGEAGPAGPRGEAGKDGAKGDRGEAGPAGPRGEAGKDGAKGDRGEAGPAGPRGEAGPAGPRGEAGKDGAKGDRGEAGPAGPRGEAGPAGPRGEAGKDGAKGDRGEAGPAGPRGEAGKDGAKGDRGEAGPAGPRGEAGPAGKDGQPGKPAPKTPEVPQKPDTAPHTPKTPQIPGQSKDVTPAPQNPSNRGLNKPQTQGGNQLAKTPAAHDTHRQLPATGETTNPFFTAAAVAIMTTAGVVAVAKRQENNQSSFCYLTDGK

SEQ ID NO: 33310 - protein, 489 aa, Burkholderia pseudomallei K96243
MHTDSSFTFVLFGGTGDLSMRKILPALFEAHRANMLSEAGRIVAVARHAADREGYLQWVEEHVKPHAAKAAGGAFDEAVWRSFLERIVYVKLDLGRAEDYALLRDTVGGLSGIRVFYLATGPSLFVPICKALAAVGLNEGARIVLEKPLGYDLRSSNAINDAVGEIFAEDQIYRIDHYLGKEPVQNLLALRFGNALFEPLWRREWVESIQITIAEELGVEARGDFYDNTGALRDMVQNHLLQLLSIVAMEPPHSMDSDSVRDEKLRVLRALKPVDPRDIGKVAVRGQYHAGVIKGAQVPAYATEPGVKADSQTETFVALKVEIENWRWAGVPFFLRTGKRLADRVAEIVVNFRPVPHSALGPTALRAGANRLVIRLQPNESIRLYCLAKQPGEGMNLASVHLDLAFDQFFKEGQMEAYQRLLLDVINGRLALFVRRDEQEAAWRWVEPILNEWARTTKPPKPYAAGTWGPAAASAMLAQHGTCWLEEEN

SEQ ID NO: 33311 - protein, 425 aa, Gibberella zeae PH-1
MAATTSKIDDSMPARISSDCPEEIREVLYYAWGHDRSGLKKLLKTTGKATAQDPKTGETPLHAAIRACGPASPDDDGQEEDGSVEEAKDIVHDLFLQGAIWNDVDSNNETPGCLALRLGRKSLYQLCIEAGVRAELLFALMGDYEELSSGSEDGDEEMEVQQDDDEEAPQLVSTEDVEPTVEEPKFIPPDAKEKQVTSEEYLNSKLVYDDAKLVDSDLNGVMMAWETDIMRRSVAALIPDSAPGKRILNIGFGMGIVDGMFAELKPSRHHIIEAHPSVLEHLSKDESKFGPSWEKSGPEEGAFKVHKGKWQDIVPKLLEDGEIYDAIYFDTFGEDYSQLRYFFSECIIGIMDQEGKFSFFNGLGADRKICYDVYTKVVEMQCADAGLDVEWEESDVDMSGLEKAGEGEWEGVRRRYWTLDSCRQP

SEQ ID NO: 33312 - protein, 220 aa, Arabidopsis thaliana
MAPTIKRIGSFRTHQKHFVDFFGDDLIVTVTPTASVIRRWIRSVRSYNRNHSVHPLVVGIGVQWRPDSSDPDPPPKTLQLCVGSRCLIIQLGYNYGLPKVLRTFLADPKTTFVGVWNGQDQKKLEKCRHRVEIGKLLDIRMFVRDSRGARMCFCSFEQIVKERLGRVGVRLDPAICMSDWGVYNLNHYQVLQASIESYVCFKLAVEERLWNLKVAANLVI

SEQ ID NO: 33313 - protein, 290 aa, Picea sitchensis
MASSVTLSNSLSVIGGRPSVPSARHDVFPAAVTLAFPSSLFRSLSLSVSSASWPPAAAASIRKRGGVKRAPVMANASEWEQDVGVKTQEEGEEGAGDGEIDFENEFVELPEGTKLFVGNLPFNLDNQQLGELFEGAGEVLDVNIITDRETGNSRGFGFVTMGTVEEAEKGVELFNRHSLEGRLLTVNKAAPRGTKVERPSQAGSSTNKIYVGNLPWQADDNSLLQLFSEHGKVLEARVVYDRETGRSRGFGFVTYSSESEVNDAIAALDGTDMDGRPLRVNIAEDRRRGF

SEQ ID NO: 33314 - protein, 389 aa, Campylobacter coli RM2228
MLTQRSQVLEESITLAITALANELKAKGEDVISFSAGEPDFDTPQTIKNAAIAAIEKGCGKYTAVAGIADVLKAIQNKLKKDNNLSYETSEIITNVGAKHSLFECIECLVEEGDEVIIPSPYWVSYPEMVKFAGGKPVFIEGLEENGFKINAEQLKKAITPKTKILMLNSPSNPVGSIYNKEELLSIAKVLEGTKIIVLSDEMYEKLRYDGFEFVAFASVSENALNRTVTINGLSKCGAMPGWRFGYMASKNKALISAVKRLQGQSTSNICSITQHAAIPAFNGECDEDIEKMRQAFEKRRDLALNMLHQIPNISVYKPEGAFYLFVNTQKIEKDSMKFCQKLLEQEKVAVVPGIGFGMDGYFRLSYATSDELIKKGIERIANFIKNYK

SEQ ID NO: 33315 - protein, 200 aa, Streptomyces coelicolor A3(2)
MGSYTIPNVVERTPQGERSYDVFSRLLSERIIFLGTEIDDGVANVVIAQLLHLESSAPESEIAVYINSPGGSFTSLMAIYDTMTFVQAPISTFCVGQAASTAAVLLAGGDPGRRFVLEHARVLLGQPASGGRQGTVSDLALQAKEMVRIRSQVEEVLARHTHHDVATLRADMDRDKVFTAQEAVAYGLADEVLARRLTRV

SEQ ID NO: 33316 - protein, 122 aa, Campylobacter coli RM2228
MIGQTAVIEDDVLIYQGVTLGGTSLEKGIKRHPTIKKGVIIGSGAKVLGNITIGENAKIGSNAVVVKDVGANLTAVGIPAYIVEERRKNKENTRAVDANCEDKLEKLERKIAELEKALSDIK

SEQ ID NO: 33317 - protein, 129 aa, Yarrowia lipolytica CLIB122
MSNKTDSEWRAVLSPEQFRVLREKGTERPHTGKYNSTFDNGTYNCAGCDAPLYTSKAKFRSSCGWPAFYEAIPGALKLNVDKTLGMTRTEMVCANCDGHLGHIFKGEGYDTPTDERHCVNSVSLSFKPE

SEQ ID NO: 33318 - protein, 1228 aa, Ostreococcus tauri
  misc_feature (1228)..(1228): Xaa can be any naturally occurring amino acid
MADADADVAVKRETKPSDFSTAILERKKAPNRLVVGACERVAIAMSSRSTSMSSRSDASRRLTVDGDDVDEAINDDNSVVALNLQKMEELQLFRGDTVLLKGKKRKDSVCIVLADETCDEGKIRMNKVVRKNLRVRLGDVVSVHQCTDVKYGKRVHVLPFSDSIEGVSGNLFDVYLKPYFLEAYRPLRKGDTFLARGGMRAVEFKVVETDPAEYCIVAPDTEIFCEGEPINREDEERLDDVGYDDVGGVRKQMAQIRELVELPLRHPTLFKTIGVKPPKGILLYGPPGSGKTLIARAVANETGAFFFLINGPEIMSKLAGESESNLRKAFEEAEKNAPAIIFIDEIDSIAPKREKTNGEVERRIVSQLLTLMDGMKSRSHIIVMGATNRPNSIDPALRRFGRFDREIDIGVPDEVGRLEVLRIHTKNMKLDEAVDLEKISKETHGYVGADLAALSTEAALQCIREKMDLIDLEDEEIDAAVLDSMAITNEHFATALTTSNPSALRETVVEVPNVSWDDIGGLETVKQELQETVQYPVEHPEKFEKFGMAPSKGVLFYGPPGCGKTLLAKAIANECQANFISIKGPELLTMWFGESEANVREIFDKARQSAPCVLFFDELDSIATQRGGNQGDAGGAADRVLNQLLTEMDGMGSKKTVFIIGATNRPDIIDTALMRPGRLDQLVYIPLPDEPSRLSIFKANLRKSPIAADVDLNVLAKFTNGFSGADITEICQRACKYAIRESIARDIEAERAAAMNPDAMTDETADDPVPEITKAHFEEAMKHARRSVTDADIRKYQTFSQTLHQARGFGGDFQFPTGQANGTSNAAPAAAGGDDDDLHELRLHPPCYYRASPAAYSLDSKEEAPEIISMSSVVIAAWRHLARVFTRILHRLHSRTEFRRVVLQHGVVHHHASLELREIEQEFGTIRTFNLVGVELVDTLFRRLFELLVRHERRDGGLEGNRRRKAVVDDVRLRRISRHDLVRNRRCGRKCERLLGCINDDIVDLLRHHSRQLRASLVANDVIRHPRRHRVQNLRVFHHRRDTGTTNVCSVSAPGVSPSSRTNGFTIARDFSHFVCAPFSLDAATIFIALVIFWMFPTERIRIFTAWSEIVRTFAGTLRACQTTRIDRQSMYRTRNSFDRARPGPDRIPGFVLSLLRAAVSAQENRKNPRGNIPSILPHRARARAVVASTHPSLAADQPPRTGAAIPRGVIDAPRAPSFIAARIATCX

SEQ ID NO: 33319 - protein, 217 aa, Streptomyces coelicolor A3(2)
MSPFTAGPAPARTPRAEEGDTPATRFDDRLAEQLLDQRIVLLGTQVDEVSANRVCAQLLILSAQDPRTDISLYVNSPGGSVHAGLAIYDTMRLIPNDVSTLAMGFAASMGQFLLSVGTAGKRYALPNARIMMHQPSAGIGGTTADIEIQADNLDFTKRTIERITAEHTGQSPETISRDGDRDRWFTAEEAREYGMVDQVVQSLADVRPAATRRRMGL

SEQ ID NO: 33320 - protein, 300 aa, Pneumocystis carinii
MEQYQRLEKIGEGTYGVVYKAKDLESGTIVALKKIRLEAEDEGVPSTAIREISLLKEMHNDNVVRLLNIIHQESRLYLVFEFLDLDLKKYMNSIPKDMMLGAEMIKKFMSQLVSGVKYCHSHRILHRDLKPQNLLIDREGNLKLADFGLARAFGVPLRGYTHEVVTLWYRAPEVLLGGRQYATALDIWSIGCIFAEMATKKPLFPGDSEIDEIFRIFRILGTPDENSWPGITSYPDFKATFPKWSPKNLGELITELDSDGIDLLQKCLRYYPAERISAKKALDHPYFDDFINLNRSNVVL

SEQ ID NO: 33321 - protein, 144 aa, Frankia sp. EAN1pec
MTTARDIMHGDAKCVGADESLASAARMMRDLGVGALPICGADDRLGGIITDRDIVINCVAEGRDPASTRAGDLGKGKPLFVRADADLDTVLNEMMEHRVMRMPVIDNKRLVGMISEADLARNLSGEKLGALVEAIKSGPADRVT

SEQ ID NO: 33322 - protein, 666 aa, Thiomicrospira crunogena XCL-2
MNTSNKSVQPQLGRRQFVKGIALSTISAAIGSHLPSAWAKEEFSAIGAGNLNPKQPVLIGPEFDLTISETPVNITGSPVKATLINNSLPAPTLVWREGETVTIRVKNTLSVDTSIHWHGIILPFQMDGVPGLSYDGIKPGETFTYQFTVQQHGTYWYHSHSEFQEQTGLYGALVILPKKADPLDYDHDFVIQLSDWSDSAPDTLYSNIKKMGDYYNYSQRTVGDFWHEVKTYGFSKAWEKRKMWNQMRMTDRDLSDVTGATYTYLMNGLSPKAHWRTVIESGKKVRLRFVNSSAMTFFDVRIPGLKMTVVAADGNLVQPVEIDEFRIGVAETYDVIVEPDTSKQAYAIFAQAIDRSGFAMGSITSDPTQLADSPEMDPLPILSMTDMGMEMDMGSTSHPMNMDGEMEGMNPSSQPMNMNTDSQRMTPSDHNSMNGTKHDMSSMQQQDYGHALAMEKSQMGKDVSNVDHSKHSHGMENMNVNLDDITIPMDMNPQLPQIKTPSAEGAQIGMRAMAPQYRLDDPGVGLRENGRKVLTYADLKNRFPTRHHPKPTKELVMHLTGNMERYMWSINGIPFEEAEPLNFQYGDRVRITFINDTMMNHPMHLHGVWSDLETGDENHIPRKHTVIVQPGSKISYRVTMDAKGDWAYHCHLLYHMMGMFRKVQIR

SEQ ID NO: 33323 - protein, 339 aa, Burkholderia pseudomallei K96243
MNTTTLSTKLNAFARLNLIDAPTPLQYLPRLSAHVGRDIHVKRDDCTPLAMGGNKLRKLEFLAADALGQNADVLVTAGAIQSNHVRQTAALAAQLGLGCVALLENPIAAARDDYLQSGNRLLLDLFDVRAHVVDGLDDVDRQLEAAARRLRDEGRRPYVIPIGGSNPLGALGYVRAGLELAQQIRAAERDFAAVVLASGSAGTHAGLAFALAHALPGLPVIGVTVSRTDAQQRPKVRHLLDGMSGLLDVALPAGARIDLWDDYFAPRYGEPNRAGIDALRLLARTEGLLLDPVYTGKAMAGLIDGVARGRFDGNGPVLFVHTGGAPALFAYQDACRASR

SEQ ID NO: 33324 - protein, 610 aa, Arabidopsis thaliana
MSKQTYKVCFCFRRRYRHTVSVAPAEIKTLFDNYSDKGLMTTDLLLRFLIDVQKQDKATKEEAQDIVNASSSLLHRNGLHLDAFFKYLFAVTNSPLSSLEVHQDMDAPLSHYFIYTGHNSYLTGNQLSSDCSELPIIEALKKGVRVIELDIWPNSDEDGIDVLHGRTLTSPVELIKCLRAIREHAFDVSDYPVVVTLEDHLTPKLQAKVAEMVTDIFGEMLFTPPSGECLKEFPSPAFLKKRIMISTKPPKEYKAATDDDLVKKGRDLGDKEVWGREVPSFIRRDRSVDKNDSNGDDDDDDDDDDDDDDGDDKIKKNAPPEYKHLIAIEAGKPKGGITECLKVDPDKVRRLSLSEEQLEKASEKYAKQIVRFTQRNLLRVYPKGTRITSSNYNPLIAWSHGAQMVAFNMQGLGRSLWVMQGMFRGNGGCGYIKKPDLLLKSNAVFDPEATLPVKTTLRVTIYMGEGWYYDFPHTHFDRYSPPDFYTRVLKCCNLGGFTSFEVEADATFSNISQVGIAGVPADTVMKKTKTLEDNWIPAWDEVFEFPLTVPELALLRIEVHEYDMSEKDDFGGQICLPVWELRQGIRAVPLRNQDGVKCRSVKLLVRLEFV

SEQ ID NO: 33325 - protein, 300 aa, Pneumocystis carinii
MEQYQRLEKIGEGTYGVVYKAKDLESGTIVALKKIRLEAEDEGVPSTAIREISLLKEMHNDNVVRLLNIIHQESRLYLVFEFLDLDLKKYMNSIPKDMMLGAEMIKKFMSQLVSGVKYCHSHRILHRDLKPQNLLIDREGNLKLADFGLARAFGVPLRGYTHEVVTLWYRAPEVLLGGRQYATALDIWSIGCIFAEMATKKPLFPGDSEIDEIFRIFRILGTPDENSWPGITSYPDFKATFPKWSPKNLGELITELDSDGIDLLQKCLRYYPAERISAKKALDHPYFDDFININRSNVVL

SEQ ID NO: 33326 - protein, 265 aa, Arabidopsis thaliana
MAPTIRTIGTYATQQRYLVDFFGEEFIVIVTPDPSVIGQWIHDVLSHNRFSSHPLVVGVGVQWTPSSYYSASSPVRYRSDSPPVSYRSYSPPVSYRSDSPPVSYCSDSPQVRYRSDSPRVRRRFDPPADTLQLCVGNRCIIIQLSHCERVPQVLRNFLADRDYTFVGIWNSQDAGKLKRSKHELEIAVLLDLRKFVSDSSGRTMKRCSFEKIVEENLGHSGVRLDRKVSRSDWRVYDLRYVQILQASIDVYACCKLAILDHLWEY

SEQ ID NO: 33327 - protein, 210 aa, Arabidopsis thaliana
MAPRIRTIGSYATQEKYSVNFFGEELTVTVTPDPSVIGQWIHDVLSNNRFSSHPLVVGVGVQWTPPGYDPPADTLQLCVGNRCIIIQLSHCDRVPRVLHNFLAYPDYTFVGVWNSQDARKLERSRHQLEIDDLLDLRKYVEDSSGRRSMRGCSFEVIVEECLGYRGVRLDREISMSDWSAYELCDDQILQASIDAHVCFKLGVKYRLWKV

SEQ ID NO: 33328 - protein, 376 aa, Oryza sativa Indica Group
MATAGKVIKCKAAVAWEAGKPLSIEEVEVAKEMEVRVKILFTSLCHTDVYFWEAKGQTPVFPRIFGHEAGGIVESVGEGVTDLAPGDHVLPVFTGECKECAHCKSAESNMCDLLRINTDRGVMIGDGKSRFSINGKPIYHFIGTSTFSEYTVMHVGCVAKINPAAPLDKVCVLSCGISTGLGATINVAKPKGSTVAIFGLGAVGLAAAEGARIRGASRIIGIDLNANRFEEARKFGCTEFVNPKDHDKPVQQVLAEMTNGGVDRSVECTGNINAMIQAFECVHDGWGIAVLVGVPHKDAEFKTHPMNFLNERTLKGTFFGNYKPRTDLPNVVELYMKKELEVEKFITHSVPFSEINTAFDLMHKGEAIRCIIRMEN

SEQ ID NO: 33329 - protein, 475 aa, Oryza sativa Indica Group
MAVTIQSVKARQIFDSRGNPTVEVDVGLSDGSFARGAVPSGASTGIYEALELRDGGSDYLGKGVLKAVSNVNTIIGPALIGKDPTEQVDIDNFMVQQLDGTSNNWGWCKQKLGANAILAVSLAVCKAGAMVKKIPLYQKLQHIANLAGNKTLVLPVPAFNVINGGSHAGNKLAMQVKYCLNNKTMSMHDSVIFSAHLAAVQEFMILPTGASSFKEAMKMGVEVYHHLKSIIKKKYGQDATNVGDEGGFAPNIQENKEGLELLKAAIAKAGYTGKVVIGMDVAASEFYSEKDKTYDLNFKEDNNDGSHKISGDSLKDVYKSFVSEYPIVSIEDPFDQDDWATYAKLTDEIGQQVQIVGDDLLVTNPTRVAKAISEKTCNALLLKVNQIGSVTESIEAVRMSKRAGWGVMASHRSGETEDTFIADLSVGLSTGQIKTGAPCRSERLAKYNQLLRIEEELGDAAVYAGEKFRAPVEPY

SEQ ID NO: 33330 - protein, 1145 aa, Pinus sylvestris
MVSISSDQACTIPKLYANFFLGSDIEFVRPDGRPEFFNADRFLSYYHSMTFAVNQEGQALLPGRKLLAMELHEPFFESWDPRHENPCKWTGVICSLDHENLVTEINIQSVQIAGNVPSQFAVLGSLRSLVISAANLTGSIPAEIGGYESLEILDLSGNRLRGNIPAEISKLKNLKSLILNSNQLQGSIPAEIGNCHNLVDLVVFDNQLSGKIPAELGRLANLEVFRAGGNENIEGTLPDELSNCTNLVTLGLAETNISGKIPLSFGSLKKLQTLAIYTAFLSGTIPAELGNCSELVNLYLYENRLSGAIPRELGKLQKLEKLYLWDNELDGSIPAELGSCSSLKFVDLSTNSLSGSIPDSFGSLKNLSELEITDNNVSGSIPAALANCTELTQIQLYNNQISGQMPAELGALKKLTVLFLWQNNLEGPIPSSLGSCDNLQSLDLSHNRLTGSIPPSLFEIKNLTKLLLLSNELTGALPPEIGNCVALSRLRLGNNRLLNQIPREIGKLENLVFLDLAMNQFSGSIPAEIGGCSQLQMLDLHGNRLGGELPRALGFLHGLQVVDLSANELTGLIPANLGNLVALTKLTLNGNALSGAIPWEISRCTNLQLLDLSLNRFSGQIPPEMGKCKRLEIALNLSWNNLSGSIPAQFSGLTKLASLDLSHNLLSGNLSALAQLSESCFSQHFFQRFFRVSARYQVFSDLCLPSDLSGNAALCTSEEVCFMSSGAHFEQRVFEVKLVMILLFSVTAVMMILGIWLVTQSGEWVTGKWRIPRSGGHGRLTTFQKLNFSADDVVNALVDSNIIGKGCSGVVYKAEMGNGDVIAVKKLWTGKESECEKVRERDSFSAEVNTLGAIRHRNIVRLLGCCTNGRSKLLMYDYMPNGSLGGLLHEKRSMLDWEIRYNIVLGVRRGLSYLHHDCRPPILHRDVKANNILLGSQYEPYLADFGLAKLVDSADFNRSSTTVAGSYGYIAPEYGYTMKITQKIDVYSFGVVLLEVVTGKQPIDPTIPEGVHLVEWARDAVQSNKLADSAEVIDPRLQGRPDTQIQEMLQVLGVAFLCVNSNPDERPTMKDVAALLKEIRHDCHDYNGKADLLLKQTPAPGSTRSPNPTADARSPVGSSFGLEYSSASTTAHESYSLHSSVSNVI

SEQ ID NO: 33331 - protein, 184 aa, Prochlorococcus marinus str. MIT 9312
MDLSSIPPSPMKGIVNIVVEIPAGSRNKYEYCSEAGIMALDRVLHSSVRYPFDYGFIPNTLADDGAPLDAMVIMDEPTFAGCLIKARPIGVLDMHDCGAYDGKLLCVPMANPRQANIVSIKQIAPNQLEDVAEFFRTSKGLDGRTVQIDGWRDFDAVENLLKNCTPLKKKSFKVLKKSTISKVN

SEQ ID NO: 33332 - protein, 537 aa, Ornithobacterium rhinotracheale
MAEIIKMPRLSDTMEEGKVESWNKKVGDKVSYGDILAEIETDKAVQEFETDVEGTLLYIGVEAGQAAPVDSILAIIGAEGEDISGLVSGGGASQSAPAQEAAAPAEEPQAEAAPAAEVPENVTIVSMPRLSDTMEEGKVESWNKKVGDKVSYGDILAEIETDKAVQEFETDVEGTLLYIGVEAGQSAPVDSILAIIGPEGTDVSAIVAGGGAKPAAKAEAPKAEAPKQAAPAQEKKETPAPAAPKAQATNNSGRVFISPLAKKLADEKGYDINQIQGTGDNGRIIKKDVENFTPQAAAAKPAVAGPVALEVGEDTVIPNSQMRKVIAKRLSESKFTAPHYYLTIEVDMDNVMAARKQINQIPNTKVSFNDIVLKATAMAVKKHPVVNSTWKDNEIVQYAAVNIGVAVAVPDGLVVPVVKNTDLKSLSQISAEVKDLATRSRDRKIKADEMEGSTFTVSNLGAYGVESFTSIINQPNSCILSVGAIVEKPVVKNGQIVVGHTMKLCLACDHRTVDGATGSTFLQTLKQYLETPMSMLV

SEQ ID NO: 33333 - protein, 354 aa, Clostridium thermocellum ATCC 27405
MQKQGAYGFVILGGIINNRGKVVFEVAVLVTGGAGYIGSHTVAELVEKKEEVIVVDNLEKGHRDAVAGAKLIVGDLRDKEFVKKVFLENDIEAVIHFAAYIEVGESVQNPLKYYNNNVIATLNLLTAMEEAKVDKIVFSSTAATYGEPENIPILETDRTLPTNPYGETKLAVEKALKWCDRAYGIKYIALRYFNASGAHESGEIGEDHSPESHLIPLVIQAALGKRESIKIFGNDYNTPDGTCIRDYIHVSDLANAHYLALQRLREGKESAVYNLGNGKGFSVKEVIDVVRKVTGRPIKVEDAPRRPGDPAVLVASSEKIKKELNWQPRMADLETIVSTAWKWHLSHPNGYNDK

SEQ ID NO: 33334 - protein, 294 aa, Oryza sativa
MSLKSREFSGRLPPPPSSSSDQQEQYYCSGQHQQRGEDGGGGGDGEMVHFSHPEHRLARFDFPYLFMCMGCKEYGAGKRFMCQLCGFQLHEFCALAPPSLHDHPFHPKHQHLLFFVKPGGFLRCKCDICGKSVKGFSFRCTSCSFAMHPCCAAMSRRMDLPVAHEHPLMLAPSPPTPPMATPTSDVVGVGDGGVGTSFVCQMCRRCRRPAGQYVYQCMPCGYYLHARCAKDVVNGLYVHGVAPPEKGSALAAVARVTINALFSVIGGLIEGIGEGIGEAFVDNIGRSRGRSSFR

SEQ ID NO: 33335 - protein, 179 aa, Fritillaria agrestis
MASSATMLSSVATAACVAPAQASMVAPFVGLKSASAFPVTQKTVTGLSTLPSNGGRVQCMKVWPIVGLKKFETLSYLPTLSVESLLKQIEYLIRNGWVPCLEFSLEGFVSRDNNKSPGYYDGRYWTMWKLPMFGCTDAAQVVKEAAECKKEYPAAFIRVIGFDNVRQVQCVSFIVEKPE

SEQ ID NO: 33336 - protein, 179 aa, Fritillaria agrestis
MAASSTMLSSVATAACAAPAQASMVAPFVGLKSTSAFPVTQKPATGLSTLPSNGGRVQCMKVWPIVGLKKFETLSYLPTLSVESLLKQIEYLIRNGWVPCLEFSLEGFVSRDNNKSPGYYDGRYWTMWKLPMFGCTDAAQVVKEAAECKKEYPAAFIRVIGFDNVRQVQCVSFIVERPE

SEQ ID NO: 33337 - protein, 173 aa, Flaveria pringlei
MASIPATVATVAQANMVAPFTGLKANAAFPVTKKVNDFSTLPSNGGRVQCMKVWPPLGKKKYETLSYLPDLTEVQLAKEVDYLLRNKWVPCLEFELEHGFVYRENARSPGYYDGRYWTMWKLPMFGCTDSAQVMKELQECKKEYPQAWIRIIGFDNVRQVQCISFIASKPGGF

SEQ ID NO: 33338 - protein, 178 aa, Flaveria pringlei
MASISSTVATVSRAAPAQANMVAPFTGLKSNVAFPATKKANDFSTLPSNGGRVQCMKVWPPLGKKRYETLSYLPNLTEAQLAKEVDYLLRNKWVPCLEFELEHGFVYRENARSPGYYDGRYWTMWKLPMFGCTDSAQVMKELQECKKEYPQAWIRIIGFDNVRQVQCISFIASKPEGF

SEQ ID NO: 33339 - protein, 179 aa, Fritillaria agrestis
MASSATMLSSVATAARAAPAQASMVAPFVGLKSASAFPVTQKPATGLSTLPSNGGRVQCMKVWPIVGLKKFETLSYLPTLSVESLLKQIEYLIRNGWVPCLEFSLEGFVSRDNNKSPGYYDGRYWTMWKLPMFGCTDAAQVVKEAAECKKEYPAAFIRVIGFDNVRQVQCVSFIVEKPE

SEQ ID NO: 33340 - protein, 394 aa, Clostridium thermocellum ATCC 27405
MAASLAIILLLGLPAKRIFEKLRLPGLLGMLILGILIGPHVLNLLQTDMLQISSDLRSIALIIILLRAGLGLNKDELKSIGIPALKMSCIPGLFEGLFIALASVYFLDFTFVQGGMLGFIIAAVSPAVVVPFMLKLNENKIGTKKGVPTLILAGASIDDVFAITVFSAFLGLYYGSEINIGIQLLNIPISILLGILSGILVGFLLINIFKKYNIPDTKKVLLILGFSILLNQLESVLKTKLRIASLLGVMAIGFILTEYLPDTGKKLSDKFNKVWVFAEILLFVLVGAEVNVNVALKAGGIGIILILTGLIGRSVGVAISLLGTDFNWKERVFCIIAYIPKATVQAAMGAVPLSLGVESGDIILAIAVLAILITAPLGAIGIHYSAEKLLIEKQ

SEQ ID NO: 33341 - protein, 179 aa, Fritillaria agrestis
MASSATMLSSVATAACAAPAQASMVAPFVGLKSASAFPVTQKTATGLSTLPSNGGRVQCMKVWPIVGLKKFETLSYLPTLSVESLLKQIEYLIRNGWVPCLEFSLEGFVSRDNNKSPGYYDGRYWTMWKLPMFGCTGAAQVVKEAAECKKEYPAAFIRVIGFDNVRQVQCVSFIVEKPE

SEQ ID NO: 33342 - protein, 536 aa, Ostreococcus tauri
MTPHEEPELVDPEELLLVDGEIGPVTRPATKELDVAREAWYVRAILTADVYDVAIESPCEIAPRLSERIGASIYLKREDLQPVFSFKIRGAYNKMKQLSEEERARGVITSSAGNHAQGVAMSGKARVQGDHRHAGDDARDQGGAVRRLGGEVVLSGNYDATQAYAKQRSKEEGLTYIPPFDDPFVIAGQGTVGVELLRQLPSVDIVFVPIGGGGLAAGMAAYIKAIRPEIRVIGVEPAGANAMTISLARGKIVKLNKVDGFADGVAVREPGRDCFEIIHSMLDGIITVRTDQIASAIKDVFGDTRSILEPAGAVAVAGAKAYCTANNFKGKVVAVTSGANMNFDRLRVISEIADQGGKEEATLLSVIPEKNGEFKRFVETVGDRNISEFKYRVQGDNARVLYSIEVSDIKEVQETMARMDALGFKTVDLSNDTATQFHLRHMTGGKARVKDERLYSVEIPERAGALGNFLDFISPKWSISMTHYRADGGQVGKVLFGVQVTENDREEFEKCLELCGYKYVDMTSNVAFRTLFGDDN

SEQ ID NO: 33343 - protein, 378 aa, Burkholderia pseudomallei K96243
MTLASTPDIIAELKAGRMVILVDEEDRENEGDLVLAAEFVTPEAINFMARYGRGLICLTLTQERCKQLNLPLMTYRNGTQYGTAFTVSIEAAEGVTTGISAADRARTIATAVAHDVRPEHIVQPGHVFPIMAQPGGVLVRAGHTEAGCDLTALAGLTPAAVICEIIKDDGTMARLPDLLEFGKEHGLKIGTIADLIHYRSRTESIVERVAERTMQTAHGPFKTVLYRDHPTGSPHIALVRGTPTPNDETPVRVHEPLSVLDLLETGVSTHSWTLDAAMKEIAARELGVIVLLNCGDTKEHLVDVFLAFDEKEKAAELKRRPVDFKTFGIGAQILRDVGVGRMQVLSNPRKLGSMSGYGLEVTGFAPMPGSATSASGAA

SEQ ID NO: 33344 - protein, 427 aa, Chlorobium tepidum TLS; identical to SEQ ID NO: 1588

SEQ ID NO: 33345 - protein, 99 aa, Arabidopsis thaliana
MERKKFSSKFIHLLIVFLLLCTFLSRTESALPYHHELLLGRKRMNYYKPNSNTIGTPSSTSNHAPGGHGRRLMSIYRPNGDIFTGPSGSGHGGGRTPAP

SEQ ID NO: 33346 - protein, 173 aa, Burkholderia pseudomallei K96243
MEIGQYQPNLEGDGLRIGIVQSRFNEPVCNGLADACVEELERLGVSGEDVLLVTVPGALEIPLALQKLAESNQFDALIALGAVIRGETYHFELVSNESGAGITRIALDFNTPIANAVLTTETDEQAIARMTEKGRDAARVAVEMANLTMTLDQLSDDEEDEEDEDDEDEEERA

SEQ ID NO: 33347 - protein, 223 aa, Frankia sp. EAN1pec
MPTLDRHDDVFVLDIGDGENRFHPDWIASVEAALDEVEKASGPRALVTAATGKYFSNGLDLDWLLANADRPQEYAVSVHELLARMLALPVVTVAALQGHTFAAGAMFSLAHDFRVMRADRGYWCLPEADIDIPFTPAMSALIQARLSPQTAHEAMTTARRYGGRDACAAAIVDRAVAEEEVRGTGVEIARAQAGRAGTTLGTIKARMYAPVLDALRDRERPLG

SEQ ID NO: 33348 - protein, 416 aa, Burkholderia pseudomallei K96243
MRARGARPLFAFLPRFDSTMNTAADSLLRLASRVDAIEPFYVMEIVKEAAVLERAGRDIIHMSIGEPDFTAPEPVVDAAAAALRRGVTQYTSALGIAPLREAIAAHYARAHGLSIAPERIVVTAGASAALLLACLALVGRDDEVLMPDPSYPCNRHFVATAEGRAVLVPSGPETRFQLTADDVKTRWGERTRGVLLASPSNPTGTSLEPAELGRIIDAVRARGGFSIVDEIYQGLSYDGAPVSALSFGDDVVTVNSFSKYFNMTGWRLGWLVVPPALVGTFEKLAQNLFICPSALAQHAALACFEPDTLAIYEARRAEFRRRRDFIVPAIESLGFKVPVMPDGAFYVYAQCGGVAHPAAGDSAALVNAMLHDAGVVLVPGMDFGVHAPRDYIRLSYATAYSRLEEAVERLGKLFGR

SEQ ID NO: 33349 - protein, 769 aa, Arabidopsis thaliana
MSSNCSCSLLSLFSLLLIIDLTVASSCPKTCGGIDIPYPFGIGTGCYLEKWYEIICVNNSVPFLSIINREVVSISFSDMYRRFFNVGYGSIRIRNPIASKGCSSGGQEFGSLLNMTGYPFYLGDNNMLIAVGCNNTASLTNVEPSIVGCESTCSTNQDIPINDYLGVLYCNARYGDSEYCKNISIMNDTSCNGIGCCKASLPARYQQIIGVEIDDSNTESKGCKVAFITDEEYFLSNGSDPERLHANGYDTVDLRWFIHTANHSFIGSLGCKSIDEYTILRRDNREYGIGCLCDYNSTTTGYATCSCASGFEGNPYIPGECKDINECVRGIDGNPVCTAGKCVNLLGGYTCEYTNHRPLVIGLSTSFSTLVFIGGIYWLYKFIRRQRRLNQKKKFFKRNGGLLLQQQLTTTEGNVDSTRVFNSRELEKATENFSLTRILGEGGQGTVYKGMLVDGRIVAVKKSKVVDEDKLEEFINEVVILSQINHRNIVKLLGCCLETDVPILVYEFIPNGNLFEHLHDDSDDYTMTTWEVRLRIAVDIAGALSYLHSAASSPIYHRDIKSTNIMLDEKHRAKVSDFGTSRTVTVDHTHLTTVVSGTVGYMDPEYFQSSQFTDKSDVYSFGVVLAELITGEKSVSFLRSQEYRTLATYFTLAMKENRLSDIIDARIRDGCKLNQVTAAAKIARKCLNMKGRKRPSMRQVSMELEKIRSYSEDMQPYEYASENEEEKKETLVDVNVESRNYVSVTAASSQYSIATTSSSRSDVEPLFPR

SEQ ID NO: 33350 - protein, 98 aa, Synechocystis sp. PCC 6803
MISNAATSTPDRLTSTVRKTYPNFKVIVLNDDFNTFQHVSDCLLKYIPGMTGDRAWELTNQVHFDGLAIVWVGPQEQAELYHQQLRREGLTMAPLEKA

SEQ ID NO: 33351 - protein, 175 aa, Arabidopsis thaliana
MSTMKPSRSDEISDPEQQIKNANQIRADFDSLAPKRPTKPTRSEPGLPGSFSASDKITDHPEADKFQSLQSQTSCSGKVLGEGDSSAVQDEFLETEYYSNLTAIDKQHHTTGSGFINVVKEDNGEESEAVTAAAIGDGGEKAVYRSNPATNEWIPATEEDFDSESSSKPNRSESS

SEQ ID NO: 33352 - protein, 374 aa, Xanthobacter autotrophicus Py2
MTDTIERPGFVERNRPGRAKMKAAIFVEKNRIVLDEKPIPDVGPLDALIRITTTTICGTDVHILKGEYPVEKGLTIGHEPVGIIEKLGSAVEGFAEGQRVIAGAITPSGYSNACLCGCASQDGPRMKHGFKPMGGWRFGNTIDGAQAEYLVVPDAMTNLAPVPEALGDEQVLMCPDIMSTGFAGAESGKVRIGDTVAVFAQGPIGLCATAGARLMGATRIIAVDRVGERLNVARAMGADEVVDFSKVDPVEEILRLTDGRGVDVAIEALGRQETFEAALRVLRPGGTLSSLGVYSSDLKIPLDAFAAGLGDNKIVTSLCPGGKERMRRLMDVVASGRVDARALVTHRFKLDDIEKAYDLFSHQRDGVLKVAITP

SEQ ID NO: 33353 - protein, 173 aa, Flaveria pringlei
MASIPATVATVAQANMVAPFTGLKSNAAFPVTKKVNDFSTLPSNGGRVQCMKVWPPLGKKRYETLSYLPNLTESQLAKEVDYLLRNKWVPCLEFELEHGFVYRENARSPGYYDGRYWTMWKLPMFGCTDSAQVMKELQECKKEYPQAWIRIIGFDNVRQVQCISFIASKPDGF

SEQ ID NO: 33354 - protein, 178 aa, Flaveria pringlei
MASISSTVATVSRAAPAQANMVAPFTGLKSNAAFPATKKANDFSTLPSNGGRVQCMKVWPPLGKKKYETLSYLPNLTEAQLAKEVDYLLRNKWVPCLEFELEHGFVYRENARSPGYYDGRYWTMWKLPMFGCTDSAQVMKELQECKKEYPQAWIRIIGFDNVRQVQCISFIASKPDGF

SEQ ID NO: 33355 - protein, 500 aa, Mycobacterium sp. MCS
MPDVNVTSESRMLIDGKLVDGEAGTFINVNPANEEVLGEVADASRADMQRAIDAARRAFDETDWSTNGELRKRCVLQLHEAIEGELAELREELILEAGAPRAVTHGPQLDAPLEDGLKYPARLIDEFTWETDLGDKVVSVTGVNTRRKVWHEPVGVVGAIVPWNFPFEVTVNKLGPALAAGNTVVLKPAPNTPFNATRLGRLIAEKTDFPAGVVNVVTASDHFVGEELTISPKVDMISFTGSTVVGKRIMEKGAATMKRLFLELGGKSATIVLEDADFNTACLIGIGPLMHAGQGCAAPTRMLLPRSRYDEGVALLKALYENMRAADPQDPGTICGPVISGRQQARILGYIQRGVDEGATLLVGSTEAPEEFDKGFWVSPTLFTDVDNSMTIAQEEIFGPVLVVIPYEDEDDAIRIANDSVYGLAGNVMSSSLDRSLAVARRLRAGFIGLNGTAGYGADTPFGGYKDSGVGRQNGIVGFSQYTEVKSVAYPADERLREEQ

SEQ ID NO: 33356 - protein, 173 aa, Flaveria pringlei
MASIPATVATVAQANMVAPFTGLKSNAAFPVTKKVNDFSTLPSNGGRVQCMKVWPPLGKKRYETLSYLPNLTEVQLAKEVDYLLRNKWVPCLEFELEHGFVYRENARSPGYYDGRYWTMWKLPMFGCTDSAQVMKELQECKKEYPQAWIRIIGFDNVRQVQCISFIASKPDGF

SEQ ID NO: 33357 - protein, 180 aa, Spinacia oleracea
MASSVLSSAAVATVSRTPAQASMVAPFTGLKSTVGFPATKKNDDITSLASNGGRVQCMKVWPTQNMKRYETLSYLPPLTTDQLARQVDYLLNNKWVPCLEFETDHGFVYREHHNSPGYYDGRYWTMWKLPMFGCTDPAQVLNELEECKKEYPNAFIRIIGFDSNRQVQCVSFIAYKPAGY

SEQ ID NO: 33358 - protein, 182 aa, Fagus crenata
MASSMISSATVATVSRATPAQATMVAPFTGLKSTAAFPATRKSNNDITSLASNGGRVQCMKVWPPLGLQKFETLSYLPPLSIESLAKQIEYLILKGWIPCLEFELEHPFVYRENNRSPGYYDGRYWVMWKLPMFGCTDATQVLAELQEASKTYPTSHIRIIGFDNKRQVQCISFIAYKPPAK

SEQ ID NO: 33359 - protein, 187 aa, Capsicum annuum
MASSVMSTATVATGANAAQASMIASFNGLKSAASFPVTRKQDLDITSIASNGGRVECMLVWPPINKKKYETLSYLPDLSDEQLLKEIEYLLQKGWVPCLEFETEHGFVYREHHRSPGYYDGRYWTMWKLPMFGCTDATQVLNEVQEAKKAYPQAWIRIIGFDNVRQVQCISFIAYKPEATKFSMFNV

SEQ ID NO: 33360 - protein, 89 aa, Citrus clementina x Citrus reticulata
FLDRETLKDIVSFINEKNIHLVCDEIYAATVFTKESSFVSIAEIIDQDIACNRNLIHIVYSLSKDMGFPGFRVGIIYSYNDQVVSCARK

SEQ ID NO: 33361 - protein, 175 aa, Aegilops tauschii
MAPTVMASSATSVAPFQGLKSTAGLPVSRRSNGASLGSVSNGGRIRCMQVWPIEGIKKFETLSYLPPLSTEGLLKQVDYLIRSKWVPCLEFRKVGFIFREHNVSPGYYDGRYWTMWKLPMFGCPAPTQVIPEVEEVRKEYPDPYCRIIGFDNMRQVQSVSFIASKPPGCEESGKA

SEQ ID NO: 33362 - protein, 174 aa, Hordeum vulgare
MAPTVMASSATSVAPFQGLKSTAGLPVSRRSNASSASVSNGGRIRCMQVWPIEGIKKFETLSYLPPLSTEALLKQVDYLIRSKWVPCLEFSKVGFIFREHNASPGYYDGRYWTMWKLPMFGCTDATQVLNEVEEVKKEYPDAYVRIIGFDNMRQVQCVSFIAFKPPGCQESGKA

SEQ ID NO: 33363 - protein, 87 aa, Citrus clementina x Citrus reticulata
TLDRDTLKSLVSFINDKNIHLVCDEIYAATVFSSPKFTSVAEVIQEMDCNRDLIHIIYSLSKDMGLPGFRVGIVYSFNDTVVNCGRK

SEQ ID NO: 33364 - protein, 183 aa, Amaranthus hypochondriacus
MASSMLSNAAMATTAATAGAQASMVAPFNGLKSFATFPITKKSSNDFSSLPSNGGRVQCMQVWPPVGKKKFETLSYLPPLSDAQLLAQVQYLLNKGWIPCIEFELEHPFVYRENHRSPGYQDGRYWTMWKLPMYGCTDPAQVLNEVEEAKKAYPSAFIRIIGFDNKRQVQCVSFIAYKPAGGL

SEQ ID NO: 33365 - protein, 256 aa, Zea mays
MVGKPLSKGFNSLVILGAWSIWKHRNRIIHVDIYTGVDLISGVTCDAPYEWSDKTDSEWEFKRDPSSETFHVVAYDFGIKHNILRRLTSYGCKITVVPANWPASEVLNLKPDGVLFSNGPGDPAAVPYAVKTVQEIIGKVPVFGICMGHQLIGQALGGKTFKMKFGHHGGNHPVCDLRSGRVDISAQNHNYAVDPESLPEGAKVTHVNLNDNSCAGLQYSKMKLMSLQYHPESSPGPHDSDTAFGEFIELMKSNRL

SEQ ID NO: 33366 - protein, 489 aa, marine gamma proteobacterium HTCC2143
MYTLDTIPFDNRFSKLSNDLFSDVKPQGLAQPFLISANPVVAELIGLDPQALKTASFVEYFSGNATLRNASPLAMVYSGHQFGSYNPQLGDGRGLLLGEVETASNGTWDLHLKGAGQTPYSRFADGRAVLRSTIREYLCSEAMAGLGIATTRGLGIIGSATPVYRETPEMGATLVRVAQSHVRFGSFEYFHYNNRPDIVKQLADYVITRNFPELEQSETKYADFLLAVVTSTAFMIAQWQAVGFAHGVMNTDNMSIIGDTFDFGPFGFMDDYNPNFICNHSDHEGRYAFNQQPGIGLWNLNALAHALSTLIDRESITQALSQYEQLLVNQYNRIFRLKLGLREEKDADAELVGSLLDLLEDQKADYTNFFRLLSHCQHSSPEFETLLRDRFVDRSSFDAWMLQYQQRLMAENSDPVLRRETMLATNPKYILRNYIAQQVIDKANSDQDYSDIGNLLTILQNPFEEHPQFSHYASDPPDWGKRLEVSCSS

SEQ ID NO: 33367 - protein, 357 aa, Colletotrichum lagenarium
MAEFIRAQIFGTTFEITSRYSDLQPVGMGAFGLVCSARDQLTNQNVAVKKIMKPFSTPVLAKRTYRELKLLKHLRHENVISLSDIFISPLEDIYFVTELLGTDLHRLLTSRPLEKQFIQYFLYQIMRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVINTIASENTLRFVKSLPKRERQPLKNKFKNADPSAIDLLERMLVFDPKKRITATEALSHDYLAPYHDPTDEPVAEEKFDWSFNDADLPVDTWKIMMYSEILDYHNVDASAQQIEEQFNGQ

SEQ ID NO: 33368 - protein, 454 aa, Yarrowia lipolytica CLIB122
MSIFQNAVNADLPRAIAGKGSYLTLENPKTGAQYDILDGSSGAAVAAVGHNHPRIVQAMQHCAGLPYIFTHAVGSKQADDLAELILSKSNGAFSRALFLNSGSEANETAMKIATQFFYEQGQTQRCNFISRDFSYHGNTLGSLSLGGFKSRQVPYKEILNSKAFHKVSTCFPYRHQKDGQTEEQYTQMLLDELDAKFQELGPDTVIAFVCETVIGATLGAVPPSKGYISGCRDICHKYGALFLLDEVMCGMGRTGTYHAWEPEFEAGTGGPDIQTVAKVLGGGYVPLAGVLLSPKVFDVFQKGSGIVYGHQTYQDHVFATGVALEIQRLIFDQNLIEECFEMGKYLGMALKRKFADNPYVGDVRGRGLFWDVEFVADKATKEVFPASMNLAGIMHVRCIENGAHFLKGKGTIDSVLGDHMMVSPAYTVTRVEIDRMIDVLANTLAEVLAENGYN

SEQ ID NO: 33369 - protein, 257 aa, Triticum aestivum
  misc_feature (30)..(30): Xaa can be any naturally occurring amino acid
  misc_feature (49)..(49): Xaa can be any naturally occurring amino acid
RQSQRIWCLPINVQNVPGVQCLPIEEVVIXWQTKLGAKVLVDACPKVPXHMPVDVQKLGADFLVQSSNKMCGPTGVGFLHGKFEILSSMEPFLGGGEMIADVFEDKSTYAEPPSRFEAGTPAIGEAIGLGVAIDYLSHFGMQRIHEYEKELGSYLYESLLSVPNVRIYGPAPSASDHRAPLCSFNVENVHPTDIAEILDLQHGVAIRSGHHCAQILHRTLGINASARASLHFYNTKEEVDAFIHGLKATIDFLTSHH

SEQ ID NO: 33370 - protein, 253 aa, Oryza coarctata
MGRKFFVGGNWKCNGTTDQMDKIVKILNEGQVPSTDVVEVVVSPPYVFLPVVKSQLRPEFQVAAQNCWVKKGGAFTGEVSAEMLVNLGVPWVILGHSERRSLLGESNEFVGDKVAYALSQGLKVIACVGETLEQRESGSTMDVVAAQTKAIAERIKDWTNVVVAYEPVWAIGTGKVATPDQAQEVHDGLRKWLATNVSAEVAESTRIIYGGSVTGANCKEVAAKPDVDGFLVGGASLKPEFIDIINSATVKSA

SEQ ID NO: 33371 - protein, 354 aa, Oryza sativa Japonica Group
MGAPATAASGGGDDDDRDVVFEYLLCTEEDAASAGSFFQQLQGPAPAVSSSPSTTTATAPAAAGSCDDGGEEEEEEVWTVDVVAELIGGEAERSHSPRADYPGRLRSGRPADLAARADSVAWILKVRELYGMLPVTAYLAVSYMDRFLSLHRLPGNGWAMQLLAVTCLSLAAKMEETLVPSILDLQMEDARYIFEHRTIFRMELLVLDALDWRLRSITPFTFMYLFADKVDPNGKHIRELIHQATQVTLATIHDTEFLDHCPSSIAAAAVLCASSEIMQLVSIDHGTLVSWRIIGLDEEAIIRCYRLMQQLISSNNVGRESTEITMATTTTTATTAVSSEEVVSSSPPSKRRKM

SEQ ID NO: 33372 - protein, 488 aa, Salmonella enterica subsp. arizonae serovar 62:z4,z23:--
MKKINHWINGKNVAGNDYFQTTNPATGDVLAEVASGGEAEVNQAVAAAKDAFPKWANLPMKERARLMRRLGDLIDQNVPEIAAMETADTGLPIHQTKNVLIPRASHNFEFFAEVCQQMNGKTYPVDDKMLNYTLVQPVGVCALVSPWNVPFMTATWKVAPCLALGNTAVLKMSELSPLTADRLGELALEAGIPAGVLNVVQGYGATAGDALVRHHDVRAVSFTGGTATGRNIMKNAGLKKYSMELGGKSPVLIFDDADIERALDAALFTIFSINGERCTAGSRIFIQQSIYPEFVKRFAERANRLRVGDPTDPNTQVGALISQQHWEKVSGYIRLGIEEGATLLAGGAEKPTDLPAHLKGGNFLRPTVLADVDNRMRVAQEEIFGPVACLLPFKDEAEGLRLANDVEYGLASYIWTQDVSKVLRLARGIEAGMVFVNTQNVRDLRQPFGGVKASGTGREGGEYSFEVFAEMKNVCISMGGHPIPKWGV

SEQ ID NO: 33373 - protein, 636 aa, Picea sitchensis
MLIRWRSLVLITFTFLALPLIPAQPVEDPRHTSFLFDGFNGTNLILETDASVIGSKSVLALTNRSHANHSHEFLLGRALYSIPVQMKSNETISSFSTTFVFSIVPPPSNAGGNGIAFFMTPHTSSMDAQPSQYLGLLNLTTNGQAYNHLFAVEFDTIMNVEFNDPDGNHVGVDVNNLVSVQTETAGYWNGEEFHELNLRSGRNIQAWIDYDHLQSRLDVTMTVVGLPRPQKPLISLQIDLHNVLQEKMYVGFSAATGLFMEDHYVLAWSFTTQGTAPPLDVSCLRSFANMYTEPLSRGFTVGVTVASLVLFLLAIAAAVFLKRVIKRETIEEWEEEYWPHRFTYKELSIATSRFRDENVLGYGGFGMVYKGVLPSSGQEVAVKCITTEFTEGMKGFVAEISSMGRLRHRNLVQLRGWCRRHTQLFIVYDYMPNGSLDKLIFGNPTTVLPWHRRYAILKGVAAGLLYLHEQWEKRVVHRDIKSSNVLLDSELNGRLGDFGLARLYDHAENPETTHVVGTLGYIAPELIQTGKATPSSDVFSFGVLLLEVACGRNPVDSLEDSERMILAEWAWELYTEGRLLEASDPKLAGKGGYDVGEMEKVLKLGLLCSHPEPESRLGMRHVCQILDGEAPIPYGW

SEQ ID NO: 33374 - protein, 157 aa, Chlorobium tepidum TLS
MRIGIGIDVHQFAEGRKLIIGGVEVPSPIGLLGHSDADVLLHAISDALLGAAALGDIGKHFPDTSPDYKDADSMELLRHVCKLLEQEGYKPVNVDTMLLLEKPKIAPYIDQMRRNIARCLGLEINAVSVKATTNEKLGYVGRQEGACAHAVCLIENA

SEQ ID NO: 33375 - protein, 378 aa, Oryza coarctata
MATGKVIKCKAAVAWGAGKPLSIEEVEVAPPQAMEVRVKILYTALCHTDVYFWEAKGQTPVFPRILGHEAGGIVESVGEGVTELAPGDHVLPVFTGECKECAHCKSEESNMCDLLRINVDRGVMIGDGQSRFTINGKPIFHFVGTSTFSEYTVIHVGCLAKINPEAPLDKVCILSCGISTGLGATLNVAKPKKGQTVAIFGLGAVGLAAMEGAGLSGASRIIGVDLNPAKFEQAKKFGCTDFVNPKDHKKPVREVLIEMTNGGVDRAVECTGNINAMISCFECVHDGWGVAVLVGVPTKEDVFKTHPMNFLNEKTLKGTFFGNYKPRTDLPNVVEVYMRKELELEKFITHSVPFSQINTAFDLMLKGESLRCVMSMYE

SEQ ID NO: 33376 - protein, 279 aa, Arabidopsis thaliana
MGSQQVAISFLTNLAKAAFGLGVAATALNSSLYTVDGGERAVLFDRFRGVLDQTVGEGTHFLIPYLQTPHIYDIRTKPHTFSSKSGTKDLQMVNLTLRVLFRPEVSRLPYIFQTLGLEYDEKVLPSIGNEVLEAVVANFNADQLLTERPQVSALVRDALIKRAREFNIELDDIAITHLSYGAEFSRAVEAKQVAQQEAERSKFVVMKADQERRAAVIRAEGESEAAQLISDATAKAGMGLIELRRIEASREVAATLARSPNVAYLPGGQSMLFNLNPGR

SEQ ID NO: 33377 - protein, 443 aa, Zea mays
MDSVMAAPDSPPQTVVLVSAGASHSVALLTGNVLCSWGRGEDGQLGHGDAEDRLVPTVLSGFDAPAITSVICGADHTTAYSEDELQVYSWGWGDFGRLGHGNSSDVFTPQPVKALQGLKIKQIACGDSHCLAVTMAGEVQSWGRNQNGQLGLGTTEDSLLPQKIQAFESVCVKMIAAGAEHTAAVTEDGDLYGWGWGRYGNLGLGDRNDRLLPEKVSSVEGEKMVLVACGWRHTITVSDSGNLYTYGWSKYGQLGHGDFEDHLVPHKVEALKDSTISQISGGWRHTMALTSEGKLYGWGWNKFGQVGVGNNDDHSSPGQVSFPEDQKISQVACGWRHTLALSEKKNVFSWGRGTSGQLGNGEIVDRNTPVLIDALSSDGSACKKLESSTAAPFAAKVWVSPSERYAIVPDENVRKAGGGTARGNGADANVPENDVKRMRVQSS

SEQ ID NO: 33378 - protein, 154 aa, Zea mays
SQVLEPNWHLMHDRLQTARSIDEVIQIHDFFLQKRLKECLLLSPELLVKVEKLKGLCLQYATSIQLLMPSIDVANSENTSKSRKSRSRIDKSQARDQQLKLASENVVMSESILKFEAAFNSELQSLAPTLSNSSQAEPYVGHDHDSIFGVGIAQ

SEQ ID NO: 33379 - protein, 312 aa, Bradyrhizobium japonicum USDA 110
MTDWTTADIPSLSGRTAVVTGATGGLGYETAMALAGAGAIVILTGRNDAKGLRAIEGICERFPDALIAYEHLDLASLSSVADFAKRFAAGNEQLDLLVNNAGVMALPKRQQTEDGFEMQLGTNYLGHYALTARLLPQLRRAKASRIVNLSSLAHRSGAINFDDLQGKRSYRPWRAYCQSKLAMLMFALELQRRSLAAGWGVTSVAAHPGYARTDLIANGPGANTLQWRVGRWLQPFISQSAAEGALPTLFAATSPAAEPGGYYGPNRFYELKGPPAPAKITPQARDFAAAAMLWDVSATLTGVSFDDIAVAA

SEQ ID NO: 33380 - protein, 322 aa, Kineococcus radiotolerans SRS30216
MNDSPLDRDSPLDRDSHGRPRAEKTHDVTVVGSVNADLAIRLDELPPAGQTVRGSDAERGLGGKGANQAVAAARLGRSVAMVAAVGDDDEGRGLRAALAAEGIDVGHVAALDVPTGVAVVLVHGGESTIVLSPGANDRMDEARVQGALAAVSTARVVLLQCEVPDEALVAAARLCTGLLVLNPAPARPLPPELLARADLLVPNAGELAVLAGEPTARDVEGIVAQARRVRPAGTTIVTRGEHGSVVVTPGGHAEVPAVPARLVDATAAGDSFVAALADALLEGAGLLDAAHWAARVAAVTVSRPGASQSLPRKADVPQEAPA

SEQ ID NO: 33381 - protein, 82 aa, Arabidopsis thaliana
  misc_feature (2)..(3): Xaa can be any naturally occurring amino acid
  misc_feature (8)..(10): Xaa can be any naturally occurring amino acid
  misc_feature (14)..(14): Xaa can be any naturally occurring amino acid
  misc_feature (20)..(20): Xaa can be any naturally occurring amino acid
  misc_feature (22)..(22): Xaa can be any naturally occurring amino acid
  misc_feature (33)..(34): Xaa can be any naturally occurring amino acid
  misc_feature (39)..(39): Xaa can be any naturally occurring amino acid
  misc_feature (43)..(43): Xaa can be any naturally occurring amino acid
  misc_feature (45)..(45): Xaa can be any naturally occurring amino acid
  misc_feature (53)..(53): Xaa can be any naturally occurring amino acid
  misc_feature (60)..(60): Xaa can be any naturally occurring amino acid
  misc_feature (62)..(62): Xaa can be any naturally occurring amino acid
  misc_feature (66)..(66): Xaa can be any naturally occurring amino acid
  misc_feature (69)..(69): Xaa can be any naturally occurring amino acid
  misc_feature (71)..(74): Xaa can be any naturally occurring amino acid
  misc_feature (76)..(77): Xaa can be any naturally occurring amino acid
  misc_feature (80)..(80): Xaa can be any naturally occurring amino acid
SXXLSSAXXXASPXQATMVXPXNGLKSSAAFPXXRKANXDITXIXSNGGRVNXMHVWPPXGXKKFXTLXYXXXXTXXELXKE

SEQ ID NO: 33382 - protein, 132 aa, Triticum aestivum
  misc_feature (106)..(106): Xaa can be any naturally occurring amino acid
DDALTARNNGAQGIGLCRTEHMFFASDERIKAVRQMIMAPTLELRQQALDRLLPYQRSDFEGIFRAMDGLPVTIRLLDPPLHEFLPEGNIEDIVSEYCLRRDQQEXMPSRELKAFRINPMLGFRGCSLGNRT

SEQ ID NO: 33383 - protein, 742 aa, Deinococcus radiodurans R1
MEWGEDADGPVHLVVGIAAASDEHLQILRRLTRVLGDEALVERLWTTTDAGDLIEALTGERPVAAAAAAPGLPYSAQVTLPNPQGLHARPATLLAGMVKKAGAKARLTRDDGRSADATKLMELLSLGLTRGTPLTVSTDQQALLRPLVDAIQSGLGDDLSAAAPQAAAPPTTRTPDWVPQQVGAALEGVGAADGLVVGTTRQHLQRSLTVTDEPADPAQGAAQLDAALQAAAADLDSMMADVHARFGADKAAIFAAHKELLADEGTVQDAVSRILDGHGPAWAYQQATNERIAQLQKLDDPVLAGRASDLGDVQRRVLRHLLGLGEDTVQTGAAPVILLAPDLTPSDTARLGPDTLLGFATAQGGPTSHTAIIARGLGLPAIVAAGAGVLEVPDGTLAILDGSAGRLYLNPSENDVQAARERMAVLTAEREAARAARHQPGGTRDGVRVEIAANINRAADAAGALDAGAEGVGLMRTEFLFLERDSAPSEANQEQEYRAMAAALGERPLIIRTLDIGGDKEVPYLGLAREDNSFLGMRGIRLCFERPDLFLPQLRAIARVAKDHPNVHVMFPMIATLEDFRRARAILDEVRAEVGAPHIPLGVMIEVPSAALLAEALAPEVDFFSVGTNDLTQYTLAMDRLHPQLARQTDAMHPAVLWLIKRTVNAAQRHGKWVGVCGGAAGDDVGALVLTGLGVKELSVSTPQVAAVKAALRGRSSQDLQQLAAQALTQTDAAAVRALVRG

SEQ ID NO: 33384 - protein, 335 aa, Streptococcus suis
VVKVGINGFGRIGRLAFRRIQNVEGVEVTRINDLTDPVMLAHLLKYDTTQGRFDGTVEVKDGGFEVNGKFVKVSAEREPGNIDWATDGVDIVLEATGFFASKEKAEQHIHANGAKKVVITAPGGNDVKTVVFNTNHDILDGTETVISGASCTTNCLAPMAKALHDAFGVQKGLMTTILGYTGDQMVLDGPHRGGDLRRARAAAANIVPNSTGAAKAIGLVIPELNGKLDGAAQRVPVPTGSVTELVATLDKKVTAEEVNAAMKAAATESFGYTEDQLVSSDIVGISFGSLFDATQTKVIEVDGEQLVKVVSWYDNEMSYTAQLVRTLEYFAKIAK

SEQ ID NO: 33385 - protein, 379 aa, Triticum aestivum
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGESRFTINGKPIFHFVGTSTFSEYTVIHVGCLAKINPEAPLDKVCVLSCGISTGLGATLNVAKPKKGSTVAIFGLGAVGLAAMEGAKMSGASRIIGVDLNPAKYEQAKKFGCTDFVNPKDHTKPVQEVLVEMTNGGVDRAVECTGHIDAMIAAFECVHDGWGVAVLVGVPHKEAVFKTSPMNLLNERTLKGTFFGNYKPRTDLPEVVEMYMRKELDVEKFITHSVPFSQINTAFDLMLKGEGLRCVMRMDE

SEQ ID NO: 33386 - protein, 263 aa, Oryza sativa
MDRYQRVEKPRNETPISENEIRITAQGRMRNYISYGMSLLEENGHDEIVIKAMGRAINKTVMVVELIKRRIGGLHQITSTESIDITDTWEPLEEGLLPLETTRHVSMIAITLSKKALDTLSPGYQPPIPAEEVRPAFDYEHEVESFPTNRGRGRGGGRRGRGRGNGPPAYDYGEEWEEEGDYYNYRGRGRGRGRRGGYGYDYGYGGRGDYYEDQGEYFEEPEDYPPLSSSVGFTGRGRGRRGGGPGPFRGRGRGRGPPPPPRR

SEQ ID NO: 33387 - protein, 178 aa, Glycine tomentella
MASSMISSPAVTTVNRAGAGTVAPFTGLKSMAGFPTRKTNNDIASIASNGGRVQCMQVWPTTGKKKFETLSYLPDLDDAQLAKEVEYLLRKGWIPCLEFELEHGFVYRENHRSPGYYDGRYWTMWKLPVFGCTDASQVLKELQEAKTAYPNGFIRIIGFDNVRQVQCISFIAYKPPSF

SEQ ID NO: 33388 - protein, 672 aa, Methanococcoides burtonii DSM 6242
MDSLIYLAPLAGIVSLAFAAFFASGVLKEGTGTKEMQDISLAIQEGAMAYLNRQYKTVAVVAIILAALMFFLLGDDSGKIVIGFIVGAAASALAGYVGMNVSIRANVRTAHAASKSLQEAMSVAFRGGAVTGLAVVGLALLGTSGFYILFGDVDLVIGFGFGASLISLFARVGGGIFTKAADVGADLVGKVEAGIPEDDPRNAAVIADNVGDNVGDCAGMGADLFETYVVTVLASMLLGSLILEQFPNAILYPLILGAVAIFASIISMFFVKVGKDGKIMKALYKGVAVSAILSMIAFYFVTDSLMGDVRLYYASLVGIIIMVLMVIFTEYYTSTSFRPVKTIAKASETGAGTNVISGLAIGFESTALPLIIIIAGILASFFVVGGATDPSMGVYGIAIAAAAMLSTTGMIVALDSYGPITDNAGGIAEMAKMPAEVRKITDALDAVGNTTKAVTKGYAIASAALGALALFADYRHKVNLEAGSLSLENPIVLVGLLIGALLPFLFTAVTMKAVGKAAFAIVNEVRRQFREIPGIMEGTAKPEYGKCVDIVTAAAIREMVIPGILAIFVPLLVGIVLGPEALGGLLIGIIVSGLLLALTMNNGGGAWDNAKKLIEDGQYGGKGSDAHKAAIVGDTVGDPFKDTSGPALNALIKVVNMIAILFSSLFIGKGLF

SEQ ID NO: 33389 - protein, 158 aa, Mycobacterium smegmatis str. MC2 155
MSGVGVPDLPEIDASSLTLAIVASTWHTEICDALLEGARKVAADAGIPDPTVVRVLGAIEIPVVAQALARTHDAVVALGVVIQGETPHFDYVCDAVTQGLTRVSLDEATPVANGVLTTNTEEQARARAGLPGSTEDKGAQAAAAALSTAVTLRELRRA

SEQ ID NO: 33390 - protein, 178 aa, Glycine tabacina
MASSMISSPAVTTVNRAGAGTVAPFTGLKSMAGFPTRKTNNDIASIASNGGRVQCMQVWPTTGKKKFETLSYLPDLDDAQLAKEVEYLLRKGWIPCLEFELEHGFVYREHHRSPGYYDGRYWTMWKLPMFGCTDASQVLKELQEAKTAYPNAFIRIIGFDNVRQVQCISFIAYKPPSF

SEQ ID NO: 33391 - protein, 182 aa, Betula pendula
MACSMISSATVAAVSRASPAQSSMVAPFTCLKSTSAFPVTQKTNNDITSIASNGGRVQCMQVWPPLGLKKFETLSYLPPLSSEQLAKEVDYLLRKNLIPCLEFELEHGFVYREHNRSPGYYDGRYWTMWKLPMFGCNDSSQVLKELEECKKAYPSAFIRIIGFDNKRQVQIISFIAYKPPGV

SEQ ID NO: 33392 - protein, 599 aa, Crocosphaera watsonii WH 8501
MALIVQKYGGTSVGSVERVQSVAQRIHRTVQQGNTVVVVVSAMGKTTDTLVNLAQEITANPSRREMDMLLSTGEQVTIALMTMALQEIGQPAISLTGAQVGIVTEAEYSRARILSIKPDRIKRHLDQAQVVVVAGFQGVSSRENLEITTLGRGGSDTSAVALAAALKANFCEIYTDVPGILTTDPRLVPSARLMEEITCDEMLELASLGAKVLHPRAVEIARNYGVSLVVRSSWSDAPGTRVVSPIPKPRSLEGLEITKAVDGVEYDGDQGKISLLRVPDRPGIAARLFGEIAHQQVDVDLIIQSIHEGNSNDIAFTVVKNILSKAEAVTEAIAPALRSTPSNPTEAEVMIETGVAKISIAGAGMIGRPGIAAKMFKTLAEANINIEMISTSEVKVSCVVAKEDGDRGIKVLCEAFDVQLSPNPVASQTVALAPPVRGVALDMKQAQIAIRHVQDKPGMAASIFGVLAENNISVDTIIQSQRCRILAGKPTRDIAFTVAQVDVEAACRALNNLSDGFDQVVIDEDIAKVSIVGAGMIGQPGVAAKFFGALAQEKINIKMIATSEIKISCVVPKEEGVKALKYVHDAFELAGVETVEVPA

SEQ ID NO: 33393 - protein, 173 aa, Flaveria pringlei
  misc_feature (63)..(63): Xaa can be any naturally occurring amino acid
  misc_feature (172)..(172): Xaa can be any naturally occurring amino acid
MASIPATVAAVAQANMVAPFTGLKANAAFPVTKKVNDFSTLPSNGGRVQCMKVWPPLGKKKYXTLSYLPNLTEAQLAKEVDYLLRNKWVPCLEFELEHGFVYRENARSPGYYDGRYWTMWKLPMFGCTDSVQVMKELQECKKEYPQAWIRIIGFDNVRQVQCISFIASKPDXF

SEQ ID NO: 33394 - protein, 173 aa, Flaveria pringlei
MASIPATVATVAQANMVAPFTGLKSNAAFPVTKKVNDFSTLASNGGRVQCMKVWPPLGKKRYETLSYLPNLTEVQLAKEVDYLLRNKWVPCLEFELEHGFVYRENARSPGYYDGRYWTMWKLPMFGCTDSAQVMKELQECKKEYPQAWIRIIGFDNVRQVQCISFIASKPDGF

SEQ ID NO: 33395 - protein, 333 aa, Vitis vinifera
MVKTIRVYELGGPEVLKWEDVQIGEPNEGEIRVKIQAIGLNFVDVYIRKGVYKIATMPFTPGVEAAGVVTAVGPGITGWKVGDVVAYAGGSMGSYSEEQILPANKVVPLPPSINPTVGASIMVKGMTVHYLVRCCFKVEPGHIVLVHAAAGGVGSLLCQWANALGATVIGTVSTNEKAVQAKEDGCHHVIIYKEEDFVARVNEITSGNGVHVVYDSVGKDTFQGSLACLRPRGFMVNFGQSSGTPDPVPLPSLGAKALFLTRPSLMHYSATRDDLLEAAGEVFANVASGVLRVRVNHKYPLSQAAQAHADLESRKTSGSVVLIPDCLWQDILN

SEQ ID NO: 33396 - protein, 180 aa, Musa acuminata
MVSSMMVSSAATFTRASPAQSSMVAPFTGLKSASAFPVTRKPNADLSHLPSNGGRVQCMKVWPIEGVKKFETLSYLPTMKDEALVKQIEYLLRSKWIPCLEFCPKGFVWRENHRSPGYYDGRYWTMWKLPMFGCTDAVQVAKEVEECKKEYPHAFIRIIGFDNNRQVQCISFIAYKPTGY

SEQ ID NO: 33397 - protein, 360 aa, Glycine max
  misc_feature (222)..(222): Xaa can be any naturally occurring amino acid
MASSLGFEFLTKKPYSPPSWASHLHPLPSHFFSLAHLPTPIHRWNLPNLPTNTELWIKRDDLSGMQLSGNKVRKLEFLMADAIAQGADSIITIGGIQSNHCRATAVAAKYLNLDCFLILRTSDLLVDQDPGLTGNLLVERMVGAHVHLISKQEYAKIGSVTLTNVLKEKLIKEGRRPYVIPVGGSNSLGTWGYIEAVREIEQQIQKGTGNVKFDDIVVACGXVHAFSVCDDPDYFHNFAQGLLDGLKAGVSSRDIVHIQNAKGLGYAMNTSEELNFVKEVAATTGVVLDPVYSGKAAYAMLKDMSENPKKWERRKILFIHTGGLLGLYDKVDQLASFVGNWQRMDVNESVPRQDGIGKMF

SEQ ID NO: 33398 - protein, 331 aa, Vitis vinifera
MVKAIRVHELGGPEVLKWEDVEIGEPNEGEICVKNQAIGVNFIDVYFRKGVYKATTMPFTLGMEAVGVVTAVGPGITGRKVGDVVAYAGTPMGSYSEEQILPANRVVPVPPSIDPTVGASIMLKGMTVHYLVRRCFKVEPGHIVLVHAAAGGIGSLLCQWANALGATVIGTVSTNEKAVQAKEDGCHHVIFYKEEDFVTRVNEITSGNGVHVVYDSVGKDTFEGSLACLRARGFMVNFGQSSGIPDPVPLPSLGAKSLFLTRPSLMQYTATRDELLEAAGEVFANVASGVLRVRVNHTYPLSQAAQAHADLESRKTSGCVVLIPDCIGTTS

SEQ ID NO: 33399 - protein, 178 aa, Zantedeschia aethiopica
MASSMMVSTAAVSRTSPAQSNMVVPFAGLHSSAAFPVTRKFADSSKLPSNGLRVRCMQVWPPEGKKKFETLSYLPPLTREQLGQEVDYLIRNGWIPCIEFCKVGFVYREYHNSPGYYDGRYWTMWKLPMFGCTDSSQVLKEVDECSKAYPDYFNRIIGFDNTRQVQCISFLTYKPEGN

SEQ ID NO: 33400 - protein, 394 aa, Rhodobacter sphaeroides 2.4.1
MRALTWHGKHDVRVETHPDPEIVNPRDAIIEVTATAICGSDLHLYDGVIPGLMSGDILGHEFMGRVVETGPKSTLKKGQRVVVPFTISCGQCFFCEHQLFSACDNSNPAEKQDLSEPLYGHAVSGLFGYSHLTGGYPGGQAEYVRVPYSDVGPIVIPDGLEDEQVLFLSDILPTGWMAAENAGIEEGDTVAVWGCGPVGLFAIQSALLMGAGKVIAIDEYPKRLALARRLGAEVIDFRRTKVLEALMEMSGGLGPDAVIDAVGMEAHGFMPDTLMDNMKQRVGIGADSGHALREAILAVRKGGRVSVPGVYGGFLDKFPLGALMEKGLTVKTGQTHVQRYTEELLRRIGEGEIDTTFLISHRLPLEEAARGYENFRFNQNEWTKVVLKPGLTGA

SEQ ID NO: 33401 - protein, 400 aa, Picea sitchensis
MACPAPTATSTPATVRSWNSQFCSNSPLASFSLAHTTRRPRRALVVCSVGPEKTVVIGLAADSGCGKSTFMRRLTSVFGGAAEPPKGGNPDSNTLISDTTTVICLDDYHSLDRYGRKDKGVTALDPRANNFDLMYEQVKALKEGKSVMKPIYNHVTGILDPAEQINPPKILVIEGLHPMFDARVRELLDFSIYLDISNEVKFAWKIQRDMAERGHSLESIKASIQARKPDFDAFIDPQKQYADVVIQVLPTELIPEENEGKVLRVRMVMKEGVNFFNPVYLFDEGSTISWIPCGRKLTCSYPGIKFFYGPDIYYDNEVSVLEMDGQFDRLEELIYVESHLSNISTKFYGEVTQQMLKHADFPGSNNGTGLFQTIVGLKIRDVYEQLISQTTGASLEAAKA

SEQ ID NO: 33402 - protein, 502 aa, Leymus chinensis
SAIPRRGLFIGGGWREPTLGRRIPVINPATEDTIGDIPAATVEDVELAVAAARSAFLLDGGSRWSRASGATRAKYLNAIAAKIKEKISYLALLETVDSGKPKDEAVADMDDVAACFEYYAGLAEALDGKQHAPISLPMEEFKTYVLKEPIGVVGLITPWNYPLLMATWKVAPALAAGCTAVLKPSELASLTCLELGAICEEIGLPSGVLNIITGLGADAGAPIASHPHVDKIAFTGSTATSKTIMTAAAQMVKPVSLELGGKSPLVIFDDVADIDKAVEWAMFGCFFNGGQVCSATSRLLLREKIAERFLDRLVEWAKNIKISDPLEEGCRLGSVVSKGQYEKIKKFISTARSEGATILHGGDRPKHLGKGFFIEPTIITDVSTSMQIWREEVFGPVICVKVFKTESEAIELANDTHYGLAGGVISDDLERCERIAKVIHSGIVWINCSQPTLVQAPWGGNKQSGFGRELGEWGLENYLSVKQVTRYCKDELYGWYQRPSKL

SEQ ID NO: 33403 - protein, 502 aa, Leymus chinensis
MASPAIPQRQLFIDGEWRAPALGRRLPVINPTTEASIGEIPSGTSEDVDAAVAAARAALKRNRGRDWSRAPGAVRAKYLRAIAAKMIERKADLARLEALDCGKPLDEAAWDMDDVAGCFEFFAGHAEALDKRQNAAVSLPENFKCHLKKEPIGVVSLITPWNYPLLMATWKVAPALAAGCTAVLKPSELASVTCLELADVCKEVGLPPGVLNVVTGLGPEAGAPLSSHPDVDKVAFTGSYATGQKIMVAAAPTVKAVTLELGGKSPIVVFDDVDIDKAVEWTLFGCFWTNGQICSATSRLLIHKNIAKEFVDRMVAWSKNIKVSDPLEEGCRLGPVVSEGQYEKIKKFISNAKSEGATILTGGVRPKHMEKGFFIEPTIITDINTSMEIWREEVFGPVLCVKEFSTEEEAIELANDTHYGLAGAVISGDRERCQRLAEEIDAGCIWVNCSQPCFCQAPWGGNKRSGFGRELGEGGIDNYLSIKQVTEYTSDAPWGWYKAPAN

SEQ ID NO: 33404 - protein, 458 aa, Pseudomonas fluorescens Pf-5
MSSGRIVQIIGAVIDVEFPRDSVPSIYDALKVQGAETTLEVQQQLGDGVVRTIAMGSTEGLKRGLDVNNTGAAISVPVGKATLGRIMDVLGNPIDEAGPIGEEERWGIHRPAPSFAEQAGGNDLLETGIKVIDLVCPFAKGGKVGLFGGAGVGKTVNMMELIRNIAIEHSGYSVFAGVGERTREGNDFYHEMKDSNVLDKVALVYGQMNEPPGNRLRVALTGLTMAEKFRDEGNDVLLFVDNIYRYTLAGTEVSALLGRMPSAVGYQPTLAEEMGVLQERITSTKQGSITSIQAVYVPADDLTDPSPATTFAHLDATVVLSRDIASLGIYPAVDPLDSTSRQLDPNVIGNEHYETARGVQYVLQRYKELKDIIAILGMDELSETDKQLVSRARKIQRFLSQPFFVAEVFTGSPGKYVSLKDTIAGFKGILNGDYDHLPEQAFYMVGGIDEAIEKAKKL

SEQ ID NO: 33405 - protein, 444 aa, Ostreococcus tauri
MMLEGHDVVAFERSRDGCGGTWRYDASAEADALGTDARRRRVHGSMYASLRTNLPREVMGFKEFPFASDKAFDGDARRFCGHSEVRAYLEAYAERFGLDAVTRFGTLVVSVERVKRANEEEENRWSSSWEVTSEDPSGVVRKEMFDAVVVCNGHYSEPRVPEFDGAETWPGERTHSHNYRIPDGFKGKKVLLIGAMASGEDLSREIASVADAVYLSARTWQNPDWAKSTEGIGARGNVYRKPNVKRFEVNGGVEFEDGSVVTDIDACMYCTGYKYRFEFISKDIVSVEDNHVAPLFEHCVSANAPSLSFIGLPWKVVPFPQFELQSIWISRMLSGAVPMPSREEALCGAADLEVTLEPKGDVPRRHAHLLGDAQFEYNDRIAKLAGVDPLGSWRQSMYKKTGLNKRLHPELYRDTSPDDDEELRGAHVEFAAVSDDEAAPHLAH

SEQ ID NO: 33406 - protein, 351 aa, Arabidopsis thaliana
MTTICDLPRDLVARILSRVPLTSMRRVRFTCKRWNTISKDPSFAKTHFGKAARQFIMMSQSRVSLMSVKLHGDGNEDELADPYIYEGYRLDVYALGYDKNLKNHKILRFVDSYEPAVKHSIIEHEIFDLKSNAWRVLDATPDWEIDSYQRGVSLKGNTYFFAKEKIVVEGDDVVVIEDFKDFLICFDFTSERFNLDHVCLYRFTLTMERPVREEQLAVLYQQDTCLMEIWVTNKIEPDVVSWSKVFLAVDMEPLTGSFIPFAFFAGSFFIDEEKKIAVVFDKDQEEINDRAYLIGENGYYKEVDLGYMNGYYQQQVDPRGPDPVFPLVCSYSPSLVTIPQGTRGKRKERDY

SEQ ID NO: 33407 - protein, 599 aa, Picea sitchensis
MVSDASKKKAAAKKAAAAVKRGSKSATAATSSKAASTDVSQNGNAERVADQLADLQISDRTCTGVLTSHALSRDIHIESLSVTFHGHELIVDSELELNYGRRYGLLGLNGCGKSTLLTALGCREIPIPDHMDIYHLTREIEATDMTSLEAVMNCDEERLKLEKEAEALAAQDDGGGEALDLLYERLESLDAATAEKRAAEILFGLGFDKKMQTKKTSDFSGGWRMRIALARALFMNPTVLLLDEPTNHLDLEACVWLEEMLKKFDRILVVVSHSQDFLNGICTNIIHMQNKKLKLYTGNYDQYVQTRTDLEENQMKQYRWEQEQIASMKEYIARFGHGSAKLARQAQSKEKTLAKMERGGLTEKVVRDKVLVFRFTDVGKLPPPVLQFVEVDFGYTPENLIYKSIDFGVDLDSRIALVGPNGAGKSTLLKLMTGELTPLDGMVKRHNHLRIAQFHQHLADKLELSVSALQYMMNEYPGIEEEKMRAAIGKFGLTGKAQIMPMENLSDGQRSRVIFAWLAWRLPHLLLLDEPTNHLDIETIDSLAEALNEWDGGLVLVSHDFRLINQVAKEIWVCENKRVTRWGGDIMDFKRHLKSKAGL

SEQ ID NO: 33408 - protein, 257 aa, Glycine max
  misc_feature (106)..(106): Xaa can be any naturally occurring amino acid
  misc_feature (180)..(180): Xaa can be any naturally occurring amino acid
MDQYEKVEKIGEGTYGVVYKARDRATNETIALKKIRLEQEDEGVPSTAIREISLLKEMQHRNIVRLQDVVHSEKRLYLVFEYLDLDLKKHMDSSPEFVKDPRQVNXILDCTRAFGIPVRTFTHEVVTLWYRAPEILLGSRQYSTPVDIWSVGCIFAEMVNQRPLFPGDSEIDELFKIFRXIIMGTPNEDTWPGVTSLPDFKSAFPKWQPKDLKNVVPNLEPAGLDLLSSMLYLDPSKRITARSALEHEYFKDIKFVP

SEQ ID NO: 33409 - protein, 482 aa, Oryza sativa Indica Group
MAAPQASPSPSAQVVGNAFVQQYYQILHQSPDLVYRFYQDASRLGRPPADRYGDMVSVTTMEAINEKIMAMDMSRAEIKTVDSQESLGGGVTVLVTGHLTVRDGVCREFSQSFFLAPQEKGYFVLNDMFRYVGDGPTPAAAAAAAVEVQPEADAVAPPLANGTATAPLQPAAPDYDGMPQEEPDVVEHAAVPPEEEEEVYNPPLEEVEGGAVEEEQSVPEVINEVPNNVVPVVAPAAAPVSHEEAPKKSYASIVKVMKEAPVPAPIPATRPAPAARPAPPKPEKQSPAPPAPAPVADATPFSSNAESSNTHEPEVDAHAIYVRSLPLNATTTQLEDEFKKFGTIKPDGIQVRSHKIQGFCYGFVEFEEATAVQSAIEASPVMIGGRQCFVEEKRTPGSRGSSRGGRFAPGRGNNNFRADGMRGRGNYSGGRSYGRGDFSYRSDYGGRGGGRGGSARGPDVGYQRVDGGRGGRTSAGPGAPAK

SEQ ID NO: 33410 - protein, 306 aa, Triticum aestivum
VGEKPAWFYAPSPLFHHHHHHCGHINLPIQAGYKFRCYFPAEFGTRVKWYFVVIAYLLAPALGFCNAYGTGLTDMNMGYNYGKVALFVFAAWAGKDNGVVAGLVTCGLVKQLVLVSADLMHDFKTAHLTLTSPRSMLVGQAAGTLMGCVVAPLTFFLFYEAFDVGNPDGYWKAPYALIYRNMAILGVEGFSALPQHCLQLCAAFFAFAVLANLARDFLPRRLGRFVPLPMAMAVPFLVGASFAIDMCVGSLVVFLWHWLDGKRAALVRSAVASGLICGDGIWIFPSSLLALAKIKPPMCMKFTPGS

SEQ ID NO: 33411 - protein, 176 aa, Glycine max
  misc_feature (2)..(6): Xaa can be any naturally occurring amino acid
  misc_feature (16)..(16): Xaa can be any naturally occurring amino acid
  misc_feature (21)..(21): Xaa can be any naturally occurring amino acid
  misc_feature (23)..(24): Xaa can be any naturally occurring amino acid
EXXXXXQYRAPEVILXAGYSXAXXMWSFACIAFELATGDMLFTPKGGQGFSEDEDHLALMMELLGKMPRKVATSGAKSKDFFDRHGDLKRIRRLKFWPLSKLLIDRYKFSERDAHEFSEFLLPLLDFAPEKRPTAQQCLQHPWLQGIESTPNEMRNESSVEKVDVGMSNLQIKVGK

SEQ ID NO: 33412 - protein, 124 aa, Zea mays
  misc_feature (13)..(15): Xaa can be any naturally occurring amino acid
KVTDNLQRWVIEXXXAPGTLYSNDTYQLQVDFPENYPMEAPQVIFLHPAPLHPHIYSNGHICLDILYDSWSPAMTVSSICISILSMLSSSTVKQRPEDNDRYVKNCRNGRSPKETRWWFHDDKV

SEQ ID NO: 33413 - protein, 465 aa, Vibrio cholerae O1 biovar eltor str. N16961
MKTFDPLSSYSPTHWRSEGDINTTAARRDWLTHVNDETTQNLLQRDANVFLHQAMSTPCLAPLASAAGCYLYDVSGKSYLDFHGNNVHQLGHGHPQVIEKITEQMQTLPFAPRRFTHETAIRCAEKLTEIAGGELNRVLFAPGGTSVIGMALKLARHITQNFKVVSLWDAFHGASLDAISVGGEACFRQGMGPLMAGVERIPPAITYRGAFPREDGSDVHYADYLEYVIEKEGGIGAFIAEAVRNTDVQVPSRAYWQRVREICDKHNVLLIIDDIPNGMGRSGEWFTHQAFGIEPDILCIGKGLGAGLIPIAALLTKEKYNTAAQVSLGHYTHEKSPLGCAAALATIEVIEQHNLLAKVHADSIYMRQRLSQMQQQFSLIGDVRGIGLLWGIELVIDRHTKQRAHDEAEAILYHCLRHGLSFKVSQGNVIQLSPPLIISRQELDQALDILYSALLAISQQMNYSY

SEQ ID NO: 33414 - protein, 145 aa, Zea mays
MEKLLKLADVTPLSPFLFVSFCVWGLRLPVAAKLKEKIEKMFKGEKINSTENRSVLHVALRAPRDAVINSDGVNVVPEVWSVKDKIKQFSETFRSGSWVGATGKPLTNVVSVGIGGSFLGPLFVHTALQTDPEAAECAKGRQLRL

SEQ ID NO: 33415 - protein, 180 aa, Triticum aestivum
MGDYTIRISTSLIEQLARDDDKQVKRRTRKPKPRKVVEQPEEPQDNGRELPTEPKSSPAPVLPFPPPMYLPVTPAPPPPSPAIQEVEAIRTVVAESEKVLEKLQKKEATMREELTKRAKELHDKEFKLPYQNPAPCTDERAGCAECYRSNVQDPLKCAEAVKRFEACVRMARRGGAAMGA

SEQ ID NO: 33416 - protein, 2111 aa, Schizosaccharomyces pombe 972h-
MAVLSSVQPINHNSALVEARDEQVNTTACSDDLLNAPPYEYDTEGNPSWAGALPKAQALYDPAYEKDSCGVGFTCHIKGQVSHKIVTDARLLLCNMTHRGATGADTRDGDGAGVMTGMPYTFMQKEFGQIGCTLPKSGEYAIGNVFFSPEADVCREAMTAFTQVAEKLGLAILAWRSVPCDNSILGPAALSREPTILQPCVVLKAAYDGEAEFDTDLFERQLYVLRKQSSHLIGKEKWFYICSLHRETIVYKGQLAPVQVYNYFLDLNNAEYVSHFALVHSRFSTNTFPSWDRAQPMRLAAHNGEINTLRGNKNWMHAREGLMKSSRFGEEFASLLPIIERGGSDSAAFDNVIELLCASGVVSLPEAVMLLIPEAWQNDKNISDEKAAFYEWAACQMEPWDGPALFTFADGRYCGANLDRNGLRPCRFYLTSDDMMICASEVGTVGIEPDRIVQKGRLYPGRMLLVDTKEGRIVDDKELKHNIASRYDFRSWLDQELIDMNSIVDSLIESTSVDLTPIVDDVPLADDKTMLAFGYTLEQINMIMAPMANGGKETLGSMGNDAAIACLSDQPRLLYDYFRQLFAQVTNPPIDPIREAIVMSLQCYIGPSGNLLEINQSQCRRLRMPTPILTVEEFNALKNVDRIYPDWKVASIDITFFKSEGVAGYAAAIERICSEADTAVNEGYKAIVLSDRNVNSERVPLASIAACGAVHHYLVQNKLRSRVALVCESGDAREVHHMCTLLGYGADAVCPYLAMEALTKLVRQNAMKPGITEETAIKNFKHAINGGILKVMSKMGISTLQSYKGAQIFEALGIDNEVINKCFLGTASRIRGVTFEHIALDAFALHERGYPTDQSIRSLQIPDMGDFYYRDGGEQHVNHPKAIASLQDAVRNKNEAAYAEFSRTHYEQTRRCTLRGMLDFDFDSSQAIPIEQVEPWTEIVRRFCTGAMSYGSISMESHSSLAIAMNRLGGKSNTGEGGEDPARSQRLANGDTMRSAIKQIASGRFGVTSWYLSDADELQIKMAQGAKPGEGGELPGNKVSESIAKTRHSTAGVGLISPPPHHDIYSIEDLKQLIYDMKSANPRARVSVKLVSEVGVGIVASGVAKAKADHILVSGHDGGTGASRWTGIKYAGLPWELGVAETHQTLVLNDLRGRVVIQTDGQIRTGRDVAIACLLGAEEWGFATTPLIALGCIMMRKCHLNTCPVGIATQDPELRKKFEGQPEHVVNFFYYVAEELRGIMAKLGFRTINEMVGRSDKLKVAEPINNKSKLLDLTPLLTPAFTLRPGAATYNVRKQDHRLYTRLDNKLIDEAEVTLEEGIPSVVECEIINTDRTLGATLSNKISKRYGEEGLPTDSIRVNVFGSAGQSFGAFLAPGVTLQLEGDCNDYVGKGLSGGRLIIYPPRVSPFKPEENMIIGNVCLYGATSGHAFISGVAAERFAVRNSGAIAVVEGVGDHGCEYMTGGRVVILGSTGRNFAAGMSGGIAYVYDMQMDFAGKINTEMVDISSVTDAAEIAFLRGLIQDHRHYTGSQVADRILSDFPRHLSRFVKVLPREYKAVLEREAAKKEEAKRLQYPKAFMPGNPIRQQIEETNAQIADVEDTLGATVKKSAPLDKLRGFMKYQRRSEHYRNPLKRTNDWKELSVRLREDELRVQTARCMDCGTPFCQSDYGCPISNKIFTWNDLVFKQQWKEALTQLLLTNNFPEFTGRVCPAPCEGACTLGIIESPVGIKSVERAIIDKAWEEGWIVPRPPAERTGRRVAIIGSGPAGLAAADQLNRAGHHVVIYERADRPGGLLQYGIPNMKLDKKVVERRIQLMIDEGIEVLTNVEVGKNGDVSLDELHKVYDAVVLASGSTVPRDLPIPNRDSKGIHFAMEFLHKNTKSLLDSELKDGNYISAKGKDVIVIGGGDTGNDCLGTSVRHGAKSVRNLELLPIPPRERAFDNPWPQYPRVFRVDYGHAEVQAHYGQDFREYSILTKSFEKDEDGNVKGINTVRIEWTKNSKGRWIMKEIRNSEEFFPADLVILALGFLGPEEQATAGMNVDRDARSNISTPTKSYETSVPGIYAAGDCRRGQSLVVWGIQEGRQCAREIDLKFQGKTFLPGDGGLVKRTVNC

SEQ ID NO: 33417 - protein, 554 aa, Schizosaccharomyces pombe 972h-
MSSSIPPRLYDMSPTESKKQEDVSETELVYPVELADATIQPSKSDDDLFDSNDFSKTYLAKSRILSNAMNEIGFGRYQWYLFFVAGFGWMSDNIWPVCTSLILMRLDEVDGPHPPAEGRAPYLTLSQNLGLLVGAMVWSLSADTIGRRWAFNLTFLFTGVFAVIAGASPNFASICVFDALWSFGVGGNLPVDSAIFLEALPSSHQWLLTVMSFWWAIGQVIANLVSWGLISNFSCPDDESVCHRADNKGWRYFLFTMGGMTLLMFAARFLVSVYESPKFYLAKGDDYKAVETIHKIARINGKTCTLTVEELYAIDRQEQEESDLDDSKSSDAKSVTQGTTNLIVEKLRKYNFEHIRQCFGSRKLAISSILVILSWAVIGLAFPLYNAFLPYYLETRGNANEPLSVAKTYRNSLIVSAIGVPGSLIAGVLVEFRIGRKGTLCLSLILTGVFLFASTTAKTSNAYLGWNCTFSFFSDIMYGVLYAYTPEVFPSKVRGTAVGLAASANRILGIFSPVIAMRANLTTSAPIFVSGALFIFAGILVVFFPYEPRGKSSF

SEQ ID NO: 33418 - protein, 427 aa, Arabidopsis thaliana
MAFAPILRRASAVKNLFSLTRLAVGSALSTRSLQTGASGDDSQSMGGYHVSPGGFMRGAVYREPNKPLTIEEFHIPRPKSNEILIKTKACGVCHSDLHVMKGEIPFASPCVIGHEITGEVVEHGPLTDHKIINRFPIGSRVVGAFIMPCGTCSYCAKGHDDLCEDFFAYNRAKGTLYDGETRLFLRHDDSPVYMYSMGGMAEYCVTPAHGLAPLPESLPYSESAILGCAVFTAYGAMAHAAEIRPGDSIAVIGIGGVGSSCLQIARAFGASDIIAVDVQDDKLQKAKTLGATHIVNAAKEDAVERIREITGGMGVDVAVEALGKPQTFMQCTLSVKDGGKAVMIGLSQAGSVGEIDINRLVRRKIKVIGSYGGRARQDLPKVVKLAESGIFNLTNAVSSKYKFEDAGKAFQDLNEGKIVSRGVVEIL

SEQ ID NO: 33419 - protein, 697 aa, Synechocystis sp. PCC 6803
MTSSLYLSTTEARSGKSLVVLGILDLILKKTTRIAYFRPIIQDPVNGKHDNNIILVLENFRLQQTYTDSFGLYFHEAVSLASDGAIDQVLDRILAKYRHLADQVDFILCEGSDYLGEESAFEFDLNTTIAKMLNCPILLLGNAMGNTIADSLQPIDMALNSYDQESCQVVGVIINRVQPELATEIQAQLEQRYGDRPMVLGTIPQDIMLKSLRLREIVSGLNAQVLSGADLLDNLVYHHLVVAMHIAHALHWLHEKNTLIITPGDRGDIILGVMQAHRSLNYPSIAGILLTADYHPEPAIMKLIEGLPDAPPLLLTSTHTHETSARLETLHPALSPTDNYKIRHSIALFQQQIDGEKLLNYLKTIRSKGITPKLFLYNLVQAATAAQRHIVLPEGEEIRILKAAASLINHGIVRLTLLGNIEAIEQTVKINHIDLDLSKVRLINPKTSPDRERYAETYYQLRKHKGVTLAMARDILTDISYFGTMMVHLGEADGMVSGSVNTTQHTVRPALQIIKTQPGFSLVSSVFFMCLEDRVLVYGDCAVNPDPNAEQLAEIALTSAATAKNFGIEPRVALLSYSSGSSGQGADVEKVRQATAIAKEREPDLALEGPIQYDAAVDSTVAAQKMPGSAVAGKATVFIFPDLNTGNNTYKAVQRETKAIAIGPILQGLNKPVNDLSRGCLVEDIINTVVITALQVK

SEQ ID NO: 33420 - protein, 223 aa, Buchnera aphidicola str. APS (Acyrthosiphon pisum)
MNLNKLKKKAAWAALDYIDPGTIIGVGTGTTIFYFIEALGTIKNLIYGAVSSSNSSTVLLKKHGIEVFDLKNFSSLAIYVDSADEINNHMQMIKGGGGALTREKIIASMSKKFVCIIDKSKKVDVLGTFPLPIEIIPMALSYIFREMIKIGGTPKYRKNVITDNGNIIIDVYNLCIKDPISMEKKINSLPGVVTVGLFASRSADIVLIGTQKGIRTINKKENR

SEQ ID NO: 33421 - protein, 434 aa, Buchnera aphidicola str. APS (Acyrthosiphon pisum) [sequence omitted]

SEQ ID NO: 33422 - protein, 363 aa, Arabidopsis thaliana
  misc_feature (298)..(298): Xaa can be any naturally occurring amino acid
MEIDSATNGNSDTVMTDSAATITPSPVVVSSSRSNQFTESLKLEHQLLRVPFEHYKKTIRTNHRSFEKEVSTIVNGVGELADSDWSKDDTVSRLTCLVTRLQGLKRKLEEGSNVENLQAQRCRARIDHLDSVDVENITEWNNTKLKRILVDYMLRMSYFETATKLSESSNIMDLVDIDIFREAKKVIDALKNREVASALTWCADNKTRLKKSKSKFEFQLRLQEFIELVRVDTAESYKKAIQYARKHLASWGTTHMKELQHVLATLAFKSTTECSKYKVLFELRQWDVLVDQFKQEFXQVIWHDDGTLIEHLLTGRLVCAENSIWFRRRLYQRGPSLTRELSEASFAFTVLQAAPFKACLLYF

SEQ ID NO: 33423 - protein, 161 aa, Buchnera aphidicola str. APS (Acyrthosiphon pisum)
MRIGYGFDLHAFGSTKPLIIGGVLIPCEKGLIAHSNGDLLIHSLIDALLGATAMGDIGSFFPSNNYIYKNIDSRILLKKIWNKIILLNYDICNIDITIIAEYPKMLPYIFFMRSNLSLDLNTEIDNISIKSTTSKKIGCIGRKEAIACHSIVMLIKNKKCI

SEQ ID NO: 33424 - protein, 369 aa, Zea mays
  misc_feature (148)..(148): Xaa can be any naturally occurring amino acid
  misc_feature (154)..(154): Xaa can be any naturally occurring amino acid
  misc_feature (274)..(274): Xaa can be any naturally occurring amino acid
MAMLCRTTRGRRVPGRPPRLLSFSPVTENQCSFGSRFAAPVPSRRKVCGLGPAAAARRLSAAEAFAACEGSLLRPLPGLDLPPCLPDNLSRSPTRITTLPNGLRVATEDVPCGLILKLIYGARLRQGPSACIGFFVDSGSIYESGETXGVSHLXLERMAFKDTKHRSHLNIVSELELAGGNVGASASREQMVYSYDTLKGYMPEALEILIDCMRNPLFLQEEVERQLVLAREEVNELQKNPEKFLHEQLNLVGYSGALANPLIAPEDALARINXKIIQKFYHENFTADRVVLAASGVDHEHLLGYVDLLLKDWHKGTPMEKPKSTYVGGDSRHRADLDMTHVALAFEVPGGWLQERDATIMNVIQIDVS

SEQ ID NO: 33425 - protein, 807 aa, Cytophaga hutchinsonii ATCC 33406
MHIIQPLYMKIILSVSIFLISVFSAFSQDCWKMVAKGSDHTIAVRQDGTLWSWGQNMYGQLGDGSGYSSIIPVQVGTLTTWDKVFAKYDNSFAIMKDGTLWAWGMNSLGTLGDGTEQVRKTPVKVGTATDWQSVETNFNFTAAIKKDGSLWIWGDNYNGQLGNGTKVKNIIPSKVGSGKNWKSVSIGSSNILAIKTDGTLWGWGNNYYNQIGYTPTVDVLSPTQIGSETDWKSVSCGDDHVMAIRTNGSLWIWGSNKEGQIGNGEINSYQTEPVQVGSDTDWGTCHAIQDWSIAIKTNGSLWTWGSGYGYYNSSYIRKNIPTQFGRDTDWSMIYPSEQQSVAFKTDGSLWTWGSNARGQLGLGLYGNTNIPYMVSCPEVLTSSCWQAASIVQSTSFGLRTDSTLWKWGWGNENSLDIYARNDPGFARIGTYKWRAYASGGALLAIKDDGTLWQSGGRNVPVLLSSSKDWKAVAASSSRGYAIKTDGSLWGWDIDNYTNNTEPSGGVIPLLKEINPGTQWQSISASTTTAAAIRDDGSLWIWGSALYGAMGTGIAVAGSPTLIQMGNDTGWQFVSVGESTTMAIKTDGTLWACGQNNYGQLGNGNTTDIYTLTQIGTATDWKTVVAGPYHTLAIKTDGSINGWGSYTYNKLGLGYDLYGNLLEQNWKHIATGPYNSFAIHGDGTLYTVGDNEYTQLGSQNYRSNGPVKIECIIAEDTDPVITSTNDKTTQATEQKYMVYPNPNNGSFTISGSKNSDVYIYNIEGHLEKFTTMSDLKEQIQIDLIQGIYYIIVVDEAGNSSRQTFIVHQ

SEQ ID NO: 33426 - protein, 362 aa, Streptococcus thermophilus LMG 18311
MAKRLLILEDGTIFEGQAFGADVDVTGEIVFNTGMTGYQESITDQSYNSQILTFTYPLVGNYGVNRDDYESITPTTKGVVVSEASRRASNWRNQMTLDEFLKAKNIPGVSGIDTRALTKIIRQHGTMKATLAKPGDSIEHLQDQLRATVLPTNNIEQVSTKTAYPAPGIGKNIVLVDFGLKHSILREFSKRDCNVTVVPHDITAEEILHLNPDGVMLSNGPGNPEDVPHALDMIRGIQGKIPIFGICMGHQLFSLANGAKAYKMKFGHRGFNHAVREIATGRVDFTSQNHGYAIDRDTLPECLMVTHEEINDKSVEGVRHRDFSAFSVQFHPDAAPGPHDASYLFDEFLELIDAFQAENARR

SEQ ID NO: 33427 - protein, 390 aa, Picea sitchensis
MAERPKYPSVVQKMSCQTYLGSRITPSWQVRQNGALQPFKYDGALSAPVQSYGGLQSAFLHASRASNVALAPGHSPVFIPAPAEKGFKGFMIDFLMGGVSAAVSKTAAAPIERVKLLIQNQDEMLKSGRLAEPYKGIGDCFGRTIKDEGFIALWRGNTANVIRYFPTQALNFAFKDYFKRLFNFKKDRDGYWKWFAGNLASGGAAGASSLLFVYSLDYARTRLANDSKAAKKGGERQFNGLVDVYKKTLKSDGVAGLYRGFNISCVGIIVYRGLYFGMYDSLKPVVLTGDLQDNFLASFLLGWGITIGAGLASYPIDTVRRRMMMTSGEAVKYKSSLDAFNQIVKNEGTKSLFKGAGANILRAIAGAGVLAGYDQLQLILLGKKYGSGGG

SEQ ID NO: 33428 - protein, 463 aa, Vitis vinifera
MASIQFLLNNTLPSASDLRHSFSGLSGSSNGGRAIACVKVGVQAPGSGDSGKMGFRGASKEVMEAEGRLMVGTYARAPVVISHGEGCKLYDAEGREYLDMTAGIAVNALGHGDPDWLKAVVEQANTLTHVSNMFYSIPQVELAERLVSCSFADRVFFSNSGTEANEAAIKFARKFQRFLHPDQKQLATEFISFSNSFHGRTMGSLALTSKEYYRSPFEPVMPGVTFLEYGNIHAARELIQSGKIAAVFVEPIQGEGGIYSATKEFLQSLRSACDDAGSLLVFDEVQCGLGRTGYLWAHESYGIFPDIMTLAKPLAGGLPIGAVLVTERVASAIKYGDHGSTFAGGPLVCKAAVAVLDKISKPTFLDSVSKKGQYFKELLMQKLGGNPHVREVRGLGLIVGIELDVPASPLVDACRNSGLLILTAGKGNVIRIVPPLIISEEELELAAEILLKCLPVLDKTKSK

SEQ ID NO: 33429 - protein, 442 aa, Burkholderia pseudomallei K96243
MTEHVSQTPDLSAFWMPFTANRQFKEAPRLLVAAKGMYYTSHDGRRILDGTAGLWCVNAGHGRDEIVAAVQAQAEEMDFAPTFQMGHPKAFEAATKIARHTPGDLKHIFFTNSGSEAVDTALKIALAYHRARGEGQRTRFIGRERGYHGVGFGGISVGGIAPNRNAYSGALLPSVDHLPHTLNLKEAAFSKGQPAWGAQLADELERLVALHDASTIAAVIVEPVAGSTGVLIPPRGYLERLRELCDKHGILLIFDEVITGWGRLGAPFAAQFFGVTPDLLTMAKGTNNAAVPMGAVAASGAIHDAIVGGAPAGIELFHGYTYSGHPLAAAAAVATIDLYEREGLLTRAARIAPIFEREIHKLKDARHVIDVRNLGIVGGVELTPRDGKPGARAYEVFVKCFEKGAMIRYTGDILAFSPPLIVEEAQIVELFSIVAQALKETE

SEQ ID NO: 33430 - protein, 352 aa, Picea sitchensis
MHICRMAAATLQPARATTQAYNAHINISCFNDLPSTGSLPSLKRKSLTYDLIAIIKPVALVTGRKNGRTCSISAQASPVLDPVLSSSKNSNDPPKKSSEAALILIRHGESLWNEKNLFTGCVDVPLTQRGVEEAVEAGKRISNIPVDAIFTSALVRAQMTAMLAMTQHRRKKVPVIIHNESEQAKGWSTIYSEDTKKQSIPVITAWQLNERMYGELQGLNKQETADRFGKEKVHQWRRSYDIPPPNGESLEMCAERAVAYFKEQIVPQLDCGKNVMIAAHGNSLRSIIMYLDKLSSQEVISLELSTGIPMLYIFKEGKFMRRGSPIGPSEAGVYAVTKNLALYRQKLDDMIH

SEQ ID NO: 33431 - protein, 343 aa, Picea sitchensis
MPSARFSMWKKDKAMITRQSMLCIIRVIFAVTISVLLLLLFVAVKPLSICYDAKVSLKDFHIMKQPRTYAGSKENIEKFDCMRCPQAAPVVANKVEGVRHPFFISLADLGSPEKPNRNFLRMLKGKPFRKPDISQTVQEVLEKLESNGLASKRGTVVDVGANVGMAAFAAAAMGYKVVAFEAVFENLQRLCDGMYLNRAGDVVSFYHAAVSDVPGNLTMHKVVGRLDNSAVSVTGAKLAFKSNEIVPVSVRSITLDTVIPEFEPVILLKIDVQGWEYHVLKGASRLLSRVPGDAPYIIYEDDEKLLQESNTSSKEIRDFLVSMGYSSCTRHGTDTHCKKERTT

SEQ ID NO: 33432 - protein, 412 aa, Magnetococcus sp. MC-1
MQISQTVQNAHQALSIFINQMIYDLKHLGEDVTVLSLGESFFEMEMDDFSQLDLEKINHYSDSQGIPALRKKLAHYYQSRYRVTVNPDQELIISVGAKSLIYMAMLATLEPGDDVLIWEPAWLSYPEQAKLVHAKPRFIPYDLPVEQLDTLFTDKTRMVVLCNPNNPSGRVYNRAELQRIHTTCAQAGAWLLVDEVYSDFVLDEPFVSLGELVPDFNHLIIINSLSKNLGISGWRIGYAIGPEPLIAALLRINQHVITCTGTPLLHYCNHYFDKLVNRALPQVEAVMHRRKRIKGMLQELGLDEMAGSATFYHFVHLGDYPGNAFAFAAQLLLDHHISVVPGYAYGENVDRFIRISIGWESEERIWLALQSIKNVITGPAPDPRQLRQRLLALPSVLSNVGFKEVVDEGLQR

SEQ ID NO: 33433 - protein, 526 aa, Physcomitrella patens subsp. patens
MATKSSISHILGNTPDDGRLKIAKTKIICTLGPKSREVPVLEKLLRAGMNVARFNFSHGTHEYHQYTLDSLRQACINTQTMCAVLLDTKGPEIRTGNLASGKPIQLKRGEEILITTDYSHLGDENMIAMSYQRLPVDVKPGNTILCSDGTIALSVLECDAEKGVVKCRCENTAMLGEKKNVNLPGVIVDLPTITPKDRDDILNWGVPNKIDFIAASFVRKGSDLIQIKQLLGEASKNIHIISKVENQEGLVNFDDILRESDGVMVARGDLGMEIPTEKIFLAQKMMIYKCNSAGKPVVTATQMLESMIKSPRPTRAEATDVANAVLDGTDAVMLSGETANGLYPELAVAVMSQICQEAEASLDYASIFKETMKSVPLPMSPLESLASSAVRTANKVCASLIIVLTRGGTTARLVAKYRPCVPILSVAVPVMTTDSLTWTCSEESPAHHSLVVRGLIPLLAEGSARSTDSESTEVILNAAIKYALRRRLCLVGDSIVALHRIGVGNVIKIMEVKDVKYYARMSTIHR

SEQ ID NO: 33434 - protein, 505 aa, Oryza sativa Indica Group
MAASLAWLLLALLLASLYTATHRIAAARRRLPPGPTPLPLVGNLLSVSRTSPHRSLARLAARYGPLMRVRLGVVDYVVVSSPAVADDIYHSRHNAHLSSRPPYDAWWGEKHRLNSVIALPPHAVWRAQRRLAMEEVMSPGRLDALAPLRREKVRELLVRVRRVAAARGDGDGELVPVEVGQAAFEGFLSILSSTMVSVDLADSDLRDVVREAAILAATPNVSDIFPAIAAADLQGYRRRMGELVARGYGIFEELLARRKGGREAGERRKDDLLDVVLDREDELKKESNPVLDRNAIKGLITDLMVAGTDTSSSTIEWAMAELLQNSESMQKVKDELRRVIGTRTQIEESDISHLPYLQAIIKETLRLHSNVPMSYYMAEATVEVQGYTIPKGTNIIVNIWAIHHQPNVWVDPDKFMPERFIGKDTNFFGKHPELIPFGGGRRICLGLPLAYRMVHVVLASLLFHFDWKLPEGAKKDGIDMSEKFGLVLSMATPLKALATRSCNDM

SEQ ID NO: 33435 - protein, 259 aa, Corynebacterium glutamicum
MARKPLIAGNWKMNLDHQQAIGTVQKLAFALPKEYFEKVDVAVTVPFTDIRSVQTLVEGDKLEVTFGAQDVSQHESGAYTGEVSASMLAKLNCSWVVVGHSERREYHNESDELVAAKAKAALSNGISPIVCVGEPLEIREAGTHVEYVVEQTRKSLAGLDAAELANTVIAYEPVWAIGTGKVASAADAQEVCKAIRGLIVELAGDEVAEGLRILYGGSVKAETVAEIVGQPDVDGGLVGGASLDGEALPKLAANAASVA

SEQ ID NO: 33436 - protein, 475 aa, Ashbya gossypii ATCC 10895
MSDEQEPLLKEETNGAPLEMRTVVSGTAVVPAIPGNPDSLMPTGIPECSSTISSAIAETPIGSSGSATGNTATTLLLADNKGHKSYMQKAGVSISAPVRSGPKVITGSRVGPQRTSRTAQKLKLLPEEPFQRSQEQEDDSVDREVYSQVNRITDKPARRDAEKLGKSHRHLLPRVTAYCTASSYNMKELVRWLKDCKRTHHTHPKLFDECLYTPFIYTDWRGDKRFEHEDVIRLDDEGGEINVSDKQPDLFIFEYGVVVMWGFTEREEKAFLNDLERFEKEKLAEEDVQVEEFNYYITQSYQPRIYNDFITLRDGSNYMIKLSISHAISQSVKISLFEELVDNTIEDTQDIPQEIASSGKVSMSKADIMKSIGELFILRININLHGSVLDSPEIMWSEPQLEPIYQATRGYLEINQRVALLNQRLEVVSDLLQMLKEQLGHSHEENLEFIVILLLGVEVLISVVNIIVDIVADTK

SEQ ID NO: 33437 - protein, 513 aa, Triticum aestivum
  misc_feature (121)..(121): Xaa can be any naturally occurring amino acid
  misc_feature (137)..(137): Xaa can be any naturally occurring amino acid
  misc_feature (149)..(149): Xaa can be any naturally occurring amino acid
MDMERVTIHTAACFTIAFVVLTTIISKIIARIRTVHLVRKGERSPITLRPPHVVSGAPLMAALLTLVTPKKGLHAAIHELHMKMGSVFTVNLFGLKKVTFLVGPEVTPHFFKGSPSDIDFXDTAKIIVPVLGPGVLXGVDMATRNEQIXFCTKAIQPARLRRDVHSMVCEVEDYFAKWGQSGTVDLKHELGHLIVLIANRCLLGNEIKGNNLEEVSRLLHELFENSFHMISLFFPHLPIPPHRRRDEARARLGEILHEIVRSRRRISPARVMDSNDDDEGDVLQSFIDSKYSDGRSMTESEIVGLLIAILFAGQHTSSSTSTWTGACLLSNQKYMTAAMKEQKKIIEQNGEPIDYTILSKMDALRCCIKEALRLYSPTPLLLRHAHKSFTVQTRDGMEYEIPEGHALACSIVVSNKMPYIYKNPNVYDPCRFSLGREEDKTSGKFSDISFGAGRYSCLGQDYAFMQIKVIWSYLLRNFELELISPFPELENDKILPGPRGKVMVAYRRRSIVN

SEQ ID NO: 33438 - protein, 304 aa, Bradyrhizobium japonicum USDA 110
MTQAAANTASLSWYEASARQRIDALVDAGSFSEYIGPELREISPHLSIFDLPEQFDDGIVIGRGRLEGSPVLVAAQEGRFMGGAFGEVHGAKLTGLLRAARTLKHDVLILFDTGGVRLQEANAGELAIAEIMRAVVEARRAGINVVGLIGGRAGCYGGGSLIAGTCSRLIVSEQGRISVSGPEVIETNRGIEEFDSRDRALVWRTMGGKHRYLIGGADMFVDDEALAFREAAIDALKIKRGCDTSALAAEQERLERRLLRFGEAEDAVQIWQALGIDAPTEIPALPTDAFLRAADTRENADDAR

SEQ ID NO: 33439 - protein, 394 aa, Vibrio cholerae O1 biovar eltor str. N16961
MPFFFYNFVKNQKEMLMKRLFAWGAPLFALVALTLSLFSQADTKPSTIDSTSANYQQATLAGGCFWCTESDMEKLPGVVDVISGYAGGDVDNPTYKQVSSGKTGHIEVIQVTFDPKIVTYEQVLDNFFRHIDPTDDQGSFVDRGEQYRPAIFYHNAEQLEVAKRFMMEIDQLGIFKKPLKTELIEFKKFWPAEDYHQDYYKKNKVRYNYYRYASGRDQYLDEIFGADRNTHPKTLRQWIDEKNGQANVKAYVRPSDEQIRAKLTSLQYKVTQRDGTERPFDNEYWDNKEEGIYVDIVSGEPLFSSTDKYDSKTGWPSFTQPLNSSYIVTKDDNSLFYTRTEVRSRFADSHLGHVFNDGPAPTGLRYCMNSAAMRFIPKQEMAAQGYGEYLALFK

SEQ ID NO: 33440 - protein, 377 aa, Chrysanthemum x morifolium
MAIDCMIKTTSNMPSLKEDQRKSFLFDASVLKHETNIPQQFIWPDHEKPNSQKSKELEVPLIDLGGFLSGRSSSANDASSLVGEACQKHGFFLVVNHGVDANLISDAQRYMDLFFELPLSVKQRAQRKVGESCGYASSFTGRFSSKLPWKETLSFRFSAEENASNIVKDYFENTMGEEFIRLGKVYQEYCNAMSRLSLGIMELLGMSLGVSRAYYKDFFEEHNSIMRLNYYPPCQKPDLTLGTGPHCDPTSLTILHQDNVGGLEVFVDNEWRLIVPNSNAFVVNIGDTFMALSNGRYKSCLHRAVVNSKTTRKSLAFFLCPKKDKVVIPPKELVDENNPRIYPDFTWSTFLEFTQKHYRADKNTLQAFSTWVRQKTT

SEQ ID NO: 33441 - protein, 111 aa, Oryza sativa Indica Group
MSNKATDSSQLIEQKFAMAKQSSHEAAIAGLKAAAVTAVCTAIPTFASVRMSKWAKANLGNPVAKTVIITYAAGMAYFIAGEKKVVELSRKHSLEAAKARAKSEYTLTKSN

SEQ ID NO: 33442 - protein, 273 aa, Streptomyces anulatus
MPQQADLELAMRLADTADRITTRRFQARDCGYARKPDRTPVTDADTTVEAAVRESVRAARPDDDFAGEETGGEVTAGRTWIVDPIDGTKNFLRGVPVWATLIALLEDGRPTVGVVAAPALRSRWWAAAGHGAWLRRGSAGAEPLRLHVSGVARLENAYLSTTNTRTWDAFHSRAAYLRLADACWEDRAFGDFLQHCMVAEGTVDIAAEPVVSPWDIAALQILVEEAGGVCTDLLGGSPQRGTGALSANPELHRLAVEALAAPAAATTGAATIP

SEQ ID NO: 33443 - protein, 254 aa, Vibrio cholerae O1 biovar eltor str. N16961
MMVDILSDAEMLRYNRQIILKAFDFEGQEKLKQSTVLILGAGGLGCASGQYLATAGIGHITLVDDDVVELSNLQRQVLHHDADIGRAKVDSAADSLRLLNPHLQVETIQARLSDDELDALIARHDLVLDACDNVGTRNQLNRLCFKHKTPLVSGAAIRMEGQVSVFTYQDPAQPCYQCLSALFGSSALSCVEAGIMAPVVGIIGAVQAMETIKVLTELGTPKQGKILILDAMSMSWREMNLMQLPQCPVCHPQS

SEQ ID NO: 33444 - protein, 239 aa, Schizosaccharomyces pombe 972h-
MKLNISYPANGTQKLIEIDDDRRLRVFMEKRMGQEVPGDSVGPEFAGYVFKITGGNDKQGFPMFQGVLLPHRVRLLLRAGHPCYRPRRDGERKRKSVRGCIVGQDLAVLALAIVKQGEQDIPGLTDVTVPKRLGPKRASKIRRFFNLSKEDDVRQFVIRREVVPKKEGKKPYTKAPKIQRLVTPRTLQHKRHRFALKRRQAEKNREEAAEFAQLMAKRVAEAKQKKEVVKARRASSMKK

SEQ ID NO: 33445 - protein, 177 aa, Oryza sativa Indica Group
MAVAVVEGVGRKVAVAGDGDEVVARVSMITKMKDDRIGIQVSVRQNKQRDGGCHGEQAERVKKKLMSAVTRAYLDQKLALAKRCSREATLAGAKAATVASAVPTLASVRMLPWAKANINPTGQALIICTAAGMTYFVAADKKILSLARRHSFENAPEHLKNTSFQGTGHPHPPFFRP

SEQ ID NO: 33446 - protein, 568 aa, Kineococcus radiotolerans SRS30216
MEIKALSPQARADALREMAEGELDVLVVGGGVVGTGAALDAVTRGLRTAMVEARDWASGTSSRSSKLIHGGLRYLEMLDFALVHEALSERGLLRNKLAPHLVRPVPFLYPLSKRVTERPYVGSGVALYDAMAISGGNNKGFPLHRHLTRKGVQREAPGIRKDAMVGAIQYYDGQVDDARHTMTIARTAATYGALVANRTRVKEFVREGERVVGAVLVDLESGAEIRVKAKQVINATGVWTDETQELVNARGQFKVRASKGIHLVVPRDRIQSKTGVILRTEKSVLFIIPWGRHWIIGTTDTDWTMDKAHPAATSADIDYVLEHANSVLKSPLAREDVQGVYAGLRPLLSGESESTSKLSREHVVGHPVPGLVVVAGGKYTTYRVMAKDAVDVAVEGLDGKVPASTTENVPLVGAEGYHALWNQRHALAARAGIHVDHVEHLLNRYGSAIDEVLALIVADPTLGEVLPHADEYLKAEVVYAATHEGARHLDDVLARRTRISIETYDRGTETAELAADLVAGPLGWDDERRATEVRTYLQRVAAERASQEQPDDASADAVRLQAPEIVPV

SEQ ID NO: 33447 - protein, 404 aa, Oryza sativa Indica Group
MLSHWLHSMIKVFLNNQCKEGKLEHCNLHYNIALVSVKYRALRPLNTSFDCKSSRVVAVGRCFNSGTLMATSGRLVPWTGTLDCQFLACSTCKITKLKYGHGKVLWNMNLTAGIGSPLVNLDGNVIGMNFYDTRIGTPFLLWEEICKILASFETKSESSGDIGNASGACFWKMPRDVKNKVNRWSVPKPRWCRPEDAESDDDDKLAFDDTGQLQYSYILGRKVKLLRLTIPISVPIVEAKSTDEPGVDPFAQRKQKKKRVEKQGKNRLENLKKAAKVGALPSHIQLAATSLPITGTKADLPKKSRKEDLENVAGMGSATASGGKFDEKLPGEKPPKHPGKHKKFIPVAEGEGMGNLGKQQNDKILMSLLARNSEQLDVRKASSRIQWSILNCVLPTIIGTACSV

SEQ ID NO: 33448 - protein, 521 aa, Solanum lycopersicum
MAASIGALKSSPSSHNCINERRNDSTRAISSRNLSFSSSHLAGDKLMPVSSLRSQGVRFNVRRSPLIVSPKAVSDSQNSQTCLDPDASRSVLGIILGGGAGTRLYPLTKKRAKPAVPLGANYRLIDIPVSNCLNSNISKIYVLTQFNSASLNRHLSRAYASNMGEYKNEGFVEVLAAQQSPENPDWFQGTADAVRQYLWLFEEHNVLEYLILAGDHLYRMDYEKFIQAHRETDADITVAALPMDEKRATAFGLMKIDEEGRIIEFAEKPQGEQLQAMKVDTTILGLDDKRAKEMPFIASMGIYVISKDVMLNLLRDKFPGANDFGSEVIPGATSLGMRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETDAERKLLAAKGSVPIGIGKNCLYKRAIIDKNARIGDNVKIINKDNVQEAARETDGYFIKSGIVTVIKDALIPSGIVI

SEQ ID NO: 33449 - protein, 494 aa, Sphingobium yanoikuyae
MAHENIPAVTDTILNFIGGDYRRGSTGKTFDNFAPATGLRIGTVHEASEADVADAVAAAKAALNGPWGKMTTAERVKLISAVATEIERRADDFLAAEVADTGKPRHVASHIDIPRGAANFRMFADVISTTPTESFATATPDGGQALNYVVRKPKGVIAVICPWNFPLLLMTWKVGPALACGNTVVVKPSEETPRTAALLGEVMNAVGMPEGVYNVVHGFGAGSAGEFLTSNPDIDAITFTGETGTGQAIMQKAAVGVRDISFELGGKNPAVVFADADLDKVVEGLSRSVFLNTGQVCLGTERVYVERPVFDEFVKRMTVAAKAFKPGATGDPAYLGPLISAEHQEKVLGYYARAVAEGATVVTGGGVPALSGDETGGFYVEPTLWTGLAHDSSVMREEIFGPCCGVIPFDSEDEVIGLANDTDYGLCATIWTENLSRAHRVAASMQVGVCWVNCWFLRDLRTAFGGSGHSGIGREGGVHSLEFYTETENICVKL

SEQ ID NO: 33450 - protein, 531 aa, Oryza sativa Japonica Group
MMSTQLRSRAKQSTSNTSVATYRRSPCTTPAPRMRSLSATTTRRPWRTGWRGRPMRWASLVVMKLCVEAGVNKGHHLLGRDTRHEAHRASAIDTENRVERDVWFIGVVCVVPFAEISRGVVVLKRPCLQRSGNSAGERQRNWCPGTSQGHGLLEILGLLELDIDADVVGEPRCEELNLLAVGEEVGRAATQRQKALLVRRHRANLSEMLEFTQGIVADRRSILTVTELLERIPIRRTHVLLIMEVPFLCSSSEMTRKRPSTDFMETIQKDVNPSMRAILIDWLVEVAEEYRLVPDTLYLTVNYIDRYLSGNEINRQRLQLLGVACMLIAAKYEEICAPQVEEFCYITDNTYFRDECWNESNSNNSLIAYNRRFVRVAQVSDELFIVQDPALHLEFLANYVAELSLLEYNLLSYPPSLVAASAIFLAKFILQPTKHPWNSTLAHYTQYKSSELSDCVKALHRLFSVGPGSNLPAIREKYTQHKILHAADVIDLNMANAFKNVKILCQCPCQCNLLEEVMLKLFPYWKLSTAV

SEQ ID NO: 33451 - protein, 360 aa, Mycobacterium sp. MCS
MATEDPLRLGVVAGDGIGPEIVSAAVQISERALAAVSVPVDWRRLRMGAEAITAEGTPLPEATLAELDRLDAWLLGPHDNAGYPAPFRDALSPGGTIRKRYGLYANIRPARRLSGAIPAVCPTLDVVVVRENTEGFYSDRNMYDGPGEFMPTADVAMAVAVFTREACERIAHQAFRLARTRRRSVTVAHKANVLSKTTGLFRDSCVRVAEQYPDVTVRLEHIDALAALLVARPAEFDVIVAENMFGDILSDLTGQLAGSLGMAPSVNLSDTKAMAQAAHGSAPDIAGHNIANPVAMILSTAMLLEWLAERHHRGALAGAATRIRDAVCRSLDDGVHTPDLGGAATTTGFTEHVLSVLASA

SEQ ID NO: 33452 - protein, 454 aa, Oryza sativa Japonica Group
MSSNLAASRRSSSSSSVAAAAAAKRPAVGEGGGGGGGKAAAGAAAAKKRVALSNISNVAAGGGAPGKAGNAVRDGSLVGGLGSFFFLFSKALFFARFGFEIFRSFVSPMHSGDSVSVDETMSTCDSMKSPEFEYIDNGDSSSVLGSLQRRANENLRISEDRDVEETKWKKDAPSPMEIDQICDVDNNYEDPQLCATLASDIYMHLREAETRKRPSTDFMETIQKDVNPSMRAILIDWLVEVAEEYRLVPDTLYLTVNYIDRYLSGNEINRQRLQLLGVACMLIAAKYEEICAPQVEEFCYITDNTYFRDECWNESNSNNSLIAYNRRFVRVAQVSDELFIVQDPALHLEFLANYVAELSLLEYNLLSYPPSLVAASAIFLAKFILQPTKHPWNSTLAHYTQYKSSELSDCVKALHRLFSVGPGSNLPAIREKYTQHKIYAADVIDLNMMIQRDS

SEQ ID NO: 33453 - protein, 384 aa, Gibberella zeae PH-1
MSTAGKTITCKAAVAWEAGKPLSIEDIEVAPPKANEVRIQIYYTGVCHTDAYTLSGKDPEGAFPIVLGHEGAGIVESIGEGVTNVKVGDHVVALYTPECKECKFCKSGKTNLCGKIRATQGKGLMPDGTSRFKCKGKDLLHFMGTSTFSQYTVVADISVVAIEHDAPMDRTCLLGCGITTGYGAATITANVQAGDNVAIFGAGCVGLSVVQGAAARKAGKIIVVDVNPSKKEWGEKFGATDFVNPTELGDQSIQDKLIEMTDGGCDYTFDCTGNVGVMRAALEACHKGWGESIVIGVAAAGQEISTRPFQLVTGRVWRGCAFGGVKGRSQLNDLVADYKKGDLKVDEFITHRKTLGEINNAFDTMKQGDCIRAVVDMQKLEPKI

SEQ ID NO: 33454 - protein, 569 aa, Buchnera aphidicola str. APS (Acyrthosiphon pisum)
MNKKFKKIVTEKKLTDAERIKENSNYLRGTITDDLKNEITNGFTGDNFSLIRFHGMYQQDDRDLRIERNEQKLEPRYAMMLRCRLPGGVIKAKKWLKIDYFASKYTLYGTIRLTNRQTFQFHGILKKNLKDVHKMLHSIGLDSLATANDVNRNVLCTSNPMESLIHQEAYEWARKISNFLLPHTKAYAEIWLDQKKIVTTEKEPILGKTYLPRKFKTTVVIPPYNDVDLYANDMNFVAITKNEKIIGFNILIGGGLSFIHGNKNTWPFLATEIGYISVENTLSIAKAIVTTQRDWGNRTDRANAKTRYTINNFGLNEFKKEIEKRANVNLKPVREYSFISRGDRFGWIKDINNNWSLTLFIQNGRIYDDNDKLFKSGLLKIANIHDGNFRITSNQNIIISEVSEKNKNKIEKIALSSGLINKSTNLRKNSMACVSFPTCPLAMAEAERMLSFFITQLENIMLKYGVEDEVIILRVSGCPNGCGRSLLAEIGLIGKSIGRYNLYIGGNRIGNRIPKIYKENITEQEILIHLKYLIKTWSNERKNKEDFGDFIVRKEFVKEVINPVYDFWS

SEQ ID NO: 33455 - protein, 484 aa, Triticum aestivum
LLDGCSSLETLPSPFDLSKFDNPSFSHVWSSASEGLSSLEMGFIPLQMLLALLAMAIESRQRIGYVKAPVFFPSLQKLRLTVEFITDDLIGSISTALPLLTHLDLQDSPIMEPESATATDLTDAGLQQINPKGKLKHLSLIRSQEFIYTSFRHVNDLGILLMSEKCSNLESICLGGFSRVTDTGFRAIIHSCPGLHKLKVTNGSHLTDLVFHDIVATSLCLTHVSLRWCTLLTDVGIERLSFNKGLNVLDLKDCKSLGDEAVRALSCLPRLRKLVLDGTVITNQAMEYLGAGVCPLASLSLRGCYKLTNDCIPLLLAGSVKESLHALDLSRIPSLTDDAIMVIVRTRTPLTELRLRENPEIGDASVKALASMQFKGVTCGSTLQLLDLYDCGGITLLAMKWFKKPLFPRLRWLGLKGSLNRIMVDALVLTRPFLRLACGGEELGTPYRDTSGEWCRHEDDDSEDLEPWQLDGEPVSDAETVNEE

SEQ ID NO: 33456 - protein, 339 aa, Clostridium thermocellum ATCC 27405
MEGVILVTGAAGFIGFHLVQRLLKEGCNVVGIDNLNEYYDVKLKKDRLKLLSENKNFVFRKVDIKNKKAVDRIFETYRPSYVINLAAQAGVRYSIENPYAYVDSNLVGFVNILEACRKYPVKHLIYASSSSVYGGNKVSPFSTRHNVDHPVSLYAATKKSNELLAHTYSHLFGIPTTGLRFFTVYGPWGRPDMAYFSFTKDILSGNPIKVFNYGKMERDFTYIDDVVEGIVKLIDRIPTPNENWDETKDDISTSFAPYKIYNIGNNNPVPLMNFISVLESALGKVAKKVYLDLQPGDVLRTYADISDLERDINFKPSTSIEDGLRKFVQWYKEYYKAEI

SEQ ID NO: 33457 - protein, 372 aa, Medicago sativa
MGNSYITKEDNQISATSEQTEDSACLSAMVLTTNLVYPAVLNAAIDLNLFEIIAKATPPGAFMSPSEIASKLPASTQHSDLPNRLDRMLRLLASYSVLTSTTRTIEDGGAERVYGLSMVGKYLVPDESRGYLASFTTFLCYPALLQVWMNFKEAVVDEDIDLFKNVHGVTKYEFMGKDKKMNQIFNKSMVDVCATEMKRMLEIYTGFEGISTLVDVGGGSGRNLELIISKYPLIKGINFDLPQVIENAPPLSGIEHVGGDMFASVPQGDAMILKAVCHNWSDEKCIEFLSNCHKALSPNGKVIIVEFILPEEPNTSEESKLVSTLDNLMFITVGGRERTEKQYEKLSKLSGFSKFQVACRAFNSLGVMEFYK

SEQ ID NO: 33458 - protein, 379 aa, Acinetobacter sp. ADP1
MSTPAILALADGTIFKGTSIGATGSTTGEVVFNTAMTGYQEILTDPSYAQQLVTLTYPHIGNTGCNEEDTESGRIHKVWANGLIIRDLPLLHSNFRSEQSLAEYLIQHNVVAIADIDTRKLTRILRDKGAQNGCILAGENITEEEALAKARAFGGLNGLDLAKECCDPNGFEWTEGSWELGKGFTQPELKYHVVAYDYGVKTNILRMLADRGCKLTVVPAQTPAEQVLALNPDGVFLSNGPGDPAACDYAIEAVKTIVETTNLPVFGICLGHQILALASGAKTMKMNHGHHGANHPVQNLEQGTVMITSQNHGFAVDESTLPANLKVTHRSLFDGTNQGIHRTDKPAFSFQGHPEASPGPHDCAPLFDHFIELIEAAKK

SEQ ID NO: 33459 - protein, 324 aa, Rhodobacter sphaeroides 2.4.1
MLVNGKWTADWQPVQKADDHGRFVRQVSSFRNWITPDGSAGPTGTGGFAAEAGRYRLYVALICPWASRTLMARRLKGLDGLIPVTVVNPVMGTQGWEFGGHDDAEEDPLFGARHLHEIYTRAEPQFTGRATVPVLWDMKRDAMVNNESADILRMFDTAFEGLAPSDLRLYPAALAGEIDALNAQVYDRLNNGVYKAGFASTQEAYDEAVAGVFEMLDHLEYRLTGDYIFGGALTETDIRIFVTLIRFDAAYHGLFKTNRRQIADYPRLWAYMRRILARPGVRETVNMDHITRGYYSIKALNPSRIRPVGPAHIEAALRETAAGI

SEQ ID NO: 33460 - protein, 2603 aa, Phoma sp. C2932
MVPYYQPASSCGSNTMAAMDEHQHNEDATIPIAIIGMSCRFPGNATSPEKLWELCAQGRSAWSSIPKSRFRQEGFYNPNAERVGTSHVVGGHFLEEDPSLFDASFFNLSAEAAKTMDPQFRLQLESVYEAMESAGITLEHIAGSDTSVYAGACFRDYHDSLVRDPDLVPRFLLTGNGAAMSSNRVSHFYDLRGASMTVDTGCSTTLTALHLACQGLRNRESKTSIVTGANVILNPDMFVTMSSLGLLGPEGKSHTFDARANGYGRGEGIATVIIKRLDDALRAQDPIRCIIRGTALNQDGRTATLTSPSQTAQSDLIRACYRAAALDPNDTAFLAAHGTGTRTGDAVEIAAAADVFGEKRSPERPLWIGSVKTNIGHSEATSGLASVIQAALALEKGLIPPNINFKEPNEKLGQVSAAVRVPSNLQKWPSVSGVRRASVNNFGYGGANAHVILESGIPGHTPIANGSGRSNGTGNGHNGANGTTNGHNGTNGTTNGHFDATQATNGHYGTDETPDYAPLDSFVISISAKEEASARSMVTNLADYLRTLQVQDETKHFKSIAHTLGSHRSMFKWTAAKSITGPEELIAAAEGGQFQASRALERTRLGFVFTGQGAQWFAMGRELINTYPVFRQSLDRADRYLKEFGCEWSIIDELSRDAENSNVNDMTLSPPLCTAVQISLVQLLESWGIVPTAVTGHSSGEIAAAYAAGALDFKSAMAVTYFRGEVGLACQDKIVGKGGMIAVGLGPEDAEDRIARVQSGKIVVACINSQSSVTVSGDLSGIVELEDLLKAEGVFARRVKVQAAYHSHHMQVIANGYLTSLKDMLKPTKKFGKIIYSSPTTGRRETNAKLMASAQHWVNNMLSPVRFAESFQNMCFSNRNSSQSEEIFQDVDIVLEVGPHGMLQGPIQQMMSLPIFERARLPYISCLLRGQSAVHTMQTVAAGLMGWGYRVDMVAVNFPQGTYGVKILHDLPSYPWNHDNSHWWEPRLNKAHRQRVHPPHDLLGSLIVGRDLREPTWRHFIRVQDIPWIRDHVVQSALVYPGAGFICMAMEAMVQLHELRDSQSRKVAGYRLAEVDILRAMLIPDTSEGLEAHISLRPCSTKLLLTNEWYDFCVSSVGDDDKFVDHCRGRITIEFDTSGSADTPRTSLRERSRSTGLMRSVDPSNLYSFLRAQGIYHGPIFQNLKTISSRKDHSESSFVVANTASVMPNGFQSPHVIHPTTLDSIFQGAYTALPGAGLDQNTAMIPRSIQELYLSSALTSDVGQCLVSDTSLIRYDGQSFTVNVDVSSKADSEHTPVLEIKGLRNQSVGQMAPQPGDSSNNDLCFKLDWAPDISSVKQERLKEKFGFPLDPTEADIIMGLRQACIHFIHRSLQSLTAPDRDQLDWHQKRFYDWMVLQIQLAEEDRLAPNSSAWLQCSSSDEQKLLENVRASSVNGQMVVHVGKSMLAILRHEIAPLELMLQDKLLYRYYTDAIKWDRSYQQIDQLVKLHAHKCPTAKIIEIGAGTGGCTRAVLDALSNQGIARCAQYDFTDVSSGFFEAAQQKFAAFDDVIRFQKLDIEKDIEMQGFECGSYDLVIASQVLHATGKMEHTMANVRKLLKPGGKLLLVETTRDEMDLQLVFGLLPGWWLSSEEERQMSPSLSTNSWEKVLKKTGFDGLDIELRDCDSDEFYSFSVMMATASSTIASSSMAFAIVYGEVPLPDQFLDDMKTAISSSAVSDPVVGHLDSIDATGKFCIFIEDPETDILSSPDEKSYASIQKLVTRCKGLIWVSRGGAMHGTRPNSSLKTGLLRTLRLEYTEKRFISLDLDSARPQWNHDSITTINEVLCGALAQNADSSIKDSEFAEQDGQLFVPRISCDIARNEDLSSDSNSPAQMEPFHQPGKLLQMGIKTPGLIDTLQFSKTDATDNLPNDYIEIEPKAFGLNFRDVMVAMGQLEESIMGFECAGVVRRVGPSSAGHNIKVGDRVCALLGGQWTNTVRVHWHSVAPIPQAMDWETAASIPIVFVTAYISLVKIARMQAGETVLIHAASGGVGQAAIILAKHVGAEIFATVGTDEKRDLLIKEYKIPDDHIFSSRNALFAKSIRQRTNGKGVDVVLNCLAGGLLQESFDCLADFGRFIEIGKRDIELNHCLNMGMFARSATFTAVDLIAIGRDRSYMFAEALPKIMTLLQEKAIRPVTPISIYKIGDIETAFRLMQAGKHMGKIVITAPEDAMVPVITRPPKLQLRPDASYLIVGGLGGIGRSLCKNFVENGARSLVLLSRNANVSQQSGEFLDELRSTGCIVGVVDCDISSKTQVEATMLRLKKDMLPIRGIVHAGMVLQDSVFERMSLDDYNTAIRPKVQGSWNLHSGLSDCDLDFFIMLSSLAGVSGSASQANYTAGGAYQDALAKYRRAQGLSAVSIDLGMVQSVGYVAETKGVAERLVRMGYSPISEMEVLKIVEHAITNPPPEASSAQIITGISTKPGRHWTESSWLQDARFATLRERARDVKELSNSQGGAQDKQLAAGQELSMATSLVEAIDVVGRAITAKLATMFLIAAESIIASKSLSEYGVDSLVAVELRNWLAAQLSSDVSVFDVTQSQSLTALATTVATKSSRIDKSLLVA

SEQ ID NO: 33461 - protein, 499 aa, Acinetobacter sp. ADP1
MGSFFLLQVLTVIFALSIATTIFNKRILNFPQAIGVPIVSAVLVFILQWGASLLNGNQFIAINIHNIENAVRSIDFYDFLINGVICFILTSSALKFKISDLRSHWKPIGILATIALLLCAIFFAGLLYGFQYLMGNPVPILVLLLLGSALGATDPIGIKGVLSSVRAPHHLIVKLEGESLFNDAMCIAVFMTLLNVLQGEHFSLIGTIENFFYEIAVAVVIGWGFGLGVLRLLRGKHEMESLILTTALLASGAYLVSLFAHASAPIACVIGGLIVGNKWKEILEEREIREVNHFWHTVEGIINSFLFTLIGLELFILDLSTSMILGGMVAFIALHLSRFAANFLSFSFFPSFRTKSYNGSLAILSWGGVRGGISLALILAVANVPQLREYSSILIGYTFISVLMSGVVCGLGLPAVMNAFYYNPNEETTGFKGWYQRLCHKMNRKGFKYIVGEDAYGNETITIYDTDQLIDQKAEDGVAAVHHPTKIQEVKRLENPENF

SEQ ID NO: 33462 - protein, 269 aa, Cytophaga hutchinsonii ATCC 33406
MNVLKRNNVTILGEGEKVLLFAHGFGCDQNAWKYIQNFFTENYKLVLLDFVGAGKSDLSSYDPEKYASLDGYVTDIMEICDALKLSNAIFIGHSVSCMIGALASIKRPDIFEKLVFIGPSPCYISIGDYIGGFDKETIDALFEVMEEDYISWARSIAPSIMDSKNGNERTRELSDSFCSIDPIIAKQFARVTFLSDNRKDLPLIPVESLTIQCSDDMIAPLAVGEYIHANTPDNTLVVLEAYGHCPHMSHPTETAKAIMRFCSKPVQVV

SEQ ID NO: 33463 - protein, 481 aa, Bradyrhizobium japonicum USDA 110
MCATNQIVFPAGATSGIIRLSPPCHRCSIDRCSFRRAAQRVDMHLIKTISSDRRSILKGLAAAVVAPLAAPALAAESLPAQPTGSAAAIATDKAYWTAVKGLYAVTPDVVNLENGFWGIMAEPVRREFIRLSDMVNYQNTYYARQRAGADFEAVRAKVAEAVGAAPEEIALTRGATEALQLLIGGYNKLKPGDSVLYADLDYDSMQYAMNALGARRGVDVVKFDVPEPATRQAVLDAYARALEANPKARLLLLTHVSHRTGLVMPVTEIARMAKAKGVDVILDAAHSWGQMDFRVGELEVDFVGFNLHKWIGAPVGVGFLYIRKDRLADIDRDLGDEDFPATDIRSRVHTGTVNFATVLTVPAAVELHQQIGAAAKQARLRYLRDYWVSRVRGFKDIEILTPDEAGLYGAITSFRLAGKTSKVDNDATVAKLRDAYKVLTVRRAGVAKGQCIRVTPALYTEEADLDRLVEALAAITGTKAG

SEQ ID NO: 33464 - protein, 529 aa, Oryza sativa Indica Group
MDTSTLLIALTLVLLLLLLLLLTARRRRSGRPRLRLPPEPAGLPLVGHLHLFRKPLHRTLARLAARHGAVFRLRLGSRRVAVVVSSAPAAEECLGAHDVAFAGRPRLPSAGILSYGWSTMGTAAYGPYWRHVRRVAVAEILSAHRVRQFAGAHDREARATARRLCRAASRQRHHGAGAAAGRVRVELKSRLFELLMNTMMAMICDKTYYGADDDGEVSEEARWFREMVEETMALSGASTVWDFLPAVLRWVDVGGVGRRLWRLRESRTRFLQGLIDDQRKEMEHDGDGRELPAAAARPRSMIGVLLSVQRQDPEECPDQLISSLCISSLEAGTGTSTDTIEWAMSLLLNNPDVMRKARDEIDAFIGQPVRLLEADDLPKLQYLRCIIMETLRLYPPAPLLVPHESSSDCTVAGFHIPRGTMLLVNTFDIHRDPHIWDEPTSFIPERFEDGRSEGKMAIPFGMGRRKCPAENLGMQMVGLGLGTMIQCFEWERVGEELVDMTEGSGLTMPKKVPLEAFYQPRASVMHLLS

SEQ ID NO: 33465 - protein, 495 aa, Ashbya gossypii ATCC 10895
MGFQSFKPTFRNEDLVRRGAYINGEWITSAKESFNVTDPATDQVIAELPDFDSGEAEAALKAAHASFQSYKKTSPTQRSEWLRNLYDLIMENAEDLAAIVTWENGKSLREALVEIRYGATFFKWFSEEALRLYGTTIQPSNPGNRAFTIRQPVGVCALICPWNFPNAMISRKAAPALAAGCTVIIKPDPQTPLSSLALAHLAEKAGFPPGVINVVPTSKYTKDIGVLLCESSLVRKVSFTGSTAVGKILMQQAASTVKKVSFELGGNAPVIIMGDADMEKTVEEVLATKFRGMGQTCICANRLYVHRSIIDDFSSRLVKKVEGLKLGNGFQEGVTHGSLINNAAIEKVERHAKDAIERGAKVLLPGGRAPELGPHFYSPTVLSDVKPDSVLTREETFGPLCAMIPFDTVEEVVGYANDTQYGLASYVFSENIKTVYSIAEALDFGMVACNTGLFSDSMVPFGGIKESGFGIEGSLHGINDYTVLKTVTIGNVPTL

SEQ ID NO: 33466 - protein, 629 aa, Yarrowia lipolytica CLIB122
MAFAVEDKYKSLCQKLFFSRVPVKHYPRKHCNTNAKERGWTTTTVIVGWIFIYLYASGKTIAQHLFPSLAPFATSHFSGLALLSSQAVVESAIFVVARPACAKISDHLGRLEAWIVVVVAHIIGAVLYAASPNIGCYFAGTVFWEIGMVGGHLMMELYAADTSTTETRVLASYFIQSPSVWAPWISAPVVAGFLKVTTWRWGYGSMAIIIPGTSIGIIITLLYMRLKYENRLGGQGDFYSPGGPMRFIKSFDIIGLLAVGGAMILFFLPITFAAGTDKWKYHSYIAMLTIGSFLMVFTPIWEVYGTKTPLIPWKLFKSRIMVISSAQMFLLSMANKIYIPYFITWLLVVKGQSPKAATNVSSTLIVTANAWGLFAVAPYMWWRGHCKRVIVIGTCLHLVGIGMTYHYRTPHGSLAVMIIAQVFEGVGRGMIYIPAVAMAQAVFDKHKVASVTALYYTTGGVGQVIGDSISGAIYRTLYPKYIHKYAPDIPAKDLNMIINKIKKATKYPMGSKVRTEINMAFNEAMRHMLLGPFGCVAGMIVLSLFYPMVNLKEASDDVYDAPDNSDGEDIFTPHPAPGTEGDLEKQHSGDEKFESNSENGEHTNSEEGNLPRVSAEAAAASYINNTQVL

SEQ ID NO: 33467 - protein, 525 aa, Oryza sativa Indica Group
MDALLIALFLLLLIALMETARVRRSGTQRRAGNVPPPPPEPAGLPLVGHLHLFRKPLHRTLARLAARHGGAVFGLRLGSRRVAVVSSAPAAEECLGAHDVAFADRPRLPSGRILSYDWSTMGTASYGPYWRHVRRVAVTEILSARRVQHFADVHVREARAMARHLHRAAVRHGVGGAARVRVELKSRLFELLMNTMMAMICDKTYYGDDDDGEVSKEARWFREMVEETMALSGASTVWNFLPAALRWVDVGGVGRRLWRLRESRTRFLQGLINDERKEMEQEQGGDRAQPAARRRTMIGVLLSVQRQDPDACPDQLIRSLCISSLEAGTDTSADTIEWAMSLLLNNPNVMRKARDEIDAFIGQPVRLLEASDLTKLQYLQCIIMETLRLYPPAPLLVPHEASTDCSIAGFHITRGTMLLVNTFAIHRDPQVWNEPTSFIPERFENGRSEGKMAIPFGMGRRKCPAENLGMQMVGLALGTMIQCFEWERVGEELVDMTEGSGLTMPKEVPLQAFYQPRASLMHLLY

SEQ ID NO: 33468 - protein, 480 aa, Kineococcus radiotolerans SRS30216
MAHPHGKKHDTSTDDGGGLTGAVVVVALVSAISGLLYGYDTGIISGALLQIGDEFEIGNGWEQLIAASILAGAVVGALTCSRLSERRGRRGTLLVVAVVFVVGTLGAAFAPNPELLSLARLVLGFAVGGATQTAPVYVAELAPTKYRGRLVLFFQIAIGVGILTATIVGASEAVDWRVSIGAAAVPAAIMLVLMLRLPESPRWLLKSDQQDRARQSLERVRPRGADVAGELHEIDALVREESSAGTRGWRGLREAWVRPALVVGCGLAIATQLSGIEMIVYYSPTILTDNGFADSTALQVSVGLGATYLITQLIGLAIIDRVGRRRLTLITLPGAALALIVLGTFFVTGNDGKEQVPYIIATLIAFMAFTAGGIQLMGWLTGSEIYPLATRSAGAAAQSASLWGTNLLITLTLLSIIDTIGTGQTFWLYAAFNVLAFVFLYKRMPELTGHSLEEIEGRLHEGRFRPADFAKEPAERAASR

SEQ ID NO: 33469 - protein, 451 aa, Oryza sativa Indica Group
MGLRFGSRRVAVVSSAPAAEECLGPHDLAFANRPRLPSGEILAYEWSTMGTASYGPYWRHIRRIAVTELLSAHRVQHFADVNVREVRALARRLYRRAAAAAAAGARTRVELKSRLFELLMNTMMSMICERTFYGADDDEVSEEARWFRSVVKETMELSGASTVWDFLPAPARWLDAGRMTRRMRELSDSRTRFLQRLIDDQRKDMDADSDEHAPAKRRTMIGVLLSLQSKDPDSCPDQLIRSLCIGSLQAGTDTSAATVEWAMSLLLNNPGAMARARGEIDACVGQPAARLLEAADLPKLHYLRCVVMETLRLYPPVPLLAPHESSADCVVAGFHVPQGTMLLVNTFAIHRDPQVWDEPEAFIPDRFADGKNEGKMVIPFGMGRRRCPGENLGMQMVGLALGTLIQCFDWERVGEELVDMRECSGLTMPKELPLEALYQPRASMVDLLTKI

SEQ ID NO: 33470 - protein, 151 aa, Herbaspirillum seropedicae
MFYPADFTFVCPTELEDLADNYAEFKKLGVEIYGVSTDTHFAHKAWHDTSEAIKKVQYPLVGDPTATLARNFEVLIEEEGLALRGTFVINPEGQIKVLEIHDNGIGRDASELLRKVKAAQYVASHPGEVCPAKWEEGAATLKPSLDLVGKI

SEQ ID NO: 33471 - protein, 350 aa, Mycobacterium sp. MCS
MSAHRIAVIPGDGIGTEATASARTVLDAVAERHGIDLSYEEFDWSCRRFERDGAMMPADGLETLSGFDAILLGAVGWPGVPDHVSLWGLLIPIRRAFRQYVNLRPIRVFDGVASPLRDATDVDFVVVRENVEGEYSEIGGRINRGFPDEMAVQESVFTRVGVTRIADYAFDLAETRRRYVTSATKSNGIVHTLPFWDEVVAERAANHPGVRFDSEHIDALAAKFVLQPGRFDVVVGSNLFGDILSDLAAAVAGSIGIAPSANLDPTKQYPSMFEPVHGSAPDIAGRGVANPIGAVWSAALMLEHLGHASAAADVMTAVERTLAQPQTRTVDLGGHASTADVTDALVAQLR

SEQ ID NO: 33472 - protein, 254 aa, Bacillus anthracis str. A2012
MQSMRKPIIAGNWKMNKTLSEAVSFVEEVKGQIPAASAVDAVVCSPALFLERLVAATEGTDLQVGAQNMHFEKNGAFTGEISPVALSDLKVGYVVLGHSERREMFAETDESVNKKTIAAFEHGLTPIVCCGETLEERESGKTFDLVAGQVTKALAGLTEEQVKATVIAYEPIWAIGTGKSSSSADANEVCAHIRKVVAEVVSPAAAEAVRIQYGGSVKPENIKEYMAQSDIDGALVGGASLEPASFLGLLGAVK

SEQ ID NO: 33473 - protein, 268 aa, Schizosaccharomyces pombe 972h-
MSRPEHIAPPEIFYNDVEAGKYSTNTRIQSIQTEMSERALELLDAEGPSFILDIGCGSGISTQIGESQGHVVVGMDISPSMLSVALESQEIEGDLLLCDMGTGVPFRPGTFDGVISISAIQWLLNADKTCNVPQRRLNRFFQTLYISMKRGGRAVMQYYPETEKSQQMIMDTARKAGFAGGIVVDHPESKRQKKYYLVLQAGGTRTLDISSMTLDQEGTNAKQRKLKKKQDMSTREYIIHKKELNRKRGRLHVPKDSKYSGRRRKAAF

SEQ ID NO: 33474 - protein, 499 aa, Sphingobium yanoikuyae
MATQLKSAENEYGIKPEYGHFIGGEWVSGDSGKTIDLINPATGAVLTKIQAGNAKDIQRAVAAAKAAFPKWSESSPAERQEILIEVARRLKARHQHYATLETLNNGKPIRESMYFDMPQAISQFEVFAGAAYGLHGQTLDYPDAIGIVHREPLGVCAQIIPWNVPILMMACKIAPALASGNTVVLKPAETVCLSVIEFFVEMADLLPPGVINVVTGYGADVGEALVTHEDVRKVAFTGSVATARRIIQYASSNIIPQTLELGGKSAHIVCADADIDAAVESATMSTVLNKGEVCLAGSRLFLHQSIQDEFLAKFKVALEGIRQGDPLDFGTQLGAQASQMQMDKVQSYLQLATEEGATVLTGGSRNESLADGHFIKPTVFTNVSNSMRIAREEIFGPVTSVLTWNDEDDMMALANDTTYGLAGGVWTRDISRAHRIARKLETGTVWVNRYYNLKPNMPLGGYKQSGFGREFSHEVLHHYTQTKSVVINLQEGRVGMFDQ

SEQ ID NO: 33475 - protein, 271 aa, Lactuca sativa
MSIPAKRLEGKVALITGAASGIGECCAKLFAAHGAKVIIADVQDQLGQAVSEAIGSSNSMYIHCDITNEEEVKNTIDTAVATYGKLDIMFNNAGIADAFKPRIMDNEKKDIERVLGVNVIGTFLCMKHAARVMVPQKSGSIITTSSLTSHLGGMASHAYSCSKHALVGLTRNLAVELAPFGIRVNCVSPFGIATPMTADFIGLEREVFENMINGVANLKGVTHKPDDVAYAALYLASDEAKYVTAQNMLVDGGLSYCNNSFNMFKYPEEDT

SEQ ID NO: 33476 - protein, 162 aa, Solibacter usitatus Ellin6076
MANEIYAAFDTSEGKFKVKLFADKAPNTVNNFVSLADGSKTGKPFYNGTIFHRVIPDFMIQGGCPQGTGTGGPGYKFADEFHPTLKHSKPGLLSMANAGPGTNGSQFFVTVAATPWLDNKHSIFGEVTEGYDVVEKISKVPRGGQDRPVKEVRLNSVTIEKT

SEQ ID NO: 33477 - protein, 265 aa, Herbaspirillum seropedicae
MIIPPMLNTAIKAARRAATIINRASFDVSLLKVSKKSHNDFVTEVDKAAEDAIIDVLKNAYPDHAILAEESGASDNLHDENENVWIIDPLDGTTNFIHGFPQYCVSIALQQRGIITQAVVYDPTRNDLFTASKGAGAYLNEKRIRVGKRDKIADALIGTGFPFRDLDGLNEYVKMFKVMTEHSAGLRRPGAAALDLAYVAAGRLDGFFEKGLKPWDIAAGSLLVTEAGGIVGTFKGDSDYLYKGDVIAASPKIFAQQVNLLSEFA

SEQ ID NO: 33478 - protein, 205 aa, Buchnera aphidicola str. APS (Acyrthosiphon pisum)
MNSLDYNKTNFLKSYSKITDIDIQNGIEIAFIGYSNTGKSSAINALTNQKKLARFSKTPGRTQLINFFEVVSGFRIVDLPGYGYSQAPLLVRSKWQKKVYDYLEKREQIKLFVLLMDIRYPLKKLDQKIISIAVQKKISILVLLTKCDKIKINHQKNQADMVFKKLNVLLDSFEIILFSSYKKIGIEKLKLSLNSSYKKHFILNR

SEQ ID NO: 33479 - protein, 173 aa, Glycine max
FCLGLLVFFSKVSLATPKSHHSAFVGKYADELIKTAKYIATPGKGILAADESTGTIGKRFSSINVENIESNRQALRELLFTSPGALPCLSGVILFEETLYQKTSDGKPFVEFLQENGVIPGIKVDKGVVDLAGTNGETTTQGLDSLGARCQEYYKAGARFAKWRAVLKIGATE

SEQ ID NO: 33480 - protein, 476 aa, Solibacter usitatus Ellin6076
MANELQDFLKLSYTELEELNLEAKADRMGRKPMHEIQEKRLKYLTDEKRIKAVTVLFSDLEGRLHMLDYDKKFLVKSWDNLTFDGSSIRGFTAQRESDLRLNMDWSAFYWAPSDIFGAGKVLVFGEVIDKDGTPYSADIRGVLKAYAQSLFDKQGYTLNAANEIEGFLFNGSDAERRYHETTKFDYVNTGGYYHSLPGDPLRKFIDTCAEVQRAMGFQNEKDHPEVAPSQFEINYSYAEVVAAADQIQLYKLICRQVATGMGLTASFLPKPVVGVNGSGMHTNVSITKNGKNLFWDPSGQEKMSKFAWQFVDRILTHGNDLCLLLNASVNAYRRLDPHFEAPNQIKASATDRGSMIRIPIGNERSSRVEVRSVGPDANPYMVMLSVFRTGLDGETAKIKNLRSAERYLPDNVYDALANFKNAEWTTKLLGEDVKGRYADLKQSSADRCPRLLGTFVKAPEVQYHHEVYNQFLWNMF

SEQ ID NO: 33481 - protein, 132 aa, Brassica napus
  misc_feature (82)..(82): Xaa can be any naturally occurring amino acid
  misc_feature (103)..(103): Xaa can be any naturally occurring amino acid
IGQIICRFEQKGFTLKGLKLITVDRPFAEKHYQDLSAKPFFSGLVDYIISGPVVAMIWEGKNVVLTGRKIIGATNPAASEPXTIRGDFAIDIGRNIIHGSDSXVESANKECALWFPDGPVNWQSSLHSWIYE

SEQ ID NO: 33482 - protein, 535 aa, Neisseria meningitidis MC58
MSIVEIKVPDIGGHENVDIIAVEVKAGDTIAVDDTLITLETDKATMDVPADAAGVVKEVKVKVGDKISEGGVILTVETGAAAAEAAPAAAEAQPAPAAAPAAAGGATVQVAVPDIGGHTDVDVIAVEIKVGDTVAEDDTLITLETDKATMDVPCTAAGVVKAVFLKVGDKVSEGSAIIEVETVGSAAAAPAQAAQAAAPAAAPPPTAAAAPAAAPAPSAPAAAKIDEAAFAKAHAGPSARKLARELGVDLGQVKGTGLKGRIMGDDIKAFVKSVMQGGAAKPAAASASLGGGLDLLPWPKVDFSKFGNVEVKELSRIKKISGQNLSRNWVVIPHVTVHEEADMTELEEFRKQLNKEWEREGVKLSPLAFIIKASVSALKAFPEFNASLDGDNLVLKNYFNIGFAADTPNGLVVPVIKDVDQKGLKQISQELTELSKKAREGKLKPQEMQGACFTISSLGGIGGTGFTPIVNAPEVAILGVCKSQIKPVWNGKEFAPRLMCPLSLSFDHRVIDGAAGMRFTVFLAKLLKDFRRITL

SEQ ID NO: 33483 - protein, 310 aa, Mycobacterium smegmatis str. MC2 155
MPRIAYLGPEGTFTEAALLQMVAKGMVPGPAEDAGGFTPVRTDSTPGALSAVREGRADYACVPIENSIDGTVLPTLDSLAAGSPLQIYAELTLDVAFTIVVRPGHDGPVRTVAAFPVAAAQVRHWLAANLRDAEVVPAHSNAAAAHDVAEGRADAGVSTRLAAERCGLDIMAADVVDEPNARTRFVLVGLPGTPPPATGADRTAVVLRLVNEPGALVSAMTEFSIRDIDLTRIESRPTRTELGTYMFFLDCAGHIDDDPVAEALKALHRRCVDVRYLGSWPTESAAGAPPPRLDEATTWLEGLRAGSGGA

SEQ ID NO: 33484 - protein, 136 aa, Crocosphaera watsonii WH 8501
MKAFALDRVLFASVQYPYDYGFVPNTLADDGDPLDGMVIIDQPTFPGCVIAARPIGMLEMIDGGDRDEKVLCVPDEDPRFSEVKSIKDIAPHRLEEIAEFFRTYKNLEKKVTEILGWKDVDAVMPLVEECVKAGSK

SEQ ID NO: 33485 - protein, 356 aa, Burkholderia sp. 383
MKGVVFRGERKLEILDFEDPVPGPGEAVIEMKASGMCGSDLHFYRNKPADVIRSLGFKDLASRGMSEDTPVIGGHEPCGQIVAVGAGVDPRAFKVGDRVAVFHYEGCLHCDHCRTGWTQMCSHGADIHGVIKHGGHAHYMKVPATSLVHLPDEVSFAAGAAISCGTGTAWGALLRLDISARDTLAVFGLGPVGLSAVQLAAAMGVEVIGVDIAADRVARARAFGATHVIDGSKQDPIEEIQKLTGGLGVTCAMDCAGGEVPRQQAVRSTRPWGRIALVAVGGNLNVDGMKDVIGKQRTIIGSYTFSEVSMKQCIHFVADHGVDVDQLFTDYWKIDQADEAYRMFDAQSGGKGAFLF

SEQ ID NO: 33486 - protein, 388 aa, Acinetobacter sp. ADP1
MNLHEYQAKALLKKYGVSVQEGILARSAEEAVAAFEQLGGKFAVIKAQVHAGGRGKAGGVKVVKSKEEAADYANQLIGTNLVTYQTDANGQPVNSVLVCEDVYPVERELYLGAVVDRSSRRVTFMASTEGGVEIEKVAEETPEKIIKVEVDPLVGLQPFQAREVAFALGLKDKQIGQFVKLMAGAYQAFVENDFALFEINPLSVRENGDILAVDAKIGIDSNALYRLPEIAASRDKSQENERELKASEFELNYVALEGNIGCMVNGAGLAMATMDIIKLYGGQPANFLDVGGGATKERVIEAFKLILADTSVQGVLINIFGGIVRCDMIAEAIIAAVQEVNVTVPVVVRLEGNNAELGAKILDESGLKLTSANGLSDAAEKIVAAVKG

SEQ ID NO: 33487 - protein, 518 aa, Burkholderia sp. 383
MRTRRPSRSCCACDFHPSIQNRTKSKETPVSVNIPGFIEGNKKLLIGGQWVEPAGGEHIEAINPATGEVLCHIAKGGTQDVERAVAAARRAFEGPWSRFTPHERRKLLLRVHDVILDHFDELALIETLDMGAPLARTRGYKEWLSQLLQFYASQTGAGTVQAAPMSIAPGFTALKHLMPVGVVGGIIPWNGPLMGLWWIYGPALATGCTAVLKPAEDASLSSLRVSELMMEAGVPDGVINVVTGYGKDVGQALAEHPDVDRVAFTGSVGTAQAIVRASAGNLKRLQLELGGKSPDIVFADADLDKAVPGAAMGVFTNTGQVCVAGTRIFVQRAIHDEFVQRIAAFAKTIRIGDGLSPDTQIGPLISQRQLERVMHYVDIGGKEATLVHGGQRPGGELARGYFVEPTVFANVRNDMTIAREEIFGPVASVIPFDTMEEALQLANDTPYGLAGGVWTSSLSTAHKVSQGIRSGTVWVNCYGVIDPAVGFGGTKMSGYGWKGGKEHVESFLYPKATYINLG

SEQ ID NO: 33488 - protein, 496 aa, Burkholderia sp. 383
MTIVTEAAQAARTQALAWINRGPKRLLIGGRWVDAASGNTFETINPATEQVLCRVAEADSADVDAAVIAARRAFDAPSWGGLSPHARTRALLKIADAIEQHVDELAAIESLDNGMPLWFALAAVTATIDIVRYYAGWCSKVLGTTIPSDGSTLIYTLREPLGVCGQIIPWNVPILMAAIKFANALCCGNTVILKPAELACLTSIRLAELIQETDLPPGVINVLPGYGPTAGAALAQHPGVDKIAFTGSTPVGKQITRDATLNLKKVTLELGGKAPNVIFADADIEKAVQAAVKTFCGNSGQVCSAGTRLFVQEGIHEQVAERVAQIAATWKAGDPFASDTKLGPLISAKQRDRVWSYIGVGQEGGATLRLGGDPWRGAGYFVEPTVFDNVRNGMRIAQEEIFGPVLSIIPFKDEGDAVLQANDTTYGLSAAVWTRDVARAHKVVRALKAGRLWINTFGESDPAMAFGGYKQSGWGREFGQESIDAYTQTKSIMLRM

SEQ ID NO: 33489 - protein, 477 aa, Acinetobacter sp. ADP1
MSQQFDLVVIGGGPGGYEAAIRAAQLGFKVACIEKRVHKGKPSLGGTCLNVGCIPSKALLDSSHHYEDTIHHLGDHGITTGEVNIDIAKMLARKDKVVENLTGGVAQLLKGNGIEWLQGTGKLLAGKKVEFVPFEGETQVLEPKYVILASGSVPVNIPVAPVDQDLIVDSTGALEFAEVPKRLGVIGAGVIGLELGSVWRRLGSEVVVFEALDAFLPMADKALSKEFQKILTKQGLDIRIGAKVSGTEVNGREVTVKYNQAGEDKEQVFDKLIVCVGRKPYAEGLLAEDAGIKLTDRGFIEVNDHCATSLEGVYAIGDLVRGPMLAHKAMEEGVMAVERIHGHAAQVNYDTIISVIYTHPEAAWVGLTEEQAVANGHEVKTGQFPFAVNGRALAAGEAAGFVKFVADAKTDRLLGMHVIGPGASDIVHQGMIALEFVSSVEDLQLMTFGHPTYSEVVHEAALAVDGRAIHAIQRKRK

SEQ ID NO: 33490 - protein, 600 aa, Saccharomyces cerevisiae YJM789
MINDKLVHFLIQNYDDILRAPLSGQLKDVYSLYISGGYDDEMQKLRNGKDDVLQFEQFWNDLQDIIFATPQSIQFDQNLLVADRPEKIVYLDVFSLKILYNKFHAFYYTLKSPSSSCEEKVSSLTTKPGADSEKDQLLGRLLGVLNWDVNVSNQGLPREQLSNRLQNLLREKPSSFQLAKERAKYTTEVIEYIPICSDYSHASLLSTSVYIVNNKIVSLQWSKISACQENHPGLIECIQSKIHFIPNIKPQTDISLGDCSYLDTCHKLNTCRYIHYLQYIPSCLQERADRETASENKRIRSNVSIPFYTLGNCSAHCIKKALPAQWIRCDVRKFDFRVLGKFSVVIADPAWNIHMNLPYGTCNDIELLGLPLHELQDEGIIFLWVTGRAIELGKESLNNWGYNVINEVSWIKTNQLGRTIVTGRTGHWLNHSKEHLLVGLKGNPKWINKHIDVDLIVSMTRETSRKPDELYGIAERLAGTHARKLEIFGRDHNTRPGWFTIGNQLTGNCIYEMDVERKYQEFMKSKTGTSHTGTKKIDKKQPSKLQQQHQQQYWNNMDMRSGKYYAEAKQNPMNQKHTPFESKQQQKQQFQTLNNLYFAQ

SEQ ID NO: 33491 - protein, 402 aa, Acinetobacter sp. ADP1
MATEIKAPVFPESVADGTIATWHKKVGEAVSRDEVICDIETDKVVLEVVAPADGQLVSIIKDEGETVLSDEVIAQFQEGAVSGANETQAVQSDSKVEQAAAKTEAGAAPVVERAQPVSDQAPAVRKALTESGISASDVQGTGRGGRITKEDVVNHQSKPAAQPLSVAVGERIEKRVPMTRLRKRVAERLLAATQETAMLTTFNEVNMKPIMEMRAQYKDAFEKRHGARLGFMSFFVKAATEALKRYPAVNASIDGDDIVYHGFYDIGVAVSSDRGLVVPVLRDTDRMNYAEVENGIRDYAVKARDGKLGIEDMTGGTFTITNGGTFGSLLSTPILNTPQTAILGMHKIQERPMAVNGQVEILPMMYLALSYDHRLIDGKEAVGFLVTIKELLEEPAKLILDL

SEQ ID NO: 33492 - protein, 262 aa, uncultured soil bacterium
MGTLTGKTAVVTGSTSGIGLAIARAFAGAGANIVINGFGAPADIERERSGIETDFKVKAVHSAADMSKPAEIAEMIALGEKTFGSVDILVNNAGIQFVSPIEEFPIEKWDAIIAINLSSAFHAIRAAVPGMKKRGWGRIINTASAHSLVASPFKSAYVSAKHGIAGLTKTVALELATHKITCNCISPGYVWTPLVEKQIPDTMKARNLTKEQVIHDVLLEAQPTKEFVTSEQVAALALFLCGADAAQITGTNLSIDGGWTAA

SEQ ID NO: 33493 - protein, 340 aa, Burkholderia pseudomallei K96243
MSTKGTILVTGGAGYIGSHTAVELLAHGYDVVIADNLVNSKREAIARIEKITGKTPAFHETDVSDERALARIFDAHPITAAIHFAALKAVGESVAKPIEYYRNNLDSLLSLLRVMRERAVKRIVFSSSATVYGVPERSPIDETFPLSATNPYGQTKLMAEQILRDVEAADPSWRVATLRYFNPVGAHESGLIGEDPAGIPNNLMPYVAQVAVGKLEKLRVFGSDYPTPDGTGVRDYIHVVDLARGHIAALDALERRDASLTVNLGTGRGYSVLEVVRAFEKASGRAVPYELVARRPGDVAECYANPAAAAETIGWKAERDLERMCADHWRWQENNPRGFV

SEQ ID NO: 33494 - protein, 129 aa, Porphyra yezoensis
MAPNAGAVAKGKSQTRSAKAGLQFPVGRIHRFLKSGGYSDRIGAGAPVYLAAVMEYLTAEVLELAGNAARDNKKTRIVPRHIQLAVRNDDELNKLLGSVTIASGGVLPFIHKDLLPKVKGKKGEQSQEV

SEQ ID NO: 33495 - protein, 369 aa, Vitis vinifera
MEIEGTPALHGYHMPAEWEPHSQCWMGWPERPDNWRDHAGPAQRVFAEVASAISKFEPVTVCASAAQWANARSLLPQHIRVVEMSMDDSWFRDTGPTPTPSSAAPVQKIVGIDWNFNSWGGYDDGCYNDWSLDLLVAKKILEIERVPRFPQSMILEGGSIHVDGEGTCLTTEECLLNKNRNPHLTKEQIEAELKSYLGVKKVIWLPRGLFGDDDTNGHIDNMCCFAKPGVVLLSWTDDELDPQYERSVEAFSVLSNATDARGRKLQIIKLHVPGPLYMTDEEASGILQDDNAKLRVAGTRLAASYVNFYIANGRIIAPVFGDQKWDDEAVRVLSLAFPNHEVVGIKGAREIALAGGNIHCITQQQPAIA

SEQ ID NO: 33496 - protein, 351 aa, Bordetella parapertussis 12822
MSQARPATLRVAVLGAGSWGTALAAAASRRHPTVLWARDGAQAQAMAARHENTRYLPGVALPPALQVSADLAQALAHLAHDPAHALIILGVPVAGMTPLCTELAARLPALGLQAVPLVWTCKGFEEQTAHLPHETVQAALGAMPGLAAGVLSGPSFAREVAQGLPVALTVASESSAVRDAVTTALHGAAVRIYASTDVVGVEVGGALKNVIAVACGICDGLALGTNARAALITRGLAEMARFGAALGAQQETFAGLTGLGDLVLTATGELSRNRRVGLEIGAGRKLADILASGMTAEGVRCARAARDRARALNIELPITEAVCAVLFEGLSPMTAVSALLAREARPESPTP

SEQ ID NO: 33497 - protein, 404 aa, Vibrio campbellii AND4
MQNIGMSSKLDNVCYDIRGPVLKHAKRMEEEGHKILKLNIGNPAPFGFDAPDEILVDVIRNLPTSQGYCDSKGIYSARKAVVQYYQRKGILSLDVEDVYVGNGVSELIVMAMQALLNNGDEMLIPAPDYPLWTASVALSGGKPVHYLCDEGADWYPDLEDIKKKITPKTRGIVLINPNNPTGAVYSRDFLLEVIEIARQHNLIIFADEIYDKVLYDGATHTSVATLTEDVLVMTFNGLSKAYRVCGFRGGWMFLTGPKHLAQGYINGLELLSSMRLCANVPMQHAIQTALGGYQSINELILPGGRLLEQRNRAYELINQIPGVSCVKPKGAMYLFPKIDTKMYNIKNDQQMVLDFLKQEKVLLVQGSGFNWPKPDHFRIVTLPHVEDLEIAISRFERFLTTYSQ

SEQ ID NO: 33498 - protein, 427 aa, Herbaspirillum seropedicae
MSAIVDIIGREVIDSRGNPTVECDVLLESGVLGRAAVPSGASTGSREAIELRDGDKSRYFGKGVLQACENINTEISEAIMGLDANEQAFLDRTLIDLDGTENKSRLGANAMLAVSMAVAKAAAEESGLPLYRYFGGSGSMQMPVPMMNVINGGAHADNNLDIQEFMIIPVGAPSFREALRYGAEVFHTLKKILHDRGLATSVGDEGGFAPNVSSHEEAIKLIIEAIEKAGYEPGTQIALGLDCAASEYYKDGNYHLAGENMVLTPAQKTGLLASWCDKYPIISIEDGMAENDWAGWKLLTETLGKKVQLVGDDLFVTNTKILKEGIDKGIANSILIKINQIGTLTETFAAIEMAKRAGYTAVISHRSGETEDSTIADIAVGMNALQIKTGSMSRSDRMAKYNQLLRIEEDLGDIASYPGRAAFYNLK

SEQ ID NO: 33499 - protein, 250 aa, Bordetella parapertussis 12822
MYKLVLIRHGESQWNLENRFTGWTDVDLTETGREQARKAGELLKREGYAFDLAYTSVLKRAIRTLWIALDALDAMYTPVGINWRLNERHYGQLQGLNKAETAAKYGDEQVLIWRRAYAIAPEPLDLEDPRHPRFDGRYAKIPADQLPATECLKDTVARVLPFWNESIAPAIRAGRRVLVAAHGNSLRALIKHLDNVSDDDIVGVNIPTGQPLVYELDEDLKPIRHYYLGDAAEIEAAMAAVAAQGKAKKD

SEQ ID NO: 33500 - protein, 104 aa, Phytophthora parasitica
DIRFPIRLEGLLNDHARFSSYEPEPFPGLIYKLVEPKLTLLIFVSGKIVLCGARDSNHLHQAIDKMYPVLLQYRKMTAPPSLLTGKPGYEDSEDLDCLEPGANV

SEQ ID NO: 33501 - protein, 594 aa, Neisseria meningitidis MC58
MALVELKVPDIGGHENVDIIAVEVNVGDTIAVDDTLITLETDKATMDVPAEVAGVVKEVKVKVGDKISEGGLIVVVEAEGTAAAPKAEAAAAPAQEAPKAAAPAPQAAQFGGSADAEYDVVVLGGGPGGYSAAFAAADEGLKVAIVERYKTLGGVCLNVGCIPSKALLHNAAVIDEVRHLAANGIKYPEPELDIDMLRAYKDGVVSRLTGGLAGMAKSRKVDVIQGDGQFLDPHHLEVSLTAGDAYEQAAPTGEKKIVAFKNCIIAAGSRVTKLPFIPEDPRIIDSSGALALKEVPGKLLIIGGGIIGLEMGTVYSTLGSRLDVVEMMDGLMQGADRDLVKVWQKQNEYRFDNIMVNTKTVAVEPKEDGVYVTFEGANAPKEPQRYDAVLVAAGRAPNGKLISAEKAGVAVTDRGFIEVDKQMRTNVPHIYAIGDIVGQPMLAHKAVHEGHVAAENCAGHKAYFDARVIPGVAYTSPEVAWVGETELSAKASGRKITKANFPWAASGRAIANGCDNGFTKLIFDAETGRIIGGGIVGPNGGDMIGEVCLAIEMGCDAADIGKTIHPHPTLGESIGMAAEVALGTCTDLPPQKKK

SEQ ID NO: 33502 - protein, 238 aa, Cicer arietinum
FDKGARTALAFVTLRADGEREFMFYRNPSADMLLTPEDLNLELIRSAKVFHYGSISLIVEPCRSAHLKAMEVAKDAGCLLSYDPNLRLPLWPSPEEARNQILSIWDKADLIKVSDVELEFLTGSDKIDDASALSLWHPNLKLLLVTLGENGSRYYTKNFHGSVDAFHVNTVDTTGAGDSFVGALLGKIVDDQSILEDEARLREVLKFANACGAITTTKKGAIPALPTEADVLSLIKGE

SEQ ID NO: 33503 - protein, 302 aa, Oryza sativa Japonica Group
MSTCDSMKSPDFEYIDNGDSSSVLGSLQRRANENLRISEDRDVEETKWKKDAPSPMEIDQICDVDNNYEDPQLCATLASDIYMHLREAETRKHPSTDFMETLQKDVNPSMRAILIDWLVEVAEEYRLVPDTLYLTVNYIDRYLSGNEINRQRLQLLGVACMLIAAKYKEICAPQVEEFCYITDNTYFRDEDPALHLEFLANYVAELSLLEYNLLSYPPSLVAASAIFLAKFILQPAKHPWNSTLAHYTQYKSSELSDCVKALHRLFCVGPGSNLPAIREKYTQHKIYAADVIDLNMMIQRDS

SEQ ID NO: 33504 - protein, 390 aa, Buchnera aphidicola str. APS (Acyrthosiphon pisum)
MTIRKMTELNITEKRILIRSDLNVPIENGIIQSDARILAALPTIELALQKKAKVIIMSHLGRPKEGYYTKKYSLFPIFEYFKKKFNNTKIYFSNNFLDGIKLNPGEIALLENTRFNKGELNNDEQLSKKYSDLCDIFVMDAFGSAHRMQSSTYGIGKFVKIACAGLLLISEIDALKKALKKPKRPMVAIVGGSKVSTKFNVLNKLSKIADTIIVGGGIANTFLAIDYKIGKSLYEPDFVFEAKKLRDKYNIIVPIDSRVGKNFCKNEQAIIKSPDNIKEDEEIMDFGDESIKKIISIITQSQTIMWNGPVGVFEFPNFRKGTEMIAKTIANSNAFSIAGGGDTLSVIDMFNIKNNISYISTGGGAFLEFIEGKKLPAIQMLEENFKNKSK

SEQ ID NO: 33505 - protein, 366 aa, Methanococcus maripaludis S2
MYGILVLEDGTIIRGEGFGAETEVLGELVFNTSMTGYVEILTDPSYKGQIITMTYPLEGNYGVEKEWFESDGIKAEGFVVKDITGKELDEFLKEYNIPGISGVDTRYITRKIRSKGVIRSLLKTSTNPITKDEETELLKKVVDYPDISEIDLVPEVSTKETVIYNAEDEKTRCVLIDCGVKQSIVDCLVERGCSVVKVPYNSKKEEIISYNPDFVLVSNGPGDPENMSETVETVKNLIGMLPVTGICLGHQIITIALGGKTYKLKFGHRGGNQPVKDVESGKVYITSQNHGFATDDKIVPAGSELMHMNLNDDTVEGIRKLESSDLKNTVWSVQYHPEAGPGPHDARFLFDEMVELGIKFKAEKAN

SEQ ID NO: 33506 - protein, 438 aa, Streptococcus thermophilus LMG 18311
MVNYDLIVIGFGKAGKTLAAKMNAAGKKVAVIERSKAMYGGTCINIACIPTKTMIVAAEKGWSFDDTMKERGAVTSRLNAKNYKMLADNGVDVIDAEAHFVSNKVIEVVAGDDRQELTAETIVINTGAVSNILPIPGLTTTKHVYDSTGIQTLEALPKRLGILGGGNIGLEFAGLYNRLGSQVTVLDAATSFLPRVEPSIAKLAKQYMEEDGIVFEQGVRTSEVKNDGDEVVVVTDKGDFRFDALLYATGRKPNIEPLHLENTDIALTERGGIQVNKHLETSVPGVFAVGDVNGGLQFTYISLDDFRIVFNYLTGDGSYNLETRGAVPTALFLNPPLAQVGLTEDQARAAGGPVAVKELPVAGMPRGHVNGDLRGAFKAVVNPETKEILGVTLFGQESHEIINLITLAMNHHIPYTDLAKQIFTHPTMAENLNDLFAI

SEQ ID NO: 33507 - protein, 591 aa, Vibrio sp. Ex25
MVNPLAKILFAQWFPGLVQLKHYQKEWFVNDFRAAFSVVAVALPVAIAYAQLTGVSAIVGLYSCVLPMLVYAMMGTSRQLIVGPDAATCAVIAAVVTPLAAGDPTKHWQLVMTMTAMTGIWCVLASRFKLGVFADFLSRPILLGLLNGVALTIIVGQFAKVVGLKYEQRYLLERLWEAPQRLTELHWPTVTLSIVTVVVYLLTKRYRPTWPAAMLAILVTTASVWFFHLQEMGVSVVGLTQGGFPQFQTPEFELGEVRELVVPALNLAIVSFVSMMLTARSFAAKNGYDIDANKEFQALGFANIASAFSQGFAISGADSRTAVNDANGGKSQLVSIVAAITIAIIAVFIYEPLQFIPIASLGVVLIIASLSLLDLKAIWKLKSRDKDAFYLAIITFISVLIVGVIPGITLAVLLGLFQFLRIVMRPSDQLLGLDEKGTIRTIDDSGKASPIPGMVIYRFNSPLTYFNAPYFKRRVLEQVEHHKDASCVVIDAVSSFTHLDLSVMATLSDIHNTLKKRGVRLILAGRKRRLRQWCELTGISTSEGGILLRADMYLAIKLSGCYISAVGEGQIPTVQKEPDLEQPPKPIPEVA

SEQ ID NO: 33508 - protein, 237 aa, Arabidopsis thaliana
MSSQICRSASRAARSLLSSAKNARFFSEGRAIGAASVVHATGKVPQYASNFGKSGSGFVSNSWITGLLALPAAAFMLQDQEALAAEMERTFIAIKPDGVQRGLISEIITRFERKGYKLVGIKVMVPSKGFAQKHYHDLKERPFFNGLCNFLSSGPVVAMVWEGEGVIRYGRKLIGATDPQKSEPGTIRGDLAVVVGRNIIHGSDGPETAKDEISLWFKPEELVSYTSNAEKWIYGQN

SEQ ID NO: 33509 - protein, 325 aa, Cytophaga hutchinsonii ATCC 33406
MLLTTERLTKDISKAISKAEFGKEPTELYEPIRYIMDLGGKRMRPLLTILSNYIFTEDTNNVMNAAIAVEVFHNFTLMHDDIMDNAPLRRGKATVHAKWNTNIAILSGDVMLVEAYKQLMTIDEKYLKQVLDRFNETAAGVCEGQQFDMNFESLPTISVDDYINMIRLKTAVLLGFSMELGGILGDADEKSCTYLNTVGISAGIGFQLKDDLLDVYGDAATFGKQVGGDILANKKTFLLIRALEKAAGKTKKDLEKLLTDKTISDKAKIEGVTNIYDQLGIKEETEALIQQHFNTAIESLGKVKGSIFRKHYIKDYLLALIGREQ

SEQ ID NO: 33510 - protein, 345 aa, Vitis vinifera
MSNFSAANPNPNKSIEVAQPPTDSVSSLKFSPKANFLVATSWDNQVRCWEITRDGATTGSVPKASISHDQPVLCSAWKDDGTIVFSGGCDKQVKMWPLLSGGQPVTVAMHDAPIKEVAWVPEMNLLVTGSWDKTIKYWDTRQSNPVHTQQLPDRCYAFTVRHPLMVVGTADRNLIVFNLQNPQTEFKRITSPLKYQTRCVAAFPDQQGFLVGSIEGRVGVHHLDDAQQSKNFTFKCHREGNEIYSVNSLNFHPVHHTFATAGSDGAFNFWDKDSKQRLKAMSRCSQPIPCSAFNNDGSIFVYSVCYDWSKGAENHNPSTAKNHIFLHLPQESEVKGKPRVGTSRK

SEQ ID NO: 33511 - protein, 314 aa, Streptococcus thermophilus LMG 18311
MDRKPVSVKSYANIAIVKYWGKADADRMIPSTSSISLTLENMYTETKLSFLPKDATSDVMYIGDELQGEKETTKASKVLDIFRTDPNQPVKIETWNNMPTAAGLSSSSSGLSALVKAANELFQVGKTQSELAQIAKFASGSSSRSFFGPLAAWDKDSGEVYPVETDLKLAMIMLVLTDQKKPVSSRDGMKLCTETSTSFPEWIRQSELDYKDMLAYLKANDFQAVGELTEANALRMHQTTSTANPPFSYLTEASYQAMDKVKALRASGEQCYFTMDAGPNVKVLCMEEDLDRLAEHLRKDYQVIVSRTKELPDA

SEQ ID NO: 33512 - protein, 466 aa, Glycine max
  misc_feature (158)..(158): Xaa can be any naturally occurring amino acid
MASSFLSAASHAVSPSCSLSTTHKGKPMLGGNTLRFHKGPNSFSSSRSRGRISMAVAVNVSRFEGIPMAPPDPILGVSEAFKADNSDVKLNLGVGAYRTEELQPYVLNVVKKAENLMLERGDNKEYLPIEGLAAFNKATAELLLGADNPAIKQQRLHXVATVQGLSGTGSLRLGAALIERYFPGAKVLISAPTWGNHKNIFNDASVPWSEYRYYDPKTVGLDFEGMIEDIKSAPEGSFILLHGCAHNPTGIDPTPEQWEKIADLIEEKNHIPFFDVAYQGFASGSLDEDAASVRLFVARGIEVLVAQSYSKNLGLYAERIGAINVISSSPESAARVKSQLKRIARPMYSNPPVHGARIVADVVGNPVLFNEWKAEMEMMAGRIKNVRQQLYDSITSKDKSGKDWSFILKQIGMFSFTGLNKNQSDNMTNKWHVYMTKDGRISLAGLSLAKCEYLADAIIDSYHNVS

SEQ ID NO: 33513 - protein, 299 aa, Populus trichocarpa
MAEDHVPCDSNDHASNMKGANDSLVVCFGEMLIDFVSTVAGVSLAEAPAFKKAPGGAPANVAVGISRLDGSSAFMGKLGDDEFGYMLSDILKQNNVDNSGVRFDSTARTALAFVTLKDDGEREFLFFRHPSADMLLRESELDINLLEQARIFHYGSISLISEPCRSSQFAAMRIAKKSGSILSYDPNLRLALWPSAEAAREGIMSIWDQADVIKISEEEITFLTGCDDPNDDKVVMDKLFHPNLKLLIVTEGSKGCRYYTKEFKGWVPCVKVKPVDTTGAGDAFVGGMLSNLASNLNLF

SEQ ID NO: 33514 - protein, 355 aa, Salmonella enterica subsp. arizonae serovar 62:z4,z23:--
MRGIGLTHALADISGLAFDRIFMITEPDGTFITARQFPQMVRFTPSPLHDGLHLTAPDGSNALVRFTDFTPQDAPTEVWGNHFTARVAPTAINQWLSGFFSRDVQLRWVGPQLTRRVKRHNAVPLGFADGYPYLLTNEASLRDLQQRCPAGVQMEQFRPNLVVSGVAAWEEDNWKVLRIGDVIFDVVKPCSRCIFTTISPEKGQKHPSGEPLATLQAFRTALDNGDVDFGQNLIARNSGVIRVGDEVEILATAPAKAYGTAAVDDSITPDKHPDVSVTIDWQGQIFRGNNQQVLLEQLENQGIRIPYSCRAGICGCCRIRLLEGEVSPLKKSAIGDDGTILSCSCVPKTALRLEN

SEQ ID NO: 33515 - protein, 603 aa, Lolium perenne
MGIAEVALHTMPGAFASHSPASSLPLRTDTRSMRKRGTNSFYRTLGGPPKFPELRPVECQCQRIDDLAGVIEAGNGTWANDMVNKASQVLGDVAVPGQAIGGNASLSGNPEKVLPRRRNLSSVEDEAWDLLRESVVNYCGSPVGTIAANDPNDSNPANYDQVFIRDFIPSGIAFLLKGEYEIVRNFILHTLQLQSWEKTMDCHSPGQGLMPASFKVRTIPLDGDENATEEVLDPDFGEAAIGRVAPVDSGLWWIILLRAYGKCSGDLSVQERIDVQTGIKMILKLCLADGFDMFPTLLVTDGSCMIDRRMGIHGHPLEIQALFYSALLSAREMLTPEDGSADLIRALNNRLVALSFHIREYYWVDMQKLNEIYRYKTEEYSYDAVNKFNIYPDQVSPWLVEWIPPKGGYFIGNLQPAHMDFRFFSLGNLWSIVSSLATTQQSHAILDLIESKWSDLVAEMPLKICYPALENLEWKIITGSDPKNTPWSYHNGGSWPTLLWQLTVASLKMNRPEIAAKAVEIAERRIATDKWPEYYDTKRARFIGKQSRLYQTWSIAGYLVAKQLLDKPDAARILWNDEDTEILNAFSTNRKRGKKVLKKTYIV

SEQ ID NO: 33516 - protein, 353 aa, Burkholderia pseudomallei K96243
MILVTGGAGFIGANFVLDWLAQSDEAVLNVDKLTYAGNLGTLKSLQGNPKHVFARVDICDRAAIDALLAQHKPRAIVHFAAESHVDRSIHGPADFVQTNVVGTFTLLEAARQYWSALGPDAKAAFRFLHVSTDEVFGSLSPADPQFSETTPYAPNSPYSATKAGSDHLVRAYHHTYGLPVLTTNCSNNYGPYQFPEKLIPLMIANALGGKPLPVYGDGQNVRDWLYVGDHCSAIREVLARGVPGETYNVGGWNEKKNLDVVHTLCDLLDEARPKAGGSYRDQITYVTDRPGHDRRYAIDARKLERELGWKPAETFETGLAKTVRWYLDHQEWVDEVVSGDYRKWVETNYAQRA

SEQ ID NO: 33517 - protein, 293 aa, Oryza sativa Indica Group
MRGAVFWEPGRPLTLEDFRMPRPKAGELLIKTKACGVCHSDLHVLKGELPFSSPCVVGHEITGEVVDHGTHTPAAIINRFPVGSHVVGAFIMPCGNCFYCVKHPFYVFPGKPVYMYSMGGLAEYCVVPANALAVLPNSLPYTESAILGCAVFTAYGALRHAAEMRAGDSLAVIGVGGVGSSCLQIAKAFGASEVIAVDVLDEKLQNARTLGATHTVNAAKEDAVEKIKEITDGRGVDVAVEALEVLKDCLQIRVDIVDESLVKLIRESIGSGALVIWRTMDDFYNFFLGERCT

SEQ ID NO: 33518 - protein, 331 aa, Ashbya gossypii ATCC 10895
MVKVAINGLGKIGRLVMRIALSRANVEVVAINDPFITVDYAAYMFKYDSTHGKYAGDVQYEGNTLVIDGKKIKVFQERDPAQLPWGEEGIDIAIDSTGVFKELDSAQKHIDAGAKKVVITAPSSTAPMFVMGVNEEKYAGETIVSNASCTTNCLAPLAKVIDEQFGIEEGLMTTVHSLTATQKTVDGPSMKDWRGGRTASGNIIPSSTGAAKAVGKVLPQLNGKLTGMAFRVPTVDVSVVDLTVKLNKETTYDEIKAAIKAASEGKLKGILGYTEDAVVSTDFLGDNNSSIFDASAGIMLSPKFVKLVSWYDNEYGYSTRVVDLVEHVAAN

SEQ ID NO: 33519 - protein, 208 aa, Mesoplasma florum L1
MSKNVTLILIAGGTASGKTTVADRIANEILKGKSVTHISMDNYYKDFGELTLEERRKINFDHPNSVDTELLLNDLQALKDYQPIKVPVYDFKTSSRTKETITVKPSDVVILDGIFALAIKEIRKLGDIKIFIKTANDLRFIRRLQRDVNERGRTLESVVEQYLNEVKPMHDAFIGPSIEYADLIIPYKEGNEVAVDLVATKILTLLTE

SEQ ID NO: 33520 - protein, 229 aa, Phytophthora parasitica
LLQVLSLVAMEPPVQAAGHNYSNYIRDEKVKVLNCIEPIKLENTVLGQYEGSKERNEPGYLEDPTVPKGSVTPTFATAIMYVNNPRWSGVPFIMKAGKALNERKGEIRVQFRPPPGAQHLFPGVKIPVQELVLRLQPEEAVYMKMNVKSPGLQTQAISSELDLSYAERYEGAEVPDAYTRLILDVLRGKQAAFVRDDELRAAWKIFTPLLNEIETQKVKPLPYAFGSRG

SEQ ID NO: 33521 - protein, 351 aa, Ashbya gossypii ATCC 10895
MSAPTIPRTQKAVIFYENGGPLQYTDIEVPKPKATELLINVKYSGVCHTDLHAWKGDWPLPTKLPLVGGHEGAGVVVAMGENVRGWKIGDLAGIKWLNGSCMACEYCEKSNESNCPEADLSGYTHDGSFQQYATADAVQAAHIPAGTDLAQVAPILCAGITVYKALKSANLRAGDWVAISGACGGLGSLAIQYATAMGYRVLGIDGGEEKEQLFRQLGGEVFIDFRKSKDIVADVVKATNGGAHGVINVSVSEAAIESSTEYVRSNGTVVLVGLPGGAKCKSDVFSHVVKSISIVGSYVGNRADTREALDFFARGLVKSPIQVVGLSELPQIYEKMEKGAVVGRYVVDTSM

SEQ ID NO: 33522 - protein, 144 aa, Cicer arietinum
GVRVPISEDVFRLNELGEGGVVMDTGTAVTRLPTAAYDAFRDAFIGQTTNLPRSSDVSIFDTCYDLYGFVSVRVPTISFYFLGGPILTLPARNFLIPVNDVGTFCFAFAPSPSGLSIIGNIQQEGIEISVDGVNGFVGFGPNIC

SEQ ID NO: 33523 - protein, 208 aa, Herbaspirillum seropedicae
MTGLMKQSALDTQMLGMVPMVIEQSGRGERAYDIYSRLLKERIIFLVGPVNDAMANLIVAQLLFLESENPDKDISLYINSPGGSVSAGMAIFDTMQFIKPQVSTLCTGLAASMGAFLLAAGAKGKRFSLPNSRIMIHQPLGGAQGQASDIEIQAREILYLRERLNTILAEKTGRTVEQISKDTDRDNFMSADAAAEYGLIDKVLTERG

SEQ ID NO: 33524 - protein, 630 aa, Enterobacter cloacae
MAIEINVPDIGADEVEITEILVKVGDKVEAEQSLITVEGDKASMEVPSPQAGIVKEIKVSVGDKTETGKLIMIFDSADGAAAAAPAQEEKKAAPAAAAPAAAASAKEVNVPDIGGDEVEVTEILVKVGDTVAAEQSLITVEGDKASMEVPAPFAGTVKEIKINTGDKVSTGSLIMVFEVAGAAPAAAPAQAAAPALAAAPAAAGGAKDVNVPDIGGDEVEVTEVMVKVGDKVAAEQSLITVEGDKASMEVPAPFAGTVKEIKISTGDKVSTGSLIMVFEVEGAAPAAAPAAAAAPAAAAAPAQAAKPAAAPAAKAEKSEFAENDAYVHATPLIRRLAREFGVNLAKVKGTGRKGRILREDVQAYVKEAIKRAEAAPAATGGGIPGMLPWPKVDFSKFGEIEEVELGRIQKISGANLSRNWVMIPHVTHFDKTDITELEAFRKQQNEEAAKRKLDVKITPVVFIMKAVAAALEQMPRFNSSLSEDGQRLTLKKYINIGVAVDTPNGLVVPVFKDVNKKGIIELSRELMTISKKARDGKLTAGEMQGGCFTISSIGGLGTTHFAPIVNAPEVAILGVSKSAMEPVWNGKEFVPRLMLPISLSFDHRVIDGADGARFITIINNTLSDIRRLVM

SEQ ID NO: 33525 - protein, 175 aa, Cryptococcus neoformans var. neoformans B-3501A
MSFARRFVSTASTMSQVYFDIAINNAPAGRITFKLFDDVVPKTARNFRELCTGQNGFGYAGSGFHRVIPQFMLQGGDFTNHNGTGGKSIYGNKFADENFKLRHDRPFLLSMANAGPNTNGSQFFITTVVTSWLDGKHCVFGEVSSGQDLVRKIESYGSDSGKPKAKITITASGTV

SEQ ID NO: 33526 - protein, 512 aa, Oryza sativa
  misc_feature (287)..(287): Xaa can be any naturally occurring amino acid
MDGLAAPSPSHSGATSGGGASHRKRKLPPSSLSDATADEDDDTTAPSSPSTSPSSPSRPSSPSSSHSDDDDDDSLHTFTAARLDGAPPSSSGRPPKPESSTVSAAAAAAAAAAAPKPDSASAAAGDGKEDPKGLFTDNIQTSGAYSAREEGLKREEEAGRLKFLCYSNDGVDEHMIWLVGLKNIFARQLPNMPKEYIVRLVMDRTHKSMMVIRNNIVVGGITYRPYTSQKFGEIAFCAITADEQVKGYGTRLMSHLKQHARDADGLTHFLTYADNNAVGYFVKQGFXTKEITLDKERWQGYIKDYDGGILMECRIDQKLPYVDLATMIRRQRQAIDEKIRELSNCHIVYSGIDFQKKEAGIPRRTMKPEDIQGLREAGWTPDQWGHSKSRSAFSPDYSTYRQQLTNLMRSLLKNMNEHPDAWPFKEPVDSRDVPDYYDIIKDPIDLKTMSKRVESEQYYVTLEMFVADMKRMFSNAKTYNSPDTIYYKCASRLESFFSNKVASQLAQASTKN

SEQ ID NO: 33527 - protein, 486 aa, Mycobacterium smegmatis str. MC2 155
MTEHENRVVSGVQKRLFIDGKWVDATDGATFDVLDPATGEVLCAVADASPQDGRAALDAAVAAQPEFAALPPRERADMLTGAFELLHERIDDLALLMTLEMGKPLAEARGEITYAAEFFRHFAAEAVRIDGGYQTAPAGGSRFLIARQPVGPCLLITPWNFPMAMGTRKLGPAIAAGCTSVIKPAHQTPLSMLALMDILSEVGVPAGAVNCVTAMDAGGVMEPLIRSGLARKLSFTGSTKVGRMLLEQCAEKILRTSLELGGNAPLIVFEDADLDEAVEGAILAKMRNMGEACTAANRLFVHSSVIDEFGRRLAERMAEMPVGRGTEDGVRVGPLIDEAALQKVTSLVDDAVKRGATVLTGGSAPSGPGFFYPPTVLSGVPRDAEMVGQEIFGPVAPLTPFDTEEEAVAAANDTEYGLVSYVFTNDLRRALRVAEALETGMVGLNQGIVSNPAAPFGGIKESGLGREGGAVGIDEFLETKYVGIKM

SEQ ID NO: 33528 - protein, 162 aa, Nelumbo nucifera
MAPISVGDVIPDGTLSYFDENDDQQKVSIHSLAVGKKVILFGVPGAFTPTCSLKHVPGFIEKAEELKSKGVDEILLISVNDPFVMKAWAKTYPDNKHVKFLADGSATYTHALGLELDLSEKGLGTRSRRFALLVDDLKVKVANIESGGEFTVSSAEDILKAL

SEQ ID NO: 33529 - protein, 469 aa, Clostridium thermocellum ATCC 27405
MRKYGLKKIVWMLGILCFLVVSLNTSIFAADGKNVVLGDVNGDSKINAIDVLLMKKYILKVINDLPSDGVKAADVNADGQINSIDFTWLKKYMLKAVEKFPGEASNNPDAVIQFESGFAHSVLLKKDGTVWVLGNNGKGQLGLPEVSAVNEPVMINGLSGIKSVAAGREHTLALQEDGTLWAWGNNYSLQLIEYMERDPDTKERFTSIPIKVETHSDIKYVAAKFSRTLIVKNDGTVWLYSLPPINTSSDAEYMPWEIKGFGDIKMADIGTGHIVALREDGTVWTWGENVWGQLGNGWQQHHNIHTYIYFEPNQAKNLSDIVSIAAGDAHSVALKSDGTVWTWGSNFNGELGNGTTTYILEPKKVEGLEDIVAIDAGIGHTVALKADGTVWVWGKNSYGQLGNGTTMRSTVPIQVEGLEGIVAIQAGMECTIAYKNDGTVWAWGKNDFGQLGDGTFENILRPVKVFERK

SEQ ID NO: 33530 - protein, 160 aa, Buchnera aphidicola str. APS (Acyrthosiphon pisum)
MNIIQSGITAENSSIAIIIARFNEFINKNLLLGALDTLKRIGQVHEENILKIYVPGTYEIPTIASYIAKSGKYDAIIAIGTIIKGQTDHFKYIANDTSSSLSRISAQYFLPITLGILTTKNIEQSIERSGTKMGNKGSDAALAALEMINVMKKLKKVIYY

SEQ ID NO: 33531 - protein, 175 aa, marine gamma proteobacterium HTCC2143
MSFDKIPAGKDIPNDIYVVIEIPANHDPIKYEIDKEMDCLLVDRFMATPMFYPANYGYISNTLSEDGDPLDVLVVTPYPVAPGAVIRSRPIGILNMSDEAGQDAKLLAVPHDKLSSLYRDVKEPSDLPELLIKQIEHFFENYKDLEEGKWVKVDGWADSEAAKAEILKSIDAYKG

SEQ ID NO: 33532 - protein, 391 aa, Populus trichocarpa
MACANLVKLNAASSSWIGQKSPFGQRSQGSSTRRVSFSIRANSYTDELVQTAKTIASPGRGILAIDESNATCGKRLASIGLDNTETNRQAYRQLLLTTPSLGEYISGAILFEETLYQSTTDGKKFVDCLRDENIVPGIKVDKGLVPLPGSNNESWCQGLDGLASRSAEYYKQGARFAKWRTVVSIPCGPSALAVKEAAWGLARYAAISQDNGLVPIVEPEILLDGDHPIDRTLEVAEKVWSGVFYYLAENNVVFEGILLKPSMVTPGAEHKEKASADTIAKYTLTMLKRRVPPAVPGIMFLSGGQSEVQATLNLNAMNQSPNPWHVSFSYARALQNTVLKTWQGRPDNVEAAQKSLLVRAKANSLAQLGRYSAEGESEEATKGMFVKGYTY

SEQ ID NO: 33533 - protein, 430 aa, Vitis vinifera
MMYMGTPRDYEYYVALRVMMRSLMKLKVEADLVVIASTDVPLRWVQALEQEDGAKVVRVKNMNNPYKNQDHFDMRFKLTLNKLYAWSLVDYDRVIMLDSDNLFLQKTDELFQCGQFCAVFINPCIFHTGLFVLQPSMEVFRSMLHELAIGRENRDGADQGFLASYFPDLLDQPMFHQPPNATKLDGNYRLPLGYQMDASYYYLKLRWTIPCGPNSVITFPSAPWLKPWYWWSWPVLPLGLSWHRQRLQTLGYNAEMPVVLMQWIVYLGVIAMARLARSNLSKLCYRRVEKSSSSIQTGLKLLTLWSIVAAYVLPFFLIPRTVHPLLGWTLYLVGSFALSSIAMNAFLLPMLAVLTPGLGILGALLVMAFPWYPDGVVRALVVFAYAFCCAPIAWTSLVKIMTCHQVSPEKETKAAASWFPQLTPCPEQEV

SEQ ID NO: 33534 - protein, 332 aa, Polaromonas sp. JS666
MRYESILDAIGHTPLVRLNQLTRHLSCAVYAKLEFLSPGGSVKDRIGMYMIQQAERRGEIGPGATIVECTSGNTGMGLALFAAGRGYKTVFTIADKQSKEKVDMLRAMGAEVIVCPTDVPPDDPRGYIQAAQRLARDIPGAFLCNQYDNPDNTLAHYASTGPEIWNDTGGMVTHFVCGMGTCGTISGAGRYLKEQNAMVRVIGVDPQGSIFHELFHRGVTVQPHVYRLEGIGEDFIPKALDWHVIDDVIQVSDQGSFLMARRLARDEGIFAGGSSGAAMLAALQVAEKLGPNDLMVVLLPDGGRQYLGKLYNDDWMREHGYLDAKPDSAPRS

SEQ ID NO: 33535 - protein, 373 aa, Clostridium thermocellum ATCC 27405
MNKPLVMTPGPTYVHEDVRRAMQQEVGNPDVEESFFEFYRETCERLKELLKTKNDVIILSGEGILGLEAACASVIEPGDRVLCIDNGIFGNGFGDFVKMYGGEATYLKFDYRRAVDVNVVENFLKNDHNFKAATLVHCETPSGITNPIADICKMLKRYGILSIVDAVSSIGGEPLEADEWEIDVVLGGSQKCISAPPGLTFMSISRDAWNAILKRKTPIIGYYCNLAVWKSWYEDRWFPYTQPVSDIYALRAAVDRLLQDDLRIERHKNIADRVRAALADRGLELYPENGFSNTVTAFYVPDGATFTDIYNIMLSEHNILIAGSFGFLKDKVIRIGHMGENCYEDKILKTFAALDKTFEKLNIDLRNKLPGSR

SEQ ID NO: 33536 - protein, 479 aa, Escherichia coli K12
LISGRHDRKPYYAGEAAIMAINSPLNIAAQPGKTRLRKSLKLWQVVMMGLAYLTPMTVFDTFGIVSGISDGHVPASYLLALAGVLFTAISYGKLVRQFPEAGSAYTYAQKSINPHVGFMVGWSSLLDYLFLPMINVLLAKIYLSALFPEVPPWVWVVTFVAILTAANLKSVNLVANFNTLFVLVQISIMVVFIFLVVQGLHKGEGVGTVWSLQPFISENAHLIPIITGATIVCFSFLGFDAVTTLSEETPDAARVIPKAIFLTAVYGGVIFIAASFFMQLFFPDISRFKDPDAALPEIALYVGGKLFQSIFLCTTFVNTLASGLASHASVSRLLYVMGRDNVFPERVFGYVHPKWRTPALNVIMVGIVALSALFFDLVTATALINFGALVAFTFVNLSVFNHFWRRKGMNKSWKDHFHYLLMPLVGALTVGVLWVNLESTSLTLGLVWASLGGAYLWYLIRRYRKVPLYDGDRTPVSET

SEQ ID NO: 33537 - protein, 567 aa, Cytophaga hutchinsonii ATCC 33406
METLFLYIWQENERIKIHEPHMTNTSDFTSWKKLNEHYSKSSNLQMRDLFAADKDRFSKYSVQFNDILVDYSKNRITDETISLLIALAEEAGLKQAIEDMFAGKKINNTEKRSVLHVALRNRSNTPILSDGKDVMPEVNAVLEKMKGFCEKVRSGAWKGYTGKSITDIVNIGIGGSDLGPVMVTEALKPYGSPTLHVHFVSNVDGTHIVETTKKLNPETTLFIIASKTFTTQETITNAESAKAWFLQTAKDEAAVAKHFVALSTNAKSVAAFGIDTENMFEFWDWVGGRYSLWSAIGLSIALYIGYDNYIELLSGAHAMDKHFKETPFAKNIPVLLALIGIWYNNFYKAESHAILPYDQYMHRFAAYFQQGDMESNGKRVTKDGTAVTYSTGPIIWGEPGTNGQHAFYQLIHQGTKLIPCDFLAPVISQNPIGDHHPKLLANFFAQTEALMKGKTAAEAKAELEKAGLSAEDVAALVNHKVFEGNRPTNSIFFKKLTPFTLGSLIAMYEHKIYTQSVVWQINAFDQWGVELGKQLANAILPELKDNAAVTSHDSSTNGLINFYKANK

SEQ ID NO: 33538 - protein, 404 aa, Magnaporthe grisea 70-15
MAEPIPNKRAGADPIAPTPQNTPAQHAPITSHAQQPGVDSIKEEDFTAASIFAQNPKLVQMIQGRLGTLVGRSSGYIESLPPQVKRRVAGLKGIQKEHSKLEAEFQEEVLELEKKYFAKFTPLYQKRSAIVNGSNEPTESEIEAGEESDEVDEEGEKKEVKTEETAASEASDVKGIPEFWLSAMKNQISLAEMITDRDEQALKHLTDIRMEYLDKPGFRLIFEFSENEFFSNKTISKTYYYQNESGYGGDFIYDHAEGDKIEWKGDDKDLTVRVEQKKQRNKNTKQTRIVKKTVPTESFFNFFSPPKAPTEDDDDAASDIEDRLELDYQLGEDIKEKLIPRAIDWFTGEALAFEEMDEDDLEDDFEDEDDDDDLSEDHDDDEESDDDDDDASKPKQEAAECKQS

SEQ ID NO: 33539 - protein, 82 aa, Brassica napus
MGDNGIDTLILRGLHLFNLPLSHFLLLLFGEVSLDQFLAAAIDAAQKAGEVIRKGFYETKHVEHKGQVLVQTKTSGHVPMDT

SEQ ID NO: 33540 - protein, 447 aa, Methanococcus maripaludis S2
MVEKSTEYRKTKILVTMGPSLDGTFEKSLEFIDGIRFNMSHTNTKHIEKYLDILNKKNIAKLMDLKGNKIRIKKSNFSELIENQVVKLGKDILISYIPECIKKGQNILINDGKIKLIVESVEKDITARVLVGGHIKEKMGVNFPEGCFPNDLTDEDIKNVKFAVENEFEYIALSFVRSETDILNLKNLIKEYSGNCSVIAKIETKEGLKNIDEILNHSDGVMIARGDLGVEVAIEYLPIIQKNIIKLANEKGKLIITATQMLDSMVNNPYPTRAEVTDVANAIFDGTDCLMLSNETTIGKYPIESIKTLDNIARVSENDISKYKQEIEFEEHSIYSGIAYAVEALSKKLNPKIVITPTTSGKTPLRISKFRFNSPIIALAPENIVFRKLRLVWGVIPIKIDEIGDVDEVLEISKKIAKNIIDSGIYVVTLGHPKGEKKTNVIKVESI

SEQ ID NO: 33541 - protein, 431 aa, Acinetobacter sp. ADP1
MSFFALGVNHQTASVELREQVAFNAERLKDLLAQQRNHAHLNDMVVVSTCNRTEVYAMTEHADILLNWLAQTNGIDIKQLLHHVYRYEDAQAVTHLMRVASGLDSLMLGEPQILGQVKSALALSKESHTVSRDLNRIFEYAFYAAKRVRSETAVGSHAVSMGYAVAQLALQVFSNPEKLTVMMVAAGEMNTLVAKHLAEMGVAKVIICNRSRERAESLAQEIAHQVEVEIIGFDQLAANLHRADVVSSCTGSLHQVIFYQDVKAALKKRRYNQMLLVDLAVPRDIDSKVETLDGVYLYGVDDLQSVIDENLAQRRQAAVEAEVMVSQLASQLLTHQKIQQAGSTIQMYREFSQQQSQDEIARALTDLNKGHDAEDVLKQFAHRLTQKMMHPTSILLREAAQHESPDYFEWMKEQLTDVFEHQRKPKNNLDR

SEQ ID NO: 33542 - protein, 378 aa, Brassica napus
  misc_feature (203)..(203): Xaa can be any naturally occurring amino acid
MASASSLLRWNPPFTHTRRRQNRTTLFCSKPPQRESILFRFQIAVKYKQSDSGPCQNPFDQQIKKTLDSLKKPAVAAVLLGLLLFYDPNSALAASGGRIGGNSFSSRRSSSSSSSSYSVPRTLDPSSSSRYSAPYYGPSPLSGGLYVGPAVGFGFGGGFSSFSPILVGLAAFIVVSGFLSDRRSQGSTLTATQKTSVIKLQVXGLLGLGRTLQQDFNRLAENADTSTSEGLAYVLTDATLALLRHPDYCISCYSSVDVRRSIEDGEKRFNQLSIEERGKFDEETLVNVNSIKRQSSKIRTASGFSNEYIVVTILVAAEGTHKLQPINGTADMKEALQKIGSIPRNKIMAVEVLWTPQNEKDTLSERKLLEDYPLLRPL

SEQ ID NO: 33543 - protein, 392 aa, Brucella pinnipedialis
MAKTISLEMGAPITMARDQQAAAGLYHLNAFIQALENFKFEEERTDNSGEIIVREPIGVCGLITPWNWPMNQIALKVIPAIAVGCTVVLKPSEIAPMSAMLLAEILHEAGLPKGVFNLVNGEGLVVGEAMSRHADIDMMSFTGSTRAGTAVARGAADTVKRVSLELGGKSPNLIFADSDIESAVERAIAECFNNTGQSCNAPTRLLVENSVYDQVVQLAARAADQILVDDPALEGDHIGPLSSKVHFDKVQGLIQTGIDEGARLVAGGLGRPKGFNAGNYVRPTIFADVRYDMTIAREEIFGPVLVIIPFDDEQEAIAVANDTPYGLSAYVQTGSVERAKRLGRKLRAGMVQINGSSLGSGSPFGGYKQSGNGREGGKWGLEDFTEVKVITG

SEQ ID NO: 33544 - protein, 357 aa, Arabidopsis thaliana
MGIYLSTPKTDKFSEDGENHKLRYGLSSMQGWRASMEDAHAAILDLDDNTSFLGVYDGHGGKVVSKFCAKYLHQQVLSDEAYAAGDVGTSLQKAFFRMDEMMQGQRGWRELAVLGDKINKFSGMIEGLIWSPRSGDSANKPDAWAFEEGPHSDFAGPNSGSTACVAVVRDKQLFVANAGDSRCVISRKNQAYNLSRDHKPDLEAEKERILKAGGFIHAGRVNGSLNLSRAIGDMEFKQNKFLPSEKQIVTASPDVNTVELCDDDDFLVLACDGIWDCMTSQQLVDFIHEQLNSETKLSVVCEKVLDRCLAPNTSGGEGCDNMTMILVRFKNPTPSETELKPEASQAEGNHDEPSSSN

SEQ ID NO: 33545 - protein, 317 aa, Acinetobacter sp. ADP1
MPNLVVFSGNAHPQFAQKVVSHLHIPLGAASVGHFSDGEISVEITENVRGKDVFIVQPTCAPTNDNLMEILVMADALRRASAGRITAVIPYFGYARQDRRPRSARVPITAKVVADMLTTVGVDRVVMIDLHADQIQGFFDIPVDNIYGTPALLADLRQQSHDNLMVVSPDVGGVVRARAVAKQMGDIDLAIIDKRRQKANESQVMHLIGDVKDRDCVIVDDMVDTAGTLCKAADALKQFGARRVVAYATHPVLSGKALENLQNSVLDELVVTDTIPLSPEALNLGKIRQVSVASMVAETIRRINNEESISAMFDSYL

SEQ ID NO: 33546 - protein, 338 aa, Yarrowia lipolytica CLIB122
MAIKVGINGFGRIGRIVLRNALKNPEVEVVAVNDPFIDTEYAAYMFKYDSTHGRFKGKVEAKDGGLIIDGKHIQVFGERDPSNIPWGKAGADYVVESTGVFTGKEAASAHLKGGAKKVIISAPSGDAPMFVVGVNLDAYKPDMTVISNASCTTNCLAPLAKVVNDKYGIIEGLMTTVHSITATQKTVDGPSHKDWRGGRTASGNIIPSSTGAAKAVGKVIPELNGKLTGMSLRVPTVDVSVVDLTVRIKNGASYEDIKATMKAASESPELKGILGYTDEDVVSTDFIGDTHSSIFDAKAGIGLNDNFVKLISWYDNEYGYSARVVDLIVAVAKKDASA

SEQ ID NO: 33547 - protein, 314 aa, Photobacterium sp. SKA34
MSCCKKDVAAVMQQAFDLHKDNKDGANASYIPFLASVPSDLCGLAFVSVTGEIVKIQDVDYKYAIESISKIMTLGLALEQSGADAIHSKVGAEPTGLPFNSVMALELHNGKPLTPLVNAGAMATVSLIEADDKEQRWQKILAFQSALAGTNIEFSEDVNQSEQTTNAHNRAIALLLESSNRIYSDPLEACDVYTRQCSTLFNTVELATVGATYANGGKNPISGQQLVSPENASHILAEMMIEGLYDTSGDWAYDVGLPGKSGVGGGLVTIIPNVGALASFSPRIDQFGNSVRGQLMIKYVAQTMSWNLFNSKQH

SEQ ID NO: 33548 - protein, 466 aa, Photobacterium sp. SKA34
MALHEVTRKIGNDPIYGSDTIHNVAATTKLPQQEQAPNVIYQMIRDELYLDGNARQNLATFCQTWEEDEVHKLMDLSIDKNMIDKDEYPQSAEIEGRCVHILADLWNSPESVTTVGTSTTGSSEACMLGGLAALWRWREKRRALGQPTDKPNMVCGPVQVCWEKFARYWDIEMRETKMADGHYCMTPEDMLELVDANTIMVVPTFGQTFTGLYETVKPLSDALDTYEHDTGNAIDIHVDGASGAMLAPFCATEIDPWDFRLERVKSISTSGHKFGLAPLGCGWVVWRSKEDLPDGLVFHVNYLGGDMPTFALNFSRPAGQIIAQYYNFLRLGYEGYKRIHDASYDVCEYLVKELNKFNLFEFLFDGNREKGIPAISWRLKNNADVSFSLYDLADRLRTRGWLVPAYSLPANAQDIVVQRILVKQGLTIDLANLLIEDFKRSMDFLNTHAQAKCTAEDVKTFDHSGR

SEQ ID NO: 33549 - protein, 598 aa, Oryza sativa Indica Group
MDEEQLRALLRDLDALKQRPDPAAIDRMRERVAGMVTPAAAARSKIKDMSSEVVDSNPYSRLMALQRMGIVDNYERIRDYSIAIVNSVEGWWLSSSPAIIASCRRPPSPLVVASGCRRNPSAASRGPLEPVAACRGPPAAAARRGPPAAVAPRCRPPAVVDPGRGRLRLGCRAPSLGRSVSVSPIRIWIGRKKDLRRGNSSKGTSGSSQKSAGGLDSQEILMLLRRLTASAATGSVGSVALPSAQSGSAVLGSSSSTKGPSSASGGVGSVAAEMLTRCGIGRLLLYDYDTVELANMNRLFFRPDQVGMTKTDAAVQTLSGINPDVTLESYSLNITTVKGFETFLGSLKARSSDGRNTGVDLVLSCVDNYEARMVVNQACNELGQTWMESGVSEDAVSGHIQLLVPGETACFACAPPLVVASGVDERTLKREGVCAASLPTTMGVVAGLLVQNALKYLLKFGQVSPYLGYNSLKDYFPTMEMKPNPQCSNPACVQRQKEYMQSKPARDAAAKAKMEAEASAADECPVHLDNDWNISVVDDSDTVTPSILSTGADSLPEGLVRELPTADSYQEPVAPVTSGAIDDDLEELQRQLDALNSS

SEQ ID NO: 33550 - protein, 396 aa, Salmonella enterica subsp. arizonae serovar 62:z4,z23:--
MFENITAAPADPILGLADLFRADDRPGKINLGIGVYKDETGKTPVLTSVKKAEQYLLENETTKNYLGIDGIPEFARCTQELLFGKGSALINDKRARTAQTPGGTGALRVAADFLAKNTPVKRVWVSNPSWPNHKSVFNSAGLEVREYNYYDAANHSLDFDALLASLSEAHAGDVVLFHGCCHNPTGIDPTLEQWQTLAQLSVEKGWLPLFDFAYQGFARGLEEDAEGLRAFVALHKELIVASSYSKNFGLYNERVGACTLVAADAETVDCAFSQMKSAIRANYSNPPAHGASIVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 33551 - protein, 264 aa, Chlorobium tepidum TLS
MNLELQTAVKAAKAAGAITLSRFGELSHREIVAKEYKDFVTEVDKQCEATITATITESFPDDGLLCEEGTSGSGASGRTWIVDPLDGTLNFIHSFPVFGISIAMRDASGELAVGVVYQPVLDELFTAVKGRGAFLNGKRISVSTREEMQSYLFATGLPFRDYDHYMDGYIGLLRDVIKDSAGIRRAGSASIDLAYTAAGRFDGFFEYRLFPWDFAAGVLLVREAGGIVTGIAGSDDVFAHTSILAGSPLTHPLLLEKARRHFGA

SEQ ID NO: 33552 - protein, 215 aa, Ashbya gossypii ATCC 10895
MDQDNERNVSRLWRAFRTVKEMVRDRGYFITQEEVDLSLEDFKAKYCDSMGRPQRKMMSFQSNPTEETLKKSPNMGSVWVEFCDEPSVGIKTMKNFVIHIGEKNFQTGIFIYQNGITPSALKLLPSVAPATIETFNETALVVNITHHELVPKHIKLSDEEKKELLKRYRLKESQLPRIQRMDPVALYLGLKRGEVVKIIRKSETSGRYASYRICL

SEQ ID NO: 33553 - protein, 125 aa, Brassica napus
QPVRRNLIWLYWARFWTFNRRIFDPGGPKHTVVVEEGLLLLPLTDGPDGPLVRLFPKPRRFEGPGKKAPTLTKGFWFGGAVAGAIFVNREGTLLDGGTAFVREVTRAGGGRVIAWFGVLNLKGFV

SEQ ID NO: 33554 - protein, 363 aa, Yarrowia lipolytica CLIB122
MKGLILVGGYGTRLRPLTLTLPKPLVEFGNKPMILHQVESLAAAGVKDIVLAVNYRPEVMIETLKKYEEKYGVNITFSVETEPLGTAGPLKLAEEILCKDDTPFFVLNSDVICDYPFAELAEFHKKNNAEATIVATKVEEPSKYGVIVHKQGTSKIDRFVEKPVEFVGNRINAGIYILNPSVVDLIDLRPTSIEKETFPQLAARESLYSFDLEGYWMDVGQPKDFLSGTCLYLSSLSKKNPEALVPTSEPYVTGGNVLVDPTAKISPQAKIGPNVVIGPGAVIGEGARLSRCVVLANSTIKPHAFVKNSIIGWNGRVGRWARIENVSVFGDDVEVKDEVYVNGGRVLPHKTISGNIEKPEIIM

SEQ ID NO: 33555 - protein, 301 aa, Ashbya gossypii ATCC 10895
MGLLSYIRSAYEGDESEHTDLREMEKHIELCSSCDACSPEWEAEVARDTQVFARLKIEREASLYGTSKPASVHFVVPTSQMDWAHSACDERPGSVQQRVAAWVAQQDAGPDGMPMRCSVSSQPIDILDVEVMRGHKNNVLILPHFIKLVGLTADRVEQVLDELLPLLRANDMPALLARPDIWECPEDSFIFLCSHTTRDKRCGITAPVLRKHICAHLQTHGLYRDVSDARPHGCTVAFVNHVGGHKYSANAVIFLKRSRTMLWLGRVSPVHAEPIVKHLLLPAVPQLPFPENVRCVRKYDF

SEQ ID NO: 33556 - protein, 472 aa, Haemophilus somnus 2336
MKLLRVQQQFNGDKVMSAGKIIQIIGAVIDVEFPQNAVPKVYDALKVESGLTLEVQQQLGGGVVRCIALGSSDGLKRGLKVENTGNPISVPVGTKTLGRIMNVLGEPIDEKGEIGAEEYWAIHRAAPSYEEQSNSTELLETGIKVIDLICPFAKGGKVGLFGGAGVGKTVNMMELIRNIAIEHSGYSVFAGVGERTREGNDFYHEMTESNVLDKVSLVYGQMNEPPGNRLRVALTGLTMAEKFRDEGRDVLFFVDNIYRYTLAGTEVSALLGRMPSAVGYQPTLAEEMGVLQERITSTKTGSITSVQAVYVPADDLTDPSPATTFAHLDSTVVLSRNIASLGIYPAVDPLDSTSRQLDPLVVGQEHYDVARGVQGILQRYKELKDIIAILGMDELSEDDKLVVARARKIERFLSQPFFVAEVFTGSPGKYVSLKDTIRGFKGILDGEYDHIPEQAFYMVGSIEEVLEKAKKM

SEQ ID NO: 33557 - protein, 283 aa, Schizosaccharomyces pombe 972h-
MSESQTESTTVTLTNGMVIPRIGFGAFMLKYNECYGLVTQALDSGYRHIDTAAVYGNEDICGKAIVDWCEKNNVKRTDIFLTSKLANCSDYYSTRAAIRSSLHHLGTYIDLFLIQSPAGGKKSRIASWKAMEEFVDSGDIRSVGVSNYGVKHLQELYASNPKFYPCVNQIELHPFLSQDDIVKYCQSHDIAIEAYSPLTHGIRLNDEKLVPIAKKLNISVAQLLIRWSLQKGYIPIIKSTKKEHMLSDLDVFNFTIPDDVVQELSSFDEHWHAGTTYDPTVCD

SEQ ID NO: 33558 - protein, 286 aa, Brassica napus
MTKDVAGEKGSFSGKDYQDPPPEPLFDATELGRWSFYRALIAEFIATLLFLYVTVMTVIGYKSQTDPALNPDQCAGVGVLGIAWAFGGMIFILVYCTAGISGGHINPAVTFGLLLARKVTLLRAVMYMVAQCLGAICGVALVKSFQSSYYTRYGGGANGLTHGYSVGTGVAAEIIGTFVLVYTVFSATDPKRSARDSHVPVLAPLPIGFAVFIVHLATIPITGTGINPARSLGAAIIYNKDQAWDHHWIFWAGPFAGAALAGFYHRLVLRAGAVKALGSFRSQSRV

SEQ ID NO: 33559 - protein, 338 aa, Cryptococcus neoformans var. neoformans B-3501A
MPSFQIPKTMKAIQVDAPGGPEVNVLREIPVPTPNPDEVLIKVQYTGVNYIDTYYRSGLYPKKFPYTVGQDAVGTLVQGPSSPDVKFDIPLGTTVFTPAGSSFAEYLVAPSSRVGVVPEGVDPKDGVSWSTVGLTALALAKESYPVKKGDWVLIRAAAGGVGLVLTQIVKYLGGHVIGTVSSQDKAELVKSYGADLVLLSTDPSEDNVKKILEVTNGGVHGVYDGVGKDTWEEDFLVVRRKGTIVTFGNASGAVPAFAPLKLTPKALKVTRPTVWSIVTTPEEFKEYTTELVDIVKKAGLKFEVYKVYELTQEGVVQAQKDITSRGTTGKLLIHVADK

SEQ ID NO: 33560 - protein, 513 aa, Schizosaccharomyces pombe 972h-
MESQPVIWYCHSCSNEFQRPGNCPRCNSDFVEMVEPNTAPEDDPRAANFVNATEFNDPNAMLQNILQSLGQGVVPNVNPTDANRTANPNTNSNPNPNATNAQPNPTMFSTGQFSTEQGLPNVFFGAAAAQPGSGTPFVMPGIVNAAQIRNFFQNIMGGNAPQPEANSEQARNANTETSNPPFASAQTQGQEHRPSSPNPAEHMTGAYVNTPLNQPPSYAASTQPEFQQTTSPIFSSSSTPPPPPPRPSQPTSGESQNTNPRFPFSAQSFVFSVGPNGALHQVNTSTENPQNAQAGAIPITDLGSILERIFGSLNQPGAQQGEGEPFNPANMFSNIFNLSGNPGDYAWGARGLDDIISQLMEQAQGHNAPAPAPEDVIAKMKVQKPPKELIDEEGECTICMEMFKINDDVIQLPCKHYFHENCIKPWLRVNGTCAICRAPVDPNSQQRNNTSTDSANGHNPSNHANPSTSTTNDQGATLRNESFNAASQSNLSSEHGHSSRTPMDDFVDEEPLE

SEQ ID NO: 33561 - protein, 494 aa, Haemophilus influenzae Rd KW20
MQTDNNCIVIFGASGDLTHRKLIPALYNLYKIGRLSENFSVLGVARSDLNDETFREKMREALIHNEETTPETLDAFCSHLYYQAVNTSDAQDYGKLVPRLDDLHDKYQTCGNTFYYMSTPPSLYGVIPECLAAHGLNTEEYGWKRIIVEKPFGYDEKTAQTLDVQIHRFFEEHQIYRIDHYLGKETVQNLLVLRFSNGWFEPLWNRNFIDYVEITGAESIGVEERGGYYDGSGAMRDMFQNHLLQVLAMVAMEPPAIINANSMRDEVAKVMHSLRPLTSEDMENNLVLGQYTAAEINGKMEKGYLEEKGVPANSRTETYIALRCEIENWRWAGVPFYVRTGKRLPARVTEIVIHFKTTPHPVFSQNAPENKLIIRIQPDEAISMRFGLKKPGAGFEAKEVSMDFRYADLAGAQVLTAYERLLLDAMKGDATLFARTDAVHAAWKFVQPILDYKANGGRIHEYEAGTWGPVAADKLIAKQGKVWRKPSGLMKKKV

SEQ ID NO: 33562 - protein, 228 aa, Haemophilus influenzae Rd KW20
MTEADLFVSQFLTEKLTALFPNVPVLSEENCHISFEERKNWKEYWLIDPLDGTQQFINRTDQFSVLITLVRKNKPVLSVIHAPILSTTYYAMCDFGTFKKQLDQVKKLTKNTTNFDRPLRIAVGATTSQEKVRSILPKDFPCEFVVVGSSSLKSGLVAEGAVDCYVRLGQTGEWDTAGAEVLLGETHGAIFDSHFEPLTYNQRETLINPHFVMVGDQSFDWRSIFQFN

SEQ ID NO: 33563 - protein, 354 aa, Neisseria meningitidis MC58
MASYDKISDGWYRVCPKRSSNRALITVKLPFSTLFRLKPMTDITPFANRLGKNIKHLMKWAKRNGIEAWRIYDRDIPQFPFAADVYGDRIHLQEYDTGWLMRPEEYEAWLAEVLEAVAFVTGFAPEQIRLKRRERQKGLQQYEKTGKAGDDFVITENGRKFWVNLDKYLDTGLFLDHRNTRKKVGETAAGKRFLNLFSYTGSFTVYAATGGAASSETVDLSNTYLDWAKRNFELNGIDTERHKIVRADVFQYLQTAYGEGRRFDLIVMDPPSFSNSKKMSDILDIQRDHKKLIDGAVKLLASDGILYFSNNLRSFVLDDLVSEQYAVKDISKQSVPEDFRNKKIHRCWEIRHKS

SEQ ID NO: 33564 - protein, 462 aa, Neisseria meningitidis MC58
MSIKFADLNLDKNILSAVSSEGYESPTPIQAQAIPFALEGRDIMASAQTGSGKTAAFLLPTLQKLTKRSEKPGKGPRALVLTPTRELAAQVEKNALAYAKNMRWFRTVSIVGGASFGYQTRALSKPVDLIVATPGRLMDLMQSGKVDFERLEVLILDEADRMLDMGFIDDIETIVEATPSDRQTLLFSATWDGAVGKLARKLTKDPEIIEVERVDDQGKIEEQLLYCDDMRHKNRLLDHILRDANIDQCVIFTSTKAMTEVIADELYEKGFAANCLHGDMPQGWRNRTLMDLRKGRCKILVATDVAARGIDVPTITHVINYDLPKQAEDYVHRIGRTGRAGRTGIAITFAEVNEYVKVHKIEKYINRKLPELTIEGMEPTRKRKSAGGKPKGKGGWGDRKSGGWRGDHKPSKEGFGGKTRGEGFKKEGFKRDGFKKTGEGFKGKRKAGDSFAGKGERRYKDR

SEQ ID NO: 33565 - protein, 855 aa, Schizosaccharomyces pombe 972h-
MKRTRSEKTLSFLNPSRASSNTHLSREGTNRSSNVTRTVSGRKSNHGSSLTDTGESDQLSLKSFGAIRQPSQHRSSLFSRMLGSTSHIFGIREDMDNESSEEERDGIPRVEGNAADPFSWIPDGKNVWDSPPKYIRVLSHNKKEKSLDHLFLAQELYCKPTLAATHDRYYEPRATDFPNLAHESSEPSSSRHTADAQSITNASVHLHNSSSPLNRTPSVISDTLAVAITSNSSSNSSNNAIWAMKFSRDGRYLAVGGQDRILRIWAVLDSEHARSVASETCSSDPNNPKLNLKAPVFSEAPIREYAGHTADILDLSWSRNNFLLSSSMDKTARLWHPVRKDCLCCFEHSDFVTSIAFHPKDDRFFLSGSLDCKLRLWSIKEKAVSFWNELPELITAVAFSPDGGLAIAGTFVGLCLFYDTRGLRFRTQMSIRSSRGKNAKGSKVTGIQTRTQMIDNIAGDTEMLVTTNDSRIRIYNLRDKSLELKFKGHANAQSQNRAYFDDDGNYVICGSEDHQVFIWDLPPQHMHKTKKKKHEHFKASVRPITAAVFAPTKTKQLLTLSGDPVYLAAISARRSSVISNASIETGPSLRNLKSLSHSYLPIEIMKGHIIVCGDLDGRIRVFRQDSVFAARKLIEKKNIERKNSETLSNSSFFPQALKAHMNSISSPKRHFSLRHKKNASQITNNENNGNDDIKKGDEPEEEHVGLRKNSTQEKNANLDPNEALKRADMMMLQEGASSMVYYSLTNLDNPGATVNEAAKTAATIEQNEHEIQTSVDPISNVKAILPNADDVSSKNSSTEDQLECLRCGNSLFNVFSRSFVFEGAKFSIVCSHCNRKLLKSGSDDGSETHEMSTLP

SEQ ID NO: 33566 - protein, 608 aa, Buchnera aphidicola str. APS (Acyrthosiphon pisum)
MNFNFNKYPILSFANSVENLRLLSVEQLPQLCFELREYLLDVVSISKGHFASGLGVVEITVALHYVYNTPFDNLLWDTGHQAYPHKILTGRGEKINSIRKKNGLHSFPCREESEYDSLSVGHSSTSISAGLGMSIAAEKEGRNRKTICIIGDGAMTAGMAFEAINHAGEIQSNLLVILNDNQMSISRNVGALNKHLKILRSVQNTQKNRKKIRLLNKKLFFKDKRIQNHSISFNSIFSNLGCKYLGPFDGHNIFSIINTLKKIKNKKGTYLLHLVTKKGKGYLPAELNPIKWHTISSRDSSVSKSLSYSDVFGTWLCEIAAFDKKLIAITPAMCEGSGMVKFSRLFPNQYFDVAIAEQHAVTFAAGLAISGYKPVVSIYSTFFQRAYDQLIHDIALQKLSVLFAVDRAGIVGNDGQTHQGVFDLAYLRCIPGIVIMTPSNENECRQMLYTGYMHNKGPSVVRYPKGYGVGELLMPMNRIPIGKSLIKRRGKKIAILNFGILLHNAYCAAEKLDATLVDMRFVKPLDKSMILKLSSQNKFFITLEEGVISGGAGSAVNEFIMVNKIFLPVLNIGLPDTFIPQGTQEEIRHVYKLDSEGIYKQIFYWLRQ

SEQ ID NO: 33567 - protein, 331 aa, Nelumbo nucifera
MDSKALFFFALVCFCAVALRPVFAENEEDPGLVMTFYKDSCPQAEDIIKEQVKLLYKRHKNTAFSWLRNIFHDCAVQSCDASLLLDSTRRDLSEKETDRSFGLRNFRYLDTIKEAVERECPGVVSCADILVLSARDGIVALGGPYIPLKTGRRDGRRSRADVIEQFLPDHNESISVVLDRFAAMGIDTPGVVALLGAHSVGRTHCVKLVHRLYPEVDPALNPDHVEHMFKKCPDPIPDPKAVQYVRNDRGTPMKLDNNYYRNIMDNKGLLIVDHQLANDKRTKPYVKKMAKSQDYFFKEFARAITILSENNPLTGTKGEIRKQCSVANKHH

SEQ ID NO: 33568 - protein, 855 aa, Oryza sativa
  misc_feature (669)..(669): Xaa can be any naturally occurring amino acid
MALFLFLAAIVLAAASPAVGQLPAGFLSIDCGLEANYSGYKDTDTGIVYVSDDPYVDTGKNHRISADSTYQRFYQTIRSFPTGERNCYALPTVYGDKYIVRVMISRNSQMISLLWPTLPQFALHLGANYWDTVQDDSTEVYEALFMAWASWAPVCLVNTDQGTPYASAIELRPLGNELYPAVMANQSMRMSIRCRMGQTDSSITRFPDDQHDRYWWTTPTNPMWANLSTTSDIQEESSLFGVPSAILQKAVTVVGNGTMLNVTWEDRLFIEFMVFLHFADFQDSKIRQFNVYFNNDSPLLYTPLYLAADYVYSVVWYSSTNGKFNITLVATAKSLLPPMLNAYEIYTLIAHSTPTTFSKDFDVIMAIKFEYGIKKNWMGDPCSPSQFAWDGVICRNTSDNIPRIISLDLSNSNLHGVISNNFTLLTALENLNLTGNQLDGTIPDSLCKLNAGSFIFSYNSDQDVCNKTSPSSSRSRATILAISIAAPVMVVAILGTSYMIWRVKRKSNFFAYNPPRVLEHTNASRNEKYHWDHLQENENRQFTYEDLEKITDNFQLIIGEGGSGRVYHGRLEDNTEVAVKMLSGTSSSGLNGFLAEVQSLTKVHHKNLVSLVGYCSEKAHLALVYEYMSRGNLFDHLRGKSGVGAKLQLGNACRVLLDAAQGVDYLHKXGCNKSIIHRDVKTSNILLGQNLRAKIADFGLSKTYISDSQSHMSATVAGSMGYIDPEYYHTGWITENSDVYSFGVVLLEVVTGELPILQGHGHIIQRVKQKVDSGDISSIADQRLGSDYDVSSMWKVVEIALLCTEPVAARRPSMAAVVAQLKDSLTLEEAREERGLKENPTDEVAMLPTSGPSAR

SEQ ID NO: 33569 - protein, 282 aa, Buchnera aphidicola str. APS (Acyrthosiphon pisum)
MHFFHLYERYKHRINQKLFYTLNQLPFQKSSLLKAMKYSVFSGSKRLRSSLIYSTGDVFKVNITTLDVISTAIEFIHSYSLIHDDLPCMDNDNFRRGKISCHVKYGESTSLLAGDALQSLAFNILSNSFMPNVSNLKRIKMISELSYSIGSSGMCMGQNLDLEAEKKDVNLSELEIINLYKTSFLMRSAVRLVYFSSNNFSKSILSILDLFSISIGLAFQIQDDILDFKKDSVKTDNKKIIKKHTYPLIIGLDESRKKIKQLHKKSFLALNSLKKKISIPTY

SEQ ID NO: 33570 - protein, 731 aa, Erwinia carotovora subsp. atroseptica SCRI1043
MNDQQPFSVTASPTTEKTSAFSLTIRPDNIGVISIDVPGERVNTLKSEFAEQILSVFELARQHATLRGLIFISAKPDSFIAGADITMLNKCSSAEQAENLAKQGQETFDQIAALPFPVVAAIHGACLGGGLELALACDYRVCSLDEKTVLGLPEVQLGLLPGSGGTQRLPRLIGLDSALDLILTGRHLRAGQALRQGLVDEAVPHDILLDTAVEILKKGKRKAVPLGWRSRLLNSPGIRHLLFKMVKRKTRAKTHGNYPATEKIIQVVRRGIEKGREEGYRHEARAFGKLVMTPESAALRHLFFATNALKKTSGAASEAKPIHRVGILGGGLMGGGIASVTATRGQLPVRIKDINEQGINHALKYNWQLLTKRVQSKRMKPTERQRLMTLISGSTDYRGFEHADIVIEAVFEDLALKRQMITEIEDHAAPHTIFASNTSSLPIHQIAEGARRPQLVVGLHYFSPVDKMPLVEVIPHAHTSAETVATTVALARKQGKTAIVVGDSAGFYVNRILAPYINEAAYCLLEGEPIESIDYALVRFGFPVGPLALLDEVGIDVATKIVPVLSEELGDRFTSPPAFDAILKDGRKGRKNGKGFYRYNKTRRFWHSGKEVDSSVYPLLDVTPKAHIDPALISQRAVMMMLNEAARCLDEGVIQCARDGDIGAVFGIGFPPFLGGPFHYMDRLGMETVVKTLLVLQQQYGDRFAPCERLLTMREGQRTFYPPADKDNSIS

SEQ ID NO: 33571 - protein, 323 aa, Triticum aestivum
MSGGHGDAGMASGKMAKLKELLQKSENRICADCSAPDPNWASANIGVFICVKCSGVHRSVGTHISKVMSVTLDKWSDDEIDSMVEVGGNSQANAIYEAFLPEGYRKPHPDSAQEERQKFIKSKYELQEFLEPSLRIVSNHPSDAGKQASNSHSASSKSEIGMVEFIGILNVKVIGGTKLAIRDMSSSDPYVVLTLGQQKAQTSVIKGNLNPVWNEELKLSVPQKYGPLKLQVLDHDMVSKDDLMGEAEIDLQPMINAAASFGDPELLGDIQIGRWLKSGDNALTADSAVMVTGGKVKQEVTLKLQHTESGEVTVEMEWMALNI

SEQ ID NO: 33572 - protein, 398 aa, Neisseria meningitidis MC58
MQNYLTPNFAFAPMIPERASGSRVWDTKGREYIDFSGGIAVNALGHCHPALVDALNAQMHKLWHISNIYTTRPAQELAQKLVANSFADKVFFCNSGSEANEAALKLARKYARDRFGGGKSEIVACINSFHGRTLFTVSVGGQPKYSKDYAPLPQGITHVPFNDIAALEAAVGEQTCAVIIEPIQGESGILPATAEYLQTARRLCDRHNALLILDEVQTGMGHTGRLFAYEHYGIVPDILSSAKALGCGFPIGAMLATEKIAAAFQPGTHGSTFGGNPMACAVGSRAFDIINTPETLNHVREQGQKLQTALLDLCRKTGLFSQVRGMGLLLGCVLDEAYRGRASEITAAALKHGVMILVAGADVLRFAPSLLLNDEDMAEGLRRLEHALTEFAATSDNP

SEQ ID NO: 33573 - protein, 296 aa, Zea mays
  misc_feature (225)..(225): Xaa can be any naturally occurring amino acid
  misc_feature (258)..(258): Xaa can be any naturally occurring amino acid
GYHGEVYTNPSEVLRKQYAEVVEEERQLSQGLDALRELPCVTLDGHRVPLLVNTGLLADVARAQQRGAEGVGLYRTEVPFMINQRFPSEKEQLAIYREQLSAFHPLPVTMRSLDIGGDKSLSYFPIKEDNPFLGWRGIRVTLDHPEIFLVQTRAMLKASEGLNNLRILLPMISGTHELEEALHLIHRAWGEVRDEGADVPMPPIGVMIEIPAAVYQAKELARQVXFLSVGSNDLTQYLLAVDRNNPRVADLYDYLHPXAVLQALQNVVRDAHAEGKQVSICGEMAGDPAAAVLLMA

SEQ ID NO: 33574 - protein, 456 aa, Zea mays
MQKQTGKSGGTGGGTPAKRGRPFGSTTGGGAAAAAAAAAVVDPGAPAALVGPSLQVLSALSDQNNKRIVLALQSGLKSEILWALNALTVLSFKEKDDLRRDATPLAKVPGLLDALLQVIDEWSDISMPKDHTKPPRLRTLGANTTLSGFGQENMEKVYSDTATTSNDQSKAEDSSVTKKRAASFWFDEDGLFNNDDEGRAERQQCAIAASNIIRNFSFMPENEIIMVQHRHCLETIFHCLENQNREDDELITNMLETLVNLAPVLDLRIFSSSKPSFIKMTEKGAIHAIMGMLSSSVKPWHCAAAELIGRLIINPDNEPFLLPIIPQIYKRLVDLLSVPAYDAQAAAVSALYNVAEVNMDCRLKLASERWAVDRLLKIVKTPHPVPEVCRKTSMILESLVSEPQNRMHLLVHENTFAEILTSEGKYSDTFARIVYELTARPSNKVTSGHAIWGNIN

SEQ ID NO: 33575 - protein, 288 aa, Populus trichocarpa
MYGIAVAALGMLSTIATGLAIDAYGPISDNAGGIAEMAGMSHRIRERTDALDAAGNTTAAIGKGFAIGSAALVSLALFGAFVSRASISTVDVLTPKVFIGLIVGAMLPYRFSAMTMKSVGSAALKMVEEVRRQFNTIPGLMEGTAKPDYATCVKISTDASIKEMIPPGALVMLTPLIVGIFFGVETLSGVLAGSLVSGVQIAISASNTGGAWDNAKKYIEAGASEHARSLGPKGSDPHKAAVIGDTIGDPLKDTSGPSLNILIKLMAVESLVFAPFFATHGGLLFKIF

SEQ ID NO: 33576 - protein, 219 aa, Acinetobacter sp. ADP1
MSSLIQAEIFFSALSPAEQRIQQALDDIRHGKPVLVMDDFDRENEADLIVAAETLNVETMARMIRDGSGIVCFCLTEQLADHLELTPMVQNNSSQFHTAFTVTIEAAQGVTTGVSAKDRVKTIHTAIQDGAIASDLNRPGHVFPLRARDGGVLTRRGHTEATIDLARLAGLKPSGVLCELTNPDGSMATGIQVLAYAQTHHLTVITIEELVQYRIKHNV

SEQ ID NO: 33577 - protein, 280 aa, Chlorobium tepidum TLS
MTNWLIAYQGEPGAYSEIAALRFGEPLPCESFDDVFSAVTEQKADYAVIPIENSLGGSIHQNYDLLLRRPVVILAETFVKVEHCLLGLPGASVETATKAMSHPQALVQCHNFFATHPQIRAEAAYDTAGSAKMVAESRDKSALAIASKRAGELYGLDILKENLADEEWNITRFFCIAHENNPDISHLKVRPDVARQKTSIVFALPNEQGSLFRALATFALRGIDLTKIESRPSRKKAFEYLFYADFIGHREDQNVHNALENLREFATMVKVLGSYGVVNP

SEQ ID NO: 33578 - protein, 326 aa, Rhizobium leguminosarum bv. viciae 3841
MTKTQAVSFSRTGGPEVFDYVEIDLPSPSAGEVQIRQAAVGLNFIDVYFRNGTYKAPHLPFVTGKEGAGTVTSVGPGVEDFKVGDRVAYAGADGAYSAGRNVETRHLVHVPDGIELETAAAMMLKGMTAEYLLNRTFKVGPQTVLLFHAAAGGVGLIAGQWAKALGATVIGTAGSEDKIELALAHGYDHVINYKSDSFVDRVRDITGGKGVDVVYDSIGRDTFPQSLDCLKPRGLFASFGQSSGPIENFTLAALAQRGSLFATRPTLFTYIAARQELIDSAKALFDIVQSNKVRININQTYPLREVGQAHADLETRKTTGTTLLIP

SEQ ID NO: 33579 - protein, 339 aa, Rhodopirellula baltica SH 1
MSTLRKFATAAAAGYAGIVVTRAIVRRKRTFDWQNKRVVITGGSRGLGLVIARQLADQGARIAITARTEEDLCAAAAELRRRGAEVIAHPCDVRDREQVATFIDRVTNQFDGIDVLLNVAGIITVGPFESMTMEDFQSAMQTNCWGALHVAMEVLPHMRAAGWGRIVNIASLGGKRAVPHMLPYAASKFALVGLSNGMRAELKADNIFVTTACPSLMRTGSPRNAIFKGQHRDEYAWFSIGDSLPGLSMNAEAAAEQILTACQHGRGEVFIRSPLNVTIALQNLFPELTQEILALAASVLPKMGGIGRTAAKGHQSQSEWSPSVLTTLTEQAAIRNNQI

SEQ ID NO: 33580 - protein, 220 aa, Chlorobium tepidum TLS
MPGKTTLLAPSILSADFTNLKASVELAEKAGADWMHCDVMDGIFVPNITFGSFIVQAIKQCTSIVIDTHLMIVDPDKYIEDFAKAGSDQITVHLEACPHLHRTIQLIKSLGVKAGVSINPATPVSLLEPVLADLDLVLLMSVNPGFGGQKFIPGAIKKIMQLDAMRMEMNPEMVIAVDGGVTEENAAMIVDAGADALIAGTAFFRAPDPVAAAKKLKGLE

SEQ ID NO: 33581 - protein, 493 aa, Bordetella parapertussis 12822
MSLSVGNAALLPGRNLIGSEWREAALGARFAVADPATGKVIAHVPDSGARDAGAAVTAAHQAFADWRRTPAKVRAQIIKRWNALLHENAEDLARLISSEQGKPLAEARGEVSYAASYVEWFAEEATRADGDLIPSPAQGRRMFALREPVGVVAAITPWNFPAAMIARKIAPALAAGCTVVCKPAEDTPLTSLALTALAQQAGVPPGVLNIVTASRGRAAEVADAWLDDPRVRKITFTGSTPVGKHLARRSADTLKRVSLELGGNAPFIVFDDADLDAAVEGLMVSKFRNGGQTCVCPNRIFVQAGVHDAFVRKLAARVEGLVVGPASDPASQIGPMINARAVEKIEHHVADALERGARLAVGGKRIHSARCAGDHYYAPTVLTGVDETMACFREETFGPVAPITVFASEADVVAAANATAFGLAAYFYSTDVRRIWRLADALETGIVGVNEGALAAEAAPFGGVKDSGYGREGSRHGLAEYMQIKYVCQGQLD

SEQ ID NO: 33582 - protein, 297 aa, Herbaspirillum seropedicae
MTTDLTNVAPQIKAEILAEALPYIRKFHGKTIVVKYGGNAMTEESLKHGFARDVILLKLVGMNPVVVHGGGPQIDAALKKIGKQGTFVQGMRITDEETMEVVEWVLGGEVQQDIVMLINHYGGQAVGLTGKDGGLIRARKMQMPDKEHPGAFLDIGYVGEIEAINPAVVKALQDDAFIPIISPIGFGDDGQAYNINADVVAGKIAEILHAEKLIMMTNIAGVQDKAGNLLTDLSAREIDEMFADGTISGGMLPKISSALDAAKSGVNTVHIIDGRIEHSLLLEVLTEQAFGTMIRSH

SEQ ID NO: 33583 - protein, 627 aa, Propionibacterium acnes
MPRMALLDDIGCPDDVRKLTTKQAEDLAEEIRAFLIDKVSRTGGHLGPNLGVVELTIALHRVFDSPHDPIIFDTGHQSYVHKILTGRANGFEKLRQRGGLSGYPSRAESVHDWVENSHASASLSWAEGMAKGFLSQGEDRTVVAVIGDGALTGGMAWEALNSIADQQGLRLVIVVNDNGRSYTPTVGGLANQLAIIRTDPHYEEALDRMKRHVTDKPLGKQVFGLMHAAKAGVKDALIGNGIFSDLGIKYLGPVDGHDVLSVERALELAKRYGHPVIVHVMTTKGKGFAAAEANEEDHFHAVGRIDPVTGASLKASGGASWTQAFAGAMVELGERRPDIVGVTAAMLHPVGLAPFAARHPDRVLDVGIAEQHAVTSAAGMAAAGLHPVVALYSTFLNRAFDQLLMDAGLHHAGVTIVLDRAGITGTDGASHNGMWDMAMCGIVPGLMLSAPRDRQHLVSVLNEAVDIDDRPTVIRYSKDPIPDDIRIVTSHDGLDVLCDGPEDGILLVAHGQLCAEALAAVDQLDSPVRVVSPRWSLPVCGGLIEEAARARAVVSVEDGLVVSGLGSHLADALSQRGMWRPIRSLGIPQRYLDHDSRSAIMAELGLDSRGIADAVSQLVAQLDGEYS

SEQ ID NO: 33584 - protein, 500 aa, Mycobacterium sp. MCS
MTANRRPEGVPQRIQHFIGGKLVDSLADTWFDVIDPVTNQPYAQAAAGQADDVDRAVAAAKVAFRTGPWPNMQARSRSRVLNRIADAIESRDARLAELESFDSGLPITQALGQARRAAENFRFFADLVVAQADDAYKVPGSQINYVNRKPKGVAGLITPWNTPFMLESWKLAPALASGCTVVLKPAEFTPLSAGLWADIFRDAGVPDGVFNLVNGIGEEAGDALVKHPDVRVISFTGESATGEIIFRNCATGLKGMSMELGGKSPAVVFADADLDAALDSTLFGVFSLNGERCTAGSRILVEEEIYDEFVERFAARAAGIVVGDPQDPRTEVGALVHPEHFAKVMSYIDVGKTEGRLLCGGGRPAHLPQGNFVAPTAFADVEPNARIFQEEIFGPVVALSRFQTEEQALALANGVKYGLAAYIWTNDLKRAHRFAQNVDSGMVWVNSHNVRDLRTPFGGVKASGLGHEGGYRSLDFYTDQQAVHITLGDVHTPRFGITAR

SEQ ID NO: 33585 - protein, 964 aa, Vitis vinifera
  misc_feature (54)..(54): Xaa can be any naturally occurring amino acid
MGTLQGPVICPTVRAKEAGVYTLPVSLPLKKTKIFRSGFWGFRGNCGGRTKAGXVPHQLHTRKCKTLQCSFSSSSDGNGSMAENFNENDEDYVNSSVVEAVEVKSGADGFMIKMRDGRHLRCVHNNPQGGHMPDYAPHPAIVLKMEDGTGLLLPIIARPTLYQVMKEMIDKMGYAVKLVRVTKRVHEAYFAQLYLTKAYSCCTPCSLIDCLVGNEKESVSFDLRPSDAINIAVRCKVPIQVNKYLAYSDGMRVIESAKVSVQASSSDGLLFTELDRPSGQPCIETKEFDLVRNMLIAAVEERYRDADNGVTVASNKSHWVLYHIHFEPVAHIPVTELVPAAALKYGFEGANHDERRERKSDFENSEDDRRTRIGNLKKKAINASSKFKHSLKKKGRRKSHDHLLSVSIKDVRDVEELQAVEAFRQALISDDLLPDRHDDYHMLLRFLKARKFDMEKAKHMWTEMIHWRKNFGTDTILEGYHGVDKEGRPVYIERLGKVDSNKLVQVTTLDRYVKYHVQEFEKCFAFKFPACSVAAKRHIDSNTTLLDVQGVGFKNLTKNARDLIMRLQKIDGDNYPETLCQMFIINAGPGFRLLWNTVKTFLDPKTTSKIHVLGNKYQSKLLEIIDASELPEFLGGSCICADQGGCLKSDKGPWKDPNILKMVLSGEAQFSRRIVTVSNSDGRVITKEKPIYSVIKSSDTSTAESGSEVEEFTSPEVTRGYLHPRLTPVREEVRMAGKVNSAGGFSEYDEVPMVDKAVDAEWKKQLSLQDPCDSRGILSLPRAEKTPEGLCAKIWGVLITFFLALATLFHSVASREELRPPSPAPRLTEADLFSSVLKRVGELEEKVDLLQAKPFKMPHEKEELLNAAVCRVDALEAELIATKKALHEALMRQEELLAYIDRQEEAKSQINLIRISPLVHVALFSYPDSLKERHTDTHKHNIRMIATTHPDDRHILSGYVCPDH

SEQ ID NO: 33586 - protein, 777 aa, Ashbya gossypii ATCC 10895
MAGHSHRSSVKKGHKTFKSKHASKGALKRLHKGKVEQETAAGVKGVRVVRKQDRKNAAKQLRQQKISSTSQLRRLFEGANGAAKIVAVIPLTPDVDAGDIVQRLVQGCDEDVSGMQTPCVRDFRIGKFRSTLKVIVPDMGSFLSIMDAAKVADYVVLGLSGTSEVDPVFGEQVIRVLELQGIASYMGVVSNLSKVHPKEKFQLDVKQSLESYFRHFFPTEDRIYNLEKASDSLNAQRILCQQYPRGVSWRDSRGYLVAGSVDYVESGPDAGELVVDGTVRGVGLHPNRLVHLPGLGDFQVSAIEKIAASSRSSEDNGEGSGVFLPDAQQDTLEEFAPHDLDMEEWDDNQFEYDNLTSARYDDHGFLPGREQSLERAKVPKGTSEYQARWYVDNVVDVSDDDAEDEMELEMGSNEVGTVADDTMMDAEDAQSDDASEADMATMVDEMFVDLSPEEEERQLQEYRAMEKDDLEFPDEIELDPSESAIERLKRYRGLKNLHNCVWNVDEQDPHCPSEWKRMLRIGSYKNLKARTNKSVAAEASVVAGDKVRLRIRFPKHLLERLKDPRIAPFVVYGLLPHEHKQVVANLSIQRWEEFEDPVPSGESLIVQYGVRRYTIQPQFSSASNVPNNVHRFERFLHHNSASIATCMLPLDLTQSPAIYFKENPSDPKGLTFVGHGTFLNADHTRILAKRIILTGHPFKFHKRVVTVRYMFFRPEDVEWFKSIPLFTKSGRSGFIKESLGTHGYFKATFDGRLSAQDTVAMSLFRRVWPKTSLPWFY

SEQ ID NO: 33587 - protein, 317 aa, Herbaspirillum seropedicae
MALENLMVFTGNANPELARGVAEKLGIPLGKANVSKFSDGEVMVEINENVRGKDVFVLQSTCAPTNDNLMEIMIMVDALKRASAGRITAAIPYYGYARQDRRPRSARVAISAKVVANMLQEAGVERVLIMDLHADQIQGLLRYPGGQHLRFAHPAGRPGQQELRRPAGGLARRRRRGARPCAGQCCLNCDLAIIDKRRPKANVSEVMNIIGEVEGRNCVIMDDMVDTAGTLTKAAEVLKERGAKKVVAYCTHPVLSGPAIERIANSPLDELVVTDTIPLSPAARGCPKVRQLTCADLLAETFKRITKGDSVMSLFAE

SEQ ID NO: 33588 - protein, 258 aa, Archaeoglobus fulgidus DSM 4304
MSEFNEKPEKLIVDGLRLDGRKFDELRPIKIEASVLKRADGSCYLEMGKNKVIAAVFGPREVHPRHLQDPSKAIIRYRYNMAPFSVEERKRPGPDRRSIEISKVSKEAFEAVIMKELFPRSAIDIFVEVLQADAGSRTACLNAASVALVDAGVPMKGMITSVAVGKADGQLVLDPMKEEDNFGEADMPFAFLIRNGKIESIALLQMDGRMTRDEVKQAIELAKKGALQIYEMQREAILRRYIEVGEEMDEITEGGEDA

SEQ ID NO: 33589 - protein, 277 aa, Brassica oleracea
MNTFPASTEMVGSENESPVTTVVGGDYYPMLAASCPKKPAGRKKFQETRHPIYRGVRLRKSGKWVCEVREPNKKSRIWLGTFKTAEMAARAHDVAALALRGRGACLNYADSAWRLRIPETTCHKDIQKAAAEAALAFEAEKSDVTMEETMAVASQAEVNDTTTDHGMNMEEATAVASQAEVNDTTTDHGVDMEETMVEAVFTEEQSEGFNMAEESTVEAAVVTDELSKGFYMDEEWTYEMPTLLADMAAGMLLPPPSVQWGHNDDLEGDADMNLWSY

SEQ ID NO: 33590 - protein, 259 aa, Archaeoglobus fulgidus DSM 4304
MPEDILVDIKRDYVLSKLRDNERIDGRGFDEFRKVEIIPNVIEKAEGSALVKLGDTQVVVGVKMQPGEPYPDTPDRGVIIVNAELVPLASPTFEPGPPDENSIELARVVDRGIRESEAVDLSKLVIEEGEKVWIVFVDIHALDDDGNLLDASALAAIAALMNTKVPAERFDLGEDYLLPVRDLPVSVTSLIVGNKYLVDPSREEMSVGDTTLTITTDKDDNVVAMQKSGGYLLDEKLFDELLDVSINCARKLREKFKEI

SEQ ID NO: 33591 - protein, 381 aa, Blastopirellula marina DSM 3645
MTQPIAKLALEDGTVFTGRSLGAEGEVDGEVCFNTSMTGYQEILTDPSYRGQILTMTYTQIGNYGVNTEDMESAKTHMSGFIVRECSRRVSNFRSTQSLDEFLKQNGVVGLSGIDTRALVRRLRSSGSMKGVLSNIDLDDASLVEKARNSAGLVGRDLVKEVMPTAGQSWTEKLSPWVKMGDKIRADKSRTELDLHVVALDFGMKWNIPRHLQDMGCKVTVMPGSATAEEVLSQNPDAVFLSNGPGDPEPLLGPIETIRGLLGQKPIFGICLGHQLLSLACGAKTFKLKFGHRGANQPVLDVTTGKVEITSQNHGFAVDEASLPDCLEVTHRNLNDNTVAGVRHKTLQAFSVQYHPEASAGPHDSEYLFERFREMVDGQKV

SEQ ID NO: 33592 - protein, 487 aa, Herbaspirillum seropedicae
MGKATGFMEYQRLKEASEAPAARTKHYKEFVLHLSDADAKIQGARCMDCGIPFCNNGCPVNNIIPDWNDLVYRGNYKEALDTLHQTNNFPEFTGRICPAPCEAACTLGINNDAVGIKSIEHFIIDKGWENGWVVPQPAAIKTGKKVAVVGSGPAGLAAAQQLARAGHDVTVFEKNDRVGGLLRYGIPDFKMEKSHIDLRVEQMKAEGVTFRTGVFVGKDFPETVNNWSKETVTPEELKKEFDAVVIAGGAESPRDLPVPGRELKGVHFAMDFLPLQNKVNAGDKLKNQIMATGKNVVVIGGGDTGSDCVGTSNRHGAASVTQFELMPQPPESENKPLVWPYWPIKLRTSSSHEEGCQRDFAVTTKRLEGKGGKVEKLIAARVEFKDGKMVEVPDSEFEIKADLVLLAMGFVSPVQQVLDAFGVEKDARGNAKATTDGEGCYKTSVDKVFAAGDMRRGQSLVVWAIREGRQCARAVDEFLMGSSLLPR

SEQ ID NO: 33593 - protein, 421 aa, Blastopirellula marina DSM 3645
MSSESGHPIGGETPFKIEYAQRVYRLPPYMFGRINALLYEKRVAGHDVIDLGMGNPSDPPQEFVMEKMCEAVKDERNHGYSKSNGIRNLRREVAGKYLKKYGVRLDPESEVIACLGSKEGFSHMCLAMMGPGDTAIVPAPYFPVHTYAVALASGNVIALEVGDSEKFLENIAYTCEHLYPKPKLLIICYPHNPSTVTVEPEFFVEIVKLAKRYGFMVISDFAYADIAFDGYKPPSFLSAPGASSVGVEFTTMSKGYNMAGWRVGFCAGNAEMIKGLATIKGYYDYGMFQAIQIAAIIALREGDAAVEEQSRIYESRRDVLVDGLTRLGWGVTPPKAGMFVWAKVPDVWMQRMNTMDFAMMLLEKGDVAVSPGSGFGPCGEGYVRMAMVENEERLRQAVRQIGRCLKHEEKELVTAETTLES

SEQ ID NO: 33594 - protein, 404 aa, Neisseria meningitidis MC58
MTVKTPVYLDYAATPPVDKRVAEKMIPYLTETFGNPASNSHSFGWEAEEAVEKARADIAALINADSKEIVFTSGATESNNLAIKGAAHFYKSKGNHLITVKTEHKAVLDTMRELERQGYEVTYLDVQENGLVDLDVLKAAIREDTILVSVMWVNNEIGVVQDIPAIGEICRERKIIFHVDAAQACGKVPVDVEAAKVDLLSMSGHKVYGPKGIGALYVRRKPRVRLEAQMHGGGHERGFRSGTLPTHQIVGMGEAFRIAKEELAQDTAHYLKLRDIFLKGIEGIEEVYINGDLEHRVPNNLNVSFNFVEGESLIMAVKELAVSSGSACTSASLEPSYVLRALGRNDELAHSSLRITFGRMTTEEEVQFAAELIKSKIGKLRELSPLWEMFKDGIDLNSIEWAAH

SEQ ID NO: 33595 - protein, 250 aa, Brassica oleracea
MNSVSTFSELLGSENESPVGGDYCPMLAASCPKKPAGRKKFRETRHPIYRGVRLRKSGKWVCEVREPNKKSRIWLGTFKTAEIAARAHDVAALALRGRGACLNFADSAWRLRIPETTCAKDIQKAAAEAALAFEAEKSDTTTNDHGMNMASQAEVNDTTDHGLDMEETMVEAVFTEEQRDGFYMAEETTVEGVVPEEQMSKGFYMDEEWMFGMPTLLADMAAGMLLPPPSVQWGHNDDFEGDADMNLWNY

SEQ ID NO: 33596 - protein, 241 aa, Haemophilus influenzae Rd KW20
MSSMEGKKVPQVTFRTRQGDKWVDVTTSELFDNKTVIVFSLPGAFTPTCSSSHLPRYNELAPVFKKYGVDDILVVSVNDTFVMNAWKEDEKSENISFIPDGNGEFTEGMGMLVGKEDLGFGKRSWRYSMLVKNGVVEKMFIEPNEPGDPFKVSDADTMLKYLAPQHQVQESISIFTKPGCPFCAKAKQLLHDKGLSFEEIILGHDATIVSVRAVSGRTTVPQVFIGGKHIGGSDDLEKYFA

SEQ ID NO: 33597 - protein, 128 aa, Neisseria meningitidis MC58
MAYSDKVIDHYENPRNVGTFDKGDDSVGTGMVGAPACGDVMRLQIKVNDEGIIEDAKFKTYGCGSAIASSSLITEWVKGKSLDDALAIKNSEIAEELELPPVKIHCSILAEDAVKAAVADYRKRQENR

SEQ ID NO: 33598 - protein, 215 aa, Zea mays
  misc_feature (148)..(148): Xaa can be any naturally occurring amino acid
MSQDQENGGTNGQHAADVMEVEPKRRAPRLNERILSSLSRRSVAAHPWHDLEIGPEAPAVFNVVVEITKGSKVKYELDKKTGLIKVDRILYSSVVYPHNYGFVPRTLCEDNDPMDVLVLMQEPVLPGAFLRARAIGLMPMIDQGDCRXEKDDKIIAVCADDPEYRHYNDISELSPHRLQEIRRFFEDCTRACSLSLSLSLSLSLSLSLSLHLAAR

SEQ ID NO: 33599 - protein, 208 aa, Buchnera aphidicola str. APS (Acyrthosiphon pisum)
MLYDQIKNNKTSSYATFIPMVVEQHSRGERSYDIYSRLLKERIIFITGAIEDNMANNIVAQILFLEAENPEKDIFLYINSPGGIITSGMSIYDTMQFVKPEISTICLGQACSMAALLLTSGAKGKRFCLPNSKVMIHQPLGGYQGQASDIAIHAREIMEMKKKLNKLMSFHTGQSIKKINKDTERDCFLSANQSIKYGLIDFILSQRQ

SEQ ID NO: 33600 - protein, 340 aa, Streptomyces fradiae
MKALVFEAPERAVLTHRDIPAPAPGEALVRVAYNSVCGSDLSFYKGVWHGFTYPVVPGHEWSGSVVDVNGPRGADLVGRNVVGDLTCSCGTCAHCAAGTPTLCEDLGELGFTRDGACAEYMTVPVANLRPLPDTLPLRTACQVEPLAVALNAVDRLGVTPGEKVAVMGAGGIGLLLVQAVRLRGGTVTAVAEPVPERRAAALALGVPAAVGGDPGALVELTRSDPAAVPDVVLEASGYPTAVQEAVEAVRPGGRVGLVGYRIEEAAVMAPHHIVLKVLTVRASMGPGTRFEEAVDVLASGAVDVDALLSHEFALDDYAKALDVALRRADGNTRSYFNLRA

SEQ ID NO: 33601 - protein, 199 aa, Streptococcus thermophilus LMG 18311
MTEEQVLNTHNAEILLSAANKSHYPQDDLPEVALAGRSNVGKSSFINTLLGRKNLARTSGKPGKTQLLNFYNIDDKLRFVDVPGYGYARVSKKERAKWGKMIEEYLVTRDNLRVVVSLVDLRHEPTQDDIQMYEFLKYYEIPVIVVATKADKIPRGKWNKHESIIKKKLNFDKNDHFIVFSSVTRDGYDEAWDTILAEL

SEQ ID NO: 33602 - protein, 548 aa, Neisseria meningitidis MC58
MKHLHDLPAWSKLWNHFDDSKTLHMREMFEQDPQRAERYWLQVGGLTLDYSKNRINDETMSLLFELAREAGVPERMRQMFHGEKINTTENRAVLHVALRNRTNSPIVVDGEDVMPKVNRVLQRMGEFAHEVRSGSWLGYTNQVITDVVNIGIGGSDLGPLMMCTALKPFGHPRLNMHFVSNVDGSQLRDVLSKVHPETTLFIIASKTFTTQETLTNALTAREWFLNHAGDEEAVAKHFAAVSTNQKAVAEFGIDTANMFEFWDWVGGRYSLWSAIGLPIMLYLGEENFIEMLNGAHLMDQHFINTPLERNLPVILALIGIWYINYYGGGSHVIAPYDQHLHRLPKFIQQLDMESNGKQVTLDGKAVGHETSPIIWGETGINGQHAFFQLLHQGTHITPIDLIASLEKRSNLPGHHEILLANVFAQAEAFMRGKTPDEVRAELKAQGMDEVRIEELVPHKTFSGNRPTNLILMDKVNPRNMGSLIAMYEHKTFVQGIIWGINSFDQWGVELGKQLAKTILGELTGETGPQKHDSSTERLINLYLQTNRK

SEQ ID NO: 33603 - protein, 483 aa, Streptococcus thermophilus LMG 18311
MIVSTYYPKIFYCDKLVLLHLLEESMENHNYENEGQFQRKMTSRHLFMLSLGGVIGTGLFLSSGYTIAQAGPLGVILSYLVGAVVVYLVMLSLGELAVAMPVTGSFHTYATKFISPGTGFTVAWLYWICWTVALGTEFLGAAMLMQRWFPSVPAWIFAAFFALVILGINALSVRSFAEAESVFSSIKVIAIFVFIILGLGAMFGLVSFEGHHEAIMFKHLTANGLFPNGGLAIVSVMLAVNYAFSGTELIGIAAGETDNPKEAVPRAIKTTIGRLVIFFVLTIVVLASLLPMKEAGVSSAPFVDVFDKMGIPFAADIMNFVILTAILSAGNSGLYASSRMLWSLANEGMLNKKLVTINKHGVPMTALLISMAGAVLSLFSSIYAADTVYLALVSIAGFAVVVVWLSIPMAQINFRKQWKLEHSEDELDYKTPFNPILPYITIVLLAISVLGIAWDSSQRAGLYFGIPFMIFCYLYHYLCFNKW

SEQ ID NO: 33604 - protein, 483 aa, Crocosphaera watsonii WH 8501
MVATTQETSVGKITQIIGPVVDAEFPSGNLPRIYNALKVEGQNFAGDTVSVTCEVQQLLGDNQVRAVAMSGTDGLVRGMDIVDSGSPISVPVGKATLGRIFNVLGEPVDEMGDVGNEETSPIHRPAPKLTDLETKPKVFETGIKVIDLLTPYRQGGKIGLFGGAGVGKTVIMMELINNIAIQHGGVSVFAGVGERTREGNDLYNEMIESKVINPENLSESKIALVYGQMNEPPGARMRVGLSGLTMAEYFRDVNKQDVLLFVDNIFRFVQAGSEVSALLGRMPSAVGYQPTLGTDVGDLQERITSTKEGSITSIQAVYVPADDLTDPAPATTFAHLDGTTVLSRGLASKGIYPAVDPLDSTSTMLQPSVVGDEHYDTARAVQSTLQRYKELQDIIAILGLDELSEDDRRTVDRARKIERFLSQPFFVAEVFTGSPGKYVSLADTIKGFQMILDGQLDDLPEQAFYLVGDIEEAKAKAEKLKQA

SEQ ID NO: 33605 - protein, 498 aa, Burkholderia sp. 383
MLSLVSHLDHLNVRPGRLFIDGQWLDWPDARFDQLNPCTNEVMTSFADAGAQGVELAVAAARKAFDEGPWPRMRAQDRKRLLQPIVERLYAAEEEIARLQTLDNGIPYAFSRHSRVSAKSAADVFDHFLGWIDKINGDTLPIFSGASNMQYMTFRDPVGVVAAVLPYNGPVLTFAMKVAPALACGCTVIVKSSELTNLAVARLAQIIADSDLPPGVFNFVTGGVETGSALTSHAGVDKVTFTGSPAVGEKIMIASAPTMKRLSLELGGKSAALVFPDTRSVQTTAHALMGLCSTFLSGQVCSTPSRAVVHRSIMDEFLHHAQEQLQKVRFGDPFDAATTSAPMISRRHQARVLDYVESGRQQGATLLAGGRAPGGEFRNGNWVEPALFANVSNDMTIAQEEIFGPVLSVIPFDTEEEAIRIANDSAYGLAGCVYTTDVSRAFRVARAVKSGAIGVNGFASIPNAPFGGIKRSGTGREGGWSTIEAFTELKTVNFNLDA

SEQ ID NO: 33606 - protein, 399 aa, Populus trichocarpa
MSSEVEEAARRRTAIAEYRKKLLNHKELESRVRTVRENLRAAKKEFAKTEDDLKSLQSVGQIIGEVLRPLDNERLIAKASSGPRYVVGCRSKVDKEKLTAGTRVVLDMTTLTIMRALPREVDPVVYNMLHEDPGNVSYSAVGGLSDQIRELRESIELPLMNPELFLRVGIKPPKGVLLYGPPGTGKTLLARAIASNIDANFLKVVSSAIIDKYIGESARLIREMFGYARDHQPCIIFMDEIDAIGGRRFSEGTSADREIQRTLMELLNQLDGFDQLGKVKMIMATNRPDVLDPALLRPGRLDRKIEIPLPNEQSRMEILKIHAAGIAKHGDIDYEAVVKLAEGFNGADLRNVCTEAGMSAIRAERDYVIHEDFMKAVRKLNEAKKLESSAHYNADFGKD

SEQ ID NO: 33607 - protein, 284 aa, Thermotoga maritima
  misc_feature (283)..(283): Xaa can be any naturally occurring amino acid
MRIDTVNVLLEALPYIKEFYGKTFVIKFGGSAMKQENAKKAFIQDIILLKYTGIKPIIVHGGGPAISQMMKDLGIEPVFKNGHRVTDEKTMEIVEMVLVGKINKEIVMNLNLHGGRAVGICGKDSKLIVAEKETKHGDIGYVGKVKKVNPEILHALIENDYIPVIAPVGIGEDGHSYNINADTAAAEIAKSLMAEKLILLTDVDGVLKDGKLISTLTPDEAEELIRDGTVTGGMIPKVECAVSAVRGGVGAVHIINGGLEHAILLEIFSRKGIGTMIKELEGXR

SEQ ID NO: 33608 - protein, 283 aa, Thermotoga maritima
MRIDTVNVLLEALPYIKEFYGKTFVIKFGGSAMKQENAKKAFIQDIILLKYTGIKPIIVHGGGPAISQMMKDLGIEPVFKNGHRVTDEKTMEIVEMVLVGKINKEIVMNLNLHGGRAVGICGKDSKLIVAEKETKHGDIGYVGKVKKVNPEILHALIENDYIPVIAPVGIGEDGHSYNINADTAAAEIAKSLMAEKLILLTDVDGVLKDGKLISTLTPDEAEELIRDGTVTGGMIPKVECAVSAVRGGVGAVHIINGGLEHAILLEIFSRKGIGTMIKELEGR

SEQ ID NO: 33609 - protein, 271 aa, Oryza sativa Japonica Group
MAPFSSSSSPSPALAPASSSSTASTPRAPRQQLPRGASSSSSSSPVYLNVYDVTPANGYARWLGLGVYHSGVQGMYALLSSPSILYAYGAHDGAGSGIFEVAPRRCPGYAFREAILVGTTELTRAEVRAVMADLAADFPGDAYNLVSRNCNHFCDAACRRLVRARIPRWVNRLAKIGVVFTCVIPGNGAAVRRKGDPPATATAPGGKASIRSRSARQGADAAAPPRPKTFFRSLSVGGGGGGGGGKNVTPRPLSTSPSPTPPAPPAFTTAT

SEQ ID NO: 33610 - protein, 359 aa, Herbaspirillum seropedicae
MSKTHRIAVIAGDGIGQEVMPEGLRAVQAASKKFGIDIEFTHFDWAHCNYYAEHGKMMPDDWFEQLKGFEAIYFGAVGWPATVPDHVSLWGSLLKFRRDFDLYVNLRPVRLMPGVPCPLANRKPGDIDFYVVRENTEGEYSSIGGRMYEGTERETVIQESVFSRKGTDRILKFAFDLAQSRPKKHLTSATKSNGIAITMPYWDERVEAMGAKYPDVRRDKYHIDILTAHFVLNPDRFDVVVASNLFGDILSDLGPACAGTIGIAPSANINPTRELPSLFEPVHGSAPDIFGKNIANPVAMIWSGAMMLDFLGDGQGKYRQAHDAMLAAIETVLVNGPTTPDLGGKSNTAEVGQAIAAAI

SEQ ID NO: 33611 - protein, 304 aa, Arabidopsis thaliana
MKGLTRLLNSLSRHTASVTCSPSSSSLLISRRSLFISAATHFPVNFSESITTNASRNCSRSSSFPFNWIEQRRTMFIQTQSTPNPSSLMFSPGKPVMEIGSADFPNSRSAMSSPLAKAIFAIDGIPRLLLQHTIVSSSYNPCFVTKIVSVDAGVVRVFYGSDFVTVTKSDDVTWDILKPDIFAVVMDFYSSGQPLFLDSQATAAKDTAIHEDDSETVAMIKELLETRIRPSVQDDGGDIEYCGFDTETGIVKLRMQGACSGCPSSSVTLKSGIENMLMHYVSEVKGVEQEFDGEEEGTSSGPME

SEQ ID NO: 33612 - protein, 513 aa, Mesoplasma florum L1
MKNTQILILDFGSQYTQLLARRVREANIYTEVLPFDTSIEKIKEYPLLKGIILSGGPSSVYLQNAYKIDSEILNLDIAILGVCYGMQLLTQYFQGAVELADEQEFGKAIITIDDKKNPLFKNVTTESQVWMSHADHVTELPVDFKQIAHSNASIAAIAHNTKPIYGIQFHAEVTHSLQGKEMLENFLYDIAKCNKDWNLDDFIDQQIKEIKETVKDKQVILGLSGGVDSSVAAAIIGKAIGKQLTCIFVDTGLLRKNETIEVMKAYETNFDINIKLVEASDLFFSELKGIKEPEAKRKIIGKCFIDVFTDAARQHKDADFLAQGTIYPDVIESSSHGASSKTIKSHHNVGGLPEDLKFRLIEPLRNLFKDEVRQVGFKLGLPEEMINRHPFPGPGLGIRVIEEVTKDKVEILQEADAIFIKKLREWNLYNTVSQAFVTLLPVKTVGVMGDNRTYDYVVALRSVNTIDFMTATSTHLPWEFLDEVVNEIINKVDNVNRVVYDVTSKPPGTIEWE

SEQ ID NO: 33613 - protein, 481 aa, Neisseria meningitidis MC58
MSTQTNFDLVLFGATGDLAMRKLLPCLYQAHVAGLLHPEGRILGVSRSELDTEGFLAKVETSSKIHVKENFSDEAWASFVERFAYLKVDVTQPDDFAALGDLVKARKETDNVVIYLSTAPKFFAQACENLAAIGLNADNVRVVLEKPLGTDLASSQQINTDVARYFKEGQIYRIDHYLGKESLQNLLALRFANVMFEPLWNNKYIESVQLTIAEQLGVEERGEFYDITGALRDMVQNHLMQMLCMTAMEAPASLDADAVRDEKVKVIKSLKPLTVESVNENVVRGQYTAARGMNGYLEEINVPQDSFTETYVAIKAEIENERWKGVPFYLRTGKRMAGKVAEIVLNFKDLNSHIFEGSRTAPNRLVIELQPYESVRLYTQMKTPGAGNKVETVPLATDLGKALEGRRAEAYERLLLDVINGKLALFNRRDELEAAWEYVMPILENWTNNTTPPHGYGAHSWGPEAARELLARDGHKWHEEQ

SEQ ID NO: 33614 - protein, 445 aa, Physcomitrella patens subsp. patens
MATIQSIKARAIYDSRGNPTVEADIHLSDGSWYRAAVPSGASTGVYEALELRDGGKDYMGKGVQKAVDNVNKIIGPALVGKDPTNQTAIDNFMVHELDGTQNEWGWCKQKLGANAILAVSLAVCKAGAGVSKTPLYQHIANLAGNKEIVMPVPAFNVINGGSHAGNKLAMQEFMILPTGASSFKEAMKIGSEVYHNLKAVIKKKYGQDATNVGDEGGFAPNIQDNREGLELLKTAIAKAGYTDKVVIGMDVAASEFYNEKDKLYDLNFKEDNNDGSSKLNGDEFIKLYESFVEEYPILSIEDPFDQDDWAHYSKINELMGDKVQIVGDDLLVTNPKRVAHAIQHKACNALLLKVNQIGSVTESIEAVVMAKKAGWGVMTSHRSGETEDSFIADLAVGLSTGQIKTGAPCRSERLSKYNQLLRIEEELGDKAVYAGLKFRKPAEPY

SEQ ID NO: 33615 - protein, 346 aa, Neisseria meningitidis MC58
MKAMVYHGANDIRFEEKPRPQIIDPTDAVVKIVKTTICGTDLGIWKGKNPEVADGRILGHEGIGIVEEVGEAVKNIKVGDKVIISCVSKCCTCDNCKTQLYSHCRNGGWILGYMIDGTQAEYVRTPYADNSLVPLPDNVNEEIALLLSDALPTAHEIGVQYGDVKPGDTVFIAGAGPVGMSALLTAQLYSPAAIIVCDMDENRLKLAKELGATHTINPASGEVSKQVFAIVGEDGVDCAIEAVGIPATWNMCQDIVKPGGHIAVVGVHGQSVDFKLEKLWIKKLAITTGLVNANTTEMLMKAISSSSVDYTKMLTHHFKFSELEKAYDVFKHAAENQVMKVVLEAD

SEQ ID NO: 33616 - protein, 445 aa, Physcomitrella patens subsp. patens
MATIQSIKARSIFDSRGNPTVEADILLSDGSWYRAAVPSGASTGVYEALELRDGGKDYMGKGVQKAVDNVNNIIGPALVGKDPTDQTGIDNFMVHELDGTQNEWGWCKQKLGANAILAVSLAVCKAGAGVLKTPLYQHIANLAGNKEIVMPVPAFNVINGGSHAGNKLAMQEFMILPTGASSFTEAMKIGSEVYHNLKAVIKKKYGQDATNVGDEGGFAPNIQDNREGLELLKTAIAKAGYTDKVVIGMDVAASEFYNEKEKTYDLNFKEDNNDGSSKLNGDEFIKLYESFVEEYPILSIEDPFDQDDWAHYSKINELMGDKVQIVGDDLLVTNPKRVAHAIQHKACNALLLKVNQIGSVTESIEAVVMAKKAGWGVMTSHRSGETEDSFIADLAVGLSTGQIKTGAPCRSERLSKYNQLLRIEEELGDKAVYAGLKFRKPAEPY

SEQ ID NO: 33617 - protein, 283 aa, Mycobacterium smegmatis str. MC2 155
MTENSTDPAELRAVAEQLADEAAELVLRRRAEVFGAAGASNDDAAGGQAVRTKSTPTDPVTVVDTETERWLRERLAVLRPGEHVLGEEEGGKQEGRAGLSWVLDPIDGTVNFVYGIPAYAVSIAVQLDGRSIAGAVAHVSAGAVYSAALGGGAHVRQNGVTTPLRCSAVDDLAMTLVGTGFSYSHEARRRQAQVLAQILPTVRDMRRLGSCALDLCMVAAGQLDAYYEDGVHVWDWAAAALIAAEAGATVWLPAGGGGGKVIAAAPGVATALRDALAGAGMDL

SEQ ID NO: 33618 - protein, 109 aa, Populus trichocarpa
MSKKVVAESPLQRNSLASLDQKLAMAKRCSHEGVVAGAKAAVLATIATAIPTMASARMLPWARANLNHTAQALIISTVAGAAYFIVADKTVLATARKNSFKSPSSNIEA

SEQ ID NO: 33619 - protein, 149 aa, Brassica napus
  misc_feature (53)..(53): Xaa can be any naturally occurring amino acid
MEQTFIMIKPDGVQRGLVGEIICRFEKKGFTLKGLKLITVDRPFAEKHYQDFXSPSPFFSSLVDYIISGPVVAMIWEGKNVVLTGRKIIGATNPAASEPGTIRGDYAIDIGRNVIHGSDSVESANKEAALWFPDGPVNWQSSLHSWIYE

SEQ ID NO: 33620 - protein, 439 aa, Vibrio sp. Ex25
MQALADRLRNYKVEGLTTRPVASGKLVRVVGLTLEATGCRAPIGSLCLVETMSGQMEAEVVGFSGDNLFLMPSEQITGILPGARVTPLTSDAGLPVGMELLGRVIDGVGNPLDGLGPLYTDHRASFNAEPINPLARKPISEPLDVGLKAINGLLTVGKGQRIGLFAGSGVGKSVTLGMMTRGTTAQVVVVGLIGERGREVKEFIEEILGEDGRRRSVVVAAPADASPLMRLKGCQTALTIAEYFRDQGLDVLLLMDSLTRFAQAQREIALSVGEPPATKGYPPSVFAKLPALVERAGNGSAEQGSITAFFTVLTEGDDLQDPIADASRAILDGHIVLSREMADAGHYPAIDVEKSVSRVMPQITTEEHVLMSKAVRQVLSICRKNQDLVSIGAYKPGTDPAIDGAFTLKPKLDEYLQQSMKESVPYDMCVNMLRNILGG

SEQ ID NO: 33621 - protein, 427 aa, Physcomitrella patens subsp. patens
MSGAASAIFLLDMKGRVLIWRDYRGDVSAPQAERAFAKLMDGEGDPASHAPLLLDNGVTYLFIQHNNVYVMTASRQNCNAASLVLFLHRIVDVFKHYFEELEEESLRDNFVVVYELLDEMMDFGYPQYTEAKILSEFIKTDAYRMEVTTRPPMAVTNAVSWRMDGIKYKKNEVFLDVVESVNILVNSNGQLVRSDVVGALKMRTYLSGMPECKLGLNDRVLLEAQGRSTKGKAIDLDDIKFHQCVRLTRFENDRTISFIPPDGAFDLMTYRLSTQVKPLIWVEAQVERHSRSRVEFMIKARSQFKERSTASNVEIELPVPADASTPAVRTSMGTAVYAPEKEALIWKIKSFPGGKEYMMRAKFGLPSIEAEDVVIEKRPPIRVKFEIPYFTVSGIQVRYLKIIEKSGYQALPWVRYITTAGEYELRI

SEQ ID NO: 33622 - protein, 329 aa, Lactobacillus reuteri
MTKKLLLLSTGGTIASVVSDEGLAPGESGEELIKMLGRLEYDITVRDILELDSSNIQPEEWKIIAETIYDHRNEYDGIVVSHGTDTMAYTASMLTFMLQHINIPVVLTGSQVPMNVILSDAPDNLRLAFAAAANCEPGVYIAFNRKVMRGCRSVKVRTTAFDAFESVNVPPVGEVTSDGFSIRDHQHPQPGKSQLNTKIDTHVSLVKLFPGFDPALLHAMAKNGCHGIVIEAYGLGGMTSIRRNMVAAVGELIRNGIPIITSSQCLYERSDLTKYEVGRLALLEGAISARDMTSESAITKLMWGLGQGMDVKEIADFFNTDVAGEVTLD

SEQ ID NO: 33623 - protein, 648 aa, Ashbya gossypii ATCC 10895
MSVDLNTRKLEKQVKERLFEQLNQCTRQDPILLLIQPSLVPYINALCTFSELTKHTRVNVIMTLDESCLGNLLSMDVGLTKLVVLLDVRSDLKVPDQLHEIIRGLSLRKLDVISASWKEHTEIEEAKVFPDYLQLQLDEVALRVHKWCMLPVCYLDDDFLNCNVLMTSDGQNLYYPATPSLAGTTRNVLVNHLKESLVSLCLENDITITHSVALGPNSKRLVDALQTDLRDLVTQEAQAQQKVLYGKRHSGLQTDLIVFERQIDNMTPLLSQLTYVGMLNDVFTFTADSKLQDLRVGDVLENPEDQRAVHLDYKEDGVWNELKYVNFGAVGTKLNTWAKELKGQYDARHQVETVGEIKRFVSGLGDLQQRQKLLKLHTGISSKIMEHVNHGAIFQQLIETEQDFCMNNLDNRASCERILDLMYSGAPKDVVLRLCCLLSLTKNGIRDREFLTLKTEILDAFGVEVLPELERLTAHGLFLSKTVFPARSAVKDFQTLAAWYDLCPQLDRPIDPLDPREPTFTLCGVIPLSVRILQSLYDRSVALQHYSSQQPFVISRAPSLARLEPLFAAQYGRDTAHQRVWDRSADPATIAVGAPGRAPDLALLVFVGGVTPAELATVAFLQRALRAKNVRKRFVVLADGLLRAAPPV

SEQ ID NO: 33624 - protein, 463 aa, Physcomitrella patens subsp. patens
MDMAYLISLFGFITIAKSFLPPELNDLLMKWWVKLIRPVNPYCIFHIPEVGSNKQNDLYRVVQLHMRAAKLSKEADELVLSRDENDKEITFSLAADEVVKETYEGVTVWWSHRTEKSGKDSDEFEKSSFELKMRKKDKEFVMTRYLDFVTKNAAEFRRQLRELHLYSNMDCGIGLVQVYDNNALKQLLVNTTSKSIIVIEDIDCSLDLAGQRKTAKEPKVDSNDDSKSSVTLSGLLNFTDGLWSCCGDERIIIFTTNHVEKLDAALLRPGRMDMHINMSYCQFETFKALVKNYLGIDSHPLFDTVKALLESRKLITPAQVAEHLFENRADPDAAMKVLIQWLEDWKPEEPVEETKAPVEETTTQEQESDSAPATSTPATTENGVTDNGITENGVAENGVTDNGDANAALSDDLRKTVSILEERVGSIENTLKQQLDSKTTVMKPDILSHIENGDSQVESDSDV

SEQ ID NO: 33625 - protein, 421 aa, Photobacterium sp. SKA34
MDIFKKQESKVRSYSNSFPVVFTKAKGSWLETEQGDRYLDFLAGAGSLNYGHNNPIFKQALLDYIEQDGITHGLDMHSTAKADFLKILERNILAPRQLNYVTQFTGPTGTNAVEAALKLARKVKKRSSIVAFTNGFHGCTTGALAATGNQHHRQGAGTSLNNVTRIPFEGYADIDGLKLFETMLADNSAGMDKPAAVLIETVQGEGGLNVASNQWLQRLEKVCKQNDILLIVDDIQAGCGRTGTFFSFEPSGIKPDMVTLSKSIGGYGLPMAIVLFKPELDIWNPGEHNGTFRGNNHAFITATKALETYWADDLLEKHVATCSNIIANVIDKCLHEHPDMFVQRKGRGMMIGIECNDGDLSSQITKNCFENGLVIETAGPNDEVVKFFSPLTITTAELEQGLSIFENAVEQVVAKNFKKAS

SEQ ID NO: 33626 - protein, 164 aa, Vitis amurensis
GEGGFGRVYRGTLPNSQTPIAVKRISHDSKQGMREFVSEIASIGRLRHRNLVQLLGWCRRYGNLMLVYDFMENGSLDKFLFDEPKLILSWEQRFNIIKGVASGLLYLHEGYEQVVIHRDIKASNVLLDNELNGRVGDFGLARLYEHGSNPGTTRVVATLVTSRQ

SEQ ID NO: 33627 - protein, 506 aa, Herbaspirillum seropedicae
MNLADISKLGVRDPFKQRYDNFIGGKFVPPVKGEYFENISPVIGRAFCEVARSSAEDVELALDAAHAAKKSWGKTSPTERANMLLKIADRMEANLELLATAETLDNGKPIRETMAADIPLAIDHFRYFAAAVRTQEGSICPIDNDTYAYHFHEPLGVVGQIIPWNFPILMAVWKLAPALAAGNCVVLKPAEQTPASIMVLIELIADLIPPGVVNIVQGFGVEAGKPLASNKRIAKIAFTGETTTGRLIMQYASQNLIPVTLELGGKSPNIFFADVLDKDDDFFDKALEGFAMFALNQGEVCTCPSRVLVQESIYERFIERALKRVAAIKQGNPLDKSTMIGAQASQEQLEKILSYIDIGKQEGAKVLAGGGREELGGDLASGYYVKPTVFQGNNKMRIFQEEIFGPVVSVTTFKDEEEALAIANDTLYGLGAGLWTRDGTRAFRMGREIQAGRVWTNCYHLYPAHAAFGGYKQSGIGRENHKMMLDHYQQTKNLLVSYSPKALGFF

SEQ ID NO: 33628 - protein, 513 aa, Bacillus cereus G9241
MLDQKQQSNTFEERVETIKQGGAPKYHEQNKAKGKLFVRNRLALLFDNGEYVEDALFANCEQTGLPADGVITATGKIHGRTACVMANDSTVKAGSWGARTVEKILRIQETAEKLRVPLFYLVDSAGARITDQVEMFPGRRGAGRIFYNQVKLSGKVPQVCLLFGPSAAGGAYIPAFCDVVMMVEGNASMYLGSPRMAEMVIGEKVTLEEMGGARMHCSVSGCGDVLCKTEEDAITQARQYISYFPNNYLEKTPLVTPQEPKQFDKTLEEIIPENQNAPFNMKDLINRVIDEGSFYEVKKLFAQELITGLARIDGKPVGIIANQPRMKGGVLFHDSADKAAKFINLCDAYHIPLLFLADVPGFMIGTKVERAGIIRHGAKMISAMSEATVPKISIVVRKAYGAGLYAMAGPAFEPDCCLALPTASIAVMGPEAAVNAVYANKIAALPEEERDSFIAEKREEYKKDIDIYHLASEMVIDGIVHPNNLREELKGRFEMYMSKYQVFTDRKHPVYPV

SEQ ID NO: 33629 - protein, 127 aa, Leptospira interrogans serovar Lai str. 56601
MSTEALLEQIGKLTLVEAADLVKKMEDKFGISAAAPVAVAAVGAAPAGAGAAEEASTFNVILKGFDSAKKIEVIKLVREITGLGLADAKGLVEAGGKAVKEGVAKAEADDLKKKFEGAGAQIELKAS

SEQ ID NO: 33630 - protein, 289 aa, Archaeoglobus fulgidus DSM 4304
MNSKTHLLLALTMLIWAGSFIFIKIGLKELDPFNLAFYRFLLASPLLMAWVFWKRGLAKPSGSEWLHLSVLALSGVTLLYAFQFLALKYTTATNASILINTSAVFVALWGLVKGEANPRKLAGVFLSFAGVVLIVSKGTLEFFSSKTIFGDVLMIVDGFLWAVYTVLGSKMLLKYDHETLTAYAFALGTIFLIPFALMSGFANPVTFNPETVAALLYLSILCSVFAYVVWYYALTNADSTSVAVYVYLVPLFTAIFAFYALNEKPDFFTAIGGIITIAGVYLTTAKQHQ

SEQ ID NO: 33631 - protein, 164 aa, Vitis amurensis
GQGVFGRVYRGVLPTSKLEIAVKKISHESRQGMKEFVAEIVSIGRLRHRNIVSLLGYCRRKGELLLVYDYMPNGSLDKYLYDQPKVSLNWSQRFRVLKGVASGLSYLHGEWEQVVVHRDVKASNVLLDGELNGRLGDFGLARLYDHGTDPQTTHVVGTLGYIAR

SEQ ID NO: 33632 - protein, 151 aa, Clostridium botulinum
RKSLNLYANIRPVKSYKGVKSRYENVDLIIVRENTEDLYAGIEHMIGDNIAESIKIITKKASDRIVDYAFNLSRKENRNKVTAVHKANIMKLSDGLFLKCAKEVASKNEDINFEDVIVDAMAMKLVLNPEKYDVLVMPNLYGDILSDMAAG

SEQ ID NO: 33633 - protein, 388 aa, Desulfococcus oleovorans Hxd3
MKIHEFQTKELFRTYGIPTPEGRMVNTAEAAGEAAGELGGFPVVVKAQIHAGGRGKGGGVKLAKSADEAKSLAGAMLGSRLVTPQTGPEGTLVQKVLVEQGVSIAKELYLSVVADRETAGIVIMASEAGGMDIEAVAETTPEKILKVFVNPLAGLSAFHCRQAAYGLNLPAEAIKPFTQVVSGLFKLFVDYDASLVEINPLILTTDKAVMALDAKINFDDSALFRHKDILALRDTDEEDPLEVEASRFNLNYINMDGNVGNMVNGAGLAMATMDIIKLAGAEPANFLDVGGGANAEMVENGFRIILSDPKVKCILVNIFGGILRCDVLASGIVQAARNTAIHVPLVVRMEGTNVDEGKRILAESGLDLHSAASLKDAAARVAQVVAAA

SEQ ID NO: 33634 - protein, 248 aa, Triticum aestivum
  misc_feature (123)..(123): Xaa can be any naturally occurring amino acid
  misc_feature (140)..(140): Xaa can be any naturally occurring amino acid
  misc_feature (148)..(148): Xaa can be any naturally occurring amino acid
  misc_feature (154)..(154): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGXCTDATQVINEVEEVKKXEYPDAYVXRIIGFXDNMRQVQCVSFIAFKPPGCKESGKGLNSSLTTGHNIKCHLQFLSTPDIGLWGFPLPPIWSFLNLVPKKNIVVMSNGFHVNKPWPSEKKRWLRYG

SEQ ID NO: 33635 - protein, 574 aa, Lotus japonicus
MEGKGYTLDGTVDLAGRPVLSSLTGKQKACTYILVYRVLERFAYYGVGANLVNFMTTQLNKDVVSSITSFNNWSGLATLTPILGAYIADTYTGRFWTITFSLLIYAIGLVLLVLTTTLKSLRPACENGICREASNLQVALFYTSLYTIAVGSGAVKPNMSTFGADQFDDFRHEEKEQKVSFFNWWAFNGACGSLMATLFVVYIQEKNGWGLAYSLSAIGFLLSSIIFFWGSPVYRHKSRQARSPSMNFIRVPLVAFRNRKLQLPCNPSELHEFQLNYYISSGARKIHHTSHFSFLDRAAIRESNTDLSNPPCTVTQVEGTKLVLGMFQIWLLMLIPTNCWALESTIFVRQGTTMDRTLGPKFRLPAASLWCFIVLTTLICLPIYDHYFIPFMRRRTGNHRGIKLLQRVGIGMAIQVIAMAVTYAVETQRMSVIKKHHIAGPEETVPMSIFWLLPQNIILGVSFAFLATGMLEFFYDQSPEEMKGLGTTLCTSCVAAGSYINTFLVTMIDKLNWIGNNLNDSQSRITIMPFFSVISALNFGVFLWVSSGYIYKKENTSTTEVHDIEMSAEKTVKY

SEQ ID NO: 33636 - protein, 151 aa, Clostridium botulinum
RKSLNLYANIRPVKSYKGIKSRYENVDLIIVRENTEDLYAGIEHMIGDDIAESIKVITKRASDRIVDYAFNMARKENRNKVTAVHKANIMKLSDGLFLNCAKEVASKNKDINFEDVIVDAMAMKLVLNPEKYDVLVMPNLYGDILSDMAAG

SEQ ID NO: 33637 - protein, 141 aa, Herbaspirillum seropedicae
MAIERTLSIIKPDAVAKNVIGQIYTRFENAGLKVIAARMAQLSRAEAEGFYAVHRERPFFKDLVDFMVSGPVMIQVLEGEGAILKNRDLMGATDPKKAEKGTIRADFADSIDANAVHGSDADETAKVEIAYFFPALNVYSR

SEQ ID NO: 33638 - protein, 592 aa, Physcomitrella patens subsp. patens
MENQVKGMMSGGLDVSDLKNANTVGGGVGDTFGEDAATEEQPFTPWARIVASGLELLRDPRYNKGLAFTEVERDRHYLRGLLPPTVISQELQVERILENVRSYQNPLEKYIALMDLQERNERLFYKVLIDHVEELLPIVYTPVVGEACQKYGNIFRRPHGLYISLKDRGHVLELLKNWPEKNVEVIVVTDGERILGLGDLGLNGMGIPIGKLALYTALGGVRPSSTLPIAIDVGTNNEALLKNPFYIGLRQRRTTGQEYDELLHEFMIACKQAYGEKVLIQFEDFANHNAFRLLQKYATTHLVFNDDIQGTAAVALAGLVAALPITGGTLADHKFLFLGAGEAGTGIAEIIALEVSKQGKITVEEARKAIHLVDSKGLVTKSRYESLQEHKRPYAHEHPPAHDLLSAVKVLKPTVLIGTSGKGGTFTKEVLEEVSSYQDKPIIMALSNPTSQSECTAEEAYKYTKGKCIFASGSPFSPVTYEGKTYVIGQSNNCYIFPGMGLGCTISGAIRVHDDMFLAAAEALAKQINEEHLAKNQLYPAFNEIREISAHIGAAVAAKAYELGLATKLPQPKDLFAYAKSCMYSPNYRQYR

SEQ ID NO: 33639 - protein, 435 aa, Haemophilus influenzae Rd KW20
MSAKSNKIGVVQLTILTMVNMMGSGIIMLPTKLAEIGTISIVSWLVTAVGSTALAYAFAQCGMFSKKSGGMGGYAEYSFGKAGNFMANYTYGVSLVIANTAIAISAVGYGSELFGTILSPLSIALWTIFTLWLATVLNFGGARITGNISSFTIWGVIIPVVGISIIGWKWFDGSMYVNSWNPHNVPTFEAIGVSISMTLWAFLGLESACANADAVENPEKNVPIAVLGGTLGAAVIYIVSTNVIAGIVPNLELANSTAPFGLAFAHMFDETVGKVIMGLMVMSCFGSLLGWQFTIAQVFKSSAEEGYFPAFFKKITSKDAPVVGMITITALQTLLSLMTISPSLNKQFNVLVDLAVVTNVIPYLLSMAALAVLLKAENVAPQKYKTTVFVAFIGSLYSIYALYAAGEQAMLYGSIVTFIGWTLYGFVSYKFDLKK

SEQ ID NO: 33640 - protein, 517 aa, Desulfococcus oleovorans Hxd3
MGNTQDRISELKEKERAVREMGGKEAVAKHKQAGKLTARERIEALFDPGTFRELDMFVTHRCTNFGMEKVAIPSEGVITGHGRVEGRPVFAYSQDFTARAGSLGEMHAKKITKVMDMALKAGAPVVGMNDSGGARIQEGIDALSGYGEIFYRNSLCSGVIPQISAIMGPTAGGAVYSPAMTDWVFMVKKTSYMFITGPEVIKAVTGESITFEELGGAMTHNEKSGVAHFACENDQDAIDRIRKLLSYIPSNNMEDPPVVATGDDPFREDPALDALMPDDPNKPYDMKTVIRSIVDNGEIFEPHEYYAKNILICFARMNNRSLGIIANQPSVQAGCLDSNAADKATRFIRFCDAFNIPLLTIADVPGYLPGKDQEWGGIIRHGAKLLWCYSEATVPKLLLITRKDYGGAYLAMSSRHLGADMVYAWPTAEVAVMGAEGAANIIYRKEIKGADDPAAKRKEKIEEYKARFSNPYRAAERGYVDAIIMPRHTRQHLCEALELMCTKRETRPPKKHGNIPV

SEQ ID NO: 33641 - protein, 151 aa, Clostridium botulinum
RKSLNLYANIRPVKSYKGIKSRYENVDLIIVRENTEDLYAGIEHMIGDDIAESIKVITKKASDRIVEYAFNLAKEENRNKVTAVHKANIMKLSDGLFLKCAKEIASRNQDVNFEDVIVDAMAMKLVLNPEKYDVLVMPNLYGDILSDMAAG

SEQ ID NO: 33642 - protein, 398 aa, Bacillus sp. SG-1
MSRNSQSIIEQTQEYGANNYHPLPIVISEAEGVWVKDPEGNKYMDMLSAYSAVNQGHRHPRIIQALKDQADRVTLTSRAFHNDQLGPWYEKICKMTNKDMALPMNTGAEAVETAIKTARRWAYDKKGVADNQAEIIACEGNFHGRTMSAVSLSSEEEYKRGFGPMLPGINLVPYGDIDALKEAITPNTAAFLIEPIQGEAGIVIPPEGFLKAAYELCKENNVLFIADEIQAGLARTGKMFACEWEDVEPDMYILGKALGGGVFPISCVVADEDILGVFNPGSHGSTFGGNPMACAVSVASLEVLEDEELAQRSLDLGKYFMDKLKEIDNPKIKEVRGRGLFIGVELTEPARSYCEKLKEEGLLCKETHETVIRFAPPLIISQEDLDWAIERIQKVLSR

SEQ ID NO: 33643 - protein, 334 aa, Haemophilus influenzae Rd KW20
MAFNMKNRHLLSLVHHTEREIKYLLDLSRDLKRAKYAGTEQQKLKGKNIALIFEKTSTRTRCAFEVAAYDQGAQVTYIDPNSSQIGHKESMKDTARVLGRMYDGIEYRGFKQSIVQELADYAGVPVFNGLTDEFHPTQMLADVLTMIEHCDKPLSEISYVYIGDARNNMGNSLLLIGAKLGMDVRICGPKALLPEANLVEMCEKFAKESGARITVTEDIDKAVKGVDFIHTDVWVSMGEPLETWGERIKLLLPYQVTPELMKRTGNPKVKFMHCLPAFHNSETKVGRQIAEKYPELANGIEVTEEVFESPMNIAFEQAENRMHTIKAVMVASLA

SEQ ID NO: 33644 - protein, 414 aa, Bacillus sp. SG-1
MGENLNLFTSTQHVINDALGKLGYNEEMFELLKEPIRMLTVRIPVRMDDGSIKVFTGYRAQHNDAVGPTKGGVRFHPEVDEEEVKALSMWMSLKCGIVDLPYGGGKGGIVCDPRTMSFTELERLSRGYVRAISQIVGPTKDIPAPDVYTNSQIMAWMMDEYSRLRENDSPGFITGKPLVLGGSQGREKATAQGVTICIEEAAKKKGIDLKGARVVIQGFGNAGSFLAKFMHDAGAKVIAISDAHGALHDPKGLDIDYLLDRRDSFGTVTTLFENTISNKDLLELDCDILVPAAISNQITESNAYNIKASIVVEAANGPTTFEATRILSERDILLVPDVLASAGGVTVSYFEWVQNNQGYYWTEEEVNEKLHKKLVDAFNNVYETSMNRRVNMRLAAYMVGARKMAEASRFRGWV

SEQ ID NO: 33645 - protein, 239 aa, Triticum aestivum
MACAFSASTVSTAAALVASPKPAGAPQCLSFPRSFVARAAAEYDLPLVGNKAPDFAAEAVFDQEFIHVKLSDYIGKKYVILFFYPLDFTFVCPTEITAFSDRHEEFEKINTEILGVSVDSVFSHLAWVQTERKSGGLGDLKYPLVSDVTKSISKSFGVLIPDQGIALRGLFIIDKEGVIQHSTINNLGIGRSVDETLRTLQALQYVQENPDEVCPAGWKPGEKSMKPDPKGSKEYFAAI

SEQ ID NO: 33646 - protein, 466 aa, Bacillus sp. SG-1
MSGITIREKSREEVEAAVVLQKNYYATGKTRPMATRKDNLKKLADVLRKNESKLLKALHDDLNKSEREAYTTEIGILLEEISFTLKHLDSWAKPKKVKTAVTHLGSKGYRIPEPYGVSLIIAPWNYPIQLAVSPLIGALAAGNTAIIKPSELTPHTSKVLSEMFENAFNKELVYVMEGGVQTNQFLLDQAFDYIFFTGSVPVGKIVMEAASKRLIPVTLELGGKSPCIVHEDADLSLAAKRIAFGKLANSGQTCIAPDYLFVHRHAEGKFIEEYKKAVQEFYGEEPLQSDQYGKIVNERHYDRLKKYLNDGEVILGGRYDDQSLQIQPTLIKPLNTDVPVMTEEIFGPIFPVLTYDRLQEVKAFITSRPKPLALYLFTEDEDVEKDITQNLSFGGGCINDTLMHVATPHLPFGGVGESGIGSYHGESSFSTFSHYKSVLKQTNLFDLPFKYPNSKKGLKIVRRLLR

SEQ ID NO: 33647 - protein, 347 aa, Streptococcus thermophilus LMG 18311
MLNIHKYNIIFYIIQNEREIPMTQTKSFLKEIDFTKQELEELIDLSIKFKQLKKNRIPHKYLDSLNIALIFEKTSTRTRSAFTVAGQDLGMNVTYLGAGDIQLGKKESVVDTAKVLGSMFDGIEYRGFKQEDVEDLAKYSGVPVWNGLTDTWHPTQMIADFMTLKEHFGSLEDLTIAYIGDGRNNIANSLLVTSAILGVNVKIISPEILQPEADIVELAQKHNNGANLTITDDISEVKGVDILYTDVWVSMGEEVDFKSRIDLLLPYQINIGLLAKVENPDVIVMHCLPAFHDLNTQIGQEIYEKYCLAELEITDEVFHKYSEIIFQEAENRMHSIKAIMYNSLKNI

SEQ ID NO: 33648 - protein, 244 aa, Arabidopsis lyrata subsp. petraea
MSFSPVSPSQFPSVTKLQVDSVTFDPSVKSPASSNPLFLGGAGVRGLDIQGKFVIFTVIGVYLESNAVPSLSVKWKGKTTEELSESVPFFREIVTGAFEKFIKVTMKLPLTGQQYSEKVTENCVAIWKSLGIYTDCEAKAVEKFLEIFKEETFPPGSSILFALSPTGSLTVAFSRDDSIPETGIAVIENKLLAEAVLESIIGKNGVSPGTRLSIAERLAKLMTKNKVEEDASNHSIDEKLAKEN

SEQ ID NO: 33649 - protein, 413 aa, Erwinia carotovora subsp. atroseptica SCRI1043
MADSTSPRRFTRIDRLPPYVFNITAELKMAARRRGEDIIDFSMGNPDGPTPPHIVEKLCTVAQREDTHGYSTSRGIPRLRRAISRWYADRYEVDIDPESEAIVTIGSKEGLAHLMLATLDHGDTVLVPNPSYPIHIYGAVIAGAQVRSVPLVEGVDFFNELERAIRESIPKPKMMILGFPSNPTAQCVELDFFERVVELAKQYGVLVIHDLAYADIVYDGWKAPSIMQVPGAKDIAVEFFTLSKSYNMAGWRIGFMVGNSELVNALARIKSYHDYGTFTPLQVAAIAALEGDQQCVRDIAEQYRQRRNVLVRGLHEAGWMVDEPKASMYVWAKIPDAYAHLGSLEFAKRLLSEAKVCVSPGIGFGDYGDTHVRFALIENQDRIRQAVRGIKTMFRADGILPTTKPLAGKGPAA

SEQ ID NO: 33650 - protein, 544 aa, Populus trichocarpa
MRTDIDNFWIFALASKCRVFTQENIAWSLLIMGLAWIATTLIYWAYPGGPAWGKYKLKNTSFTISKPIPGPRGLPLIGGMRLMTSLAHHKIAAAADACKARRLMAFSLGDTRVIVTCNPDVAKEILNSSVFADRPVKESAYSLMFNRAIGFAPYGVYWRTLRKIASTHLFCPKQIKTAASQRRRIASETVSMFNDHEGSGFTVRGILKRASLNNMMCSVFGREYELDSCNSEVEELRALVDEGYDLLGTLNWTDHLPWLADFDPQKIRFRCSNLVPKVNRFVSRILAEHRAQAGNETPDFVDVLLSLQGHDKLSDSDMIAVLWEMIFRGTDTVAVLMEWILARMVLHPDVLSKVHDELDKVVGRSRAVAESDITAMVYLQAAVKEVLRLHPPGPLLSWARLAITDTTIDGYHVPKGTTAMVNMWAISRDPDSWEDPLEFMPERFVTKKGELEFSVLGSDLRLAPFGSGRRTCPGKTLGLTTVTFWVASLLHEYEWLPCDGNKVDLSEVLGLSCEMANPLTVKLRPRRSHYKPTVLGVQNYVLDV

SEQ ID NO: 33651 - protein, 523 aa, Saccharomyces castellii
MSHHQNSTTANTAMAIHNLTNTTNTPMQSASNLRLLNGNLPMTPANQTPASTASPPTSMRDDSTIVGLHYKIGKKIGEGSFGVLFEGTNMINGLPVAIKFEPRKTEAPQLKDEYRTYKILTGTPGVPQAYYFGQEGLHNILVIDLLGPSLEDLFDWCNRKFSVKTVVQVAVQMITLIEDLHAHDLIYRDIKPDNFLVGRPGHEDANKIHLIDFGMAKQYRDPKTKQHIPYREKKSLSGTARYMSINTHLGREQSRRDDMEALGHVFFYFLRGQLPWQGLKAPNNKQKYEKIGEKKRTTNVYDLAQGLPIQFGRYLEIVRNLSFEETPDYEGYRMLLLSALDDLGQSADGEYDWMKLNGGRGWDLAINKKPNLHGYGHPNPPNEKSKRHRNKLNAAGVAGGNPQQRQTNSPLHTAHHTPQPPQLQPLQQNQHTENDMQQNEAQLDPTSYEAYQQQTQQKYAQQQKKSQLHQQHTATKQGANINNGKYQHQAQPTAVKQPQRGQQQQDESSDHSAKGFFSKLGCC

SEQ ID NO: 33652 - protein, 106 aa, Populus trichocarpa
MASSSSAGNAAQNPRKSLGLVANAMKRKDSFIQLFAMTGIFLLSIRSLGQKYQIHDLQEDTIALKEEQKNLTDRMKNIKRSLLHEASLDSSGLFASRLRLLFGEDH

SEQ ID NO: 33653 - protein, 469 aa, Oryza sativa Japonica Group
MSSSSSSGWSSKKVCVVGAGMAGLAAARELRREGLDVTVLEQSADVGGQWLYDAATDGRDPLGMAGVHSSIYSSLRLNSPREVCGFSDFPFRPTNGGGGDARRYPVHGELLRYIREFCDVFGLMDAVRLDTTVVRVAMAPPRRDGSLRWTVRSKHNGDAETEEVFDAVVVATGQYSQPRLPSIDGMDKWRRRQLHSHSYRVPDSFAGEVVVIVGCNLSGKEVALELLRVAKEVHLSSKSTKEAMTPSMSKMLARYDNLHLQPLVEHLCEDGRVVFDDGSFVVADAGKVTVDDNRVGPLYEHVFPPALAPSLSFVGIPVKVILPRFAEVQARWVAQVLSGRRTLPSPGEMLRAVEEYNRAKEAAGLPKRQTHDLFLDLEYCDEYGERHCGFPRTEQWKKELIWSSISDMCDDIENFRDDYHDSDIVRDGRRLHGWASSPPLAPRPQEKDDDHDKEEDKHLGFGPSKFSLR

SEQ ID NO: 33654 - protein, 529 aa, Saccharomyces castellii
MSRVQGPTPMAVNNLTNIPAPTSLSQQQQQRPSTSTHDDNSTIVGLHYRIGKKIGEGSFGVLFEGINMINGTPVAIKFEPRKTEAPQLKDEYRTYKILAGTPNIPLAYYFGQEGLHNILVIDLLGPSLEDLFDWCNRRFSVKTVVQVAVQMITLIEDLHANDLIYRDIKPDNFLIGRPGQPDENFIHLIDFGMAKQYRDPKTKQHIPYREKKSLSGTARYMSINTHLGREQSRRDDMEALGHVFFYFLRGQLPWQGLKAPNNKQKYERIGEKKRTTNVYDLAQGLPVQFARYLEVVRNLSFEETPDYRGYRELLLSSLDDLGQSADGEYDWMKLNGGKGWDLNINKKPNLHGYGHPTPPNEKSRRHRTNNNNNKVNAPVNQLSPHQLQQQQLHLQQQQMQMQQQQLQMQQISSQGQGHPSMQPLRSINPPQQEASKKLDPSSYEAYQQQVQQKYSQQQDKTRQNNAANQNNYHVNANPNTNQYASQQEPMNNLHQQAQPQQGKNNQMQQTADDASSESGKGFFSKLGCC

SEQ ID NO: 33655 - protein, 530 aa, Zea mays
MAAAAWWETLVVAAAADGTGGSSTTVVSICMFTTVLCLCLVAGHLLEENKWVNESITALVIGCIIGVIVFLLTKGKHSHILRFDEQLFFIYVLPPIIFNAGFQVKKKQFFHNFMTIMSFGVFGVFISGAIVSAGCYWLFPKVGFGELGAVDYLALGAIFSSTDTVCTLQVINQDETPRLYSLVFGEGVVNDATAVVLFNAIKDLDISQLKGGVVLKVIFDFLYLFATSTVLGISIGLVTAYVLKALYFGRHSTDREVALMALMAYLSYMLAELLELSGILTVFFCGIVMSHYAWHNVTESSRITTKHIFATLSFIAETFIFLYVGMDALDIDKWRTSKESFKTSIGIFGILILLILLGRVAFVFPISILSNIMSGSSERTPITFKHQVVIWWAGLMRGAVSIALAYNQFTFSGVTSDPVHATIITSTIIVVFFTTLVFGFLTRPLISGMLPHQSRALSRGHSTGSNSPKDDFTLPFLSGDEGASGSGIVLEQAKRSLSMMLERPVHTVHIYWRKFDDRFMRPIFGGPRSH

SEQ ID NO: 33656 - protein, 168 aa, Xylella fastidiosa Temecula1
MMTGLNVRIGQGYDVHAFGPSDHVMLGGVRVPHRCGVLAHSDGDVILHALCDAMLGALGLGDIGQHFPPSDVRWKGADSGVFVRHCNLLLRERDWCVGNVDATAICESPKIAPYVNAMREGIARLLEVQPECVSVKATTSEGLGFIGRGEGLAAQVVVLLYRLNGVVV

SEQ ID NO: 33657 - protein, 255 aa, Magnaporthe grisea 70-15
MEGIQTHPSNAAQAKAFTAPGSLSFPGGHGELTPPNDANGQRPAANGAPLGSQAANGTGVTPATPAATPAATQTGSGLTPTLQNIVATVNLDCRLDLKTIALHARNAEYNPKRFAAVIMRIREPKTTALIFASGKMVVTGAKSEDDSKLASRKYARIIQKLGFNAKFTDFKIQNIVGSCDIKFPIRLEGLASRHHNFSSYEPELFPGLIYRMIKPKIVLLIFVSGKIVLTGAKVREEIYQAFEMIYPVLQDFRKV

SEQ ID NO: 33658 - protein, 389 aa, Arabidopsis thaliana
MASSTATMLKASPVKSDWVKGQSLLLRQPSSVSAIRSHVAPSALTVRAASAYADELVKTAKTIASPGHGIMAMDESNATCGKRLASIGLENTEANRQAYRTLLVSAPGLGQYISGAILFEETLYQSTTDGKKMVDVLVEQNIVPGIKVDKGLVPLVGSYDESWCQGLDGLASRTAAYYQQGARFAKWRTVVSIPNGPSALAVKEAAWGLARYAAISQDSGLVPIVEPEIMLDGEHGIDRTYDVAEKVWAEVFFYLAQNNVMFEGILLKPSMVTPGAEATDRATPEQVASYTLKLLRNRIPPAVPGIMFLSGGQSELEATLNLNAMNQAPNPWHNTCLKTWGGKEENVKAAQDILLARAKANSLAQLGKYTGEGESEEAKEGMFVKGYTY

SEQ ID NO: 33659 - protein, 263 aa, Haemophilus influenzae R2846
MARRPLVMGNWKLNGSKAFTKELIEGLKAELHDVTGCDVAIAPPVMYLGTAEAALSGCGCNCGGKSVIQLGAQNVDINVKGAFTGDISTEMLKDFGAKYIIIGHSERRTYHKESDEFVAKKFGALKEAGLVPVLCIGESEAENEAGKTEEVCARQIDAVINALGVEAFNGAVIAYEPIWAIGTGKSATPAQAQAVHAFIRGHIAAKSQAVAEQVIIQYGGSVNDANAAELFTQPDIDGALVGGASLKAPAFAVIVKAAAAAKN

SEQ ID NO: 33660 - protein, 424 aa, Photobacterium sp. SKA34
MAAIAVFISIFNHKFGRFQTTIAITGWSIAISLILLALTQFGFISVEKENALIELIQHIKFEDFLLKGVLGFLLFAGALNIDLDHLKDQKFEITFLALVGTLFSTFFIGITIWFIFSLIGIELNFIYCCLFGALISPTDPIAVLAIVKKLKAPQRISTQIEGESLFNDGIGLVIFVTIFEIAFSKTAPTVSETAMLFIREALGGLAFGAVLGSIFHYLIKGSNDNMLRLILTMLIPTCGYVIGEHLEVSAPLAMVVSGILIGNITRKYISEQSADQMAHLWELVDEILNAVLFLLIGFVMITFSFHSIDIIAVIIAVPLVLLSRYLSIRLSYVGFKRYRQYNPESVKILTWGGLRGGLALAMAMAMAMAMAIPTHIYLPSHPDVSIKEIIVLMTYAIVIFSILIQGSTITSMIMKAKAVDNKPF

SEQ ID NO: 33661 - protein, 195 aa, Pyrobaculum aerophilum str. IM2
MHAINIAFFALIMPVEKTLLILKPDAVARGLVGEIISRFEKAGLKIVALKMVKASPEEIERFYPSSEEWLRSAGQKLLKAYQELGIDPRAKIGTDDPVEVGRIIKRSLVKYMTSGPIVVMVLKGNRAVEIVRKLVGPTSPHSAPPGTIRGDYSIDSPDLAAEEGRVVFNLVHASDSPSEAEREIRFWFREEEVLE

SEQ ID NO: 33662 - protein, 266 aa, Mesorhizobium loti MAFF303099
MARSALLNVMVQAAMKAGRSLSRDFGEVQNLQVSLKGPGDYVSQADRKAEDIIFAELSKARPGYGFLMEERGAVEGEDSQHRWIVDPLDGTTNFLHGIPLFAVSIALERQGQIVAGVIYNPAMDELYTTERGGGAFMNDRRLRVAGRIKLVDTVIGCGMPHLGRGHHGNFLVELRNVMAEVSGVRRLGSAALDLAYVAAGRMDGFWETGLSAWDIAAGLLLIREAGGFVSDMDGGQDMLDNGSVVAGNEVIQRALLKAVKKPLSAR

SEQ ID NO: 33663 - protein, 151 aa, Clostridium botulinum
RKSLNLYANIRPVKSYKGIKSRYENVDLIIVRENTEDLYAGIEHMIGDDIAESIKVITKKASDRIVDYAFNMARKENRNKVTAVHKANIMKLSDGLFLNCAEEAASRNKDIDFEDVIVDAMAMKLVLNPEKYDVLVMPNLYGDILSDMAAG

SEQ ID NO: 33664 - protein, 151 aa, Clostridium botulinum
RKSLNLYANIRPVKSYKGIKSRYENVDLIIVRENTEDLYAGIEHMIGDDIAESIKVITKKASDRIVDYAFNMARKENRNKVTAVHKANIMKLSDGLFLNCAKEVASRNKDIDFEDVIVDAMAMKLVLNPEKYDVLVMPNLYGDILSDMAAG

SEQ ID NO: 33665 - protein, 198 aa, Mesoplasma florum L1
MFKQSVFIKSAANKSGWIEDNIPEVCFVGRSNVGKSSFINTLANNKKLAKVANTPGKTRLLNFFDINNSSFRLVDAPGYGYAKISNSMKVEFGIMMEDYLTTRENLKLVCMLVDLRHKPTNDDVQMYDFLKANDIPVLMIGTKLDKLKRNEIAKNEKLIKETLEFDQNDVFVKVSNLDKINIKESYDALIRLLEVENG

SEQ ID NO: 33666 - protein, 425 aa, Ashbya gossypii ATCC 10895
MRKCKVFMGTSHPELGKLVCEKLGIEPAPCTLKKFANGETSVQIGVSVRDEDVYVIQSGSSTINDHIMELLILVSACKGGSARKVTAVIPQFPYSKQCKMKKHRGAITARMLANLLIIAGADHVVSMDLHASQMQGFFTKPVDNLYGGPSLAKWIRENVEDYQHAVVVSKNPGGTKRVTALADSLKINFAMIHTDRRRSKDLYSQTKDMKQLRMRKQSMLRKNRPIVRPGAAEDEEENIILTNGIQTARIINGHVIDDDVDDAYHSDVVVSDQEGSLASDSYPIGGSYEAAADSEDEEAPQEKQEKLITLVGNVNGRSAIILDDMIDRPGSFISAAEHMVKNCGAKRVYVVATHGIFTGDCLEQLEQSDAVYQVIVTNTYPINRDRMKRSQKLVVIDTSSIFAECIRRDHYGESISVLFDSLASL

SEQ ID NO: 33667 - protein, 151 aa, Clostridium botulinum
RKSLNLYANIRPVKSYKGIKSRYENVDLIIVRENTEDLYAGIEHMIGDDIAESIKVITKKASDRIVDYAFDIARKENRNKVTAVHKANIMKLSDGLFLNCAKEVASKNKDIDFEDVIVDAMAMKLVLNPEKYDVLVMPNLYGDILSDMAAG

SEQ ID NO: 33668 - protein, 151 aa, Clostridium botulinum
RKSLNLYANIRPVKSYKGIKSRYENVDLIIVRENTEDLYAGIEHMIGDDIAESIKVITKKASDRIVDYAFDMARKENRNKVTAVHKANIMKLSDGLFLNCAKEVASKNKDIDFEDVIVDAMAMKLVLNPEKYDVLVMPNLYGDILSDMAAG

SEQ ID NO: 33669 - protein, 214 aa, Glycine max
MEAVLTPHATAQKQPFAPNKNIRMKTPKKNGRGNFICANNRSENFDTYAGLLNPPSRAMSFSYSHPLSASSLFTHHCAQQPPLLLCPHVVSPTYGSGQGLVVVVNKNKNRSRDMSLTPKKSKPTKREEAKKRSVTQSDNRWGPDPKDLPKVVLGMGNNHHDVVSGAVFNLAPPPSSLPLPKFSLRSKLGCNAETAAGGVDDGATNNLRRLLRLR

SEQ ID NO: 33670 - protein, 559 aa, Physcomitrella patens subsp. patens
MVMLIAEAAVVKYDWTVDYITASPDCVEKLVLSVNNQFPSPTIHAMEGDTLVVRVTNAIPTEGVVFHWHGIHQTTTPFFDGAAYVSQCPINPGETFTYRFTVERAGTYFYHGHFGMQRAGGLFGSLIVSISLHKEPFAYDGEHSIILTDWWHKSIYEQQLGLTSIPFRFVGEPQSLLIQGRGSYNCTGLAGVAPGSLNCIVCNSTNPLCAPHVLPVMPGKTYRLRIASVASLSSLNFILEGHTLTVVQADGRYVKPFQVDNLNVYSGQSYDVLFTTNKEPSRNFWAAVNVRGRKMSTPTGLAILQYLPNPATLVPLTPTPVSPAWNDTAASVAQAKMILAKFGYEQAPPLKPDRTVTILGTQNMVDGHIKWALNNISHVARPTPVLAALKYNIRGAFDSEPPPDFPIKDYDVFAPPPTNYRNATSGSPVYVFTKDSVVDIIVQNANTLTPNNSEIHPWHLHGHDFWILGYGEGQFDPEKDPAFFNLVDPPVRNTVAVFPYGWVVIRFIANNPGAWPFHCHIEPHFHMGMGTVFAEGIEHIPELPTQTLGCGLTKRLMRL

SEQ ID NO: 33671 - protein, 381 aa, Oryza sativa
  misc_feature (22)..(22): Xaa can be any naturally occurring amino acid
  misc_feature (301)..(301): Xaa can be any naturally occurring amino acid
GTRLVVASISSFGINHEFTPMXYPLLISSVGIIACLITTLFATDFFEIKAVDEIEPALKKQLIISTVVMTGGIALVGSPGLPGSFTIFNFGAQKTVYNWQLFLCVAVGLWAGLIIGFVTEYYTSNAYSPVQDVADSCRTGAATNVIFGLALGYKSVIIPIFAIAFSIFLSFARAAMYGVAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKXGGAWDNAKKYIEAGASEHARTLGPKGSDCHKAAVIGDTIGDPLKDTSGPSLNILIKLMAVESLVFAPFFATHGGILFKWF

SEQ ID NO: 33672 - protein, 193 aa, Mycoplasma pneumoniae M129
MEARFLKSASDLESCPQDSVKEVCFMGRSNVGKSSLINAFFQKKLAKTSATPGRTQLLNFFEYNRKRFVDLPGYGFAKLSKVQKEAITNLLTQFLNFRQNLTGVVLVIDSGVVTVQDQEVVKTILQTGLNFLVIANKFDKLNQSERFHTQNKLAHFLKVNPNKCLFVSAKTGYNLQVMHKQIFELFKADGQAI

SEQ ID NO: 33673 - protein, 160 aa, Dechloromonas aromatica RCB
MNFRVGQGYDVHKLVDGRKLILGGVEIPHPTGLLGHSDADALLHAITDALLGAVALGDIGRHFPDTDPRYKGADSRVLLRAAVALLAERGWRPVNVDATLIAQQPKLAPHAVAMVANVAADLGISPDCVNIKGKTNERLGYLGREEAIEAQAVALVERVG

SEQ ID NO: 33674 - protein, 335 aa, Haemophilus influenzae Rd KW20
MITSQTPITVLGAGSYGTALAITFSRNGSPTHLWGHNPAHIAQMQTERQNYRFLPDVIFPEDLHLESNLAQAMEYSQDILIVVPSHAFGEILIKIKPHLKAHHRLIWATKGLERNTGRLLQTVVEEQLGTQYPLAVLSGPTFAKELAQGLPSAITLAANNEQFAREFQSRIHCSKGFRVYINSDMTGVQLGGAIKNVIAIGAGISDGMGFGANARTALITRGIAEITRLGISLGANTNTFMGMSGLGDLVLTCTDNQSRNRRFGLMLGKGLDAQMAMENIGQVVEGFYNTKEAYLLAQRQGVEMPITEQIYQMLFCGKSAQDVAISLLGRACKGE

SEQ ID NO: 33675 - protein, 267 aa, Haemophilus influenzae Rd KW20
MTLDVWQHIRQEAKELAENEPMLASFFHSTILKHQNLGGALSYLLANKLANPIMPAISLREIIEEAYQSNPSIIDCAACDIQAVRHRDPAVELWSTPLLYLKGFHAIQSYRITHYLWNQNRKSLALYLQNQISVAFDVDIHPAAKIGHGIMFDHATGIVVGETSVIENDVSILQGVTLGGTGKESGDRHPKVREGVMIGAGAKILGNIEVGKYAKIGANSVVLNPVPEYATAAGVPARIVSQDKAAKPAFDMNQYFIGIDDGMNLNI

SEQ ID NO: 33676 - protein, 370 aa, Arabidopsis thaliana
MAENQNCARMTRAAAKRKASSMALDENPVSKKRVVLGELPNMSNVVAVPNQERETLKAKTSVNTSKRQMKKALMIPEASVLIESRSVDPQMCEPFASDICAYLREMEGKPKHRPLPDYIEKVQSDLTPHMRAVLVDWLVEVAEEYKLVSDTLYLTISYVDRFLSVKPINRQKLQLVGVSAMLIASRKYEEIGPPKVEDFCYITDNTFTKQEVVSMEADILLALQFELGSPTIKTFLRRFTRVAQEDFKDSQLQIEFLCCYLSELSMLDYTCVKYLPSLLSASAVFLARFIIRPKQHPWNQMLEEYTKYKAADLQVCVGIIHDLYLSRRGNTLEAVRNKYKQHKYKCVATMPVSPELPLAFFEDITIRGMA

SEQ ID NO: 33677 - protein, 408 aa, Mycoplasma pneumoniae M129
MTKTKFNPYQFRKQFKWFKNNPQWVNFDNAATSIALDTVSQACKEYYELFSVNPHNKTPDLNNQIIAIIAETRQLVADWFNVTALEIIFTSSATESINLFAHGLKPWIKPGDEIVLKGDEHSANVLPWVALAKQTKARLVWVEKQANQSLEDTFKSLINPKTKVVAITATSNLFGNSIDFAQIADYLKQVNPKAFVAVDAVQTVQHKQIDIAKTQIDFLAFSTHKFYGPTGLGVAYIKKSLQPQLQPLKLGGDIFTQIDPDNTIHFKSTPLKFEAGTPNIMAIYALNKLLRFFKQKFNFAQMMAYGHQLKQQAYELLNSNPQIVLANHDQDVPIFSFKHRQLATIDLATFLNINKIMVRQGSICVGRYRNKDYFVRVSLMHYNTVKELQYLAKLLATDTKTIIKNVIK

SEQ ID NO: 33678 - protein, 3574 aa, Aeromicrobium erythreum
MNEQDPQDRTAALLRRATTELRAARRRVQQLESDPVAVVSMACRLPAGIDTPEKLWDLLDAGRETLSDFPDDRGWDLTGLFDPDPDHPGTSYVDQAGFLDDATGFDPELFGIAPREAEAMDPQHRILLESCWELFERAGMDPLGLRGSATGVFVGAAKFGYGEGDVGDPDGYAVTGTAPSVASGRLSYTFGLEGPSLTVDTACSSSLVALHLAVDSLRKGESSLAVVGGAAVMGSPDVFVDFSRQRALAADGRSKAFGAGADGFGFSEGVSLVLLERLSDAQRLGHPVLAVVRGSAVNQDGASNGLSAPSGRAQRRVLRAALERCGLEPADVDVVEAHGTGTALGDPIEAGALLEVYGQDRSEPLALGSVKSNLGHTQAAAGTTGLLKVVLALQHECLPRTLHVEEPSTHVDWTSGAVRLLDQARPWPRSDRPRRAGLSAIGISGTNAHVIVEEAPATEEESGPVDREPVSGPVLLPMSARTPEALVEQAHRVAGLLRAESVDLADLAVSLGTTRAHLEHRAVVVASTPAAALDALATVGRDQPDGDVVRGTADAGGRTTAFVFPGQGSQWPEMGRELMATSALFAEAVDACDAAMRPWQDWSVADVLRQEPGAPGLERVDVVQPVLFTVMVALARLWRSRGVEPAAVVGHSQGEIAAAHVAGILTLDGAARLVVLRSQALRRLSSQGGMVAVACDEDAARERISAWGSALSVAAVNGPRSVVVSGDRDALADLVATCERDGLAARTVDVDYASHSAHVDAVREEVLRHAREVRPRDGEIAFYSTVTAGPLAGSRLDAEYWFRNLRERVRLHETVDLMVDQGYDAFVEVGPHPVLLPALTATVESGSGGDGAVVLATLRRGEGGPTGFARAVAAAYVAGVEIAWSTVAPGGRGRALPVTYPFQHRRFWRSERRGGARPAGLVHHVEWSTLDRSDSTAAPAGTWLVVTPDDAAEGWSDVVLDAVGRAGGTAQVVSTAVVDAWADGTAEVPDGLAGTVVLPPSPGQDAVAVAEWGRSTVQALARTTSGAPLWLLTAGAVAAAPGEVPAHPEQATLHGIGHVARLELGDAWGGVVDLPASASEEVAASLADAWGRRRESVMAVRGGRLLGRRLRDGGARTSDRWRPRGTVLVSGAATPVGAVLARWVAQHGADRLVLVGRAPDPQLVRELEEGGVRVSTSPVDLADLRAAIGEDEPTAVVHAESDPVFAPVVEADADGFRRTVSARSSLPDLLDELLDGARLEREVLCSSVAATWGGAGMAAYAAGAAYLEATAARRRSQGHATSVVTWTPWDLPAGHHAAPDLSGSALRALAVPRALEAWESILAAAPSDVVVADADWPALADEFSAARPTALFDGLAQPAAPAAAGPTPSGPTHDAGSEELRAVAALGGEERREAARVLVADVAADVLGQDQASRVSRTRALREQGLDSLGTLALRKSLVARTGLTLPASLVYDHPSVNAIADHLLALVDPEAGAQDERPVARGAAEEPIAIIGVGCRFPGGIRSPEGLWDLLRTGADVTGSFPDDRGWDVEGLYDPEGLRPGTTYVDRGGFLDDVASFDPGFFGITPREALAMDPQQRLVLETSWEAMERAGIDPEAVRGSDVGVYLGMNGQSYASLLDGEGDRVDGYKGLGNAASVLSGRVAYTFGWEGPALTVDTACSASLVAVHLAVRALRSGECSMALAGGVTVMTDPYTFVDFSSQQGLARDGRCKAFSADADGFALADGVATMLLVPLSRAAELGYPVLGVVRGTAVNQDGASNGLAAPNGPSQERVVRAALADAGLGPQDVDVVEAHGTGTQLGDPIEAGALLSTYGRDPGRPVHVGSVKSNLGHTQAAAGAAGMLKVLLALRHGVVPRTLHADEPTPHVDWASGGLRLAQDDVPWPRGERPRRAGVSSFGVSGTNAHVVLEEAPDAGTVERPGADAARAVPLVLSGRSEGAVRGAARQLASRLADGTHDVRDVAWTLSRGRSAMEWRAAVPADDVPAAVAALEALADGSPTADGVGPTLSRPRRAVLVFPGQGSQWDGMARDLLATSTVFRQSMQECAQALSAHVTWDLFDVVEGRADVDPERVDVLQPVLFSMMVSLARTWRGHGLVPAAVVGHSQGEIAAACVAGALSLDEAARVVALRSRALREIDGDGGMVSVAVAADEAERLLAPWADQLAVAAVNGPRMVVVAGPVEQLDAFCAAVEQAGHEPRRVAVGYGSHSGEVERVRAQVVDALGDVRVRTSEVPVYSTVTAERIDSASMDAGYWYDNLRGRVRFTETVEALVRDGHDLFVEASPHPVLLGGVQDVADDLGADVDVVATLRRDRPGARELARATGEAFAHGASVEPATTVPDGRLVDLPTYPFQRERFWPRRHRPAPVTDSGLPGVEHPVLSTVVEVPGSGERVLVGRLDPHAHPWLAEHVVEGRRLVPGSVLVELALATGELVGLPVLEELLLQEPLELPAAGGLRLRLVVGPDDGGRCDLQVHAAPDGMQDPTWTLQASGVLGADASTSRPTSGGSAWPPADADAIELAGHYDTLAGLGFEYGPAFRGLRRAWRAGERVLAEVEVPAARHGFVVDPVLLDVVAQTLGVAAAESGRLPFAWNGVRVHGPVVGALRVVLGGDPRSDASLEVVTPAGVPVLTVDGIVVRDASAGTDLRSGTLQSLTWVPAQPDGPAPTVTTVEVTTLDELDAPGRPDADLVVLRHVDDDPDPITATRRAVAWAAEVVRRWGATDRRRARLVVVTDGAARVGADDPPARPGPAAVWGVLRAAQAESPNRFLLVDGALDVPARPDLPQVAVRDGLTLVPRLQDRPTSWVPGAGQRVAPGSGSIDGLVLEKVPASQLQPGPGEVRVAVCATGLNFRDVMLALQVYPDAALMGTEAAGVVEAVGEGVTSVEVGDRVLGLFAGAYAERAVTDARLVAPLPPGWSFAEGAAVPIAFTTAYYALHDLAGVQRGQTVLVHAAAGGVGMAAVSLALHAGADVLATASPAKHDAVQARGLPADQVRSSRTSGFAEAFLGHTRGRGVDVVLNSLTGPLLDETIRLVAPDGVVVELGKADLRDPADVAARYLPFDLGEVGPDRLGEILRTVVDLLAGGRVPPVPVSARPLADLRAALTEMSRGGHVGKLVVEQSRPAPLEGTVLVVGGTGTLGSLVARHLVSTRGVRHLLLVSRRGPDAPGAADLVAELEAEGARVDVVACEATDRARLAEVVRGVPAEHPLVGVVHAAGVLADSFVVSIDADAVETVVAPKVDVVQHLDELTADLDLGLFAVFSSAASVLAGPGQGVYAAANAVVEACVARRASRGARATALGWGLWQDSSDLTRGLEDQIARTGVAPLSRARALELLDEALGSDEPVLYPMALDVDALAEADVVPEVLRARVAPRDRVVPTRGRRGTGPDRDERGADWASRLRGLDADARRTEVLDLVRAHAAAVAGFSSAAQLPEQRAFRDLGFDSLAAVELRNRLRDATSVRLPSTLVFDYPTAEAVAERLLEDLEPVVEHDASSLEEQLAALERAVRDATPDQLPADLGSRVRGLLDVLPAGEVEGRAWDGGAAAAALVDDDTSDDELFSLLDARLGAEGDQDR

SEQ ID NO: 33679 - protein, 63 aa, Neisseria meningitidis
MAYSDKVIDHYENPRNVGTFDKNDESVGTGMVGAPACGDVMRLQIKVNDEGIIEDAKFKTYGC

SEQ ID NO: 33680 - protein, 467 aa, Burkholderia xenovorans LB400
MKSESKNQHVGKVTHHELKQTLGTWQLWGIAVGLVISGEYFGWSYGWASAGTLGFVITAIFIAAMYTTFIFSFTELTTSIPHAGGPFAYARHAFGPTGGYLAGAATLVEFVFAPPAIALAIGAYLHVQFPGLEPKHAAMGAYLVFMALNIVGVQIAAAFELCVTLLAIFELFVFMGVVSPGFQWSNFTKGGWSGADTFSMGSFHGMFAAIPFAIWFFLAIEGVAMAAEEAKNPKRSIPIAYVTGILTLVVLAIGVMVFAGAAGDWTKLSNINDPLPQAMKFIVGEHSGWMHMLVWLGLFGLVASFHGIILGYSRQIFALARAGYLPEWLSRVHPRFKTPHRAIIAGGVVGIAAIYSDELIQFGGQTLTANIVTMSVFGAIVMYIISMLSLFKLRRAEPNMERPFRAPLFPVFPAFALVAAVICLATMVYFNFLVAIVFAIFLALGYVYFLMTRHQREAAPADALLEE

SEQ ID NO: 33681 - protein, 661 aa, Nicotiana tabacum
MAKDNGNAESNHRRAGLLKDQVRLVKRKNCDRYEIVSIPDNLSFEKGFFVVIRACQLLVQKNEGLIIVGVAGPSGAGKTVFTEKILSFMPSVAVISMDNYNDASRIVDGNFDDPRLTDYDTLLKNINDLKAGKQAEVPIYDFKSSSRVGYRTLEVPSSRILIIEGIYALSEKLRPLLDLRVSVTGGVHFDLVKRVLRDIQRARQEPSEIIHQISETVYPMYKAFIEPDLKTAHIKIINKFNPFTGFQSPTYILKSSRNVNVAQIKSALSEEHTESTEETYDIYLLPPGEDPETCQSYLRMRNKEGKYSLMFEEWVTDSPFVISPRISFEVSVKLLGGLMALGYTIAAILKRSSHVFSDEKVCVKIDWLEQLNRHYVQVQGRDRVIVKSVADQLGLEGSYTPRTYIEQIQLEKLVNEVMALPDDLKTKLSLDEDLVSSPKEALSRASAERVAWRNKNFRGGLSHSYANHREKHLSKIDTDSRRFDDRNTDSAATLANQGAVTHLSEQISTLNDRMDDFTSRMEELNSKLSSKRASPSTQNLALQPEACNGSGPTSYFISGLENGSLTGSIMPNSSSSSSLIPKESTLMEELSNVARGQRQIIHQLDNLSNLLRDRLGEQSRQSRKSKRRDITDIDSIRVPLIVTLAVGGLGLFLFKSLQNRN

SEQ ID NO: 33682 - protein, 235 aa, Novosphingobium aromaticivorans DSM 12444
MLDLFGASSAPTFGNQGKFTTDPVTGALIPVVVEQSSRGERSFDIYSRLLRERIIFVTGEVEDHMASVIIAQLLFLESENPSKDISMYINSPGGVVTAGLAIYDTMQYIRPRVSTVCIGQAASMGSFLLAAGEPGMRIALPNARIMIHQPSGGARGMASDIEIQAREILRIRKRMNDLYVKFTGRSLDEIEKAMDRDTFLEAEEAMKFGLVDKVFESRPATDSVGEGEGSGGAPA

SEQ ID NO: 33683 - protein, 322 aa, Saccharomyces cerevisiae YJM789
MKPTQDSQEKVSIEQQLAVESIRKFLNSKTSYDVLPVSYRLIVLDTSLLVKKSLNVLLQNSIVSAPLWDSKTSRFAGLLTTTDFINVIQYYFSNPDKFELVDKLQLDGLKDIERALGVDQLDTASIHPSRPLFEACLKMLESRSGRIPLIDQDEETHREIVVSVLTQYRILKFVALNCRETHFLKIPIGDLNIITQDNMKSCQMTTPVIDVIQMLIQGRVSSVPIIDENGYLINVYEAYDVLGLIKGGIYNDLSLSVGEALMRRSDDFEGVYTCTKNDKLSTIMDNIRKARVHRFFVVDDVGRLVGVLTLSDILKYILLGSN

SEQ ID NO: 33684 - protein, 401 aa, Streptococcus pneumoniae R6
MEYRKIQEALEALQKGRLVLVIDDKDRENEGDLICSAQAATTENVNFMATYAKGLICMPMSESLANQLMLSPMVENNTDNHKTAFTVSIDYKETTTGISAEERGLTARMCVAEDITPSDFRRPGHMFPLIAKKGGVLERNGHTEATVDLLKLAGLKECGLCCEIMNHDGKMMRTDDLIQFSKKHNIPLITIKELQEYRKVYDQLVERVSTVNMPTRYGNFKAISYIDKLNGEHHLALIMGNIEDEANVLCRVHSECLTGDVLGSLRCDCGQQFDKAMKMIVENGSGVLLYLRQEGRGIGLINKLKAYHLQDQGMDTLDANLALGFEGDLRKYHIGAQMLKDLGLQSLHLLTNNPDKVEQLEKYGITISSRISIEIEANPYDSFYLETKKNRMGHILNMEEK

SEQ ID NO: 33685 - protein, 725 aa, Saccharomyces cerevisiae YJM789
MPQSTPSQEVQRVPWDNKPALKQITLRATIAGIAIGSLVLTSNFQFGLQTGWVSMMSLPSALLACAFFKNIWPLIFPNDRPFSDVENVYVQSMAVAVGTGPLAFGFVGVIPAIEKFLTNDESGGLREQGQSFTFRELLIWSTALAFFGIFFAVPLRKQVIVREKLPFPSGSATATLISVLNGTEILQEVSKSELLEMRQRRLNECPEVLQPNRDPEETDYLMNSSHSELGDYTATSQDGSSILSTGSENYRANIIILLKTFVVSSLYTMVSYFVPVIRSIPVFGKYLSNNYLWNFQPSPAYIGQGIIMGLPTVSYMLIGCFLGWGVLAPLARYKGWVPPDADVHDWEEGVQGWILWSSLSIMVADSVVAFIVVTVKSIVKFILIDDKAALLNNIIDDTFQSMLLEEERAINSSRRNTYVDGRQDTVRLVSRDNEIEVDSKHLVRYTTVISGCLVSSIICIVSIIYLFGIQVIPLYAIITALILALFLSILGIRALGETDLNPVSGIGKISQLIFAFIIPRDRPGSVLMNVVSGGIAEASAQQAGDLMQDLKTGHLLGASPRAQFCAQLIGACWSIILSSFMYLCYNKVYSIPSEQFRIPTAVVWIDCARLVTGKGLPDKALECSMILGVIFAVLSLIRNTYRDYGYGWILYIPSGVAVGVGIFNSPSFTIARFIGGWASHFWLKNHRGDLNAKTKMIVFSSGLVLGEGIFSVINMVFICLNVPHY

SEQ ID NO: 33686 - protein, 506 aa, Burkholderia xenovorans LB400
MNHAEMQFLTTEFPYKKQYANFIGGEWVKPVGGEYFDNVSPITGEAFTSIPRSREADVELALDAAHRAKTAWGKTSAADRANILNRIADRMEANLQRLAVAETIDNGKPLRETTAADIPLAIDHFRYFAGAVRAQEGSLSEIDHDTVAYHFHEPLGVVGQIIPWNFPILMAVWKLAPALAAGNCVVLKPAEQTPASILVLVELIQDLLPPGVLNVVNGFGLEAGKPLASSKRIAKIAFTGETTTGRLIMQYASQNIIPVTLELGGKSPNIFFADVMNEDDSFFDKALEGFAMFALNQGEVCTCPSRVLIDEKIYDRFMERALKRVAAITQGHPLDTKTMIGAQASQEQLEKILSYVDLGKQEGAECLIGGERNALGGELSKGYYVKPTVFRGNNKMRIFQEEIFGPVVSVTTFRNEEEALEIANDTLYGLGAGVWTRDGTRAYRFGRQIQAGRVWTNCYHAYPAHAAFGGYKQSGIGRENHKMMLDHYQQTKNLLVSYSDKPLGFF

SEQ ID NO: 33687 - protein, 351 aa, Rhodopirellula baltica SH 1
MVQANSRARTSLFLSLWLNLMTHDVYAVGNALVDIQTMVADDLLSELKLDKGIMTLVDDEKQATVLSRFDLPSLSRCAGGSAANTIAAVADFGGKAAFVGKIGDDETGQFFLKDLRALGVTIDVDPQPGTPSGTCAVLITEDAQRTMLTNLAASTALSEADIDEAVIAASKYVYIEGYLFTGEQTKAAAYKAIELAKKNDVKVAFTASDPFLVNMMKDEMWDLIRGPVDLFFCNEEEAKSLTGLEDPIACANKIHESAENVAMTLGPNGSILMHGGEAIPVEGVKVKAIDTTGAGDMYAGGILYGITNGLDWRQSGHLASHAAARVVAQMGARLQKPFTEDEVKQLTDLTV

SEQ ID NO: 33688 - protein, 485 aa, Physcomitrella patens subsp. patens
MTIIKPHSVLDAAKVASCLRETFRTGRTRPSNWRLEQLHAIVKLIEENEDEICRALFADLHKPRHEALTMESLVVTASAKHAIKNLNKWRAPVKKETPYIVWPASAFILPEPLGVAFVIAPWNFPFLLAVDPVIGAIAAGCTVCLKTSEVTPATSELLSTLVPKYLDNDAIKVVEGGVPEVTALLEQKWDKIFYTGNPKVGRIVMGAAAKHLTPVTLELGGKCPVFIDDTVDLQLASRRIMAGKYGSNSGQACISPDYILVEEHLAPKLIKQFRSTLVEFFGEDPRTSKDLSRIVNKNHFQRLSRLLDDPATADRIVHGGERDEDSLYIAPTLIEDPALDSPIMADEIFGPLLPIITVRNVNAAIDLINDKPKALVVHLFSTNKDYVKMFTEETSSGGLVMNDCIMQFIVPELPFGGVGESGTGAYHGKASFDTFSHFKSIFNKSQSGDAPIRYPPFTLWKQAMLRAFLEGRFFKLIQLLLGLQK

SEQ ID NO: 33689 - protein, 428 aa, Rhodopirellula baltica SH 1
MTLIESIHARQILDSRGNPTVECEVTLMDGAAGRAAVPSGASTGMHEAWELRDGDKSVFMGKGVTTAVKNVNTKIADALEGMDATDQAAVDQAMIELDGTPNKKELGANAILGVSLAVAHAAAASTNQPLFRYLGGAGARMLPAPMMNIINGGEHADNGVDIQEFMVMPLGFERFSDALRCGTEIFHNLKKVLSDKGYSTAVGDEGGFAPDLKSNQEALDVIMTAIDKAGYKAGEQVWIALDAASTEFYDKSSGKYSLDNNQMSGDEMVDFLAGWCDKYPICSIEDGCDEDDWETWKKLTTKIGDKVQLVGDDLFVTNVERLQRGIDEGIANSILIKVNQIGTMTETIDAIQLAHRNGYTSISSHRSGETEDSTIADLAVAMSTGQIKTGSASRSDRMAKYNQLLRIEELLGDAAQYGGPLFAKRITG

SEQ ID NO: 33690 - protein, 245 aa, Bacillus cereus E33L
MIKLVLIRHGQSLWNLENRFTGWTDVDLSENGLSEAREAGAILKKNGYTFDVAYTSVLKRAIRTLWIVLHEMNLAWVPVHKSWKLNERHYGALQGLNKDETAQKYGEEQVHIWRRSIDVRPPALTEDDPRYEMNDPRYKALKKGEFPLTECLVDTEKRVLDYWHSEIAPKLKNGNKVIISSHGNTIRSLVKYLDNLSSDGVVSLNIPTSIPLVYELDENLRPIRHYYLSMDGEVPEGEIPKHISF

SEQ ID NO: 33691 - protein, 636 aa, Kluyveromyces lactis NRRL Y-1140
MDDDVDEILNQNNVQNTQDDDVDMDDELEDVDVDVPNAEEDEPMDEEEQDEDAEDADDDDDEDEDRSDDEDAEDRSEDDDDDDDDDDERSDDDDDDDDEEEDEEQTENGEEGTRTGEIKQSNTHEIGDDDAESAEKESATSEKDSPSSSDGKSTEMSKLDKIHQYYTTLYRSASVAESYNILPTAAIPIQTNVQALTMSKGLRYLFLGGSDGFIRKFDFLNTVDGKLSLTIQQKNALVDSIVNAGILTSYWENEVPQPPSKVKWVKQKSEYLPLVSPVHSLAVQNECLFILAGQETGGIVMQGVRYFEGRTAHYFKGHKSIVNHLVLNDEETRFLSGSWDKTVIEWDLETGTDITKFNATSQLSSLEFRPTNAAYELPEPNLSGHNPDVDSNNVVGNGDAADIDDVDTNSLFGDDDDDDDQDDQHVATNDNTEKAEDNTQQENKDKNEIQEHTSEKKVESETISKNTLALKTDENLFLTSCIDGNIQIWDRRQPSSEIIKLGRNVSTPPWCMSACWSVDGGKVIAGRRNAVVEIYDLRKPEVVESKLKLPSISGPVSKVKAMPNNSHVVAASNDNIRIFDINHIDKTPLIIPGHHGGCISNLYVDPTCRFMISTSGNRGWQGTATDVTLIYDIELN

SEQ ID NO: 33692 - protein, 234 aa, Haemophilus influenzae Rd KW20
MHSFSQRRTFMKPYLIAPSILSADLARLGDDVQNVLNAGADVIHFDVMDNHYVPNLTFGPAVCQALRDYGITAPIDVHLMVKPVDRIIPDFAKAGANYITFHPESSEHIDRSLQLIRDCGCKSGLVFNPAMPLSYLDYVLDKVDVVLLMSVNPGFGGQSFIPATLKKLQQARKIIDESGYDIRLEVDGGVKVDNIAEIAAAGADMFVAGSAIFGKPDYKQVIDQIRTQLASVSA

SEQ ID NO: 33693 - protein, 561 aa, Bacillus cereus E33L
MIHLKTQYTVSTYLLDRLSELGIEHIFGVPGDYNLAFLDDVLAHKNLEWIGNCNELNAAYAADGYARIKGIGALITTFGVGELSAINGIAGSYAENVPVIKITGTPTTTVMENGELVHHTLGDGKFNHFSNMYREITVAQTNLTPEHAVEEIDRVLRACWNEKRPVHINLPIDVYNKPINKPAEPILHKPILSNKETMDKMLLHAISKINSAKKPIILADFEVDRFHAKEYLYQFVEKTGFPIATLSMGKGIFPEKHPQFIGIYTGDVSFPYLRKRIDESDCIISIGVKLTDTITGGFTQGFTKEQVIEIHPYTVKITDKKYGPVVMKDVLQQLSDIIKHRNEETLDIKPFISESLSMTEEFNPKAHMVTQKRFWQQIYHFLQENDVLLAEQGTPFFGSAAIPLPNNTTYVAQPLWGSIGYTLPALLGTQLANLSRRNILIIGDGSFQLTVQELSTMLRQNLKPIIFLINNNGYTVERAIHGQNEPYNDIQMWEYTKLANVFGTEEKSQTFKVENETELQEVLTKISIDKDQLTFVEVVMSQGDQPELLAKLGKRFGQQNS

SEQ ID NO: 33694 - protein, 253 aa, Bordetella parapertussis 12822
MNRLEGKVVFITGGGAGIGRASALLFAREGARVVIAERDADAGRQTVELIAGQGGPRALFVPTDVTEADSVEQAVARTVAEYGRFDVLYNNAGGSTVRDSRVTDTPVEEFWAKMKLDLFGTWLGCRYGIQAMIDAGHGGAVINSTSIFALIGTHGKDAYTAAKGAVSALTRSMAVEYAQHRIRVNAVAPGATATERVLKLLQEDGVTSKSLDGQLFGLVQPEDIAHAALYLASDESKSTTGHILAVDGGLTIS

SEQ ID NO: 33695 - protein, 457 aa, Neisseria meningitidis MC58
MSNPFSSLGLGTELVSALTAQGYENPTPIQAAAIPKALAGHDLLAAAQTGTGKTAAFMLPSLERLKRYATASTSPAMHPVRMLVLTPTRELADQIDQNVQGYIKNLPLRHTVLFGGMNMDKQTADLRAGCEIVVATVGRLLDHVKQKNIHLNKVEIVVLDEADRMLDMGFIDDIRKIMQMLPRQRQTLLFSATFSAPIRKLAQDFMNAPETVEVAAQNTTNANVEQHIIAVDTIQKRNLLERLIVDLHMNQVIVFCKTKQSVDRVTRELVRRNLSAQAIHGDRSQQSRLETLNAFKDGNLRVLVATDIAARGLDIAELPFVINYEMPAQPEDYVHRIGRTGRAGADGVAISLMDESEQKMFESIKELTGNKLLIERIEGFEPQWWEQGGAKPEKPEMREPRQRNRYESAKAQREKNTRPENAANDAGAACGKIAGRSRRSRREHRTCALLQPRYGVK

SEQ ID NO: 33696 - protein, 62 aa, Glycine max
MGTTSSGALGFRRRLYHERVVDHYDNPRNVGSLDKNDPIVGTGLVGAPACGHVMQLHINVRD

SEQ ID NO: 33697 - protein, 263 aa, Bacillus sp. SG-1
MPQLGFGVWQVENNQATAAVAKALETGYTSIDTAMIYQNEEGVGKALKETSVPREELFITTKVWNSDQGYDNTLRAFDESLEKLGLDYVDLYLIHWPTPEFDEYVDTYKALEKLYQDGKVKAIGVCNFEIEHLERILNECDVKPVLNQVECHPYLAQNELKEFCAKHDIFVEAWSPLEQGGEVLKDEVVTQIAEAHGKSPAQVVLRWHLQKNTIVIPKSVTPSRIEENFNVFDFELTADEMSQIDGLNKDRRKGPHPNDMNHR

SEQ ID NO: 33698 - protein, 157 aa, Brucella suis 1330
MDFLMSKHEADAPHLLIVEARFYDDLADALLDGAKAALDEAGATYDVVTVPGALEIPATISFALDGADNGGTEYDGFVALGTVIRGETYHFDIVSNESCRALTDLSVEESIAIGNGILTVENEEQAWVRARREDKDKGGFAARAALTMIGLRKKFGA

SEQ ID NO: 33699 - protein, 399 aa, Nocardioides sp. JS614
MTFDVDRIRKDFPALDSGTAYFDGPGGSQVPRQVAEAVAGTMTSGISNRGQVTAAEQRAEDVVVGARAAVADLLGCDPGGVVFARSMTQATYDVSRALAKEWGPGDEVVVTRLDHDGNIRPWVQAAQAAGATVRWAGFDQETGELGVDDVREQLSARTKLVAVTGASNVLGTRPDVPAIAAAVHEVGALLYVDGVHLTPHVPVDVAAIGADFYACSPYKFLGPHHGIVVAAPELLERIHPDKLVPAGDQVPERFELGTLPYELLAGTTAAVDYLAGLASDAADRRTRVLESMRAVEQHEEALFARLLDGLRGIDAVTLYGDPERRTPTAFFSVAGRADQEVYERLAAAGVNAPASSFYAIEASRWIGLGDTGAVRAGLAPYSSADDVERLLAGVAEIAG

SEQ ID NO: 33700 - protein, 718 aa, Brucella suis 1330
MQMGMAVLVLVIACGVLSVLFAIWAIRSVLAADQGTQRMQEIAEAIREGASAYLTRQYSTIAIVGIVVFLLAWYLLSLNAAMGFLIGAVLSGVTGFIGMHVSVRANVRTAQAASLSLAGGLELAFKSGAITGLLVAGLALLGVSVYYFVLTVWLGYAPADRTVIDSLVSLGFGASLISIFARLGGGIFTKGADVGGDLVGKVEAGIPEDDPRNPATIADNVGDNVGDCAGMAADLFETYAVTVVATMVLGAIFFHGSDALTNVMLYPLMICGACVITSIVGTFFVKLGVNGSIMGALYKGLIATGLLSIVGLGVANTLTVGWGEIGTVAGKSITGTNLFVCGLIGLIVTGLIVVITEYYTGTNKRPVNSIAQASVTGHGTNVIQGLAVSLESTALPAIVIVGGIISTYQLAGLFGTAIAVTAMLGIAGMIVALDAFGPVTDNAGGIAEMAGLDPEVRKATDALDAVGNTTKAVTKGYAIGSAGLGALVLFAAYSNDLAYFAANGQIYPYFADMGPVSFDLSNPYVVAGLIFGGLIPYLFGGMAMTAVGRAGGAVVQEVRRQFREKPGIMTGKERPDYARAVDLLTKAAIREMIIPSLLPVLAPIVVYFGVLLISGSKAAAFAALGASLLGVIINGLFVAISMTSGGGAWDNAKKSFEDGFTDADGVKHMKGSEAHKASVTGDTVGDPYKDTAGPAVNPAIKITNIVALLLLAVLAHMA

SEQ ID NO: 33701 - protein, 257 aa, Bacteroides fragilis YCH46
MKVAIIGAGNMGGSIACGLAKGKLIPASDIIVSNPSIGKLEALKKEFPSIAITRNNAEAATGADIVILAVKPWLIRGVLREMKLRSKQILVSVAAGISFEQLAHDVVEPEMPMFRIVPNTAISELQSMTLIASRNAGQELEALMVNLFSEMGMAMILPEDKLEAATALTSCGIAYVLKYIQAAMQAGIEMGIRPSDAMDMIAQSVKGAAELILNNDTHPSVEIDKVTTPGGITIKGINELEHNGFTSAIIKAMKASR

SEQ ID NO: 33702 - protein, 448 aa, Oryza sativa Japonica Group
MAAAVRPTVKGSCSSGGHAGAGRGAGWAPRRRDRRRGGPRRGRSTRASSRRGRRRPRSGYQSRVSRAEQVGPEIRTGFLKDGKPIQLKQGKEITITIDYSIKGDENLISMSYHKLAIDLKPGSTILCADGTITLTVLSCDCEQGLVRCRCENSAMLGERKNVNLPGVIVDLPTLTEKDKVDILQWGVPNKIDMIALSFVRKGSDLMLVRSVLGEHAKSILLMSKVENQEGVANVDEIIANSDAFMVARGDLGMEIPIEKIFYAQKVMIHKCNIHGKPVVTATQMLESMIKSPCPTRAEATDVANAVLDGTDCVMFSGETAAGAYPELAVQTMANICSRAELYLDYPFIFKKLSSEAPVPLSPLESLASSAVQTANISKASLILVLTRGGTTARLIAKYRPAMPVLFVVVPELKADDSFNWTCSDEAPARQSHCQGFDPNAEHRYTKGI

SEQ ID NO: 33703 - protein, 363 aa, Nicotiana tabacum
MCSLPNESFSIELQQLDADDGRNQRTQWLLNSPAPPSFCNEIINSVTETVLPQKNNNFSSNSKQYGGGAVSSFLQGLFPILSWGRNYKVKMFKHDLLAGLTLASLCIPQSIGYANLANLEPQYGLYTSVVPPLIYAVMGSSRELAIGPVAVVSLLLSAMITEIVDPAVDPIAYTSLVFTVTFFAGTFQAAFGLLRLGFLVDFLSHAAIVGFMGGAAIVIGLQQLKGFIGISHFTTKTDVVSVLKAVFTSFHNETLSPLNFVLGCSFLIFILATRFIGKRNKKLFWLPAIAPLLSVLLSTLMVYLTKADRHGVKIVKHFKGGLNPSSVHQLQFNGPHLGEVAKIGLICALVALTVSIILFVISF

SEQ ID NO: 33704 - protein, 374 aa, Bacteroides fragilis YCH46
MNLFDVYPLFDINIIKGKGCHVWDENGTEYLDLYGGHAVISIGHAHPHYVDMISKQVATLGFYSNSVINKLQQQVAERLGKISGYEDYSLFLINSGAEANENALKLASFHNGRTKVISFGKAFHGRTSLAVEATDNPKIIAPINANGHITYLPLNDIEAAKAELAKEDICAVIIEGIQGVGGIKIPTPEFLQELRKACTEHGTILILDEIQSGYGRSGKFFAHQYAGIKPDIITVAKGIGNGFPMAGVLISPMFTPVYGMLGTTFGGNHLACSAALAVMDVIEQENLVENAANIGSYLLEELKKFKEIKEARGCGLMIGMEFDQPVKEIRSRLIHEQKVFTGASGTNVIRLLPPLCLSKEEADEFLARLRKVLG

SEQ ID NO: 33705 - protein, 64 aa, Neisseria meningitidis
MAYSDKVIDHYENPRNVGTFDKNDESVGTGMVGAPACGDVMRLQIKVNDEGIIEDAKFKTYGCV

SEQ ID NO: 33706 - protein, 128 aa, Glycine max
MTVEAVNPKAYPLADSQLAITILDLVQQATNYKQLKKGANEATKTLNRGISEFVVMAADAEPLEILLHLPLLAEDKNVPYVFVPSKQALGRACGVTRPVIACSVTSNEASQLKSQIQQLKDAIEKHLI

SEQ ID NO: 33707 - protein, 731 aa, Populus trichocarpa
MERIAESKALPAKLPVASQVSSRAYVVSGREVSQAPKLQTGLVRDVAGRFNAHQSQITDFPVPVRPWKGKDSAAIEDDLMLNVVVTSKGSGDSFDEGEPSSFSGASHPPEPIDTDLIMKTVYVPISQKKAEPGCLVKSMSVKGPFLEDLSIRVSPKKPSPVILSPAESLIEEPNDLLVLPSPFTVPRRSQNTENSLLPPDSEEKECVWDASLPPSGNVSPHSSIDSTGVVTAMSIVNSCASTYRSDVITSDGMLTIDRNCESTKGSVSVRGDSLESAKTSVSRASDSSGLSDDSNWSNITGSANKPHKGNDPRWNAILAIRARDGILGMSHFRLFKRLGCGDIGSVYLSELSGTRCFFAMKVMDKASLASRKKLTRAQTEREILQLLDHPFLPTLYTHFETDRFSCLVMEYCPGGDLHTLRQRQPGKHFSEHAARFYAAEVLLALEYLHMLGVVYRDLKPENVLVRDDGHIMLSDFDLSLRCAVSPTLIRTSFDSDPSKRAAGGAFCVQPACIEPSSVCIQPACFLPRIFAQKNKKKTRKSRHDLGLPACALPELVAEPTAARSMSFVGTHEYLAPEIIKGEGHGSAVDWWTFGIFLHELLYGKTPFKGSGNRATLFNVVGQQLRFPDSPATAYASQDLIRGLLVKEPQHRLGVKRGATEIKQHPFFESVNWALIRCSTPPEVPRPVETEPSPGKFGAVDKIGVGIVGSSSKRMAGTDMKSGGKYLDFEFF

SEQ ID NO: 33708 - protein, 606 aa, Vibrio vulnificus CMCP6
MSSATLQQINVYPVKSVGGIALTSAWVEKQGLAFDRRFMVATALGDMVTARKYPQMVTIRSALVADGIVFTYPDKPALMLKYQDFKRQETPAQVWKDNFTAYTTTDEADDWFSDILGIRVELLFSGEQSNRVREKIGHNVSFADGYPLLVISDASLKELNRRSPETHSMDQFRTNLVVSNCDAFAEDGWKKIRIGEVIFEAVKPCERCILTTVDVEKGQFRANKEPLNTLLTFRANEQGGVFFGQNLVALNEGMIQVGDRVEVLEVKEKEVYPDSACHDIRLTCVEKETIARDFVTFWLEPEHGQLPAYLPGQHLPVEITVDGDTISRRYTLSSSPSRPGRYAISVKRIDGGRVSNWLIDHLEVGDELFAQSPQGQFHIQEDKHQPLLLLSAGSGVTPMLSMLRYLADHDLVEDVVFYHQCRSVEDIPCKEELDALKSRYPGLTVKISLTQAPIDWFGLKGRLSLSHLKQIKAVESRQVFVCGPEGFMQKAKNLLLKKGLPESHYHQEAFGVSTSPNSERKTVELEFNGETFTADNQQTLLEHVENHGLTIAHSCRAGFCGACKVNVISGQVHQPDVPALTEQEKREGKALACCCVPLTDVRFQSL

SEQ ID NO: 33709 - protein, 302 aa, Acinetobacter sp. ADP1
MTSISHVNANVLQAAQERIQQDLTTALDAFDLPEPLKSAVYHTVMLGGKRVRPALCYAVASMEKNPNYAAARRAAVAVELIHCYSLAHDDLPCMDNDLLRRGQPTCHVAFGEDTALLAGDILQSMAFEVLGSRLFDQQNSVDASIVLRQMQILATASSKMVCGQVLDLQAEGKEIDQEQLENIHRNKTGALIQAALMMGAVTLFSGMDQAIPHLRQFGQRIGLAFQVQDDILDIISSTETLGKTAGKDQQVQKSTYPALMGLDAAQNYAKNLHDQALASLDYFGDAAIELQQIVQFLLSRKS

SEQ ID NO: 33710 - protein, 452 aa, Acinetobacter sp. ADP1
MNNDSSKLQRGLKNRHIQLIAMGGAIGTGLFLGSAQVIQSAGPSIILGYAIGGLIAFLIMRQLGEMIVHEPVAGSFSHFAYKYWGKFPGFLAGWNYWVLYILVAMTELTAVGKYINYWWPQIPAWQSVLFFFVVITLVNLTNVKFYGESEFWLAIIKVVAVISMIIFGLYLLFTADSSSTASFSNLWAHGGFFPNGFEGLFYMLAFLMFAFGGIELIGMAAAEAENPAKTIPKAINQVVFRILVFYVGSLTILLSLVPWNQLDLGGLDKSPFVMIFSQLGIGWAAHLLNFIILTAALSVYNSGMFANSRMLFGLAQQGNAPKIFTKVNKQGVPIPAVLFSALLIFGCVLLNYFVPEDALGHLMYVVVGALVLNWAMISLTHLKFKAAVKKLKLNVTFPALWAPVSNYLVLIFIALVLFIMWQQGFKESVIMIPVWIVLMFGLFHLLTNKDHT

SEQ ID NO: 33711 - protein, 204 aa, Acidovorax sp. JS42
MKLIGSNTSPYVRKVRVVLAEKKLDYQFVEENVWADDTAISASNPLGKVPCLIMEGGEAVFDSRVIVEYLDTLSPVGKLIPALGRERAEVKTWEALADGLLDAAILARLEATWAGRQDGERSQAWIDRQLAKARASLQSMSKGLGDKPYCSGIHLTLSDIAVGSALGWLEFRFPDIAWRTDHPNLARLMDKLMQRQSFIDTQPR

SEQ ID NO: 33712 - protein, 294 aa, Burkholderia sp. 383
MLKVTKAVFPVAGLGTRFLPATKASPKEMLPVVDKPLIQYAVEEAIDAGITEMIFVTGRSKRAIEDHFDKSYEIEAELEARGKEKLLSLVRSIKPSHVDCFYVRQAEALGLGHAVLCAEKLVGDQPFAVILADDLLDGPTPVLRQMIDVFDHYHASVIGVEEIAPEASKSYGVIDGKRWEDNLFKLSGIVEKPEPAKAPSNFGVVGRYVLKPKVFEHLRALRPGAGGELQLTDAIQSLLTDEQVLAHRYDGTRFDCGSKLGYLKATVEFALRHPEVAADFESYLAMRMSALQAA

SEQ ID NO: 33713 - protein, 384 aa, Burkholderia xenovorans LB400
MQSAMQARSKLPDVGTTIFTVIGQLAAQYDALNLSQGAPNFAPDASLIDGVAQAMRAGHNQYAPMAGIAALREALADKVATLYGVHYDPASEVTVIASASEGLYSTISALVHPGDEVIYFEPSFDSYGPIVRLQGATPVAIKLSLNDFRVDWDEVAAAITPKTRMIIINTPHNPTATVFSEADVARLKAITRNTDIVILADEVYEHVVFDGAKHQSMACHAELAERSVIVSSFGKSYHVTGWRVGYCLAPAALMDEIRKVHQFMVFSADTPMQYAFVDALARRESYLGLSAFYQKKRDLLTDALRDSRFELLPSEGSFFMLARFRGFSEESDSDFVLRLIRDARVATIPLSAFYTDGTDSGLIRLSFSKDDATLIEGARRLCQI

SEQ ID NO: 33714 - protein, 465 aa, Neisseria gonorrhoeae FA 1090
MSQGKIVQIIGAVVDVEFPRDMIPRVYDALKLDENGLTLEVQQLLGDGVVRTIAMGSSDGLKRGMTVSNTGSPITVPVGKGTLGRIVDVLGTPVDEAGPIDTDKSRAIHQAAPKFDELSSTTELLETGIKVIDLLCPFAKGGKVGLFGGAGVGKTVNMMELINNIAKAHSGLSVFSGVGERTREGNDFYHEMKDSNVLDKVAMVYGQMNEPPGNRLRVALTGLTMAEYFRDEKDENGKGRDVLFFVDNIYRYTLAGTEVSALLGRMPSAVGYQPTLAEEMGRLQERITSTQTGSITSIQAVYVPADDLTDPSPATTFAHLDATVVLSRDIASLGIYPAVDPLDSTSRQLDPMVLGQEHYDVARGVQSTLQKYKELRDIIAILGMDELSDEDKLAVMRARKIQRFLSQPFHVAEVFTGSPGKYVALRDTIAGFKAILNGEYDHLPEQAFYMVGSIEEAVEKAKTLN

SEQ ID NO: 33715 - protein, 278 aa, Bacillus cereus ATCC 10987
MKYLKKKSGKILLATGLAFSMAACGVTDNKEKTNAESSKQQNNNNDSSNNNNSNANNSNGNNNNNSNANNSNGNNNNNSNANNSNGSNNNNSNANNSNGNNNNSNANNSNGNNNNNSNANNSNGNNNSNTNNEWGTNNSNNSNNNSNNNEQKPNQNQEQSATSVTLEQHGIIVTVHKVEQADNIVRVKYTINNTTNQTIFSGAPGAKIEQKGKSTIPSDFKGNWDQRGYIAPHTSVDGTNLYSLSDITNEFDFKIRPDFEDMKNNPPIEYFILRVKMH

SEQ ID NO: 33716 - protein, 254 aa, Chlamydomonas reinhardtii
MTRVPMPKRSAGQDRPAATVAPSILSADFARLAEECKRMVDLGADWLHVDVMDGHFVPNLTIGAPVVASLRKHTDAFLDCHLMVSNPEQWVKDFAKAGADMFTFHLEAAAGPGPDDWHALSPDTANQTVVDMCRGIKAAHMHVGIAIKPSTPPELVAPYVAEGLVDMVLVMTVEPGFGGQSFMPQAVAKAAFLRNKFPDLNIQVDGGLAPNTIDRAAEAGANVIVAGSAVFGAADPAAVMKTLKSSVSAAASSG

SEQ ID NO: 33717 - protein, 231 aa, Archaeoglobus fulgidus DSM 4304
MEVFVLGCAGSGKSTFVRSFSEFLQERGYSVKCVNLDPASDPAYRADKNVREFVKTENVMVEYGLGVNGALIKSVEIASEHAEELKAEGDFVLYDTPGQLELFIYSEAGRKFVRELSGSFSCSLFLVDLTTVTDPESLLSAIMQDVIVSLRLSLPTLTAFTKSDVADVDVRSLLGEIKHREGVLAELMEKLVDFIELTTIPYRPIKISNIKKTGYEELFSALYELFCAAET

SEQ ID NO: 33718 - protein, 196 aa, Triticum aestivum
  misc_feature (135)..(136): Xaa can be any naturally occurring amino acid
MTLRDRTLEFSDIAESIKKQKSITASPKPRILERNEFSRIAAQIKQDIGSTADKLDQLTKLAKKRTLYDDPTLEIADLTSIINQDIKNINNQIAMLQQHQQATGYGRKNKQVENHADTIVKSLQGKLQKTTKGFXXVLELRTETLKKPQQEREYFTGCLQSEPTTAEQPNHLYIRLPTLPNTTTAHEVVIAPTQML

SEQ ID NO: 33719 - protein, 391 aa, Zea mays
  misc_feature (24)..(24): Xaa can be any naturally occurring amino acid
MASPTQGDAPLAAPAPAADATDAXFAAAAAVPDPGAEFGFQRPELGKEKLVGTVGFHERHVFLCYKGPDLWPSHLEASESDRLPRLLAAAIKARKPNLKKTIKLTICEGEDGTESSNGDVLIFPDMIRYKGLTHFDVDNFVEEVLVKDIDWLPRSPEPMSGSYIFVCSHGSRDKRCGVCGPALIKRFKEEINELGLDDQVAVSACSHVGGHKYAGNVIIFSSDAKGEVTGHWYGYVVPDDVPVLLHKHIGQGEVVDHLWRGQMGLSVEQQKRALELRNMVNGGEESLEETRTDGASFNPAAAGGCCQGNGGFTCCQTDLPKEKQDKSIIAEQNPKSSDKEGGAGSKKGDTKTCPVPIWFETWERADTYAALAVVAAAAAVLVSFRIYKNLN

SEQ ID NO: 33720 - protein, 566 aa, Zea mays
MQSLLAGIPAGGAAAAAAVGGLVAAAALAERADQKNRLNLPPAVPGLPIIGNLHQLKEKKPHQTFARWSEEYGPIYSIRTGASSVVVVNSAEVAKEFALLVISLPAVHFLCFLKVEMYQGLKRPPFCFEKMPYYCRIPLNAMVAKYSSINTRKLPKALSVLTRDKKIVAMSDQGELYKMVKRYIMVSMLGAAAQKQFRDTRNTMIDNMLSTFHALVADDPKAPLNFRDVFQNELFGLSMTQANDFLHILRFETGLQIQALSEDVSSVYVEEFGKALSREEIYQTAVADMMMCAIEVDWRDFFPYLGWIPNRSFETRVLTTEARRTALMQALINQQKERIARGESRMSYVDFLLAENTLTDEQLLMLVWEAVIEAADTTLVTTEWAMYEIAKHPEKQEYLYQEIRKVCGNKTVTEDHLPELPYLNAVFHETLRRHSPVPLVPPRLVHESTNLAGYEVPAGTQMIINLYGCNMNKSDWDAPEEWRPERFLDGSFEVADMYKTMAFGGGRRACAGSIQAVNIACTAIARFVQEFAWTLKEGDEDKDDTIQLTTNRLYPLHVYLTPRGRK

SEQ ID NO: 33721 - protein, 367 aa, Kluyveromyces lactis NRRL Y-1140
MSDLLLIPGPIMVSSAVEEAASIQSLAHTSPEFVKIFQGALQKLRTVFQTSNAGDQPIVISGSGTLGWDIVGNNLLKSGDSALTISTGFFSDSFAECLKTYGADVDVLKSEPGKVVALDKIESQLKSKKYQLITLTHVDTSTATLLDLPSITSLVKKVSPETFIIVDGVCSIGCEEFKFSEWSVDFVLTASQKALSCPSGLSVSLISERALSYALSNESTHGFYANLKKWIPIMKAYEAGVGQYFATPSIQLVNALNVSLGEILSYGLEARIAKNKKTSDQFKNNLKQLGLTLVSEDSNSAHGLTAVYVDQPGKVISSLKSKGIVIAGGILPGIKDKYIRIGHMGISAIDDNLHHIDKVFEAIKESI

SEQ ID NO: 33722 - protein, 447 aa, Blastopirellula marina DSM 3645
MQLSEAIQEALATEKYHTPTPIQGQAIPHLLEGSDLIGCAQTGTGKTAAFALPILNQLDLDRSRADACAPQVLVLSPTRELAVQIAQSFNVYGRNVKFRLTTIFGGVGQNPQVRALKRGVHVAIATPGRLLDLMDQGYVDLSQAKTFVLDEADRMLDMGFMPALKTIVSKLPKQRQTIFFTATMPPKVAQLASGLLNNPVRIEVAPESTTAERVEQRLMYVSQGDKRALLEHSLQAEGVGRTLVFTKTKHGADRLAKELNASGIRTDAIHGNKTQNKRNRALESFRSGRLQVLVATDVAARGIDVDGVTHVVNFDLPIDPESYVHRIGRTGRAGKEGIALSFCDFSEHGTLRAIERLIRTTITVDADHPFHVEPRSRGPRSGGGGPRRSYGKSSGRPAGNGGGRSGGYSQGGGDSSERPKTYGGGRSGGAKRTGGKRPFGAKSKRPE

SEQ ID NO: 33723 - protein, 174 aa, Glycine max
MADKEEESAMPRDAKIVKSLLKSMGVEDYEPRVIHKFLELWYRYVVDVLTDAQVYSEHAGKSAIDCDDVKLAIQSKVNFSFSQPPPREVLLELAQNRNKIPLPKTIAGPGIPLPPDQDTLISPNYQFAIPNKRPAEPLEETEDEEATIPNPSQEDVQPNPHQRVSFPLPKRQKD

SEQ ID NO: 33724 - protein, 525 aa, Blastopirellula marina DSM 3645
MLGPGQTPHDQLSPAAASDGQTLGLTDYLLKILNARVYDVAIESPLEQAARLSKRIGNAVWFKREDNQPSFSFKLRGAYNKMAHLTPEQLSRGVICASAGNHAQGVALSAHRLGCRAMIVMPVTTPQLKIEAVRSFHGEVTLHGESYSDAYAFAIEIALEQGLTFVHPFDDPDVIAGQGTIAMEILQQLQQPIHAIFCAIGGGGLISGVAAYVKAVRPEIKVIGVQIADSNAMVQSVAAGRRVQLSEVGLFSDGTAVKLVGEETFRMTQALVDAFVVVDNDAVCAAIKDVFEDTRSILEPAGALSVAGLKQYAAENKLTNSNLIAVTCGANMNFDRLRFVAERAEVGEQREALIAVSIPEQPGSFKRLCELLGTRGITEFNYRMSDKTQAHVFVGLTTSNRQDTADMIEKLNRHAFAAVDLTNDELSKMHVRYMVGGRSPHVQNERLYRFDFPERPGALMKFLSHMPPSWNISLFHYRSQGGDVGRILAGLQVPDSEMAGFEEFLSGLAYPCVDETNNPAYRLFL

SEQ ID NO: 33725 - protein, 394 aa, Pseudomonas putida
MSRVTWMFERNSALGQPVGHYLDSAASAQMLCASHDAMTLLEQGMRANVRRGSHRLAERADELYEQARGTVARFLGTSADQVVFTAGATAALNLLAHALSVRLGEGDEIVVTELEHHSNFIPWQQAARRSGASLNVWPVTAEGVLDMSVLDHMITAKTRVVSVTQVSNVTGLASDLMSIVRRVRAVGALLVVDAAQAVPHGLTAEQADFLVFSGHKVFGPTGIGVLAARHGGLEMLQPVSFGGGMAAGVGLRESTWVDMPWCLEPGTPPFSQALGLAAALDWLAREHGALEEVRRLTRVALDGLLARPRVRVIGPHDRERMGIVSFTVEGVHPHDVAQVLDDQGVWVRAGQMCAQPLLKALGLGAVVRASFAPYNTSADVEALLAGVDRSIALS

SEQ ID NO: 33726 - protein, 461 aa, Idiomarina loihiensis L2TR
MSQGKVVQIIGAVVDLEFPQDAVPKVYDALKVTEGGLEGLVLEVQQQLGGGIVRAIAMGTTDGLRRGITAKNTGESIMVPVGKKTLGRIMDVLGNPIDEAGPIGEEEKMSIHRAAPSYEEQSNTNELLETGIKVIDLICPFAKGGKVGLFGGAGVGKTVNMMELIRNIAIEHSGYSVFAGVGERTREGNDFYHEMNDSNVLDKVSLVYGQMNEPPGNRLRVALTGLTIAEKFRDEGRDVLFFVDNIYRYTLAGTEVSALLGRMPSAVGYQPTLAEEMGVLQERITSTKTGSITSVQAVYVPADDLTDPSPATTFAHLDATVVLNRDIASLGIYPAVDPLDSTSRQLDPQVIGDEHYDTAMGVQEVLQRYKELKDIIAILGMDELSEEDKLSVSRARKIQRFLSQPFFVAEVFTGAPGKYVSLKDTIAGFKGILDGDYDDMPEQAFYMVGTIEEAVEKAKNL

SEQ ID NO: 33727 - protein, 270 aa, Ralstonia eutropha JMP134
MAPFTGRVVLITGASDGIGAELAMLLAQQGARLALAARRLDMLHALASRIQAMHPHAEVAVWRTDVSDESACTRLVADVVAYYGGLDVLVNNAGVSAHGYFEQVSDYGYYETVMRVNYFGAMWCTRAALPHLRARRGLMVAVSSLAGKVGVPGRTAYSASKFALAGFCEALRCELHGSGVDICVVFPGVVATDTRVNGFGPDGRALGESRLREDDAMTAQECARQMLAAMTARKRELVMTAKGRLGQWLKLLAPAMVDRMALKALKQAGR

SEQ ID NO: 33728 - protein, 380 aa, Nicotiana tabacum
MIIYIMNASKLLMFSAIALILVSVILASDSDDENVFKPAPIPGSQDVLSKAELIQLKGAFGAESVAFDPNGEGPYTGVADGRILKWQPHSQTWVDFAVTSSQRKNCSRPSAPEMEHVCGRPLGLRFDHKTGDLYIADAYFGLHVVGPTGGLATPLVQDFEGQPLLFTNDLDIDDDDDIIYFTDTSTIYQRRQFVAATASGDKTGRLMKYNKSTKEVTVALGGLAFANGVALSKDRSFLLVAETSACRILRYWLKGPNVGNHDIFAELPGFPDNVRINSRGEFWVALHAKASPLARLIISNSWLGKTLLREFNFQQLHNLLVGGQPHATAIKLSEDGRVLEVLEDVEGKILRFISEVHEEESGKLWISSVIMSSLGVYDLS

SEQ ID NO: 33729 - protein, 362 aa, Ipomoea batatas
MVTTITVPSRVERLAGSGIERIPKEYIRPEEERPSIGDIFAEEKMGGGPQVPTVDLKGINSEDLEVREKCREELRKAAVDWGVMHLVNHGIPKELTGRVKAAGEGFFGQSIEEKEKYANDQAAGNVQGYGSKLANNASGQLEWEDYFFHCVFSEDKTDLSIWPKTPSDYIAATREYAKQLRALTTTVLAVLSLGLGLEEGRLEKEVGGMEELLLQMKINYYPKCPQPELALGVEAHTDVSALTFILHNMVPGLQLFYEGKWVTAKCVPNSIIMHVGDTVEILSNGKYKSILHRGVVNREKVRVSWAVFCEPPKEKIILQPLPETVSEADPPRFPPRTFAQHIKHKLFRLTDQEGADTPKPDE

SEQ ID NO: 33730 - protein, 264 aa, Novosphingobium aromaticivorans DSM 12444
MSQSPFRDDVLAGKTAFIAGGTSGINLGIAKRFAELGARVAVLGRNPEKAASAADEIGHDAIWRAADVRDYGAICEAMKSVRDEIGALDIVVSGAAGNFLAPVLGMSANAFKTVVDIDLLGTFNVFRGCHELLNPGASLIAITAGQAEQAMAMQAHACAAKAGINQLVRTLAIEWGPDVRVNGISPGPIADTEGMARLAPDESTRQQHYARIPMKRWGTCYEIAEAAVYLSTPAASYVTGAILDVDGGSSVGDASRTSPNKGLA

SEQ ID NO: 33731 - protein, 494 aa, Myxococcus xanthus DK 1622
MSFIQLPRSVVSCRNLVGGSWQVPPGAAHLDVRSPYTGTVIGRVPLTPASGVAQAVEAAKAAAAAWKNTSLRERTQYLYRFRQFLERDLDALAQLAASEAGKTVAEARAGLLKGMEVCDFALSLQNLDTGAHLEVSRGISCEYRREPLGVVAGITPFNFPAMVPMWMFPIAVTLGNAFILKPSEKVPLTACALGELMCEAGYPAGVFSVVHGGKEAVDALVAHPDVQAVGFVGSSAVARHLYAEGCKRGKRVLALGSAKNHLIVVPDADPELTPQAVVDSFTGCAGQRCMAASVLLAVGNVESLLQEVVRRAAKLELGPGMGALIDRGSLDRLETAIARAEAEGARVLLDGRGHKPQGEPWSGGNWLGPTLLDGVRPEMEAARRELFGPVLSIVRVPTLSAALAVENASPYGNAASIFTTNGGVAQTVVEGVRAGMVGVNVGVPVPREPFSFGGTGDSRFGHGDITGPSSLDFWTQVKKVTRKWSARTDGSWMS

SEQ ID NO: 33732 - protein, 592 aa, Triticum aestivum
MGGEAPEPRRLSRALSLDGSGVPEEALHLVLGYVDDPRDREAASLACRRWHHIDALTRKHVTVPFCYAVSPARLLARFPRLESLGVKGKPRAAMYGLIPDDWGAYARPWVAELAAPLECLKALHLRRMVVTDDDLAALVRARGHMLQELKLDKCSGFSTDALRLVARSCRSLRTLFLEECTITDNGTVWLHDLAANNPVLVTLNFYLTYLRVEPADLELLARNCKSLISLKISDCDLSDLIGFFQIATSLQEFAGAEISEQMYGNVKLPSKLCSFGLTFMGTNEMHIIFPFSAVLKKLDLQYSFLTTEDHCQLIAKCPNLLVLAVRNVIGDRGLGVVGDTCKKLQRLRVERGEDDPGMQEEEGGISQVGLTAIAVGCRELENIAAYVSDITNGALESIGTFCKNLHDFRLVLLDRQETITDLPLDNGARALLRGCTKLRRFALYLRPGGLSDVGLGYIGQHSGTIQYMLLGNVGQTDGGLISFAAGCRNLRKLELRSCCFSERALALAIRQMPSLRYVWVQGYRASQTGRDLMLMARPFWNIEFTPPSTETAGRLMEDGEPCVDRQAQVLAYYSLSGKRSDYPQSVVPLYPA

SEQ ID NO: 33733 - protein, 216 aa, Capsicum annuum
PEVLSRKEYDGKIADVWSCGVTLYVMLVGAYPFEDPDDPRNFKKTITRILSVQYSIPYYVRVSKECNHLLSRIFVADPEKRITIEEIKKHPWFLKHLPKEFMEGEEASLVQVNGGEKPLQSIEEALAIIQEARKPEEGSKASDYFVNSSISMDLDDFDTDADLDDEIDTSGDFVCALSATFEWGWSLGATIKLSSCRVTYSHEFEPWKQLLMPALG

SEQ ID NO: 33734 - protein, 255 aa, Arabidopsis thaliana
MTRSVSFPLFLFAVVLSLSSSLLADDPKPIRREVYEGGKIYDISHRYTPEIPAWESSEGLGKTFLRLAASMKNGSFANVSEMKLSVHSGTHVDAPGHFWDNYYDAGFDTDSLDLQVLNGPALLVDVPRDKNITAEVMESLHIQRGVRRVLFRTSNTDKRLMFKKEFDSSFAGFMTDGAKWLVENTDIKLIGLDYLSFAAFEESPATHRVILKGRDIIPVEALKLDGVEVGTYSLHCLPLRLVGAEGAPTRCILIK

SEQ ID NO: 33735 - protein, 266 aa, Populus trichocarpa
MAQADCNSSRDNRWLLHGMTALVTGGSKGLGHAIVEELAGLGATIHTCARTESVLNECLQEWKMKGFKVTGSVCDVSSRTEREKLMSTVSSQFDGKLNILVNNVGILYFQRTIDVTPEDISLYLSTNFESAYHLCQLAHPLLKNSGAGNIVFMSSVSGVVSVSVSLYGATKGAINQLTKNLACEWAKDNIRANSVAPWLIRTPLVERDLENELFLKAVEARTPMGRLGEPKEVSSLVAFLCMPAASYITGQVICVDGGFTVNGLTV

SEQ ID NO: 33736 - protein, 496 aa, Populus trichocarpa
MAGTGVFSEILDGDAYKYYSDGEWKKSSSGKTVAIVNPTTRKTQYKVQACNQEEVNKVMELAKSAQKTWAKTPLWKRAELLHKAAAILKEHKAPIAECLIKEIAKPAKDSVTEVVRSGDLISYTAEEGVRILGEGKFLVSDSFPGNERTKYCLTSKIPLGVVLAIPPFNYPVNLAVSKIGPALIAGNSLVLKPPTQGAVSCLHMVHCFHLAGFPKGLISCVTGKGSEIGDFLTMHPGVNCISFTGGDTGISISKKAGMIPLQMELGGKDACIVLEDADLDLVAANIIKGGFSYSGQRCTAIKVVLVMESVADALVEKVKARVAKLRVGPPEDDCDITPVVTESSANFIEGLVTDAKEKGATFCQQYKREGNLIWPLLLDNVRPDMRIAWEEPFGPILPVIRINSVEEGIHHCNASNFGLQGCVFTKDINKAVLISDAMETGTVQINSAPARGPDHFPFQGLKDSGIGSQGITNSIDMMTKVKTTVINLPSPSYSMG

SEQ ID NO: 33737 - protein, 248 aa, Neisseria gonorrhoeae FA 1090
MSTQDLSGKIALVTGASRGIGAAIADTLAAAGAKIIGTATGESGAAAISKRLAQWGGEGRVLNSAEPETVENLIADIEKTFGKLDILVNNAGITRDNLLMRMKEEEWDDIMQVNLKSVFRASKAVLRGMMKQRAGRIINITSVVGVMGNAGQTNYAAAKAGLIGFAKSMAREVGSRGITVNCVAPGFIDTDMTRALPEETRQTFTAQTALGRFGDAQDIADAVLFLASDQAKYITGQTLHVNGGMLMP

SEQ ID NO: 33738 - protein, 521 aa, Neisseria gonorrhoeae FA 1090
MTQDKILILDFGSQVTRLIARRVREAHVYCELHSFDMPLDEIKAFNPKGIILSGGPNSVYESDYQADTGIFDLGIPVLGICYGMQFMAHHLGGEVQPGNQREFGYAQVKTIDSGLTRGIQDDAPNTLDVWMSHGDKVSKLPDGFAVIGDTPSCPIAMMENAEKQFYGIQFHPEVTHTKQGRALLNRFVLDICGAQPGWTMPNYIEEAVAKIREQVGSDEVILGLSGGVDSSVAAALIHRAIGDQLTCVFVDHGLLRLNEGKMVMDMFARNLGVKVIHVDAEGQFMAKLAGVTDPEKKRKIIGAEFIEVFDAEEKKLTNAKWLAQGTIYPDVIESAGAKTKKAHAIKSHHNVGGLPENMKLKLLEPLRDLFKDEVRELGVALGLPREMVYRHPFPGPGLGVRILGEVKKEYADLLRQADDIFIQELRNTTDENGTSWYDLTSQAFAVFLPVKSVGVMGDGRTYDYVVALRAVITSDFMTAHWAELPYSLLGRVSNRIINEVKGINRVVYDVSGKPPATIEWE

SEQ ID NO: 33739 - protein, 474 aa, Zea mays
MEPRIGNRFRVGRKLGSGSFGEIYLGTNVQTNEEVAIKLENVKTKHPQLLYESKLYRILQGGTGIPNVKWFGVEGDYNVLVMDLLGPSLEDLFSFCNRKLSLKTVLMLADQMINRVEFFHSKSFLHRDIKPDNFLMGLGKRANQVYVIDFGLAKKYRDTSTHQHIPYRENKNLTGTARYASVNTHLGIEQSRRDDMESLGYVLMYFLRGSLPWQGLKAGNKKQKYEKISERKIATSTEALCRGYPTEFASYFHYCRSLRFEDAPDYQYLKRLFRDLFIREGFQFDYVFDWTILKYQQAQMTTAPPRAIAPAVGQSSGMAPVANNNRHSGTEEGRRSGWSDMDPMRRQAPPPVINAGSLAKQKSPVRPETSTSKDAVFSSSTFLGRSSGSSRRPAVSSSRELSTEAEQTRSRTTDASPGAFQRSGAPRWSPQMPDSSDGRRSSSSRRHSSNPKNYESTIRGMQGLNFDGDDRVHY

SEQ ID NO: 33740 - protein, 424 aa, Bordetella parapertussis 12822
MSVAVLAFGLNHTSAPVSVRERVSMPVDLVKPALEGLRATFGGAVREAAILSTCNRTELYCAAEGQVAEHLPAWLAEHNRLEAAALRPHLYRHQHDDAVRHAFRVASGLDSMVLGEPQILGQMKDAVRAANEAGALGTLLHQLFQRTFSVAKEVRSQTAIGAHSVSMAAAAVRLAERVFGQLEDARTLFIGAGEMIELCATHFAAQRPRSMVVANRTIERAETLAGRFSAQTMKLADLTERLAEFDVIVSCTASSLPILGLGMVERATRQRRHRPMVMIDLAVPRDIEPEVGRLDDVYLYSVDDLGRLVQSGTDARRAAVVQAEAIIETRVQGFMHWMQSREVVPVIRDLHQAADDVRAAELERARRMLARGESPEAVLEQLAHGLTQKYLHGPLAALNRSEGDERRQLLAWVPRLFPGRDSRR

SEQ ID NO: 33741 - protein, 855 aa, Arabidopsis thaliana
MKTMNGFLLLSTIAFAVFHLVQAQSQSGFISLDCGLIPKDTTYTEQITNITYISDADYIDSGLTERISDSYKSQLQQQTWTLRSFPEGQRNCYNFNLKANLKYLIRGTFVYGNYDGLNQMPKFDLHIGPNKWTSVILEGVANATIFEIIHVLTQDRLQVCLVKTGQTTPFISSLELRPLNNDTYVTQGGSLMSFARIYFPKTAYFLRYSDDLYDRVWVPFSQNETVSLSTNLPVDTSSNSYNVPQNVANSAIIPAEATHPLNIWWDLQNINAPSYVYMHFAEIQNLKANDIREFNITYNGGQVWESSIRPHNLSITTISSPTALNSSDGFFNFTFTMTTTSTLPPLINALEVYTLVENLLLETYQDEVSAMMNIKKTYGLSKKISWQGDPCSPQIYRWEGLNCLYLDSDQPLITSLDLSDNDLSGEIPDFLADMKMLTLVNLKGNPKLNLTVPDSIKHRINNKSLKLIIDENQSSEKHGIKFPLVAILASVAGVIALLAIFTICVIFKREKQGSGEAPTRVNTEIRSSYQSIETKDRKFTYSEILKMTNNFERVLGKGGYGRVYYGKLDDTEVAVKMLFHSSAEQDYKHFKAEVELLLRVHHRHLVGLVGYCDDGDNFALIYEYMANGDLKENMSGNRSGHVLSWENRMQIAMEAAQGLEYLHNGSRPPMVHRDVKTTNILLNELYQAKLADFGLSRSSPVDGESYVSTIVAGTPGYLDPEYYRTNLLSEKTDVYSFGVVLLEIITNQPVIDTTREKAHITDWVGFKLMEGDIRNIIDPKLIKEFDTNGVWKAVELALSCVNPTSNHRPTMPHVVMELKECLDSEIARKQGSQDMFSRDSIELTFSPTGFSPGPR

SEQ ID NO: 33742 - protein, 404 aa, Archaeoglobus fulgidus DSM 4304
MYLVALKCRICGTEYPPEPLYHCSLCFGPLEAVYDYEGIKESVSKEEISKRVQSVWRYREFLPTNHDPVDLGAGFTRFIHAKNLGECLGLKNLYLLDDSTNPTYSFKDRVVSVAVTKALEFGMDVVGCASTGNLAGSLAAHAAKAGLKAFIFVPAGIEKNKIVQALVHGATVVEVNGTYDDANRLAAEIAEKNRNWGFVNINLRPYYVEGSKTLAFEAAERLGWEAPSQVVVPVASGALLYSIYRGFKELETVGLIDSAEVAFNAAQPEGFPVARAVKERRQVEPIERFSTIVHSLAIGNPADGIFAKEVVERSGGYAEDPSDAEVIEAVKLLARTEGIFTELAGGVTVAALIRLVEDGRIDRDEKVVAYLTGNGLKTAEAVAETLSTVKIDARVEEFEKVLGR

SEQ ID NO: 33743 - protein, 192 aa, Xanthomonas campestris pv. vesicatoria str. 85-10
MLLMLDNYDSFTYNLVQYLQALGAEVMVVRNDAMSVDQIAALKPERIVISPGPCTPNEAGISLQLIEQLGQTTPILGVCLGHQSIGQVYGGDVIRAGNIMHGKTSPIRHQGKGVFAGLPDSYEATRYHSLVVDKTTLPDALEVTAWTENPDGSMEEIMGLRHRQFPVEGVQFHPESILTQHGHALLKNFLQR

SEQ ID NO: 33744 - protein, 815 aa, Glycine max
  misc_feature (19)..(19): Xaa can be any naturally occurring amino acid
  misc_feature (30)..(30): Xaa can be any naturally occurring amino acid
IFQPGVFGRMMNVGSFPEXKRNCYKINITXGRTYLIRTNFLYGNYDGLNKAPQFDIHLGANRWYTVTISNASTPQANEIIYVPSLDYLQICLVDTDHGTPFISAIELRTLKNYTYVTQFGSLEYYNRWDLGSNNSYRYNHDVYDRFWYIYGDNKDWKQLSASIPADYLNQNDYKPPEIILSTAVTPVNASAPLVISWEPPDQTELYYVYMHFTEIQVLAKNQTRQFNITLNGNLLYGNMSPRYHSVRTIYTTSGISGKLINFSFVMTETSTLPPIINAIEIYRVKEFPQQDTYQGDVDAITTIKSSVYGMTRDWQGDPCSPVAYLWNGLNCTYRGNENPRITTLNLSSSELSGMIDPSISYLTMLEKLDLSNNNLNGEVPDFLSRLQHLKIINLDNNNLTGSIPSELVKKSKEGFLSLSVGQNLYLCESGQCNEKKKKKNIVTPLLASVSGVLILVVAVAAISWTLKKRKPKEKNQSEMSAQCTEQDDSLHQFKKQIYSHSDVLRITNNFNTIVGKGGFGTVYLGYIDGTPVAVKMLSTSSVHGYQQFQAEVKLLMRVHHANLTSLVGYCNEGDNKGLIYEYMANGNLHEHLSGKHIKSKFLTWEDRLRIAVDAALGLEYLQTGCKPPIIHRDVKSTNILLDEKLQAKLSDFGLSKIIPIDGGTHVSTVVAGTPGYLDPEYYISNRLTQKSDIYGFGVVLLEIITCQPVIAWNEERTHIIQWVRSLIGIGDIKGIVDSRLEGDFDINSAWKAVEIAMACVSLNPSERPIMRVIVTELKETLATELARTKHNSADSINSIEPVTMNLDTEFTPLAR

SEQ ID NO: 33745 - protein, 383 aa, Ralstonia eutropha JMP134
MILKSNDRSQFELPPTSGEAPSHSADAQQAAAHAVSTPVSAMSAVTSASSAVAATQSVAGMPAVPLDPQVAALLDLIARAKRPPIHVMDVEDAKIAYEKSAPILDISPLPMHAVDDLHVCARDGHGIPVRLYAPREASWADPLPMLVYFHGGGFTVGSVNSHDALCRMQAAHADCMVLSVDYRLGPQWRFPTAANDAFDVLHWVFEEAARLGADPARIALGGDSAGGTLATACAVHARDSGLAPVLQLLIYPGTCARQDTPSHGALAEGYLLTADMIQWFFSHYLDQESSRDDWRFAPLDGGGSGADVRGCCPAWIAVAGYDPLHDEGVAYADKLRAAGVTVTLADYAGMIHDFFKMGRFVPAVAQAHADAVAALRAAFGTGQ

SEQ ID NO: 33746 - protein, 355 aa, Bacillus cereus G9241
MVTKEQVVEALEGIVDPFLHKTLKETGAIKEVTVKPEKEHVSVKIAIVKTGTAEQMQLQSGIVKLVKELGAATVGLRFAEFTEEELAQFAPEQEEEQTESLLSPNSKTTFLAVASGKGGVGKSTVSVNLAISLARLGKKVGIIDADIYGFSVPDMMGIEKRPVVRGDRIIPVERLGVKVISMGFFVEDNAPVIWRGPMLGKMLNHFFTEVEWGDLDYLVLDLPPGTGDVALDLHSMLPACKEIIVTTPHPTAAFVAARAGAMALRTEHSILGVVENMAYFESKTTGEKEYVFGRGGGDKLATELQTEVLGRIPLQQPDWNKEDFAPSVYEDTHTTGLIYRTIAEKVIDKTAVAQK

SEQ ID NO: 33747 - protein, 327 aa, Haemophilus influenzae Rd KW20
MPQNLPHFYRGRFSVAPMLDWTTRHCRYFHRQFSKHALLYTEMVTAPAIIHAKYDHLDFDLQENPVALQLGGSDPEQLKYCAKLAEERGYHEINLNVGCPSDRVQNGMFGACLMAKADLVADCVEQMQSAVKIPVTVKTRIGIDELDSYEFLCDFIEKVQGKGCQEFIIHARKAWLSGLSPKENREIPPLDYIRVYQLKRDFPHLTIAINGGIKTIEEMKQHLQYVDGVMVGREAYQNPSLLGQIDQALFDPNAPIVTAHEAVESMLPYIEQQLSQGIHLNHIVRHILGAFQNCKGARQWRRYLSENAFKQGAGIEVVETALSFVES

SEQ ID NO: 33748 - protein, 388 aa, Erwinia carotovora subsp. atroseptica SCRI1043
MKIAISGTGYVGLSNGLLLAQQHQVVALDIVAEKVALLNQRKSPINDAEIERFLQNETLNFSATLDKHEAYADAQFVIIATPTDYDPQTNYFNTSSVEAVIRDVLTINPQAIMVIKSTVPVGFTEKISQQFDTDNIIFSPEFLREGKALHDNLYPSRIVVGERSERARFFANLLIDCALKKDIRVLFTDPTEAEAIKLFANTFLAMRVAYFNELDSYAESLGLNTRQIIEGVCLDPRIGDYYNNPSFGYGGYCLPKDTRQLLANYRTVPNNLIKAIVDANHTRKDFIADTIIRRHPKTVGVHRLIMKAGSDNFRFSSIQGIMKRIKAKGINVVIYEPGIDDDNFLDFPIVHQLDSFKQQCDIIITNRYADELKDVIGKVYTRDLFGED

SEQ ID NO: 33749 - protein, 488 aa, Zea mays
MAMLCRATRVLRKVCGLGPAAAARRLSAAEAFAACEGSLLRPLPGLDLPPCLPDNLSRSPTRITTLPNGLRVATEDVPGPSACIGFFVDSGSIYESGETTGVSHLLERMAFKDTKHRSHLNIVSELELAGGNVGASASREQMVYSYDTLKGYMPEALEILIDCMRNPLFLQEEVERQLVLAREEVNELQKNPEKFLHEQLNLVGYSGALANPLIAPEDALARINDKIIQKFYHENFTADRVVLAASGVDHEHLLGYADLLLKDWHKGTPMEKPKSTYVGGDSRHRADSDMTHVALAFEVPGGWLQERDATIMTVIQTLMGGGGSFSSGGPGKGMHSRLYRRVLNKYHLVDSFSAFNNVYDSSGLFGIYLTTPSDFVAKAVDIAVSELIAVATPGEVTEVELQRAKNSTISSVLMNLESRVVVAEDIGRQLLSYGCRKPIDYFLQCMEEITLDDVATFARKMLATQPTMASWGNVDKVPPYEFICKRLQ

SEQ ID NO: 33750 - protein, 437 aa, Chromobacterium violaceum ATCC 12472
MLRQALSQLSVPDTPVATVSGKLVGVNGLLLESVGCPLQTGQRCLVETAGGGWLQAQVVGFRREVSFLMPFKKPVGLATGARVLPAPDNGGLMIGDGWLGRIVNGLGEPLDGKGRLGGDAPLAAHPPQINPLKKKPVDTPLDVGVRAINGFLTMGRGQRVGLFAGSGVGKSVLLGMITRHTEAEVVVVGLIGERGREVREFVEHALGAEGLAKAVLVVAPADESPLMRLKATELCHTIAAHYRDRGRNVLLLVDSLTRYAMAQREVALALGEPPATRGYPPSVFGLLPSLAESAGNGEGGAGSMSAIYTVLAEGDDQQDPVVDTARAILDGHIVLSRELAERGHYPAIDISRSVSRCMSQLIDADHAAVARELRGAWSRYQEVRGLLPLGAYVPGADPATDRALRLQPRIEALLCQDAGEAAPYAECLSRLQELASA

SEQ ID NO: 33751 - protein, 253 aa, Triticum aestivum
  misc_feature (8)..(8): Xaa can be any naturally occurring amino acid
  misc_feature (13)..(13): Xaa can be any naturally occurring amino acid
ASAHSEFXRRASXIGLGIHQTSQKLARLAKLAKKTSVFDDPTLEIQELTAVVKKDIGALNNAVMDLQVLCNSQNESGNLSKDTTNHSTTVVDNLKNRLMSATKEFKEVLTMRTENLKVHENRRQMFSSSAAKDASNPFIRQRPLVPREASDAAPPAPWASDSATTPLFQRKKTNGDHGASSSSSSSPAFMQQQQLAVQHLVKQVADDEDILRADGVPHDLHILRGMIPTPCNACCVQVYSLIFTELHTPCTQF

SEQ ID NO: 33752 - protein, 407 aa, Zea mays
  misc_feature (206)..(206): Xaa can be any naturally occurring amino acid
  misc_feature (221)..(221): Xaa can be any naturally occurring amino acid
  misc_feature (251)..(251): Xaa can be any naturally occurring amino acid
  misc_feature (393)..(393): Xaa can be any naturally occurring amino acid
MASSMLSATTVPLQQGGGLSEFSGLRSSASLPMRRNATSDDFMSAVSFRTHAVGTSGGPRRAPTEAKLKVAINGFGRIGRNFLRCWHGRGDASPLDVIAINDTGGVKQASHLLKYDSTLGIFDADVKPVGDNAISVDGKVIKVVSDRNPSNLPWGELGIDLVIEGTGVFVDREGAGKHIQAGAKKVLITAPGKGDIPTYVVGVNAXDQYNPDEPIISNASXTTNCLAPFVKVLDQKFGIIKGTMTTTHSYXGDQRLLDASHRDLRRARAAALNIVPTSTGAAKAVSLVLPNLKGKLNGIALRVPTPNVSVVDLVVQVSKKTLAEEVNQAFRDAAANELPGILEVCDVPLVSVDFRCSDVSSTIDASLTMVMGDDMVKVISWYDNEWGYSQSRXRVVDLADICANQWK

SEQ ID NO: 33753 - protein, 360 aa, Oryza sativa Indica Group
MGKGGKGAEAAAAAAGAGEEENMAAWLVAKNTLKIMPFKLPPVGPYDVRVRMKAVGICGSDVHYLREMRIAHFVVKEPMVIGHECAGVIEEVGSGVTHLAVGDRVALEPGISCWRCRHCKGGRYNLCEDMKFFATPPIVHPGDLCFKLPENVSLEEGAMCEPLSVGVHACRRADVGPETGVLIMGAGPIGLVTLLAARAFGAPRVVIVDVDEHRLSVARSLGADAAVRVSARAEDVGEEVERIRAAMGGDIDVSLDCAGFSKTVATALQATRGGGKVCLVGMGHNEMTVPLTSAAIREVDVVGIFRYKDTWPLCIEFLRSGKIDVKPLITHRFGFSQEDVEEAFEVSARGRDAIKVMFNL

SEQ ID NO: 33754 - protein, 206 aa, Populus trichocarpa
MKIMEQEGEDFEERKDIKFLNEEEEETKVYESGVDAEEEDDDEDEDDEDDEDDEDDDDDDDDDEDDDDDDEVQVLHSSSGPAGQSVNDDNEEDADEEEDGEGGDDDDDDDDDDDDEDEDEEEDGEDEEDMGTEYLVRPVGRAEDEEDASDFEPVDNGDDEDIDEEDDEDDTEPAGKVEAPIKRKRSDKDDSDDGGGGEDDERPSKR

SEQ ID NO: 33755 - protein, 590 aa, Populus trichocarpa
MGKSSKKSATKVEAAPAVIPAKAGKQGKNKREAEEALEKIVSAKKQKKNDGVAQAVQKAKVETKTLKKKKHESSDSDDSSSEEEEVKVLPKKAVKPTKTPAKESSDSESDSGSELESDEEPPVKATPAKKEPIAVKNGSHGAAAKKGKDDNSSSESSEDESSDDEEIPAKASAPKNVPAQPATIKKVELSDDSESDSDDSESTDDDKGASTKAAFPKKVPAPAAQKKADSSDDDSDSDESSSEDETPAAKAAVASKKPSSVTETKESKQAKATAQKESSSEEESSSDGSESEEDSEDEKPAKTPKKNDTDVEMVDADIKSDVKTPKTPVTPVAHENTGSKTLFVGNLSFQVERADVENFFKGAGEVADVRFALDADERFRGFGHVEFTTAEAAQKALKLHGNTLLGRDVRLDLAREKGSNTPYSKDSSSFPKGGSGQSQTIFVRGFDKSAGEDEIRSSLQEHFGSCGEIKRVSIPTDYDTGAIKGMAYLEFNDADALSKAFELNGSQLGEYCLTVDEAKPRSDNRDSRDSGRGRGRGSGGRGRGGRFDSGRGGRFDSGRGGRGGRGRGTPFKPSVTTAASGKKKTFNDDY

SEQ ID NO: 33756 - protein, 468 aa, Anaplasma marginale str. St. Maries
MFLRAEDLLDYIAKNSVKFIDWRFTDLLGRWHHTTYSVSSLSAEVFSSGIAFDSSSVPGWQPIEKSDMLLVPDVSTAFVDPFSPQPSLAVICNVVNPHGHNDYQRDPRYTARKAYEYMLSSEIADKCFFGTELEFFVFDHVRFGTDPYNTYFKLASQEDGGLGSRGCFSNHGYRMKAKDGYMRLAPVDSLHDVRSEMLAMLSEVGVTPLLHHHEVAASQCEIGFRYAELVTSADNVQKCKYVLRNVASSYGKSVTFMPKPVRGDNGSGMHCHQSLWKDGNNIFSGSNRGLSELCLHYIGGVIKHGRALSAFANPSTNSYKRLLPNFEAPTWLVYSHENRSAAIRIPCIPDGGSTRIEVRFPDPLANPYLCFAAQLMAGLDGIKHKVHPHEVSGKCLYSMEESETRDLLSVPTSLEEALTSLDKDRDFLLQGEVFTNEQIESYIQLKRSEVDNLRSYPHPVEFSNYYAL

SEQ ID NO: 33757 - protein, 421 aa, Chlamydomonas reinhardtii
MSRDGSDAAGAAGPSRATVNKRGGKSDAAPREASRTPAAIFVAVLIGAAAIFAAYMIQNMEDTGNVRGPGKYAAAIPALRAVAAQLLHPEKGILAADESPTTFGARLAGHPNKPTLRQTWRRILLTTPGLATHISGVILHEETFAQTADLQAARAAGVLLGIKLDNGTAPMGPKQAGELHTRGLGGLAGRCTTFHTKHGASFAKWRAVFRAGAHTPSKAAIRRNSKDLASYAAAAQKCGLVPIIEPEVLADGDHDLSRAANASARVLRGVFRALKKRGDVDVGAVLLKVAMVTPGSSSVMAATPEQVAQVTLRVLLGTVPRALPGVVFLSGGQSEELATTHMAALGRLAAERRAAGKPLPWALSFSFGRALQASAMKQWLAGDVPAAQQALLRRAAANALAQQGLAPEATAAAAVEPADAQ

SEQ ID NO: 33758 - protein, 164 aa, Malassezia sympodialis
MSNVFFDITKNGAPLGTIKFKLFDDVVPKTAANFRALCTGEKGFGYAGSHFHRVIPDFMLQGGDFTAGNGTGGKSIYGAKFADENFQLKHNKPGLLSMANAGPNTNGSQFFITTVVTSWLDGKHVVFGEVIDGMNVVKAIEAEGSGSGKPRSRIEIAKCGVCAP

SEQ ID NO: 33759 - protein, 236 aa, Populus trichocarpa
MSPKIWRSASRAAQSLLSSASKSSRFYSEGRAVAAAVSFSGKLPFLASVHGRTGSSNVARQWISGALAFPAAVYMLQEQEAHAAQMEQTFIAIKPDGVQRGLISEIISRFERKGFKLVAIKVVVPSKEHAQKHYHDLKERPFFNGLCDFLSSGPVVAMVWEGEGVIKYGRKLIGATDPQKSEPGTIRGDLAVAIGGNVIHGSDGPETAKDEINLWFKPEELVSYTSNAEKWIYGVN

SEQ ID NO: 33760 - protein, 577 aa, Lachancea kluyveri
MFTRGVNGANRDIDALADNIGQLSFDASDPNKFIFEPTTPSKYKENGSTTGTPSPTKSTLYDDNAGDVSKLSMMDIDERTQDEIDVTKSPKKLPLNFYAKASSSKTKRLVNVCQMYFLDYYCDMFDYVISRRERTRQVMKYLEQQRGQGIQPQQISNEWQGYLNKETNTLRKRRLKPKNKDFEMITQVGQGGYGQVYLARKKDTKEICALKILNKKLLVKLNETNHVLTERDILTTTRSDWLVKLLYAFQDPQSLYLAMEFVPGGDYRTLLINTRFLQAPHARFYISEMFCAVDALHQLGYTHRDLKPENFLIDSKGHIKLTDFGLAAGTVSMERIESMKLRLEEVKNLEFPEFKERSMDDRRRMYKKLRESDVNYASSTVGSPDYMALEVLEAKSYDFTVDYWSLGCIMFESLVGYTPFSGSSTNETYENLRRWKQVLRRPRCENGRYAFSDRTWDLITRLIADPVNRVRSFEHVKRMKYFAEIHFDSLRSMSPPFIPQLDSETDAGYFDDFSNEADMAKYADVFKRQDRLTAMMDDSSADSKLVGFTYRHRKGKNGSSGVLYGGAEHADPFATFY

SEQ ID NO: 33761 - protein, 405 aa, Zea mays
  misc_feature (11)..(11): Xaa can be any naturally occurring amino acid
MSVKEIEPALXEQLIISTVLMIFGIALISWLALPAKFTIYNFGTQKEVSNWGLFFCVSIGLWAGLIIGFVTEYYTSNAYSPVQDVADSCRTGAATNVIFGLALGYKSVIIPIFAIAVSIYVSFSIAAMYGIAVAALAIDAYGPISDNAGGIAEMAGMSHRIRERTDALDAAGNTTAAIGKGFAIGSAALVSLALFGAFVSRAGVKVVDVLSPKVFIGLIVGAMLPYWFSAMTMKSVGSAALKMVEEVRRQFNTIPGLMEGTAKPDYATCVKISTDASIKEMIPPGALVMLTPLIVGTLFGVETLSGVLAGALVSGVQIAISASNTGGAWDNAKKYIEAGASEHARTLGPKGSDCHKAAVIGDTIGDPLKDTSGPSLNILIKLMAVESLVFAPFFATQGGLLFKYL

SEQ ID NO: 33762 - protein, 568 aa, Rhizobium leguminosarum bv. viciae 3841
MTGEKANFSLNNPSDRRMNGGEIVLQALRDNGVEHIFGYPGAAVLPIYDEIFQQEDIKHFLVRHEQGAGHAAEGYARSTGRVGVMLVTSGPGVTNAVTALQDAFMDSVPLVCLAGQVPTSLIGTDAFQECDTVGITRPCTKHNFLVKHVDDLAKTIHLAFRVAAAGRPGPALVDMPKDVLFASGTYVSPEKVAPLPSYQPAMQGDQNAIRAAVALMAEARRPIIYTGGGIINAGPEASRLLREFVDLTGFPVTSTIMGLGAYPATGPNWLRVAGQDGSHEANMAIGECDLMVAIGARFDDLAISRVHEFSPHSKKIQIDIDASSINKRVPVDIGIQGDAAHVLADMIHAWRSLSTVLDQKRLRAWWTQIDHWRTHHSFSYRRLDHAIMPQHALERLHALTKPHDPIIATEIGQQMWVAQFFGFDRPNRWITSGGLGTMGFGLPAALGAQLAHPGRLVIDIAGDASVQTTMKELSTAIQHQAPIKIFVLSDERPGMAREWRQVPDDSGRSRSYSASLPDFAKLAEAYGAVGLRCESPSELDARIEEMIDADRPVLLHCRVARLADTNRQ

SEQ ID NO: 33763 - protein, 516 aa, Zea mays
MWSKLFRGSLPLPTPTRTRTGSRSGNHKTSVKAPEPPRAPPTTPRNPNAPPQRGISPITPYQFQFSKGRGGAAPPPPPPLTREETPPPRASPMLSDQELAQYVESLVQHTAAQGGTGISADAVVRQLGAQLGVDLSPKAQLIRSVLVALLGPAAAPAPDPTGSRKDPFDPATAAAAGGPRAETPPQQMHFSTAAASSAPAPSPAVPHFFPQQHQHQMQYFLSAPQQYQHQQQQQRAGASPSPFDIPASYRYGHQPLPQADQAQLQRLVQLQHQQQQLAAAARVAAAAAPTPGESPRAPEPPPAPAPAASKKNSASVGAKRKGGPGGLNKVCGVSPELQAIVGEPAMARTEIVKQLWAYIRRNNLQDPNNKRKIICNDELRLVFETDSTDMFQMNKLLSKHIRPLESKNDSKPEAKKLKPQGDEPISSVETDVNQLPLMVSDALATFFGTGEREMVHSEAVKRVWDHIKSNDLEDPENPTVILCDSKLKQLFGRESLTAHGVSELLSDHLYTQSTNI

SEQ ID NO: 33764 - protein, 559 aa, Oryza sativa Japonica Group
MADATAALSELAAALDEEGKGVAAVAAAVKDANKRTALHFAAREGRTHVCHFLISDLALPVDPKDDDGNLDLMKLFLSKGVDVESESDAGTPLIWAAGHGQQEAVKLLLQHDAKASLCLALNHLSISRSCGLSLTFLLKLVIAWQPNTENDDGITPLLSAVAAGSLPCLDILIQAGAHPNIRAGGATPLHIAADGGNMEIINCLLKAGSDPNACDDDGLKPIQVAALRNNREVVELLLPLTSPIPGVSSWSIDGIIEYTKSVEEKAQVKEATTQKADRLQVPQLVEVSSEAKERSLEAKSRGDDAFRNKDYLVAVDAYTQAIELNPNDATLHSNRSLCWLRAGQAERALEDARACRALRPDWAKACYREGAALRLLQSPHRPRPLRLGTKLIDQLARDDEKIQKKTRKPKPKKTVKQHQQEPQDNSRELPASEPKAPPGWPLQPPMYLPVTPAPPPPPPAFSELEAIRAVLEESEKVQEKLDKQHAGMRDELIKKSKDLRDKEFKLPYQNPTPCTEERSNCRQCYVSNAQDPLKCAEAVKRFEACVRLARQRGNTKVAQ

SEQ ID NO: 33765 - protein, 261 aa, Streptomyces chartreusis
MTDNIERTAIVTGASNGIGRAIAATLAAEGVRVHICGRDAETVEKTVTELRADRGQVSGQACDVTKPDQVTALVADCVARYGPVDILVNNAGRPGGGITANIDNELWYATIDTNLNGVFLMSKSVLNEGRMTERQNGRIINIASVWGKQGTIGGAPYAAAKHGVIGFSRCLALELAKTGITVNAVCPGYVETPMSVNVRACQAGIWQVDEEEALRRLASDIPIGRYSEPEEVAWMVSYLASSKAASVTGQALNVCGGFGVH

SEQ ID NO: 33766 - protein, 417 aa, Mycobacterium tuberculosis H37Rv
MTASVNSLDLAAIRADFPILKRIMRGGNPLAYLDSGATSQRPLQVLDAEREFLTASNGAVHRGAHQLMEEATDAYEQGRADIALFVGADTDELVFTKNATEALNLVSYVLGDSRFERAVGPGDVIVTTELEHHANLIPWQELARRTGATLRWYGVTDDGRIDLDSLYLDDRVKVVAFTHHSNVTGVLTPVSELVSRAHQSGALTVLDACQSVPHQPVDLHELGVDFAAFSGHKMLGPNGIGVLYGRRELLAQMPPFLTGGSMIETVTMEGATYAPAPQRFEAGTPMTSQVVGLAAAARYLGAIGMAAVEAHERELVAAAIEGLSGIDGVRILGPTSMRDRGSPVAFVVEGVHAHDVGQVLDDGGVAVRVGHHCALPLHRRFGLAATARASFAVYNTADEVDRLVAGVRRSRHFFGRA

SEQ ID NO: 33767 - protein, 524 aa, Kluyveromyces lactis NRRL Y-1140
MSLNWGLVDFMLDNYASITASPINGSLHDIYVIYSMFMQNFLWKNNECGETYYQFCEDLNKISEVCGGCMNFEDDSGGNIFGQKISFVDGDSLKILQKVHYDQAIKLSLSHTGNKAKQIAIDKDSVQVKERKIESEPILLNKLMGILDQSEIVTPNAKCLRHLNQILSLELGSTKLSKEQAKLNTKRSPFIPICSDPKHVSLLSTVINTVNNKIMSLQGEKLKKIEADCPDIIECSNTHIHFIPNLKPQTDLSLGDCSYLDTCHKLSTCRYVHYLQYYPESLQKQKIEEQKEQRKQYSFYTHGECCSSSFKKLLPPQWIKCDVRKFDFDILGKFSAVIADPAWNIHMNLPYGTCNDNELLQLPFDLLQEEGLLFLWVTGRAIEVGKESLQNWGYEVINEISWIKTNQLGRTIVTGRTGHWLNHSKEHLLVGVKGNPEWLNRKIDIDLIISATRETSRKPDELYGIIERLVGTHARKLEIFGRDHNIRPGWFTIGNQVTGSSIHEVDVKRKYERFMEKSKNSKTN

SEQ ID NO: 33768 - protein, 382 aa, Archaeoglobus fulgidus DSM 4304
MAYFDYTSAKPVDERVLEAMLPYMTESFGNPSSVHSYGFKAREAVQEAREKVAKLVNGGGGTVVFTSGATEANNLAIIGYAMRNARKGKHILVSAVEHMSVINPAKFLQKQGFEVEYIPVGKYGEVDVSFIDQKLRDDTILVSVQHANNEIGTIQPVEEISEVLAGKAALHIDATASVGQIEVDVEKIGADMLTISSNDIYGPKGVGALWIRKEAKLQPVILGGGQENGLRSGSENVPSIVGFGKAAEITAMEWREEAERLRRLRDRIIDNVLKIEESYLNGHPEKRLPNNVNVRFSYIEGESIVLSLDMAGIQASTGSACSSKTLQPSHVLMACGLKHEEAHGTLLLTLGRYNTDEDVDRLLEVLPGVIERLRSMSPLYRR

SEQ ID NO: 33769 - protein, 356 aa, Kluyveromyces lactis NRRL Y-1140
MPDMTNESSSKPAQINIGINGFGRIGRLVLRAALTHPEVKVRLINNPSTTPEYAAYLFKYDSTHGKYRGEVEFDDERIIIQNDHVSAHIPLSHFREPERIPWASYNVDYVIDSTGVFKEVDTASRHKGVKKVIITAPSKTAPMYVYGVNHVKYNPLTDHVVSNASCTTNCLAPLVKALDDEFGIEEALMTTIHATTASQKTVDGTSSGGKDWRGGRSCQGNIIPSSTGAAKAVGKILPELNGKITGMSIRVPTINISLVDLTFRTAKKTSYDDIMKALEQRSRSDMKGVLGVTKDAVVSSDFTSDSRSSIVDAKAGIELNDHFFKVLSWYDNEYGYSSRVVDLSIFMAQKDFEAGV

SEQ ID NO: 33770 - protein, 124 aa, Vitis vinifera
MALRAAILRHIRVPVLQTLAPASTASNWQRWIRPMSSHGDDHLQKEEVIERVLSVVKSFPKVDPSQVTADVHFQKDLGLDSLDNVEIVMALEEEFKLEIPDKEADKIDSCNLAIEYIYNHPMAG

SEQ ID NO: 33771 - protein, 482 aa, Bacillus sp. SG-1
MESLTYRQTWFGNIKGDILSGLVVALALIPEAIAFSIIAGVDPMVGLYASFTIAVTIAFVGGRPGMISAATGAMALLFTNLIAEYGLQYLLAATILTGILQILFGVFKLARYMKFIPRSVMVGFVNALAILIFSSQLQHFHGEEWIMYALVGLTLFIIYLLPYFTKVVPSTLVAIVTVTILSITMNYGVRTVGDMGTISQTLPQFFLPDIPLTLETLMIIFPYSAALAVVGLLESLLTATIVDDMTDSESDKNMESRGQGIANIITGFFGGMAGCAMIGQSVINVKSGGRGRLSALVAGVFLMFLIVVLGGIVIQIPMAALAGVMIMVSISTFDWASLRTLHLLPRTDAAVMVVTVLTVVLTHNLAIGVFTGILLSAVFFVSKISKVRVNSSLEGDKRIYKINGELFFASVTELINLFDYKEDVKKVEINLSRSHIWDDSAVAAVDKIVSKFEVNGILAEVTGLNEDSTELVDKLANRLGSH

SEQ ID NO: 33772 - protein, 386 aa, Acidovorax sp. JS42
MKIHEYQGKEILRSFGVPVPRGIPAFTVQEAVEAAQKLGGPVWVVKAQIHAGGRGKGGGVKVAKTIDDVKARASEILGMQLVTHQTGPEGQKVRRLYIEDGADIKNELYVSLVTDRGTQKVALIASSEGGMDIEEVAHSTPEKIITEMIDPLTGITPEQSKKVAAAIGLTGASVDQAVDLFAKLYKCYMDTDASLVEINPLNCDSKGNLMALDAKFNFDANALFRHPEIVALRDLDEEDPAEVEASKFDLAYISLDGNIGCLVNGAGLAMATMDTIKLFGGEPANFLDVGGGATPEKVTEAFKIMLKNPKVKGILVNIFGGIMKCDTIATGVITACKAVNLQVPLVVRMKGTNEELGKKMLAESGLPIISADTMAEAATKIVEAVR

SEQ ID NO: 33773 - protein, 272 aa, Alteromonadales bacterium TW-7
MRHEIWQQLRSEANEVVTREPLLASHVYSCILNHECLGSALSFIVANKLADAVVSAFTIRELFDQSFVKCDRMLSFVAEDIKAVKDRDPAAETYLTVILNLKGFHAIQAHRLANCLWQQNRKELARFIQSRTSEVFGVDIHPACQVGKGIMFDHATGIVIGETAVIEDNVSILQSVTLGGTGNEQGDRHPKIRAGVLIGAGAKVLGNIEVGEGARIGAGSVVLTAVPPHTTAVGVPAKIIGRPECPCPAQSMNQNFLATPEPENESHTSAML

SEQ ID NO: 33774 - protein, 248 aa, Dechloromonas aromatica RCB
MNMLTDKIALVTGATRGIGRAIALELGKQGATVIGTATSEEGAGKISAYLLEAGIKGKGIALNVCDVAQTDAALSDIAKEFGAITILVNNAGITRDNLTMRMGDDEWDAVIDTNLKAVFRLSRGVMRGMMKARFGRIVNISSVVGYSGNAGQANYCAAKAGVAGLSRSLARELGSRNITVNCVAPGFIATDMTHALTEEQKAAMLASIPLARAGTPEDIAGAVGFLVSPAASYVTGTTVHVNGGMFMD

SEQ ID NO: 33775 - protein, 78 aa, Dechloromonas aromatica RCB
MDNIVERVKKIVAEQLGVNEADIKNESSFVDDLGADSLDTVELVMALEEEFECEIPDDQAEKITTVQQAVDYILAGKK

SEQ ID NO: 33776 - protein, 184 aa, Mycoplasma pneumoniae M129
MDKFLIDVTVEIPKSSKIKYEYDRKTSQIRVDRILFGSESYPQNYGFIANTLDWDGDELDCFIFADQAFLPGVVVPTRIVGALEMVDDGELDTKLLGVIDCDPRYKEINSVNDLPKHRVDEIIGFLKTYKLLQKKEVIIKGVQSLEWAKKEYQVCVDLMKQYGKLPKDEFIAKMQKLHPEHYQK

SEQ ID NO: 33777 - protein, 338 aa, Arabidopsis thaliana
MSNLPLDLVEEILSRVPATSLKRLRSTCRQWNALLKDRRFTEKHFRKAPKESLVLMLKEISVNLNVTPPSIEFKDALGLKDSHSNSEQVDIVQVLHCDGLLLCTTKDNRHVVWNPCLGETHWIQFKVDYGRVYSSFALGYIQNNESCRSYKILWRWKSNDYKSSPRQRGFEIYEFISDKWRVIDDVNHDSLVNHNYLGRCCRVSLKGNIYWLVDDVEDNSRSLLMFDFKTERFKRLCLPHFENVGHMVLSFVREEQLSVLYWSRATPKMEIWITNNIDTDATLLWRLHLDTRFNCVRIFSSLYFEEEKKVVLCCNVKLLMMIRSARTWYTLSERTMDI

SEQ ID NO: 33778 - protein, 399 aa, Alteromonadales bacterium TW-7
MRLGPGLLVTAAFIGPGTITTASVAGANFGFALIWTLLFSVIATILLQSMAARLGVATGQDLAQALRANIQTPLFKSLAIFLVISAIGVGSAAYEAGNLSGASMGLIGIFPNVNPQIWTPLIAFLSAGLLYSGKHKVVENALIVLVILMSLVFISTLIMASPSLGDILSGFTPSLPEGSITTVLALVGTTIVPYNLFLHSGVLAAKHDSKSDLQKVIKQTNVDTGLSITLGGVITLAILSTASVAFYGTNAGQISAANMAVQLEPLLGDAAHYFFAIGLFAAGLTSAITAPLAGAYAVCGMLGWSNDMASTRFKSVAIIILLFGAAVASLGLDPVAVIIFAQAANGLLLPVITIYLVWLVNQKSVMGKFTNSFILNLVTLPVLMLIFGLSSYKLIGLIF

SEQ ID NO: 33779 - protein, 260 aa, Anaplasma marginale str. St. Maries
MTGLHLERRDLRAIMRESRVCWLVVLLAKKEDFLKTPNGGPEAAKGVVVSASILSADFANLSASVAAVEAAGVDWLHVDVMDGCFVPNLTVGPVVIAGIKKCTRLVLDVHLMVQTPALHLRSVIDAGADIITVHAESDVHLYRFVREVKSHGKKVGVSLVPKTHHSALEYVIHELDLVLVMSVDPGFAGQEFLTSQLRKIEKIRTMVEKYSLPTKISVDGGVTTENVGSIVNAGADVVVVGTSLFKSANMYKVVQALKSF

SEQ ID NO: 33780 - protein, 144 aa, Triticum aestivum
MKPKSNVHCVTCGEDGHRAKSCPTRVFICYKCNEEGHISRKCPQNQSSEMKPKSNVHCVRCGEEGHRVKSCPTWVFTCYKCNEEGHTSQNCPQNQSSEMKPKSNVHCVSCGQEGHMAKSCPTRVFTCFKCNEEGHIAKNCPQKR

SEQ ID NO: 33781 - protein, 302 aa, Anaplasma marginale str. St. Maries
MGVAGTGVGSLVDIGCCSSASMWVISGFELKTKTVYNKLAGTLVRKNIAMALCQSSARTRASFEGNINQKGSGIIVLGASEVYPHRGESVRDAASSQYVDLMVPRTASHAALLEMKLRSNVQMINALIKKSHPYRVLAGILTYAATKWCAIFGQTVAWVCGNTNVLSSQVRAAAALKFRLLTPTLRCSDNMARKDAQQEGADIAYEPELAHAASDADVVTSDSWHSMGNPTNLDVLNNHQVDEFLIALAKHGHMLLHCMPAYVEREVGRAAPCGPSSHTAEEAGNKLRIQKALPAWRFGLLS

SEQ ID NO: 33782 - protein, 384 aa, Lotus japonicus
MGLLCSKNRRYNDADTEENTQTAEIERRIELETKAEKHIQKLLLLGAGESGKSTIFKQIKLLFQTGFDEAELKSYQPVIHANVYQTIKLLHDGAKELAQNDVDFSKYVISDENKEIGEKLSEIGGRLDYPCLTKELALEIENLWKDAAIQETYARGNELQVPDCTHYFMENLHRLSDANYVPTKDDVLYARVRTTGVVEIQFSPVGENKKSGEVYRLFDVGGQRNERRKWIHLFEGVSAVIFCAAISEYDQTLFEDENKNRMMETKELFEWVLKQPCFEKTSFMLFLNKFDIFEKKILKVPLNVCEWFKDYQPVSTGKQEIEHAYEFVKKKFEESYFQNTAPDRVDRVFKIYRTTALDQKVVKKTFKLVDETLRRRNLFEAGLL

SEQ ID NO: 33783 - protein, 449 aa, Haemophilus influenzae R2846
MSKVASLDAFLTKVAQRDGYQPEFLQAVREVFTSIWPFLEANPKYRSEALLERLVEPERAFQFRVAWTDDKGQVQVNRAFRVQFNSAIGPFKGGMRFHPSVNLSILKFLGFEQIFKNALTTLPMGGAKGGSDFDPKGKSDAEVMRFCQALMTELYRHVGADTDVPAGDIGVGGREVGYLAGYMKKLSNQSACVFTGRGLSFGGSLIRPEATGYGLVYFAQAMLAEKGDSFAGKVVSVSGSGNVAQYAIEKALSLGAKVVTCSDSSGYVYDPNGFTTEKLAALFDIKNTKRGRVKDYAEQFGLQYFEGKRPWEVQVDIALPCATQNELELSDAQRLIKNGVKLVAEGANMPTTIEATEALLAADVLFGPGKAANAGGVATSGLEMAQSSQRLYWTAEEVDAQLHRIMLDIHANCKKYGTIEGQENINYVVGANVAGFVKVADAMLAQGVY

SEQ ID NO: 33784 - protein, 168 aa, Lachancea kluyveri
LEQALYASKIISYAQGFMLIREAGKTYGWKLNNPAIALMWRGGCIIRSVFLAEITKAYRENPELENLLFNNFFTEAITKAQQGWRRTIGLAATWGIPTPAFSTALGFYDGYRSERLPANLLQAQRDYFGAHTFKVLPECADDHLPAGQDIHINWTGKGGNVSASTYQA

SEQ ID NO: 33785 - protein, 542 aa, Mycobacterium tuberculosis H37Rv
MITATDLEVRAGARILLAPDGPDLRVQPGDRIGLVGRNGAGKTTTLRILAGEVEPYAGSVTRAGEIGYLPQDPKVGDLDVLARDRVLSARGLDVLLTDLEKQQALMAEVADEDERDRAIRRYGQLEERFVALGGYGAESEAGRICASLGLPERVLTQRLRTLSGGQRRRVELARILFAASESGAGNSTTLLLDEPTNHLDADSLGWLRDFLRLHTGGLVVISHNVDLVADVVNKVWFLDAVRGQVDVYNMGWQRYVDARATDEQRRIRERANAERKAAALRAQAAKLGAKATKAVAAQNMLRRADRMMAALDEERVADKVARIKFPTPAACGRTPLVANGLGKTYGSLEVFTGVDLAIDRGSRVVILGLNGAGKTTLLRLLAGVEQPDTGVLEPGYGLRIGYFAQEHDTLDNDATVWENVRHAAPDAGEQDLRGLLGAFMFTGPQLEQPAGTLSGGEKTRLALAGLVASTANVLLLDEPTNNLDPASREQVLDALRSYRGAVVLVTHDPGAAAALGPQRVVLLPDGTEDYWSDEYRDLIELA

SEQ ID NO: 33786 - protein, 167 aa, Vitis vinifera
KIRQRTDALDAAGNTTAAIGKGFAIGSAALVSLALFGAFVSRAGIETVDVLTPKVFIGLIVGAMLPYWFSAMTMKSVGSAALKMVEEVRRQFNTIPGLMEGRAKPDYATCVKISTDASLREMIPPGALVMLTPLIAGTLFGVETLAGVLAGSLVSGVQVAISASNTG

SEQ ID NO: 33787 - protein, 100 aa, Zea mays
  misc_feature (30)..(30): Xaa can be any naturally occurring amino acid
  misc_feature (56)..(56): Xaa can be any naturally occurring amino acid
PRVRQCLAQISCCPQMLVVALLYHVYARLXSHWMMVHKQFRWSWYPVPTFAPYKVXGLFYTLILAMCGHAQTTATALVALQSLTPDAQSVLRLLDEYSDS

SEQ ID NO: 33788 - protein, 525 aa, Alteromonadales bacterium TW-7
MSKDIHDSRILILDFGSQYTQLIARRIREIGVFCELWAWDVTEEQIREFNPQGIILSGGPESTTLENSPRAPEYVFNAGVPVLGICYGMQTMAIQLGGRVHSSDKKEFGYAQVEKVGNCALFDAIEDHITDGGNGVLDVWMSHGDKVMEVPASFSTTAKTPTCPHAAMSNEEKRFYGVQFHPEVTHTHQGQRLLERFAIDICGCEKLWTPAKIIDDAIERIKETVGDDEVILGLSGGVDSSVVAMLIHRAIGDRLTCVFVDNGLLRLNEGQQVMDMFGNKFGLNIVKVDAEEQFLADLAGKSDPEDKRKAIGHTFINVFDEQAKKLKNAKWLGQGTIYPDVIESAASATGKAHVIKSHHNVGGLPDDMKMGLVEPLRELFKDEVRKIGLELGLPYDMLYRHPFPGPGLGVRVLGEIKKEYCDLLRRADAIFIEELHKAELYHKVSQAFTVFLPVKSVGVMGDARKYDWVVSLRCVETIDFMTARWSHLPYEFLGVVSNRIINEIDGISRVVYDISGKPPATIEWE

SEQ ID NO: 33789 - protein, 331 aa, Streptomyces coelicolor A3(2)
MTTNPDGGRHARNDSALLTTPFDSHARAQEVIDGVDLTGRRAVVTGGASGLGAKTVRALAAAGAEVTIATRHPQSAEPLVQEAAAAGAGRVHAEALDLSDVASVDSFARAWRGPLDILVANAGIMALPTRTLTPYGWEMQLATNYLGHFALATGLHAALRDAGSARIVVVSSGAHLGTPFEFEDPHFARRPYDPWAAYGQSKTADVLFTVGARRWAADGITANALNPGYILTRLQRHVDDETMRAFGVMDDQGNVKPLPYYKTPEQGAATSVLLAASPLLNGVTGRYFEDNQEARTVEDGDDQPGGVAAHALDPEAADRLWEYGADTLSAG

SEQ ID NO: 33790 - protein, 397 aa, Acidovorax sp. JS42
MHILRFSDLCAQGQARGQRVFIRADLNVPQDDAGRITEDTRIRASVPCIQMALEAGAAVMVTSHLGRPTEGEFKPEDSLAPVAQRLSELLGREVPLVADWVDGVQVQPGQVVLLENCRVNKGEKKNDPELAKKMAQLCDIYVNDAFGTAHRAEGTTYGIAEYAKVACAGPLLAAEIDAIQTALAHPKRPLVAIVAGSKVSTKLTILQSLSKNVDGLVVGGGIANTFMLAAGLPIGKSLAEPDLVNEAKAVIAAMAARGAEVPIPTDVVVAKAFAADAPATVKKASEVAEDDLILDIGPETAAQLAAQLKAAGTIVWNGPVGVFEFDQFAGGTKAIAQAIAESSAFSIAGGGDTLAAIAKYGIEKDVGYISTGGGAFLEVLEGKTLPAIEILQKRAAG

SEQ ID NO: 33791 - protein, 483 aa, Vitis vinifera
MAWYALVAACIKLLLIPSYHSTDFEVHRNWLALTHSLPLSQWYSDETSPWTLDYPPFFAYFERFLSIFANLIDPTIVNLRQGLNYNSNTVIYFQRMTVIVSDLCLFFALYRLTAKLDSGKRNLIWVLVASSPGLFIVDHVHFQYNGFLLGILLLSLSFLEEGRDLMGGFVFAVLLCFKHLFAVAAPVYFVFLLSRFCRGGFLKGFGRVLVMGAVVALVFAAAFGPFVYYGQIQQVIHRMFPFGRGLCHAYWAPNFWVFYIILDKGLAFLLRNLGFNIQAPAASFTGGLVGDSSPFAILPSITPLTTFIMVVLAISPALIKACRNPRPEMITRWVAYAYTCGFIFGWHVHEKASLHFVIPLAIVAMQSLEDAKHYFLLSIVSSYSLFPLLFEAQEYPIKVLLLLLHSIVMCSRAATKKGDFVIGWIGKIYLLGLLVVEIWGQFLHPYLLGSRFPFVPLMLISVYCAFGIMYSWVWQLKRIIRSS

SEQ ID NO: 33792 - protein, 387 aa, Erwinia carotovora subsp. atroseptica SCRI1043
MSRIDSLRQLTESVFVRLFGYAPHAAIQAPGRVNLIGEHTDYNDGFVLPCAIDYQTVVSAAVRQDGIVRVVAVDYDNQQDEFDLAKAIVPHSEYVWANYIRGTVKFLLARGLPLSGMDMVVSGNVPSGAGLSSSASLEVSIGQTFKELNNLDISQLDVALNGQQAENHFVGCSCGIMDQFISAQGRAGQAMLIDCRSLEGRAVRMLDGVDVLIVNSNVRRGLVDSEYNTRRQQCEAAARHFNVKALRDVSLSQFEAGIEGLDPVAVRRARHVITENRRTLEAADALARQDAHRLFTLMAESHVSMRDDFEITVPPIDTLVDLIQDYVGERGGVRMTGGGFGGCIVALIPSALTDEVKQVIEREYPARTGLQPSIYLCHASDGAGRLN

SEQ ID NO: 33793 - protein, 358 aa, Glycine max
MSAYCGKYKDELIKNAAYIGTPGKGILAADESTGTIGKRFASINVENVEDNRRALRELLFCTPGALQYLSGVILFEETLYQSTKGGKPFVDILKAGNVLPGIKVDKGTIELAGTNGETTTQGFDDLGKRCAKYYEAGARFAKWRAVLKIGATEPSQLSIDQNAQGLARYAIICQENGLVPIVEPEILVDGPHDIDRCAYVTEIVLAACYKALNDQHVLLEGTLLKPNMVTPGSDSKKVAPEVIAEYTVRTLQRTVPAAVPAIVFLSGGQSEEEATLNLNAMNKLQTKKPWNLSFSFGRALQQSTLKAWSGKTENEEKARAAFLVRCKANSEATLGTYKGDATLAEGASESLHVKDYKY

SEQ ID NO: 33794 - protein, 296 aa, Chromobacterium violaceum ATCC 12472
MTRVLVVGSINMDLVVTARRMPKLGETLLGDGFATHPGGKGANQAVAAARLGAEVALLGCVGDDAFGRDLRAHLEREGVDCRGVATVPGPTGIAAITVSGGDNAILVVPGANHQLTPAHLDAAEQAFIDADVVLTQLEIPLAAVRRAAELAARHKKPLLLNPAPAVPLPEELLQRVTLLTPNEHEFLTMLAQPDADWRALLAERPGKLVMTHGKHGAYFALARGQLRHQPGFEVQAVDSTGAGDTFNGALAAFLPLGLEEAVRRANAAGALSVTRPGAQGGMPTLAELEAFLENKA

SEQ ID NO: 33795 - protein, 505 aa, Oryza sativa Japonica Group
MSGGSSPRSRRSSFNSLSRDLELPSEQGCLSVIVLGASGDLAKKKTFPALFHLFAQGFIQSGEVHIFGYARSNLSDDGLRERIRGYLKGASEEHLSDFLQHIKYVSGSYDSGEGFEKLNKEISEYEKSNKSESPRRLFYLALPPSVYPSVCKMIRTYCMNPSGWTRVIVEKPFGKDLDSSEELSAQLGELFDENQLYRIDHYLGKELVQNLLVLRFANRLFLPLWNRDNIDNIQIVFREDFGTDGRGGYFDQYGIIRDIIQNHLLQVFCLVAMEKPVSLKPEHIRDEKVKVLQSVNPIKHDEVVLGQYEGYKDDPTVPDDSNTPTFASVVFRVHNERWEGVPFILKAGKALSSRKAEVRVQFKDVPGDIFKCKRQGRNEFVIRLQPSEAMYMKLTVKKPGLEMATEQSELDLSYGMRYQNVKIPEACERLILDTIRGDQQHFVRRDELKAAWQIFTPLLHDIDEGKVKSIPYQPGSRGPKEADELSERVGYMQTHGYIWIPPTLA

SEQ ID NO: 33796 - protein, 276 aa, Zea mays
  misc_feature (168)..(168): Xaa can be any naturally occurring amino acid
MDQYEVLEQIGKGAFGSALLVRHKAEKKKYVLKKIRLARQTDRTRRSAHQEMQLIATVRNPFIVEYKDSWVEKGCYVCIVIGYCEGGDMAEAIKKVNGNHFSEEKLCKWLVQLLMALDYLHANHILHRDVKCSNIFIARDQSIRLGDFGLAKILTSDDLASSVVGTPXYMCPELLADIPYGTKSDIWSLGCCIYEMTALRPAFKAFDMQALISKITKSIVSPLPTRYSGSFRGLIKSMLRKSPEHRPSAAELLKHVHLHQPVHHEGQVHGAGAAQG

SEQ ID NO: 33797 - protein, 511 aa, Chlamydomonas reinhardtii
MADFGKALLDAAGAFPLDKYRFLRRLRETSTEQYYQLLCYYTQQVLPYIYTPTVGEACQQYHALRIQARGLYLRIDHRRSILSQLKAWPQKDVRVIVVTDGERILGLGDLGANGMGISEGKIELYTAAAGVNPAVCLPVCLDVGTNNTQLREHPVYAGLRAPRPIRQQVYDEFVQEFMEAVKIWQPHTLIQFEDFGNNNAFRILDKYKDDYCCFNDDIQGTAAITLAALLAALRVTGQRLADQRILFMGAGEAATGIASLISFCIHRRDGVSEQAARQRCHLMDSKGLVLASRTDLQHHKRPFAHSDVPPCATLIEAVRAIKPTAIVGVSAVADAFTPEVLAAMAELNDRPIIFPLSNPTSLAECTFEQAYRATNGRVLFASGSPFDPIVDERGIAHHPPQANNAYIFPAVGHAAVLTKSKRVPEEVFLVAAERLSVMATAAELQVGALFPPFARIRDISAHVMAAAAAHLVDAGLGAVPDGWPEQREGWAAAARQAMWSPPLPSVPVSRL

SEQ ID NO: 33798 - protein, 326 aa, Nicotiana tabacum
MSQESLVLRGTMRAHTDWVTAIATAVDNSDMIVTSSRDKSIIVWSITKDGPQYGVPRRRLTGHGHFVQDVVLSSDGMFALSGSWDGELRLWDLQAGTTARRFVGHTKDVLSVAFSVDNRQIVSASRDKSIRLWNTLGECKYTIQDGDSHSDWVSCVRFSPNNLQPTIVSGSWDRTVKIWNLTNCKLRLTLAGHTGYVNTPAVSPDGSLCASGGKDGVILLWDLAEGKKLYSLESGSIIHSLCFSPNRYWLCAATESSIKIWDLESKSIVDDLKVDLKQESEMSSEGTASGKNKVIYCTSLSWSADGSTLFSGYTDGLIRVWGIDRY

SEQ ID NO: 33799 - protein, 535 aa, Chlamydomonas reinhardtii
MCRAPPIDKYMWLRDLRMASPSSYFRVLVNNTLDVLPYIYTPTVGKACQEYHTLGIATRGLYLRIDQDKGKILERLKAWPQKRVRTIVVTDGERILGLGDLGANGMGISEGKIELYTAAAGVNPAVCLPVCLDVGTNNVKLREHPKYKGVRAARPPQKEYDEFVQEFMEAIRAWQPHTLIQFEDFGNTNAFRILDKYRDDYCCFNDDIQGTAAITLAALLAALRVTGQRLADQRILFLGAGEAAAGIATLISYCMTRRDNIEPAAARQRCHLMDSKGLVIASRTDLQHHKRPFAHSDVPPCTTLIEAVRAIKPTVLIGASAVPNSFTQEVVEAMAELNARPIICPLSNPTSQAECTFEQAWKWTNGRVLFASGSPFDPITDAQGIAHHPPQANNAYIFPAVGHAAVLTKSKRVPEELFLVAAEQLAAMATVEELSRGHLFPVFSHIRDISASIMASCAHYLSTPTPTGPGAGQRLAPRRARRHVEPARGGQRHRLRLHGGRHAAVVHGPPAGAGRREAARATHVGRAVSGGCVRR

SEQ ID NO: 33800 - protein, 495 aa, Chlamydomonas reinhardtii
MGCSSSIAAKNQLPESDKSTLERIRTPSGTAEDGPIDPEALWVFEETKELVKEHYAFGRILGKGQFGTCRTVTHKTTGKKYACKTIAKRRLFNMSDVNDVRREVQIMYHLQGHPSIVSIIEVYEDKTNVHIVEELCSGGELFDSIIERGHYSEKDAARAFRHIATVVAHCHNMGVMHRDIKPENFLLSSRDPDALVKGTDFGLGVFFSEGQTFKDVVGSAFYVAPEVLRKKYDKRADIWSLGVLLYLLLAGVPPFYAETEREIFRAVLSAPLDFTSAPWPSVSEAAKDVIRRMLERDPSKRISIADVLAHEWVREDGAARAAPLQHEVLVRLQNFAALNKLQQEALKIIANSLPENEVSGLRSLFMDIDADGSGSITVDELREALMKKGTNIPAEELERIMAQADISGDGTLDYEEFLAATMNLAKLEHEEHLYMAFRFFDANDDGFIDHDELVTALEKVGACICSSAEINELLQQADTSGDGQIDFEEFCHLMR

SEQ ID NO: 33801 - protein, 671 aa, Myxococcus xanthus DK 1622
MTLPADGDLRIDEVLRNTYRIVSLLGRGGMGSVYLAQHLRLPGKQVAVKVLRGGDHLTPEIFARFRREAEIASRLGHPNIVEVLDYDTLENGNPFLVLEYLRGESLQERLARGRLPMEDVVSFTRQMGSALQAAHGAGVIHRDLKPANVFLVPTDSGGVVGERVKLLDFGISKVLSSTTVQTQEATIIGTPQYMSPEQAQGKNRDIDARTDVFALGCIVYEMMAGKPVFGSGSLAQMIFRVVYEPPEPLAPLCPEATPEAISAVMRALAKGVDERYPDVSSFIEDLTGTPLHSLSTTAGNQPAPRPQAPASGIALPSTDPASLSATVPPGSLKVAPDTGREGFDSTMAPGTGQQGFSPSTTGQMGVAQAQGFSPSATGQMGVAQLSAASLIDPPGLEPTLISKQLPAIPVPERPAQHHTAVSVPVPIPGAAEADAAAALVSAPSTPVSPPPAAKGRGAFIGATAAVLLASSVGLVWWMKGGTSGTGSPTTPVADARAPQDARQANGAQQTNGQQANGTQANGTQANGTQQTNGTEQANGTEQANGTEQANGTQTPPDTENPQQVVVATVTPPDKPTSRPVTRPEPKEELPEQVRKLLKEGESALASGDASRAIALARSSQRTKRSIAAYSLLTRAYCQQKDLGGAVSEWPKVASAERAKVKKFCQKHDIEL

SEQ ID NO: 33802 - protein, 272 aa, Streptomyces avermitilis MA-4680
MSETLQTTAVAASDADLLAQTANAVRAAGSALRERFGEVVRYQSREELMRALAANDDTALDILRPRLTSLRPDAGWVEDELDGGALPPGEWWVVDPAEGNVNHLHALPEWAVTATLVRENQPVLTAVHLPLTGETYTALTGAGAHVDGRPLHVSPAADLGLSIVATSQARPDEDEKVVRRVGSSITAMLFDALVVRTAVPATLHLVNVAAGRIDAFWQFAGARADLLPGALLVTEAGGQISDAQGRPWTPQSESFLAAAPGIHAEAVATLSH

SEQ ID NO: 33803 - protein, 676 aa, Zea mays
MACNRRRKLLCACLLLACAAPAAAAAVNISVYWGQNSNEGSLGQTCSSGRYALVAMAFLSTFGSGQTPVLNLAGHCDPASGGCTALAADIAACQARGVRVLLSIGGGAGSYNLSSASDAESVATYLWDNFLGGTSSSRPLGDAVLDGIDMDIEISPSSHFDGLARNLTSLYGGDRRGRKYLLTAAPQCPYPDASLGAALATGLFDHVWVQFYNNPGCEYQQKDGDGVANLAASWKAWTQSLPSSASVFLGLPASPAAAGSGYVPPDDLVSRVLPAVSGSANYGGLMLWNRYYDNSTGYSARILSSNIIAGTAGVSGLCAIIALAALMWWYKRRYGMVIPWRRGVSGVESFLQKQGALLHPKGYTYSEVKRMTRSFAHKLGQGGYGAVYRGSMPDGREVAVKMLTGMLEGDGEEFMNEVASISRTSHVNIVTLVGYCLQGPKRALLYEYMPNGSLERYTFGSSSGEDALSWDRLFGIVVGVARGLEYLHTGCNTRIVHFDIKPHNILLDQDMCPKISDFGLAKLCGQKASRVSIAGARGTVGYIAPEVFSRSYEAVGSKADVYSYGMVVLEMVGARKNVHVSATDDGGNSSSSRYFPQWLYENLDQFCRPTTTSNGEIRGDDDDATEVLLVRKMVVVGLWCIQSKPDSRPSMGQVLEMLESNAADLQLPPKALCTAY

SEQ ID NO: 33804 - protein, 261 aa, Caulobacter crescentus CB15
MAQSTGRVAGKKAFITGGAQGLGAAAGRMLAKEGAKVALADINLAGAQAVADEINAAHGAGTAFAFELDVTQEDQWIDVLEKATAAMGGLSVLVNNAGIGGDGPIESLDFGLWKKVMSVNVDSVFLGAKHALTHMRAHQPGSIINLSSIAGLIANGNSPAYNASKAAVWLLSKNIALYCAKMKLDIRSNSIHPTFIDTPILDGFSARFGKEEAFAKLARQVPLGRIGEPTDIANAVLYLASDESKFMTGAEIKVDGGISAM

SEQ ID NO: 33805 - protein, 581 aa, Lachancea kluyveri
MSFIQDSYRKDLEKIVSNSNTTSKDVENLDLSNQDDISSQESHLNIDGKHDGIRLKKELEARHVSMIAIGGSLGTGLLIGTGTSLSLAGPVSILIAYSFVGFLVYIVMTCLGEMATYIPLDGFTSYASRYCDPALGFAVGYSYLFKYLIITPNQLTAAALVLQYWVSREKVNPGVWITIFLVIIVTINVVGVKFFGEFEFWLSSFKVLVMLCLIVLLFVIMLGGGPSHDRLGFRFYKDPGAFRPYSEAISGSKGKFVSFVAVFVYALFAYLGTELCGIVAAECKNPRRNVPRAIKLTLYRIVVFYLVTIFLLGMTVAYNDPLLLQAKKKSTSAAASPFVVAIKNAGIPVLPHIFNACVLMFVFSACNSDLYVASRSLYGLAIDNKAPKIFAKTNKWGVPYNSLILCILFCLLAYMNVSSGSAQVFNYFVNVVSIFGLMSWIAILITYIYFDRALRAQGVDKSTLAYAAPLASKGAYFALFFCCLIALIKNFTVFLGHKFDYKNFITGYIGIPVFIICFFGYKYIRGTKFVKPEEADLYTFKELIDLEEEEGKLWDAAQKEKMESSPKNFKWFYEKFLGWIF

SEQ ID NO: 33806 - protein, 325 aa, Oryza sativa Japonica Group
MDGKKPYVIAIIIQVIYTGLYVVSKAAFDQGMNTFVFIFYRQAAATLLLLPLAIILERRNAPAMSLRLFTKLFMYALLGNTITMNMYNVSLKYTSATVASATSNSVPVVTFFLAVLLRLEVIRLRTLSGVAKAAGVALCLAGVLVIALYAGPAISPLNHHRALSGGVHGAESSVGTGTRARWMKGTFLMLLSNTTWSLWIVLQASLLKEYPNKLLATLIQCALSTLQSLLLAAAVVRADPAAWRLRLDAGLLAVAYTGFVVTGVSFYLQAWCIEKKGPVFLAMSNPLCFVFTIFCSSFFLAEIVHLGSIVGGRPARRRPLQRALG

SEQ ID NO: 33807 - protein, 316 aa, Blastopirellula marina DSM 3645
MAKYLVTGGAGFIGSHIVEALVARGDQVRVIDNLSTGKRSNLDHVAKRIEFVEGCLTDSAVVADAVRGVDVIFHQAALASVPLSVERPLDTHAHCVTATVNLLNEARQADVRRVIYAASSSAYGDAPTLAKRETDLPNPLSPYAAAKLAAEYYLQAFYHTYGIETVGLRYFNVFGPRQDPDSPYSAVIPIFITLLLQGDRPVIYGDGEQSRDFTFVKNVALANLAAADANGVAGRIINVANGRSTSLLRLIELLNRELGANVQPQHVPPRVGDVRDSMADNTLARTLLGYEVEIDFETGLQMSIDYYRQLVASRSA

SEQ ID NO: 33808 - protein, 493 aa, Kluyveromyces lactis NRRL Y-1140
MGYDTRHDVIDLVGNTPLIRLQKLPKAIGIKPKVYAKLELYNPGGSIKDRIAKSMIEAAEEEGIIHPSRSTLIEPTSGNTGIGLALIGAIKGYRTIITLPEKMSNEKVSVLKALGAEIIRTPTAAAWDSPESHIGVALRLEKEIPGGIILDQYNNMKNPEAHYFGTGKEIHHQLEDLSLFSKLKAVVAGAGTGGTISGISKYIKEQNDKIAIVGADPVGSILAVPEKLNETDVTEYKVEGIGYDFVPKVLNRDSVDHWVKTDDKSSFKYARQLISNEGVLVGGSSGSAFTALVDYCNEHPELTEDDVIVVIFPDSVRSYLTKFVDDEWLKTNGLWDDAIATPIVQKETDVFEDATVKDLNLKPVVSVEEDASVATVIKILRDNSFDQLPVLTKDGKLCGLVTLSQLLKKLSTSKDVSSIKSLFFDFRKLNNFDDISSYNADKSHKKIFVRFDVNTTLSELNSFFEKNSAAIITEGLNPVHIVTKVDLLSYLAK

SEQ ID NO: 33809 - protein, 1189 aa, Bacillus cereus G9241
MFLKRLEIAGFKSFAERVSVDFVPGVTSVVGPNGSGKSNITDAIRWVLGEQSAKSLRGAKMEDIIFAGSDTRRAVNVAEVTITLNNEDQRLPIEYNEVCVTRRVSRSGDSDFYINKQSCRLKDIIDLFMDSGMGREAFSIISQGKVEEILSSKSEERRGVFEEAAGVLKYKLRKKKAEGKLADTQENLNRVQDIIHELSSQVEPLERQASIAKDYLEKKEELEKVEAALIVHEIEELHEKWEALRNQFGHNKNEEAKMSTHLQKGEEELEELRGQLQAVDESVDSLQEVLLLSSKELEKLEGQRELLKERKQNATTHCAQLEQLIVELTEKATSYDGEIESSTEVLMQFVNHVKELETKLHDNEQLLATFADDLEERIENLKGDYIELLNQQASHRNELSMIEEQSKQQNSKNERLDEENAKYVEMRMEITAKKTKLVESYEQVKEKVAGILSNIQKTEAALGKCKAQYSENETKLYQAYQFVQQARSRKEMLEEMQEDYSGFYQGVREVLKARENRLQGIEGAVAELLTVPKEYEIAMEIALGAAMQHIVVQKEEHARNAIAFLKQNKHGRATFLPQAVIKGRSLSFEQLRIVNQHPSFVGVAAELVQYNNKYENVVSNLLGTVIVAKDLRGANELAKQLQYRYRIVTIEGDVVNPGGSMTGGAVKQAKSSLLGRQRELEEWTSKLTDMEEKTTKLENFVKAVKQEIQEKEVQIRELRQSVEAERVDEQKLREEINRLELEEHRINDRLSIYDLEIEGFLQDQVKIQGRKEELEKILATLQAEITELDNKIIALTKQKSEQHSSKEKVQKEMTELKVLAAEKQQRLSNQKEKVERLTKEKEETDATLVKTKEDLAFLKQEMTSNSSGEEQITNMIEKKAYDRNQTSELIRSRREQRVSLQERVEQLERNLKETTGKHKYILEMLKDQEVKINRLDVELENRLQHLRETYTISFEAAKLKYTMVMPAEDARKKVKLIKLSIEELGTVNLGAIDEYERVAERHTFLLEQKDDLEEAKTTLHQLITEMDEEMKKRFSTTFEGIRMEFQSVFSELFGGGRADLVMTNPEDLLNTGIDIVAQPPGKKLQNLGLLSGGERALTAIALLFGILKVRPVPFCVLDEVEAALDEANVARFAQYLKKFSDETQFIVITHRKGTMEESDVLYGVTMQESGVSKLVSVRLDDGEELVASK

SEQ ID NO: 33810 - protein, 440 aa, Arabidopsis thaliana
MKISSLGWVLVLIFISITIVSSAPAPKPPKPKPAPAPTPPKPKPTPAPTPPKPKPKPAPTPPKPKPAPAPTPPKPKPAPAPTPPKPKPKPAPTPPNPKPTPAPTPPKPKPAPAPAPTPAPKPKPAPKPAPGGEVEDETEFSYETKGNKGPAKWGTLDAEWKMCGIGKMQSPIDLRDKNVVVSNKFGLLRSQYLPSNTTIKNRGHDIMLKFKGGNKGIGVTIRGTRYQLQQLHWHSPSEHTINGKRFALEEHLVHESKDKRYAVVAFLYNLGASDPFLFSLEKQLKKITDTHASEEHIRTVSSKQVKLLRVAVHDASDSNARPLQAVNKRKYHIRDGEPQPRWNEPSSILSSLETLEWIQYYGTKEEKQVAAFILRNANFSKKQLSHLNPPIITRNLRCLKSCHHRLSVLVLVSFYFFETMVNMSSNNHLCLVGACMILKS

SEQ ID NO: 33811 - protein, 175 aa, Glycine max
  misc_feature (84)..(84): Xaa can be any naturally occurring amino acid
  misc_feature (144)..(144): Xaa can be any naturally occurring amino acid
  misc_feature (160)..(160): Xaa can be any naturally occurring amino acid
QKHAAFFDLNKDGVIYPWETFKGLREIGTGVLLSVGGAIFINVFLSQSTRPGKFPSILFPIEIKNIQRGKHGSDTGVYDTEGRXFVPSKFEEIFNKHAHTHPNALTYDELTEMIKANREPKDFSGRIGSVVEWKILYKLAKDKXWITAERNNPRCLRWKXLFEQLKKQHSSGKEK

SEQ ID NO: 33812 - protein, 348 aa, Vitis vinifera
MESGLSSLGSSLLVPCVQELVKEPLTAVPHRYLRPEQDPPVLSNTTDSMPHVPIIDLHHACQEWGFFQLINHGVSSSLVEKVKAETQEFFNLPMDEKKKFWQKPGEVEGFGQAFVVSEEQKLDWGDLFFMSTLPTHFRKPRLFPKFPLPFRDTLEIYVVEMRNLALTMLSFMEKALKIEVNEMRELFEQGLQGMRMNYYPPCPQPEQVIGQTPHSDSVGLTILLQVNEVEGLQIRKDGMWIPITPLPNAFIVNIGDILEIFSNGIYKSIEHRAVVNSVKERLSIATFHSPQMDAEIGPVPSLITPEFPALFRRVGVADYFKKLFSRALDGKSYLEVLRIDGKEEGQNI

SEQ ID NO: 33813 - protein, 304 aa, Archaeoglobus fulgidus DSM 4304
MGILILPHLKLYLSCSPQNFMVILVGGTNGLMALKVAKISGLPLCYSHVDRYPDGEKYFRFASNIDGEDVVIFNSMHPNPDEIIFETLLIAETAYSNGARSVTCVFPYFAYARSLDTVKGEALPIKTVVKVLKAAGVKKIITVDFHLQENVFGVEHVDLTGMEKLAEYCLEEFSDSFTVLAPDEKAAFWAEKFAAKANCDVVALRKIRIDAENVIIDDLRTGVEGDVVIVDDIVSTGGTVCQAARIAKRAGARRVFVACTHAILARDAMMRILESGIEDIVSTDTILSPVSHVSVADVIASALS

SEQ ID NO: 33814 - protein, 293 aa, Bifidobacterium longum DJO10A
MGEVWKGYDIQLGREVAIKALRSDVTNAEAKLRRLRAEAHNSANLAHPNIAALFEYYEHDGIGFLIMEYVPSKSLADLFHSKGAMDPIELLPILIQTARGLFVAHSHGVIHRDVKPANIMVSDTGEVKITDFGVSYSTGQGQITQDGMVVGTAQYISPEQAQGQQATPQSDIYSLGVVAYEGLAGHRPFTGTTPVDIAAAHVNNPVPPLPDSVDVQLREFVMSMLAKDPLDRPKDALVVSRTLARIERRLLDQQTEMADTAMATSGNRLPRRVTSTPRIVLEAPASRLGGNKQ

SEQ ID NO: 33815 - protein, 552 aa, Oryza sativa Indica Group
MDSSPSTQDCGGWLLYVSLAAKCGGDPCRVVGFVAVAVVAFAVTSLLHWLSPGGPAWGRYWWNRRGGLGIAAAIPGPRGLPVLGSMSLMAGLAHRKLAAAAGGSPARRRLMALSLGETRVVVTADPGVARELLASAAFADRPVKESAYGMLFHRAIGFAPYGTYWRALRRVASTHLFSPRQVSASAAQRAVIARQMVEAMRSAAAAAAGGGVAARPFLKRASLHNVMWSVFGRKYELAAPESEETAELRSMVDEGYDLLGQLNWSDHLPWLAPFDLQKTRSRCSSLVPRVNRFVTRIIDEHRARLSLAVDAAVDFTDVLLSLHGGDKLSDADMVAVLWEMIFRGTDTVAVLIEWVAARLVLHQDVQARVHDELDRVVGSDRAVTESDASKLVYLQAVIKEVLRLHPPGPLLSWARLATSDVHVGGFLIPSGTTAMVNMWAITHDPAVWPDPNEFKPERFVAGPSSDQAAEFPIMGSDLRLAPFGSGRRSCPGKSLAIATVGFWVATLLHEFDWLPLSDKSRGVDLSEVLKLSCEMATPLEARLRPRRKVMSV

SEQ ID NO: 33816 - protein, 343 aa, Physcomitrella patens subsp. patens
MVGLQAAAEPVPSREHSRGRGKGKLSNGHHIIFATSKITDESISVSADDLAGVANVQNVLNGNSSGFVATLPAQVQARVKVLQEIQSEHDKLEAKFHEERAALEAKYQKLYEPLYAKRSDIVNGVVDVEAPKGEAPEATPASEEGAETVKGVPEFWLMAMKTNDIVNMQITERDEAALKHLKDIKSSNLEENKGFKLDFYFEENPFFKNTVVTTFDSELIRPSPEPVRILRTEIEWTSGKNLTQKVMKKKPKKGAKNTKPVTKTEPCESFFNFFSPPQVPEDDDIDQDTAEALQDSMEQDYDIGYVQCLEVRVQTVAPVKKGRAPKAAGGKQQGDEPPECKQQ

SEQ ID NO: 33817 - protein, 217 aa, Alteromonadales bacterium TW-7
MTQDELKKAAAWAALEFVKENTIVGVGTGSTVNHFIDALGTVKDTLVGAVSSSEASTARLKELGIEVFELNDIDVLDVYIDGADEINAQNEMIKGGGAALTREKIVAAVAKQFVCIVDDTKLVDTLGEFPLPVEVIPMARSYVARELLKLGGDPVYRQGVVTDNGNVILDVYNLNITNAKQLETDINQIVGVVTNGLFAMRGADKVIIGTKNGPQIK

SEQ ID NO: 33818 - protein, 364 aa, Vitis vinifera
MESGLSSLGSSLLVPCVQELVKEPLTAVPHRYVRPEQDSPVLSNATDSMPHVPIIDLHRLLSADFTHSELEKLHRACQEWGFFQLINHGVSSSLVEKVKAETQEFFNLPLEEKKKFWQKPGEVEGFGQAFVVSEEQKLDWGDIFFMSTLPTHFRKPHLFPKLPLPFRDTLEVYVVEMRNLALTMLSFMEKALKIEVNEMRKLFEQGLQAMRMNYYPPCPKPEQVIGLTPHSDSVGLTILLQVNEVEGLQIRKDGMWIPITPLPNAFIVNIGDILEIFSNGIYKSIEHRAVVNSVKERLSIATFYNPQMDAEIGPVPSLITPEFPALFRRVGVADYVKKLFSRELGGKSYLEALRIDGKEEGQNI

SEQ ID NO: 33819 - protein, 123 aa, Glycine max
MCSNDLLGPHPLPFLIANINCTGLPAMAKAGRVRCSMEEKPSSSSNLGMGASLLAAAAAATMSSPAAMALVDERLSTEGTGLPFGLSNNLLGWILFGVFGLIWALFFVYTSTLEEDEESGLSL

SEQ ID NO: 33820 - protein, 296 aa, Chromobacterium violaceum ATCC 12472
MYKHLEDFVGGTPLVRLKRLPGDNGNVVLLKLEGNNPAGSVKDRPALSMIRRAEARGDIRPGDTLIEPTSGNTGIALAMAAAMMGYRMVLIMPENSSAERVQAMRAYGAEVILTPAAGSMPAAIDLARSMEAAGEGRILDQFSNPDNPQAHYEGTGPEIWAETEGRITHFVSSMGTTGTIMGTGRFLKEKNPAIRIVGVHPEPGSQIAGIRKWEDPYVPKICDFSRIDEILHVGQKEAEDTARLLARREGILAGPSSGGALAVALRLDAQLRDAVIVSVVCDRGDRYLSTGLFDPA

SEQ ID NO: 33821 - protein, 192 aa, Dechloromonas aromatica RCB
MPFNLPILLTWLRIVAIPLLIAIYYLPTGWATLHERDVAATLIFMAAALTDWADGYLARKLNQTSAFGAFLDPVADKLMVAAALIVLVQLGRTDAIIATIIIGREITISALREWMAKIGAAKSVAVSMLGKVKTAAQMLALPMLLYYAPLSGIDMKSLGNWLIWIAALLTLWSMGYYLRMAWPEILKRSAEK

SEQ ID NO: 33822 - protein, 595 aa, Pseudomonas putida GB-1
MPHEGSLLQTAVIFLLAAVLAVPLAKRLQLGAVLGYLLAGVVIGPQALGLIRDTESVAHISELGVVLLLFIIGLELSPKRLWLMRKSVFGVGTAQVLLTGALIGAIALFGFSQTLPAAIVLGLGLALSSTALGLQSLAESKQLNAPHGRLAFAILLFQDIAAIPLIALVPLLAASGPDTSHGDSLQHGLKVFASIAVVIIGGRYLLRPVFRTVARTGLPEVSTATALLVVIGTAWLMEEAGISMALGAFLAGLLLADSEYRHELESQIEPFKGLLLGLFFISVGMGANLRLLLDMPLVVLGLTLLLVAVKLVLLIGVGRMVGGLNSASALRLGMVLAAGGEFAFVVFKLGKDQGLFDTQTYDLLLMTITLSMAITPLLMLGCARALKRPQPAREVPEQYKQIQTDTPRVVIVGMGRMGQIVARILRAQKIPFIALETSVDTIEMTRMFEQVPVFYGDPLRPEVLHAAKVGEAEYFIITIDDPEAAIHTAERVKRLYPHLKVLARARNRQHVHKLVDAGAEPIRETFYSSLEMTRRALVGLGLSDEQAADRIARFTQHDEEVLVAQGHVRDDRAKVMQTAKEARVELARLFDSDAD

SEQ ID NO: 33823 - protein, 326 aa, Ralstonia eutropha JMP134
MGLLVNGQWQDKWYDTASTGGRFVRKDAAFRNWITADGAPGPSGNGGFAAQAGRYHLYVSLACPWAHRTLIMRRLKGLDDMIGVSVVHWLMREEGWTFSEGPGVVPDTVNHARVLHQVYTAADPQYTGRVTVPVLWDRQRATIVNNESSEILRMMNSAFDAIGARPGDYYPAELREEIDAVNARVYDTVNNGVYKAGFATMQQAYEEAVWPLFETLDWLDNRLSMQRYLVGNRLTEADIRLFTTLVRFDPVYVGHFKCNLRRIADYPALSAFVRDIYQHSGIAETVNVEHIKRHYYESHRTLNPAGIVPAGPVLDLDAPHGRETLA

SEQ ID NO: 33824 - protein, 380 aa, Vibrio vulnificus CMCP6
MKKLSKLLISAAIALPLMFTLLAKVGVADTMDKTAPNLASLPVATLAGGCFWCTESDLEKLNGVYDVVSGYSGGEMANPTYRQVSSGKTGHIEVIQFRYDPNVVSYEAVLDYFLRHIDPTDDKGSFVDRGPQYRPAIFYHTAEQKQIAERFLKEVDEAKIYPKPIKTELIEYTAFYPAEQYHQDYYKKSSLKYKYYRHASGRDQYLDKVFGDDRIEQPKTLRQLIDEKALTKNAKTYSRPSDKEIKAQLTDLQYYVTQKEGTERPFNNEYWDNKEAGIYVDIVSGEPLFSSTDKYKSGTGWPSFTKPISSAYIVTKTDYKLLYPRTEVRSKFADSHLGHVFDDGPAPTGLRYCMNSAAMKFIPVAQMEKMGYGEYLTLFQ

SEQ ID NO: 33825 - protein, 97 aa, Solanum lycopersicum
ASYKVKLITPEGPIEFECPDDVYILDQAEEEGHDLPYSCRAGSCSSCAGKVTAGSVDQSDGNFLDEDQEAAGFVLTCVAYPKGDVTIETHKEEELTA

SEQ ID NO: 33826 - protein, 97 aa, Solanum lycopersicum
ATYKVKLITPEGPFEFDCPDDVSILDRAEETGLDLPYSCRAGACSSCAGKVTAGSVDQSDNSFLDDDQIDEGFVLTCVAYPKSNVTIETHKEEDLVG

SEQ ID NO: 33827 - protein, 299 aa, Burkholderia xenovorans LB400
MSELPDLSQIAPTLKAEILAEALPYIRQYHGKTVVIKYGGNAMTEERLKQGFARDVILLKLVGINPVIVHGGGPQIDQALKKIGKQGTFIQGMRVTDEETMEVVEWVLGGEVQQDIVTLINHFGGHAVGLTGKDGGLIHARKMLMPDRDNPGQYVDIGQVGEVEAINPAVVKALQDDAFIPVISPIGFGEDGLSYNINADLVAGKLAVVLNAEKLVMMTNIPGVMDKEGNLLTDLSAREIDGLFADGTISGGMLPKISSALDAAKSGVRSVHIIDGRIEHSVLLEILTEQPFGTMIRSH

SEQ ID NO: 33828 - protein, 403 aa, Nostoc punctiforme PCC 73102
MSLNWIVPAERIQKLPPYVFARLDELKAKAREQGLDLIDLGMGNPDGATPAPVVEAAIAALKDPANHGYPPFEGTASFRRAITNWYHRRYGVVLDPDSEALPLLGSKEGLTHLAIAYVNPGDLVLVPSPAYPAHFRGPAIAGGKIHSLILKPENDWLIDLAAIPDEVARQAKILYFNYPSNPTAATAPREFFEEIVAFARKYEILLVHDLCYAELAFDGYQPTSLLEIPGAKDIGVEFHTLSKTYNMAGWRVGFVVGNRHVIQGLRTLKTNLDYGIFSALQKAAETALQLPDVYLHEVQQRYRTRRDFLIDGLGELGWDIPRTKATMYLWVKCPVGMGSTDFALNVLQQTGVVLTPGNAFGVAGEGYVRISLIADCDRLGEALHRFKQAGIRYQPEAVVSASG

SEQ ID NO: 33829 - protein, 304 aa, Lachancea kluyveri
MAEKKQSNFAIDFLMGGVSAAVSKTAAAPIERVKLLIQNQDEMIKQGSLDRRYNGIVDCFKRTSEAEGVVSFWRGNTANVIRYFPTQALNFAFKDKIKAMFGFKKEEGYAKWFAGNLASGGLAGGLSLMFVYSLDYARTRLAADSKSAKKGGERQFNGLVDVYKKTLASDGVAGLYRGFLPSVVGIVVYRGLYFGLYDSLKPLLLTGTLEGSFFASFLLGWAVTTGASTASYPLDTVRRRMMMTSGQAVKYDGAFDAFRKIVAAEGIKSLFKGCGANILRGVAGAGVISMYDQLQMILFGKKFK

SEQ ID NO: 33830 - protein, 326 aa, Ralstonia eutropha JMP134
MLTARVIRVHEFGPPEAMQLERMELPPPAEGEVVVRQTAMGFNFIDIYQRRGTYPLPPGTGLGHEAAGVVEAVGAGVRGFAPGDRVAYMNAGLGAYADYRNVPAAKLVRVPDSISDEQAAAVIFKGMTAQYLVRHTHAVKAGDAVLIHAAAGGVGQILSSWAKALGAYVIGTAGSPEKCELARRMGCDVAIDYRSGDWVKAVREATGGRGVRVVYDAVGKDTFLGSLDCAQQFGLVVLYGAASGPAPAIEPELLNKKGCLFLTRPSVFPHNADPDMFRANAKDLFDAVTAGHVKVEIGARFALQDVAKAHAAAESRATTGAIVLLP

SEQ ID NO: 33831 - protein, 540 aa, marine gamma proteobacterium HTCC2080
MATIVSTVHTDSEAFSENRDRMLGFVDQLRRYEQRTEETSNRRLKTFRARNQLTPKERLDALIDPGMPFLQLHSMANFCVEESDREVSVPGASVIVGIGFVSGVRCMVWVDDSGIAAGAATDYTLNVTTSLLKICLRQNLPLVHLVESAGANLLKYKVELWSEFGSVFRDLARLSAKGLPTMVVLHGGSTAGGAYMPGMSDYVIGVKENGMAALGGAALVKAATGEDADDRELGGTEMHASVTGVVEYLVENDAHGLLKAREVMHCIDWNKRLTHFSRQPYSEPRYSAEELAGAIPTDPRTPYDVREILARVVDDSSIEEFKSRYGVSTVCGHATITGVACGFIGNNGPIDTNGATKAAQFIQLCDQSDLPIIFFNNTSGYMVGTQYEHAGMIKHGSKMIQAVANARVPKLSLYVGASYGAGNYGMCGWAYEPDFLFAWPNARTGVMAGQSAATTMTEVAKVGAARKGKPIPESQLEAQGQTIKQHFDAQEDAFYTSGRVLDHGIIDPRDTRKVLAFCLETIIEGRHRSLQSNSFGVARM

SEQ ID NO: 33832 - protein, 439 aa, Pyrobaculum aerophilum str. IM2
MAVDIEKIKQGIPNIVPYAGKYVDPPEGDYVEYTGPGQFKVPDKVVIGYIEGDGIGPEVAYAAIRVANAAVEKAYGKSRKVIWYEVVVGEKAEKIFGNRLPDQSINVLKKIRVFLKAPLETPVGGGFRSINVTLRQLFDLYANIRPVKYFPGLPSPLKRPEVVDLVIFRENTEDVYAGIEWPYNSPEASKIRDFLRREFGINIRDDAGIGIKPISKFGTQRIARLALKFAIENKRRVVTVMHKGNIQKYTEGAFKDWAFEVARNEFREHVVFEDELAQYGGQVPPGKVLVNDRIADNMLQQLLTRTGEYDVILAPNLNGDYVSDEAAGLVGGLGVAPGIDVGDWGMMAEPVHGTAPKYRGKNYVNPTATILALELLFRFLGWREAANYIIKGVETAYREGYFTGDLARQMDEEERKHRVKEVLGTQEFADKVVEIIKRL

SEQ ID NO: 33833 - protein, 335 aa, Thermotoga maritima MSB8
  misc_feature (13)..(13): Xaa can be any naturally occurring amino acid
  misc_feature (15)..(15): Xaa can be any naturally occurring amino acid
  misc_feature (32)..(32): Xaa can be any naturally occurring amino acid
  misc_feature (106)..(106): Xaa can be any naturally occurring amino acid
  misc_feature (227)..(227): Xaa can be any naturally occurring amino acid
  misc_feature (237)..(237): Xaa can be any naturally occurring amino acid
  misc_feature (246)..(246): Xaa can be any naturally occurring amino acid
  misc_feature (290)..(290): Xaa can be any naturally occurring amino acid
  misc_feature (300)..(300): Xaa can be any naturally occurring amino acid
  misc_feature (320)..(320): Xaa can be any naturally occurring amino acid
  misc_feature (324)..(324): Xaa can be any naturally occurring amino acid
MGSDKIHHHHHHXEXRFFVLGAGSWGTVFAQXLHENGEEVILWARRKEIVDLINVSHTSPYVEESKITVRATNDLEEIKKEDILVIAIPVQYIREHLLRLPVKPSXVLNLSKGIEIKTGKRVSEIVEEILGCPYAVLSGPSHAEEVAKKLPTAVTLAGENSKELQKRISTEYFRVYTCEDVVGVEIAGALKNVIAIAAGILDGFGGWDNAKAALETRGIYEIARFGXFFGADQKTFXGLAGIGDLXVTCNSRYSRNRRFGELIARGFNPLKLLESSNQVVEGAFTVKAVXKIAKENKIDXPISEEVYRVVYEGKPPLQSXRDLXRRSLKDEFWAS

SEQ ID NO: 33834 - protein, 443 aa, Ralstonia eutropha JMP134
MDAAKTVIPDLDALWMPFTANRQYKAAPRLLASASGMYYTTHDGRQILDGCAGLWCVAAGHCRKEIAEAVARQAATLDYAPPFQMGHPLSFEAATKVAAIMPQGLDRIFFTNSGSESVDTALKIALAYHRARGEGQRTRFIGRERGYHGVGFGGMAVGGIGPNRKAFSANLMPGTDHLPATLNIAEAAFSKGQPTWGAHLADELERIVALHDPSTIAAVIVEPLAGSAGVLVPPVGYLDKLREITTKHGILLIFDEVITAFGRLGTATAAERFKVTPDLITMAKAINNAAVPMGAVAVRREVHDTVVNSAAPGAIELAHGYTYSGHPLAAAAAIATLDLYQRENLFGRAAELSPVFEAAVHSVRSAPHVKDIRNLGMVAGIELEPRPGQPGARAYEAFLKCLERGVLVRYTGDILAFSPPLIISEAQIAELFDTVKQALQEVQ

SEQ ID NO: 33835 - protein, 324 aa, Picea sitchensis
MERIGSLISSVFGNAEAEKPAAKVKAIYIYPIKACRGISLPQVCVCPTGFRWDRQWLVVNSKCRAYTQRPEPKLALVEVSLPMEAFSEEWEPTADSFLTVKAPGMDPLKVPLLQQNREKVENVSMWEWSGSALDEGADAADWFSRYLGKPCWLVRFDTASEVRPTPAEYARGFKTMFSDEYPFLVISQESLDTLNKQLKEPLPINRFRTNIFVENCEPFAEDLWKTLRINGLTFHGVKLCARCKVPTVNQETGIPGNEPAETLSKFRSGDILFSGKKKRGEVFFGQNLICEESLNPKVCKAKTINVGDSVYVLKMASSWEEAAA

SEQ ID NO: 33836 - protein, 505 aa, Ralstonia eutropha JMP134
MNIAENRQIAEIHHYIGGTVRPGASARFADVFNPATGEVAARVALGTAQEVSDAVAAAKAAFPAWADTPPLRRARILFKFKELLDKHHDDLAALITREHGKVFSDAKGEVTRGVEIVEFACGIPNLLKTDFTDNVGGGIDNWNLRQPLGVVAGITPFNFPVMVPMWMFPVALACGNTFVLKPSERDPSPSLLIADLLKQAGLPDGVFNVVQGDKVAVDALLANPDVQALSFVGSTPIAEYIYTEGTKHGKRVQALGGAKNHLVVMPDADLDQAVDALIGAGYGSAGERCMAISVAVAVGDVADKLVPRLAERAAALKIRNGMEADAEMGPLVTGAHKAKVEGYIAKGVEEGATLVTDGRGHKVEGHENGFYVGGTLFDHVTPDMTIYKEEIFGPVLSVVRVHDFAEAVALINAHEYGNGVSCYTSDGGIARAFARQIQIGMVGINVPIPVPMAWHSFGGWKRSLFGDHHAYGEEGVRFYTRYKSVMQRWPDSIGKGAEFMMPVAK

SEQ ID NO: 33837 - protein, 465 aa, Ralstonia eutropha JMP134
MSLFRTKNIDAMLAVAHNDGLKKVLGPMDLVMMGIGAIIGTGIFVLTGTGALTAGPALTVSFVIAAMACGFAALCYAEFASAIPVSGSIYTYSYATLGEIIAWMIGWDLLLEYGLATSAVSVGWSGYFQSLVSGFGVKLPAALTAAPGAVPGVETMVNLPAVLIMLAITWIVSYGVKESARLNNVMVAIKIGVVLLFIAVGVWHVKPANWEPFAPFGMTGVFNAAALVFFAFIGFDAVTSAAEEVRNPSKDLPIGIIGSLAVCTVLYVVVAAIMTGIVPFAKFAGVDHPVSLALQYAGKNWVAGFVDLGAILGMTTVILVMTYGQTRIIFAMSRDGLLPERLSSVHPVHATPYFATWTVGIVFAAIAGFVPLNVLAELINIGTLAAFTLISIAVLVLRRTRPDLPRAFRCPGVPVVPLLSAGFCLFLMAHLQALTWIAFLVWLVIGLAIYFLYARRNAVLHNHGG

SEQ ID NO: 33838 - protein, 87 aa, Triticum aestivum
GELGPTSHAPGRHGRGISVVAAEVASLPGRYEALWKEVDGVKQLWKNRKELRVEDLGIATLFGVELYAWFCIGEIAGRGFTLTGYKV

SEQ ID NO: 33839 - protein, 237 aa, Bacillus cereus G9241
MKKYALVTGGSGGIGSAISKQLIQDGYTVYIHYNNSEEKVNELQKEWGEVIPVQANLASTDGAEQLWNQIEHPLDVIVYAAGKSIFGLVTDVTNDELNYMVELQVKSIYKLLSMALPSMIQRRSGNIVLVSSIWGQIGASCEVLYSMVKGAQNSYVKALAKEVSLSGLRVNAVAPGAIETEMLNVFSEEDKNEIAEEIPLGRLGLPEEVAKTVSFLVSPGASYITGQIIGVNGGWHC

SEQ ID NO: 33840 - protein, 338 aa, Bifidobacterium longum DJO10A
MSERNEHNDGNTQTAYFAGGCFWGLERYFQNVDGVTDTTVGYAQSTVESPAYEQVCAGGTDAAETVKVEFNPAQVSLRTLTLLFLEVIDPFSVDQQGEDRGRQYRTGMFYTDETQRAVYVAALEQLVDRQPQRPAVLVEPLRNFYPAEAHHQDYLVNNPGGYCHVPIAAIANVKRRQKYVERIWDLTLEQFAVTQNAATERPFVNEYDEEFEPGIYVDIVSGEPLFSSRDKFDSGCGWPAFSRPIAGDLLTEHEDHRIPGRDRIEVRTSDTQIHLGHVFTDGPADRGGLRYCMNSAALRFVPRSRMAEEGYGDWIAVVDGMIRHEHGEYRGRSQARQA

SEQ ID NO: 33841 - protein, 204 aa, Thermobifida fusca YX
MSTPDPAAPTGSVPVLNIANILTVSRIVMVPLFIVLLLQDGFWWRLAAFAVFVGAAITDRVDGELARRHNLVTDFGKIADPIADKALTGAALILLSWIGELWWWVTAVILIREWGVTALRFAVIKYGVIPASPGGKLKTALQIVAICVYLFPLPSEWYLQLPAHTIMAAAVAVTLWTGVDYVFKAFRLYQRARHKQPSREGGRD

SEQ ID NO: 33842 - protein, 310 aa, Nocardioides sp. JS614
MTVDPQIAALLEFIASVEAKPMSEGTPEEARQGFRTLTVDLRDPAAVPAVRSVEETTVPGAAGDLPARVYRPGLDGPLPTIVLLHGGGFVIGDLDTHDITARTLANGCAAVVVSVDYRLAPEHPFPAPVDDAVAAARHVADHLADFGGDDRVALAGDSAGGNLSAVVAQAFREEGRPLAGQLLIYPVTDMTGEYPSHTENAEGLFLDLATMAWFQQQYAGHLADLADPRLSPLLGDLHGLAPAVVVVAELDPLRDDGLAYATALAAAGVPVEVRRFPGLVHGFVDMGRHSEAAQRALDETCALFRAVLHG

SEQ ID NO: 33843 - protein, 535 aa, Ralstonia eutropha JMP134
MPTLETKLNARSESFKSNAEAMQALVADLKAKVAKLAEGGGDAARDKHLSRGKLLPRDRVQQLLDPGTPFLELSQLAAYDMYDNAAPGAGIITGIGRVAGQECVIVCNDATVKGGTYYPMTVKKHVRAQEIAEQNNLPCIYLVDSGGANLPNQDDVFPDRDHFGRIFYNQANLSKQGIPQIAVVMGSCTAGGAYVPAMSDESIIVKNQGTIFLGGPPLVKAATGEEVTAEDLGGADVHTRLSGVADYFAQNDHHALSLARNIVQHLNRRKPDQIRLHAPADPLYPVEELYGVIPTDTRKPFDVREVISRIVDGSEFDEFKARYGTTLVCGFARIWGYPVGIIANNGILFSESALKGAHFIELCCQRKIPLVFLQNITGFMVGRKYENEGIARNGAKMVTAVATAQVPKFTVIIGGSFGAGNYGMCGRAYSPRFLWMWPNARISVMGGEQAASVLATVRRDGIEAKGGNWSAEEEEAFKQPIRDQYEHQGHPYYASARLWDDGVIDPAQTRTVLGLGLSASLNAPIDDMKFGVFRM

SEQ ID NO: 33844 - protein, 237 aa, Haemophilus influenzae R2866
MNIQHNLNLIQQKIETACKEENRNQNTVKLLAVSKTKPISAILSAYQAGQTAFGENYVQEGVEKIQYFESQGVNLEWHFIGPLQSNKTRLVAEHFDWMQTLDRAKIADRLNEQRPTNKAPLNVLIQINISDEESKSGIQPGEMLTLAKHIENLPHLCLRGLMAIPAPTDNIAEQEAVFRKMSDLFEQLKQALPNQQIDTLSMGMTDDMPSAIKCGSTMVRIGTAIFGARNYSTSQNK

SEQ ID NO: 33845 - protein, 685 aa, Pisum sativum
MTTSFAAAALRDPKLQIPNYHGLRSSSAASSLSRNALSVPSSTRSSSLIRAVSTPAKSETATEKKRSKVEIFKEQSNFIRYPLNEDMLTDAPNLSEAATQLIKFHGSYQQYNRDERGSRTYSFMIRTKNPCGKVSNQLYLTMDDLADQFGIGTLRLTTRQTFQLHGVVKKDLKTVMGSIIRNMGSSLGACGDLNRNVLAPAAPIVSKDYLFAQETSENIAALLTPQSGFYYDVWVDGERFMSAEPPEVIQARNDNSHGTNFTDSPEPIYGTQFLPRKFKIAVTVPTDNSVDILTNDIGVVVVTGDGGEPQGFNLYVGGGMGRTHRMETTFPRLAEPLGYVPKEDILYAVKAIVVTQRENGRRDDRRYSRMKYLIDSWGIDKFRNVVEEYYGKKFEPFRSLPEWEFKSYLGWHQQGDGGLFCGLHVDNGRIAGKMKTALREVIEKYHLNVRLTPNQNLILTDIRAAWKRPITTILSQAGLLLPRYVDPLNITAMACPAFPLCPLAITEAERGIPSILKRIRDMFEKVGLKYNESVVVRITGCPNGCARPYMAELGLVGDGPNSYQIWLGGSSNQTSIARSFMDKVKPQDLEKVLEPLFYHWKQKRQSKESFGDFTVRLGFEKLKEFIEKWEGPAVPPTRHNLKLFTDKDTYEAMDGLAKLQNKNAHQLAMEVVRNYIASNLNGKGE

SEQ ID NO: 33846 - protein, 404 aa, Bacteroides fragilis YCH46
MEPIRLNTIEEAIADFKEGNFVIVVDDEDRENEGDFIIAAEKITPEKVNFMLTHGRGVLCAPITEERCAELELDMQVSSNTSIYETPFTVTVDLLEGCTTGVSMHDRAMTIRALADPKTKPADLGRPGHINPLRARSRGVLRRAGHTEASVDLAKLAGLYPAAALIEIINEDGTMARLPQLVEVARRFGLKIISIKDLIAYRLQMESIVDRGVEVDMPTQFGHFRLIPFRQKSNGMEHIALIKGTWDTDEPILVRVHSSCMTGDIFGSCRCECGEQLHKAMEMIEAAGKGVIVYMNQEGRGIGLMNKIAAYKLQEEGYDTVDANLHLGFDADERDYGVGAQILREIGVKKMKLMTNNPVKRIGLEAYGLEITENVGIEIKPNPYNERYLKTKKDRMGHTLHFNK

SEQ ID NO: 33847 - protein, 439 aa, Chromobacterium violaceum ATCC 12472
MKVTVIGSGYVGLVTGTCLAETGYHVCCLDVDPRKIEILQSGGIPIFEPGLEDMVKRNVAAGRLHFTTDVAASVAFGDIQFIAVGTPPDEDGSADLQYVLAAARNIARHMTDYRVVVDKSTVPVGTADKVRAAIADELAARGADIPFSVVSNPEFLKEGAAIDDFMRPDRVVIGADDDRAAEIMRRLYKPFQRSHERVLLMDVRSAELTKYAANAMLATRISFMNELANLAETMGADIEQVRQGMGSDPRIGYHFLYPGVGYGGSCFPKDVKALVQTAKENGHTLRVLTAVEEANEVQKLRLVEKVVSRFGEDLSGRRFALWGLAFKPNTDDMREAPSRVIVEELTRRGAEIVAFDPVAAHEAQRVMTGVNGIAFAEDMMKALQDADALLIVTEWKMFRAPDFEAVRRSLKQPLIFDGRNMYDPAWLREQGFDYHAIGR

SEQ ID NO: 33848 - protein, 286 aa, Alteromonadales bacterium TW-7
MWKAINEHISQATNTDFKHTQKRQLQSTTTDRYFHISNSTQSYFVKIALKSELERLESESRGLQMLANNSYFNVPTCITSGANIEFSFIVLTWLDLDEQPYCQWQKMGTQLAQMHQKHDQAMFGFDIDNHLGTTVQPNRWHKKWDVFFAEERIGWQLQLLAEKGIKFANPEHIINEVKAQLHSHVVSPSLLHGDFWRGNLGFLKEVPTVFNPACYYGDREVDIAMSELFAPLPDEFYVAYNKQYPLLPSYQKRKHIYQLYPILNHANIFAGHYLTEAKQHIDKLMQ

SEQ ID NO: 33849 - protein, 397 aa, Bacteroides fragilis YCH46
MNQLSDRLNSLSPSATLAMSQKSAELKAQGVDVINLSVGEPDFNTPDHIKEAAKKAVDDNFSRYSPVPGYPALRNAIVEKLKKENGLEYTAAQISCANGAKQSVCNTIMVLVNPGDEVIVPAPYWVSYPEMVKLAEGTPVIVTAGIEQDFKITPAQLEAAITPKTKALILCSPSNPTGSVYSKEELAGLAAVLAKYPQVIVVADEIYEHINYIGKHQSIAQFPEMKDRTVIVNGVSKAYAMTGWRIGFIAGPEWIVKACNKLQGQYTSGPCSVSQKAAEAAYTGSQAPVEEMRQAFERRRDLIVKLAKEVPGFEVNVPEGAFYLFPKCSSFFGKSAGDRKIENSDDLAMYLLEDAHVACVGGTSFGAPECIRMSYATSDENIVEAIRRIKEALAKLK

SEQ ID NO: 33850 - protein, 384 aa, Staphylococcus aureus subsp. aureus NCTC 8325
MKLSLNSNSKYLRAPSIRQFSNRMNNLDDCVNLTIGQPDFPMPDVVKKAYIDAINNDKTSYSHNKGLLETREAISQYFKNRYHFSYDPEEIIVTNGASEAIDTTLRSIIEPGDEIIIPGPIYAGYIPLIEVLGGKPIYIDTTATQFKITPDALESHISPKTKAVLLNYPTNPTGVVLKRNEVLNIVNVLKKYPLFIISDEIYAENTFSGKHVSFAEFEDIRDQLILIGGLSKSHSATGIRIGFLLGPQYLIDKLTFMHAYNCIFANVPAQIACITALNEGLEAPKYMNEAYVERRNYLVSELTKLGFEITAQPEGAFYIFPSIKHITDDDFEFCVDLLESTHLAIVPGSSFTEFGKGFVRISYAYEMDVLKEGMKRLAKYLNTK

SEQ ID NO: 33851 - protein, 400 aa, Burkholderia xenovorans LB400
MNTVTLKPSKEKSLLRRHPWVYANAIDRIDGNPAPGATVLVRAHDGRFLARAAYSPHSQIRARVWSFDETEPIDHAFFKRRVQRALAHRQTMVHDTGAVRLIFGEADGLPGLIVDHYVAEDEGQRSQLVCQFMAAGVEAWKEAIVAALTGATGCPNVYERSDVSIRQKEGLEQITGVLAGEPPSEALIVSENDVRYHVDVRNGHKTGFYVDQRDNRPLVQQLAQDRDMLNCFCYTGGFSLAALKGGAKRVVSIDSSGDALAIAQQNVAANGFDAERATWLDADAFKTLRRLYDDGERFDLVVLDPPKFAPSREHVDRASRAYKDINLTGLKLLRPGGLLFTYSCSGAIDSELFQKIISGAAADARVDARILKRLGAGMDHPLLTAFPEGEYLKGLLLQIA

SEQ ID NO: 33852 - protein, 194 aa, Picea sitchensis
MASAIMSSAAAMAAVAAPLKTSNGNGSSSSGNVVSAFTGLKSTAQFPSSMKTNNAGAELEQKTTSNGGRVRCMQVWPPYNNPKFETLSYLPRLTQEQLLKEVEYLLKNKWVPCLEFDEDGIIKRKYGSTPGYYDGRYWVMWKLPMFGCTEASQVLNEVNECAKAYPKAFIRVIGFDNVRQVQCISFIVHKPEYN

SEQ ID NO: 33853 - protein, 98 aa, Triticum aestivum
NEEVALEVATIPLDEVIPDAERVVLIKIDVQGWESHVLRGASKLLSRRRGEAPYLIYEEDERLLQASNSSAQEIRAFLGSVGYNQCTRHGTDAHCTKE

SEQ ID NO: 33854 - protein, 608 aa, Caulobacter crescentus CB15
MADHDDLSPDSAPPWDEAPAERDENTADIFGDAPAPAAEARPVVETPPEGEKGDAYTVLARKYRPRTFEDLIGQEAMVRTLANAFSTGRIAHAFMLTGVRGVGKTTTARLLARALNYETDTVKGPSVDLTTEGYHCRSIIEGRHMDVLELDAASRTKVDEMRELLDGVRYAPVEARYKVYIIDEVHMLSTAAFNALLKTLEEPPPHAKFIFATTEIRKVPVTILSRCQRFDLRRVEPDVLVKHFDRISAKEGARIEMDALALIARAAEGSVRDGLSLLDQAIVQTERGQTVTSTVVRDMLGLADRSQTIALYEHVMAGKTKDALEGFRALWGFGADPAVVMLDVLDHCHASAVSKALGPDALSMPKEQAARLAAIGAHTSAGTLSRLWQMLLKAHDEVRRAPDAMAAAEMALIRLCYAADLPGPEEALKALRDGAPVGGGGPGGGVAIGGGGAGGATASAQSPVMMAAPGAQAMPVLASFDDVMALIAAKRDIGLRLDVEQYVRPINFRPGAITFEAAPGAPGNLAGRLVRFLKEHTGQPWLVAAEGGGGAESLMERQKREEREALEAIKQDPFVASVLSAFPGAEIVEIRKILTPETAPLEPDEEEG

SEQ ID NO: 33855 - protein, 508 aa, Ustilago maydis 521
MISGLLSRSSVGPARAFQASTLPRVVSTLPRVHSRGLATGADPYDVVVIGGGPGGYVAAIKAAQLGLKTACVEKRGALGGTCLNVGCIPSKAMLNNSHLYHQAQHDFKSRGIDVGSISLNLETMLKAKSSAVTGLTKGIEGLFKKNKVDYLKGAGSFSSPTTIKVALNDGGETEIEAKNIIIATGSEVTPFPGIEIDEKQIVSSTGALELQKVPEKMIVIGAGVIGLEMGSVWSRLGAKVEVVEFLSTVGGAGIDGEIAKNFKKTLEKQGLKFRLGTKVIDAEKKDGKVYLNVEDAKSGDKTQLDADVVLVAIGRRPVTSGLNLEAVGIEKDERGRIIVDDQYNTTCKGVKCIGDATFGPMLAHKAEEEGIAAVEIIKSGHGHVNYAAIPAVVYTHPEVAWVGKNEEELKKEGVEYKVGKFPFLANSRAKTNADSDGTVKFLVEKETDKVLGVHIIGPNAGEMIASAVLAIEYQASAEDIARTCHAHPTLSEAFKEAAMASYSKAIHF

SEQ ID NO: 33856 - protein, 397 aa, Synechococcus sp. WH 7803
MLTSERLARLGSGVFDRNDRRKAQYCLGDRHPQQPLIDLSLGSTDLAPPAEVIAAMATALQEPVSASYCLHAGTEAFRHAAAAWCERRFGVAVDAETEVLLLVGSQEGTAHLPMAVLDPGDSALILDPSYPSHRGGLELADARIHTLPLQAERGWAPDFSALTTEQWRQLRLMVLGFPHNPTACTGDQTWLDEAMAHCHRHDLVLAHDNPYVDLALEGEAPALLRCPHWKERGIEFFSLSKGWCLGGFRLAFAVGAAPLISALRQLKGVVDFNQCRALQQGAVLALDRHADWPGSLRPVYRQRRDRMLSALAGIGWSVPEPSMALYLWMPLPPWVHSRGWSDERLAAEVLEHCGVALTPGSGFGTAGAGWLRLALVRPVMELEAAVDRLAPWWALQS

SEQ ID NO: 33857 - protein, 367 aa, marine gamma proteobacterium HTCC2080
MATDEQLETIRARIDAIDGQLLALISDRARCAQEVAEIKLAAVQSDTQASPMFYRPEREAQVLRAIQDRNPGPLPGDYMARIFREIMSSCLALEKPLSVAFLGPVGTYTQAAARKHFGQSALPHAQSSIQAVFREVEERRCDFGVVPVENSTEGMIGQTLDCFLESPLHIVGEVELPVVHHLFVGQATGNAEIGKICGHPQALAQCRTWLETHLPQVPLEPVASNGEAARRAQFEMGVAAIAGDIAAEMYTLEKREVSIQDYASNTTRFLVLGRDFVPESGKDKTSVIIASRNRPGALLNLLRPFEDAGISLTRIDSRPSKTEKWTYVFYIEFEGHLEDQIVDQIMNELEEQSIMLKRLGSYPCAPI

SEQ ID NO: 33858 - protein, 272 aa, Methanocaldococcus jannaschii DSM 2661
MNKAVIYTLPKGTYSEKATKKFLDYIDGDYKIDYCNSIYDVFERVDNNGLGVVPIENSIEGSVSLTQDLLLQFKDIKILGELALDIHHNLIGYDKNKIKTVISHPQALAQCRNYIKKHGWDVKAVESTAKAVKIVAESKDETLGAIGSKESAEHYNLKILDENIEDYKNNKTRFILIGKKVKFKYHPKNYKVSIVFELKEDKPGALYHILKEFAERNINLTRIESRPSKKRLGTYIFYIDFENNKEKLEEILKSLERHTTFINLLGKYPVFD

SEQ ID NO: 33859 - protein, 337 aa, Magnaporthe grisea 70-15
MSPSTESNPVPPYPLHPSVASRINPEYAAFYNAHIADKQQVHLQPIAASRSSGVLIPGAGPLLPVGSTQDYTIPRTASSGPDVRVRVFTPPGARPASGWPGCVYFHGGGWVLGTIDTENVVCSNLCARGGAVVVTVDYRLAPEDPFPAAVDDCWEAVRWVVARGPELLGLDLGRLATGGSSAGGNLAAVMCQRAAVVADHPPFRLQLLSVPVADNTATAETTPSWRENEHTPALPAPKMLWYRRHYLPRESDWAHPEASPLLWDGDWSRLPRAVIVCGELDVLRDEGVAFGDRLNKAGVRADVHVLEGQPHPFLAMDGVLEDGRRAITYFCEALKEL

SEQ ID NO: 33860 - protein, 475 aa, Arabidopsis thaliana
MASQSSVAVISSAAARGESFPDSKKPIGSVRFQQPLRLSFSYCKSGNMSSRICAMAKPNDAETLSSSVDMSLSPRVQSLKPSKTMVITDLAATLVQSGVPVIRLAAGEPDFDTPKVVAEAGINAIREGFTRYTLNAGITELREAICRKLKEENGLSYAPDQILVSNGAKQSLLQAVLAVCSPGDEVIIPAPYWVSYTEQARLADATPVVIPTKISNNFLLDPKDLESKLTEKSRLLILCSPSNPTGSVYPKSLLEEIARIIAKHPRLLVLSDEIYEHIIYAPATHTSFASLPDMYERTLTVNGFSKAFAMTGWRLGYLAGPKHIVAACSKLQGQVSSGASSIAQKAGVAALGLGKAGGETVAEMVKAYRERRDFLVKSLGDIKGVKISEPQGAFYLFIDFSAYYGSEAEGFGLINDSSSLALYFLDKFQVAMVPGDAFGDDSCIRISYATSLDVLQAAVEKIRKALEPLRATVSV

SEQ ID NO: 33861 - protein, 300 aa, Nocardioides sp. JS614
MLVVGESLVDIVHGPDGNTTEYAGGSAANVAVALARLGRRVRFVTAWAADERGRVLADHLARAGVELAGDPHVLARTATAAATIGADGAASYEFDLEWQIPDVSAEPAPLVLHTCSLGAVLEPGADGVLALVERLRDRATISYDVNARPAITGTGPDVVALVERLAAVTDLVKASDEDLAHLYPQLDEEAAARHLLALGPAGVVVTRGGNGAAWFAAHAIVEAASLPVEVADTIGAGDTFGAAVVDALWQRDLLGADHRSELRELDPGVIAEVLAHATRAAAVTVSRPGADPPYRSELEA

SEQ ID NO: 33862 - protein, 86 aa, Micrococcus luteus
MGQEEEKEARLALFRDYQVDAAAMARAADDAIFLHCLPAYRGYEVTAKVIDGPRSVVFDEAENRLHAQKALIAWLLYRSGLAEEPR

SEQ ID NO: 33863 - protein, 215 aa, Vitis vinifera
MEGEKLYMSEDFIEMMWRRTLLLLHVLERGYSFIFTDTDVSWLRNPFPRLTTNLTADLQISTDKFLSSHRPEDNSINTGFYFVRSNNKTIALFQTWYAMKNNSIGKKEQDVLSDLMLKGIFRQLGLEVRALHTLYFSGFCQDSKDFRAVTTVHANCCRSISAKVADLKAVHRDWRRFKAATATNKTVTDVDAATFRWSAHAACVNSWNIPMNTVG

SEQ ID NO: 33864 - protein, 117 aa, Zea mays
  misc_feature (37)..(37): Xaa can be any naturally occurring amino acid
DRTRPAFLDTIYAFVDLYKDQRITPAAGFEARGFIYXPPIALAITAKFVPLTKPIKLPRDVISEEYSLEYGTDKIYMHVGAVHANYRALVIDDLIPTGRTLCPPVKLIERVSSKVVK

SEQ ID NO: 33865 - protein, 319 aa, Brassica napus
  misc_feature (61)..(61): Xaa can be any naturally occurring amino acid
MSKKKYFVLFLYGASKRKRIIYGASQLPLLLFKYLSERKKILNRRKFRQKFSKSNGDSPAXEVTMGFFRRLFGSKKQEKTIHTKNKSKKWSFTTRSSNPTSSSHPSKRRTDEEILDADKHAIAVAAATAAVAEAALAAAHAAAEVVRLTGRGGGRTSSVTQTNRNNRRLAQEYVAAVKIQSAFRGYLARRAFRAFPELVKLQALVKGHIVRKQTADMLRRMQTLVRLQARARASRSSHVSESLSEAEYIKLIAMDHHHNHRSQMGSSRWNAPLYNEDNDKILEVDTWKPHLPSYHKESPRKRGSLVVPTSVENSPQVRS

SEQ ID NO: 33866 - protein, 165 aa, Alteromonadales bacterium TW-7
MIRIGHGFDVHKFGGEGPLTICGEKIDYPQGFLAHSDGDVAIHALCDAILGALAMGDIGKHFPDTASEYENIDSRILLRHVVKLAKDQGYVLGNGDVTIVAQAPKMLPHIQAMRVNLASDLNCDLSQINVKATTTEKLGFEGRKEGISSHAVVIMSKELASTKNV

SEQ ID NO: 33867 - protein, 375 aa, Vitis vinifera
MHRVQEKGKFSSQPQQNSSGAHDIGEKKSENSAKLNEVKAVITLRCGKQVDQLMPKPKENKSWEQEENKALEVVPQDDLEAALSKASMPNKTVIITIVNKAYVEGDDTSMLDLFLESFWIGEGTREMADHLLVVALDQTAFDRCIFRRLHCYKMVSEDGDMDGEKLYMSKDFIKMMWRRTLLLLRVLDRGYSFIFTDTDVSWLRNPFPRLTTNLTADLQISTDLFLSSRRPEDNLINTGFYFVRSNNKTIALFQTWYAMKNNATGKKEQDVLSDLMRKGIFRELGLELRVLHTLYFSGFCQNSKDFRAVTTVHANCCRSISAKVADLKAVHRDWRQFKAATATNKTVTDIDATTFRWSVHEACVRSWNTSRNPVG

SEQ ID NO: 33868 - protein, 303 aa, Arabidopsis thaliana
MEEPCETLDSGEAYQISRYHNYNQHSSRSSSPWLDLRVFYVRISNFVVEDSTPEVLTINHIPLDPDTLLEINGVRMGMYSEGGSSQLRRDRVDKKSEEATYVSTDNIRLTGSVKFEVYDKNELVLSGTLEMSGSNGFTGESKNRWKMNCEAEVTAGSGFLKEKSINGQELSSPLPTIEVYVTGCFSGTPIILTKTLQLGLKKKQSRRMALDAIPEYETAEPQKDTSYALDLQATTEYGNYKEEYEGDMYWRSECIDGEMSWFNAGVRVGVGIGLGVCVGLGIGVGLLVRTYQSTTRTFRRRLL

SEQ ID NO: 33869 - protein, 316 aa, Metarhizium anisopliae
MAEQLILKGTLEGHNGWVTSLATSMENPNMLLSASRDKTLIIWNLTRDETQYGYPKRSLTGHSHIVSDCVISSDGAYALSASWDKTLRLWELATGTTTRRFVGHTNDVLSVSFSADNRQIVSGSRDRTIKLWNTLGECKFTISEKGHTEWVSCVRFSPNPQNPVIVSSGWDKLVKVWELSSCKLQTDHMGHNGYINTVTISPDGSLCASGGKDGTTMLWDLNESKHLYSLNANDEIHALVFSPNQYWLCAATASSIIIFDLEKKSKVDELKPEFTAVGKKSREPECVSLAWSGDGQTLFAGYTDNIIRAWGVMSRA

SEQ ID NO: 33870 - protein, 908 aa, Oryza sativa
MATANLLYAALLVPTVLYLAVTRRRSRRLPPGPVGLPLVGSLPFIDPNLHTYFASLAAKHGPILSIRLGSKVDIVVNSAQLAREVLRDQDSVFANRVMLDAGDAVSFGGAQNIVGNPLGPMWRLLRRVCVQEMMSPAGLASVHGLRRREFRSTLRYLHSKPGEPVDVGAQMFLNTMNVITGTMWGGTIGSESERSAVGSEFRGLVAEVTELLGTPNVSDLFPVLKPFDLQGIRRKMERLRSRFDLLFTKIIQQRMRSQQDGGEMTTDFLECLLKMEKEGSDGKTTFTMDNVKGFLLEMVVGGTDTTSNSVEWIMAELLQNPQVLNKVQQELDSIVGRDAVVEESHLPQLHYLRMVIKETLRLHPPVPLLVPHSPSAAATVGGYHVPEGCRVLINVWAIQRNPLVWNKPLDFNPDRFARDGGHKGDFTGSQLDYLPFGSGRRMCAGMAMGEKVMVYSVAMLLQAFDWKLPQGVQLDLSEKFGIVMKKATPLVAIPTPRGGEVGGGVGTGGGLMEGRRWHLRAVLSAVEGAAGQRLHAAEAELGRNAEHDETPSLSGMGTGRAVASNSTGNGGGRSVGAGRATTAARAAGRSWVEMESSPACERNGASATIGGNRMVAEVQAGSVSVTVATTRRGGGSSGGGARPEMGGGRRSSGWRRLAGAVEGGGGAGAVEDDEGGTGAVEGGSGAGAGGRRRRQRGGGRRRPDAVNGGDGGNAGAVEGGGGPTRVVAAATAAAVATQADAVVGHDGYHRLSPYLHLRPRLGVATGLHPPGLATPSPSPVCKKSPVPIPIPAHGGRIYPVPVPMRVRGTRQRHGVSDGAAAWSRRRRPGVGGDGGALWYPDVDAATQRLGGGWDAAPALWWSAGRCSLPDRWLYMCHVLYLETHGDSGTGSWRMSPSPLHPTGDVFYR

SEQ ID NO: 33871 - protein, 111 aa, Pleurochrysis carterae
IIPVVMAGVLGIYGLIIAVIIGNGVKGPEGGKPQYSSFTGFAHLAAGLACGLSGMAAGIAIGIVGDAGVRASAQQAKLYVGMVLILIFAEALGLYGLIVGLILTSKEAPCS

SEQ ID NO: 33872 - protein, 253 aa, Chlamydomonas reinhardtii
RRFISVRAKASATDSSSHTKNVFVFGLGYTSVALANWLAKEGWPELSARLADSPYVLSSIPPVALALYDPALSAQKSLLRPLAAGGRLAWFGYLSSTGVYGDWQGEWVDESSPCRQTSSKAIVRQEAEAAWQQMCEQHGLPTHIFRLGGIYGPGRSVLDSLRSQPADLSASQERRGRQRYTARCHVYDICAVLKASMAAPRPGAVYNIVDDDPAPRGEHSCLDRQWSATSAPSWTCTLFTASSLPENGMHPYL

SEQ ID NO: 33873 - protein, 508 aa, Glycine max
  misc_feature (173)..(173): Xaa can be any naturally occurring amino acid
  misc_feature (181)..(181): Xaa can be any naturally occurring amino acid
MDYHTTVLLLITFVSATIILIFIRRLFNQTSESEYAKLPPGPRPFPIIGNILELGTNPHIALTKLSKIYGSLMTFKLGRITTLVISSPQVAKEVLLENGQVLSSRTIPHSVHALDHHIYSTVWLPPSAQWRNLRRVCATKIFSPQLLDSTQILRQQKVKDLLDFVKERCKKGXAVDIAEGXFTTILNSISTTFFSMDLPDSTSEKSHEFMNIIRGIMEEIGRPNVADLFPILRPLDPQRVLARTTNYFKRLLKIIDEIIEERMPSRVSKSDHSKVCKDVLDSLLNDIEETGSLLSRNEMLHLFLDLLVAGVDTTSSTVEWIMAELLRNPDKLVKARKELSKAIGKDVTLEESQILKLPFLQAVVKETLRLHPPGPLLVPHKCDEMVNISGFNVPKNAQILVNVWAMGRDPTIWENPTIFMPERFLKCEIDFKGHDFKLIPFGAGKRICPGLPLAHRTMHLIVASLVHNFEWKLADGLIPEHMNMEEQYAITLKKVQPLRVQATPIKRD

SEQ ID NO: 33874 - protein, 353 aa, Myxococcus xanthus DK 1622
MVISLPHESAPAVPVGGAAHFSLSSSARVLGTLHLGPGANIAQGAVVRSHEGAVRLGAGSAVLENGVIIGLPQQPVTVGERTFLDHRSIVLGAEVGALCDVGGASILMPGARIGTRCLLAEGTLIPAGTVVPDDSVVVGRPGRILRRTTADDLERLRKRRGGSLDLPGQPLTAFSARDRAEDAPMGQLYTFRDKHPLVHPTATLFSSAEVTGDVIIGPGCIIGPGVKILGDGNGPVRIGAGVQVLANTVLHRLSDHTLTLEDGAIIGPGCTVHGSHVGANTVVEPGAILCDGTRLGRGSFVGAGSLVKQGSAFADGAHIEGFPATQTGTLASLPPVPRWALRPEDLPGLRRIG

SEQ ID NO: 33875 - protein, 306 aa, Caulobacter crescentus CB15
MKALSIPDVLAEVAVLVRPHFGKGKPADYIPQLATVPGGKFGMAVRMVDGDEHVIGDADEGFSVQSITKVFALGLALNRLGDEIWTRVGKEPSGTPFNHLSLLEAEQGVPRNPFINAGALAVTDVLMDVTRDPAALVRDFGGFLCGERLEIDPAVATSELAHAWQNRAIASLMRAKGTITHDPEAVVAAYCRQCALSMSCRQLARAFLPLAAGGFSPIAQETVFPERLTRRLNALLLTCGIYDSVGSFAYRVGLPAKSGVGGGIVAVVPGKATVAVWSPELDRFGTSVVGTAALEAFSQITNCSVL

SEQ ID NO: 33876 - protein, 398 aa, Pseudomonas putida
SGNRGVVYLGSGKVEVQKIDYPKMQDPRGKKIEHGVILKVVSTNICGSDQHMVRGRTTAQVGLVLGHEITGEVIEKGRDVENLQIGDLVSVPFNVACGRCRSCKEMHTGVCLTVNPARAGGAYGYVDMGDWTGGQAEYVLVPYADFNLLKLPDRDKAMEKIRDLTCLSDILPTGYHGAVTAGVGPGSTVYVAGAGPVGLAAAASARLLGAAVVIVGDLNPARLAHAKAQGFEIADLSLDTPLHEQIAALLGEPEVDCAVDAVGFEARGHGHEGAKHEAPATVLNSLMQVTRVAGKIGIPGLYVTEDPGAVDAAAKIGSLSIRFGLGWAKSHSFHTGQTPVMKYNRALMQAIMWDRINIAEVVGVQVISLDDAPRGYGEFDAGVPKKFVIDPHKTFSAA

SEQ ID NO: 33877 - protein, 417 aa, Methanocaldococcus jannaschii DSM 2661
MIMFLTLDDFNFEDKRVVLRVDINCPIDPNTGEILDDKRIREIKSTITELINKGAKVVILAHQSRPGKKDFTTLKNHAKVLSDVIGKEVEYIDEVIGSTAREAIINMKCGDVILLENVRFYSEEVLSDWKKWENITPKKQAETNLIKRLAPLFDYFVNDAFAAAHRAQPSLVGFSYYMPMIAGRLMEREVGVLSKVLENPEKPCVYVLGGAKADDSIRVMKNVLENGTADKVLTSGIVANIFLVAMGYDLGVNMDIIENLGLKSQIEIAKELLNKFEDKIVVPVDVALNINEERVEADLNKDEKVEHLINDIGEKTIELYSEIINEAKTIVANGPAGVFEKEAFAKGTEELLKAIANSKGFSVIGGGHLSAAAELFGIADKIDHVSTGGGATLDFLAGEKLPVIEMLKESYKKYKGQ

SEQ ID NO: 33878 - protein, 504 aa, Oryza sativa Indica Group
MDGGRCCSALQPLPPWMMDDGFMVGWCHGGAAAIGGMWLGLLVRPPPMCVGLHGDRFVEMGVIWYQIFLFVKDETGVYKNLLQEVAQRVGAPLPSYTTERSGLGHLPVFTCTVELAGITFTGDPAKNKKQAEKNAASAAWSSLRQLVRQEASSSNEPESNDEQEQIRIARALLNYRLKEKMAMANNPHASPFPKKFPMQPERRTAFPQSSHSSYSKILPLFRPKSNSRSRPESPAASDAASQTPFRPTESPNPRSRFPAAEAAPYVPVGHFRMPCHSMAPPVTVRTSIPVFSAPPLPPPGARTQQLPPLMSHPPPIRMASPVRIRPAPPLFTPSAVQGPKPMMPVQIKDVQHQQIKETRSPVMPVQVKDAQNQLLKGSLSPVIPVQIKDVQSQPPKEALSPAIPVQIKDVQLQPRNEPVSIGKGVVPLPAIRPPVKVEAPAEVKEASQPVAGSSVVQCKADTSPDSLPKTQLKTANADNADAKDDHLPVDAEEVEDIIRHLELK

SEQ ID NO: 33879 - protein, 312 aa, Bacillus cereus E33L
MKKVYFNHDGGVDDLVSLFLLLQMDNVELTGVSVIPADCYLEPAVSASRKIIDRFGKNTIEVAASNSRGKNPFPKDWRMHAFYVDALPILNESGKIATHVAAKPAHHHLIETLLQTEEKTTLLFTGPLTDLARALYEAPIIENKIKRLVWMGGTFRTAGNVHEPEHDGTAEWNSFWDPEAVVRVWEANIEIDLVTLESTNQVPLTIDIREQWAKERKYIGIDFLGQCYAIVPPLVHFAKNSTYYLWDVLTAAFVGKADLAKVQTINSIVHTYGPSQGRTVETDDGRPVHVVYDVNHDRFFDYITGLAKKVST

SEQ ID NO: 33880 - protein, 217 aa, Picea sitchensis
MAMKPILYRERGASLVLQADSCRAKPNSFHNLVKSRYFSGNLKPISGACHHRWHAGRDVQGNYSKVASEEQQSMSLYDLLGIPKNGSLAEIKQAYKQLARRYHPDVCPNPDQSEEYTRRFVQVQEAYEVLSDPPRRALYDQHLAMGFKHYSYSTFSARKRRQYCTQQDVGREDWKSRWESQLAGLKRRSAYKDAGRPLSWAARVRRENAQSSQPSEE

SEQ ID NO: 33881 - protein, 263 aa, Neisseria meningitidis MC58
  misc_feature (1)..(1): Xaa can be any naturally occurring amino acid
  misc_feature (11)..(11): Xaa can be any naturally occurring amino acid
  misc_feature (70)..(70): Xaa can be any naturally occurring amino acid
  misc_feature (110)..(110): Xaa can be any naturally occurring amino acid
  misc_feature (124)..(124): Xaa can be any naturally occurring amino acid
  misc_feature (142)..(142): Xaa can be any naturally occurring amino acid
  misc_feature (157)..(157): Xaa can be any naturally occurring amino acid
  misc_feature (189)..(189): Xaa can be any naturally occurring amino acid
  misc_feature (258)..(258): Xaa can be any naturally occurring amino acid
XNVYFLGGGNXAAAVAGGLVKQGGYRIYIANRGAEKRERLEKELGVETSATLPELHSDDVLILAVKPQDXEAACKNIRTNGALVLSVAAGLSVGTLSRYLGGTRRIVRVXPNTPGKIGLGVSGXYAEAEVSETDRRIADRIXKSVGLTVWLDDEEKXHGITGISGSGPAYVFYLLDALQNAAIRQGFDXAEARALSLATFKGAVALAEQTGEDFEKLQKNVTSKGGTTHEAVEAFRRHRVAEAISEGVCACVRRSQEXERQYQ

SEQ ID NO: 33882 - protein, 304 aa, Caulobacter crescentus CB15
MTDVAEEAGWATAKTLAEALPYIQIYDRETVVIKYGGHAMGQEDVAKVFAADAVLLKLLGVHPVVVHGGGPQISRMLDKAGVKSTFVDGLRVTDEATMEVAEMVLSGAINKEIANWITLAGAEADVRGVGLSGKDARLITAEKVTRTKKDPDSNIEQAVDLGFVGEPTKVDPQLIEALLTSEHDYIPVVAPIGVSPDGDTFNINADTVAGALAGALKAKRMLMLTDIKGVLDGNGELIREMTIEQARALIDTGVATGGMIPKLENAIHAIESGVEAVVILDGRRPHAMLVELFSEYGAGTLIKR

SEQ ID NO: 33883 - protein, 184 aa, Synechococcus sp. WH 7803
MIPGLEPVALRELQALGQPRVWEVDGTHDELASLTPIRGRVCAEHRGNILEVEGSLSTIICLRCDRCLGHFNQELNVENRELIWLGSDPSDANVSTPELDAAVPEGLMECLDPRGRFEPERWVFEQLSLQMSVVNFCGDHCPGPPLQTSTPAASTPPTPLKDPRWQALRDLQASMQPPSDQPDD

SEQ ID NO: 33884 - protein, 323 aa, Ralstonia eutropha JMP134
MHHAIRIHETGGPEKLVWDQISVDDPGPGQARLRQTAVGVNFIDIYFRTGLYPLPLPFIPGREAVGVVEAVGPDVTSLKPGDRVVYSGVQGAYAQVRLVPADRLVKLPDGISDEIGAAVMQKGMTAQFLCRQTYQVGKDDTILVHAAAGGVGLVLCQWAKHLGATVIGTVSTEEKAKLVEAHGCDHALIHGKDDFVEVVKEITGGVGVPVVYDSIGKDTFMGSLDCLRPRGLMVLYGQSSGPVPPFDISILDKKGSLFLTRPTQNAYLPTRAKVEEGAQEVFDVVQSGAVKVHINQRFALKDAAEAHLAMESRKTTGSLVLLP

SEQ ID NO: 33885 - protein, 481 aa, Ralstonia eutropha JMP134
MSRLYSNLIAGEFVEGANISRNINPSNTNDVVGEYAQGSVADVNKAVDAAKAAFPAWSRATSQERFDILRKASDEIIARKEELGRLLSREEGKTLAEGIGEVARAGQIFAFAAGECLRAGGEAIPSVRAGVGVEITREPVGIVGMITPWNFPIAIPAWKIAPALAWGNCVVIKPADLVPGSAWALVDIIQRAGLPKGVLNLVMGRGSVVGQALLEHKDVHAISFTGSVATGRKVAATCIASNPMKKVQIEMGGKNPLVVLDDADLNTAVEVAVNGAFFSTGQRCTASSRLVVQAGIHDRFVEACIERLKSIVVDDALKQGTQIGPVVDQSQIDQDLRYIQIAKDEGGKLVFGGELLKRATPGFYLQPALFTETTNAMRISREEVFGPVANIVRVRDYDEALALANDTEFGLSAGICTTSLKYATHFKRSSEAGMVMVNLPTAGVDYHVPFGGRKGSSYGSREQGTYAKEHYTTIKTAYTMA

SEQ ID NO: 33886 - protein, 479 aa, Dechloromonas aromatica RCB
MSTADIGVIGLGVMGVNLALNLSDQGFRLSVYNRTLAVTTEFVATHGLDRVIAAAGSPEELVSHLAPPRIILLMVTAGRAVDAVIGQLLPRLEPGDILIDGGNSNYRDSQRRCRELATQGIHFVGMGISGGEEGARHGPSLMPGGAAAAWPTIRDMFQSIAARVDDIPCCQWLGDGGAGHYVKMVHNGIEYGDMQLIAEVCHLMQHALGMSHDEMADTFAEWNAGRLESYLIDITSRILRQRDKDGSPLVDNILDRAGQKGTGVWTAQDALDHAVPLTLIGEAVHARMLSARKAERVAAAALLGSKPVAVAKTARADCLSALHDALYAAKLVSYAQGFMLMQAAAEAEGWVLPYGEIALLWRAGCIIRSRFLADIKASFSRTPVPPSLLQDPFFIAEIKAAEAGWRQAVMLAVGSGVAAPALSSALAFYDGYRCANGSANIIQAQRDFFGAHSYQRTDRDGSENFHTRWLGDGVEEQLP

SEQ ID NO: 33887 - protein, 202 aa, Azoarcus sp. EbN1
MPCYEIDGLRPVVHPSAFVHPDAVLIGDVIVGARCYVAPLASLRGDFGRIILEQGSNLQDNCVMHGFPNLDTIVEEDGHIGHAAVLHGCRIGRNALVGMNAVVMDNAVVGDSAVVAACAFVKADMLVPPRMLAAGIPAKVVRELTAQEMDWKVDGTRCYHELTVRSLATLKLCVPLAEPEANRPKFDLPPGIVPLVDLKRGK

SEQ ID NO: 33888 - protein, 449 aa, Ralstonia eutropha JMP134
MQTYDYDLFVIGAGSGGVRASRIAAGYGARVAVAEEYRTGGTCVIRGCVPKKLLMYASHFAQAVDDAAGFGWRAPTPVHDWASLIAAKNAEIARLEAIYVRMLQSAGVDAITGRAQIVGPHRVEVNGVIFTAKVILVASGSVPVEPAIQGAELMITSNEAFYLDTLPKRIAIIGGGYIACEFAGIFNGLGSDVTQLYRGQQILRGFDDELRNHLGAEVSKSGVDLRVAVDVAAVGKRGDGLVVHLTTGQAIEVDAVMAATGRRSNTSGMGLESAGVLLDESGAIKVDEYSATSNPDIYAVGDVTNRLNLTPVAIHEGHAFADTVFGGRKRASAHDNVPFAVFSQPQAASVGLTEAQARRRHAKVDVYSSAFRPMRTALSGRDERALVKLVVDASTDRVLGAHIVAADAAEIILGIAVAIKAKATKADFDATLGVHPTLAEEFVTLRNRR

SEQ ID NO: 33889 - protein, 487 aa, Dechloromonas aromatica RCB
MSCATESHAYVIFGATGNLAMAKLLPALYQLHRLGQLAPDVRILGCGRTPHTRDGWRSEVRQRLETSDPALLDRFLQRLDYLAGDLEDAAFYQALDSWIGASDCGNNVIFYLSVSPEFYAPITIRLAQAGLLAERAGWRRMVIEKPFGHDLQSARDLQHELNTHLKEEQIYRIDHYVGKESVQNLLVLRFANMILEPLWNRHYIDQVQITHAETVGLDGRANYYDRHGGATRDMIQSHLLQVLALLAMEPPVSLEAESLRDEKVKVLRSIRPLELPQLASHTVRAQYAGYQQEAGVAAGSHTETYAALKLYVDNWRWRDVPFYLRTGKRLKERRSMVAVRFREPPMQLFQGTGASAVHPNWLLIGIQPDDVVQMEISAKVPGQETRTRQISMDASVGNPGERKADAYEDLLMDVIQGDRSLFLRYDEVKAAWNVVDPVMRGWADDERPPLQYPVGSWGPKAADQIFGQADRAWRQTLSCNGKSEGET

SEQ ID NO: 33890 - protein, 449 aa, Dechloromonas aromatica RCB
MSFSVWALIVGALLITMALAGTLMKRLPVSASMFYLAVGYGLGSAGWGLMAPDPRQVSVILERVAEVALLISLFSVGLKLGLPFSSRHWRLPLRLAFVSMALTIGLITLAGIFLLGMPLGAAILLGGILAPTDPVLAADVQVDEPSDRDRLRFSLTGEGGFNDGAAFPFVMLGLGLLGMHELGSWGWRWIAIDVLWALAGGLLIGSLLGALIGKLVVYLRTRHQEAVGLDEFLALGLVALAFGVAQLLQASGFLAVFAAGLALQRVKERSRHQKAPDEGPAGLQGKDAHLAVATHPNLASAYMMQAVRGFNEQLERIAELVIVLAVGAMLAYVRIDAWAIAFLALLFFVLRPVSVWLGLLGASVSGDQRFLIAWFGIRGIGSVYYLMFALNHGLSGSLADQAINITLLAVAASIILHGVSVTPLMALYGRRQAGRSRRSLSENRRHDIR

SEQ ID NO: 33891 - protein, 474 aa, Anaplasma marginale str. St. Maries
MNLALKYRPRSFDDLVGQDVLVRILRNAFTIGSLSSPILMVGASGVGKTTCARIVSLCLNCVNGPTPDPCGTCHECVSIKNSTNPDVIEMDAASNTGVDDIRVLLENSSYLPTSSRYKVYIIDEVHMLSISAFNALLKTLEDPAEHVRFVMATTEVRKVPVTVASRCHRLDLFKLTTDQLFAHLVEIAKKEDIEHDGDGLRLIAENASGSVRNALFLLEQSAIYTKNKIHVSEVRALLGCVDKHLTENLVKCILLADASSALEVFRELCSQSLPVPILEGVQLIVYELCVTSVSKGHKFDLGRELLSTVRSGSTPFLSRVWQTLTHGLQEVKNADDVQRAGEMMVIRLCYLSDLPSPQKIAGLLLSKSREGAPMHTVKKKVEGATTYSYGTPELESRTMGGTSGESAGPSQVAASESAPTQRVYDNEQRTEPMKKNGVNTHDKVYNPEEDEAVMGVMRDFEGASVVGCYDLVSE

SEQ ID NO: 33892 - protein, 334 aa, Anaplasma marginale str. St. Maries
MLRIGINGLGRIGRCLFRVLFENNIPNVELVAVNGSSSLELHRHLLRNDSVHGRFGCNIGIKEGALLEVGGKTVKFFKEKQPQDIPWEEVGVNVVLECTGKFNNRESSGLHLGGTVKKVVVSAPVADADIQVIFGVNEGAISSEHDVISVGSCTTNCAAHVVKAMDEAFGIEGGFITTVHAYTNDQNHVDGSHKDLRRARACGLSMIPTTTGASKALEVLFPKLSGKLSASSIRVPTPNVSVVDFAFVSSSKATVTSINEALCKAATARPDVLMASDEQLVSSDFNHTTYSAVFDLMETYANDGGVSRVLAWYDNEWAFATRMVDVSRELLRFL

SEQ ID NO: 33893 - protein, 476 aa, Acidovorax sp. JS42
MWIFVASTDYYRDQQCAHSLQEIAMSFAVIDPNPAAAVRTDAAWLEAHWMPFTGNRNFKAQPRMIVSGQGAYYTDAEGRKIFDGLSGLWCSGLGHGRTEVAQAIGRAAATLDYAPAFQFGHPASFALANKLKELTPAGLDYVFFTGSGSESADTSLKMARAYWRAKGQGTKTRLIGREKGYHGVNYGGISVGGIVGNRKLFGQGVEADHIPHTQPPAGTFQKGMAEDGGRALADKLLDVIALHDASNIAAVIVEPFSGSAGVVIPPKGYLERIREICTQNNILLIFDEVITGFGRCGTWTGAEAFGVTPDILNFAKQVTNGAQPLGGVIATKEIYDTFMAQGGPEYMLEFPHGYTYSAHPVACAAGNAVLDILQKEDMPGRVKALAPYFENAVHGLKGAKHVADIRNYGLAAGITISALPGEPAKRPYEIAMKCWEKGFYVRYGGDTIQLAPPFISTQAEIDRLVSALGDALHETA

SEQ ID NO: 33894 - protein, 505 aa, Acidovorax sp. JS42
MHHDKNVTTTVSHLIDGKLVADTERTQPVFNPATGQSTTSVALASKATVEAAIASAEAAFPAWRNTPPLKRARVLAKLKVLLEENADKIAALITAEHGKVLADAHGELQRGIENVEYASYAPELLKGEHSRNVGPGIDSWSEFQALGVTAGITPFNFPAMVPLWMWPMAVACGNTFVLKPSERDPSSTLFIAQLALEAGLPPGVLNVVNGDKLAVDTLLQDPRVKAVSFVGSTPIAEYIYAEGCKHGKRVQALGGAKNHAVLMPDADVDNAVSALMGAAYGSCGERCMAIPLLVAVGDAVGDAVIAGLKAEIAKMKVGPGTDNSNDMGPLVTKPHFEKVKAYVDSGVAEGATLVVDGRGVQVAGHEEGYFLGACLFDNVKPGMKIYQEEIFGPVLGVVRVKTLQEAMQLINDHEYGNGTCIFTRDGEAARYFTDHIQVGMVGVNVPLPVPVAYHSFGGWKRSLFGDLHAYGPDAVRFYTKRKTITQRWPSAGVREGAVFSFPSSR

SEQ ID NO: 33895 - protein, 770 aa, Acidovorax sp. JS42
MPDTPAAPPTSDKRALLRRAALEYHEFPQPGKITIAATKQMVNQHDLALAYSPGVAAPCEEIVKDPAAAFRYTARGNLVGVVTNGTAVLGLGDIGPLAGKPVMEGKGVLFKKFSGIDVFDIEINEKDPDKLIEIIASLEPTFGGINLEDIKAPDCFYIERKLRERMNIPVFHDDQHGTAIVVGAAILNGLKVAGKDPKKIKLVTSGAGAAALACLGLLVKLGIPRENIWVTDLAGVVYEGRTELMDEDKVQYAQKTSARTLAEVIEGADVFLGLSAGGVLKQDMVRKMNARPLIFALANPNPEISPEDVKAVRDDAIIATGRTDYPNQVNNVLCFPYIFRGALDCGATTITTEMEIAAVHAIAELAQAEQSEVVAAAYVGEPLAFGPDYLIPKPFDPRLMMKIAPAVAQAAADSGVAQRPVADMDAYRDHLQTFVYASGTTMKPIFTAAKVAPKKRVAFSEGEEERVLRAAQIVVDEKIARPTLIGRPAIIAQRIEKFGLRLKEGQDYDVVNVEQDHRYRDFWQTYHRMTERKGVTVPIAKIEMRRRLTLIGSMLLHKGEVDGLICGTWGHTSHHLQYIDQVIGKRAGVNTYACMNGLLLPDRQVFVVDTHVNYDPTAEQLAEITIMAAEEMMRFGIKPKAALLSHSNFGSSNQPSAVKMRQTLDLLRVQAPWLEVDGEMHGDVALDGKARSALMPHGTLAGDANLLVMPNIDAANISYNLLKTAAGGNIAIGPVLLGAAEPVHILTASATVRRIVNMTALTVADANAAR

SEQ ID NO: 33896 - protein, 177 aa, Physcomitrella patens subsp. patens
QDNYYKDNPHLSLAERELINYDHPFAFDNELLIEHLSQLKEGQTAYAPVYDFTVHARSSVDKVELTPNNIVIIEGLHVLSDEKLREMLDIKVFVDTDPDVRILRRVLRDIEERGRSIQSIHQQYLATVKPMHEAFIEPSKKYADLIIPEGGENEVGIQLLSILTEKFLTGDRNWSDI

SEQ ID NO: 33897 - protein, 463 aa, Burkholderia xenovorans LB400
MSLFRKKSVEHMIAASAQNAGLKKALGALDLTFLGVGAIIGTGIFVLTGTGAVQAGPALMISFLIAALACGFAALAYAEFASTIPVAGSIYTYSYATLGELAAWIIGWDLMLEYGLATSAVSVGWSGYLQSLLSGFGVSLPVALTAAPGALPGHDTLFNLPAFLVMMAITALLSFGVRESARINNIMVAIKVIVVLLVICVGVFHVTPANWHPFMPNGWNGVFGAAAVMFFAFIGFDSVSSAAEEVKNPKRDLPIGIIASLGVCAVLYVAVAAVVTGIVPSAQFANISHPVSYALQVAGQKWVAGFIDLGAVLGMLTVILVMAYGQTRVIFAMSRDGLLPARLSRVHPRFATPFFTTWLVGIFFGLIGAVVPLNVLAELINIGTLAAFSMVSIAVLVLRKTHPELPRAFRCPGVPVVPVLAVASCLFLMINLQAVTWVAFVVWLLVGMVVYFGYSRRHSRLSS

SEQ ID NO: 33898 - protein, 389 aa, Cyanidioschyzon merolae
MLVSNAMYVLVPCSLKAAQATLRNRKKNSTFVRAKPEQTRILGYARRSPRARQRVQLALTAPPSVALARDVSDLVGNTPIVELKKIPEEEGVQAHILCKLESMEPCSSVKDRIGKYMIVEAEKRGDIQPGKTVLIEPTSGNTGIALAYLAAARGYRLILTMPDSMSIERRMVLRAFGAEVVLTPAAKGMKGAVAKAEQLFHTTPNAYMLQQFNNPDNPKAHYETTGPEIWAATGGKVDAFVAGVGTGGTVTGAGRYLREQNPHVYIMAVEPAESPVLSGGRPGPHKIQGIGAGFVPGILDTKIYNEVKQVTSMDSIEMARRLAVEEGLLCGISSGAAVVAALELGRRPEMKGKNIVVIIPSFGERYLTSALFDKQREEAYNMVAVEVET

SEQ ID NO: 33899 - protein, 390 aa, Cyanidioschyzon merolae
MVQHAANGHAQCSFRPLRYKAETRGRVARSTRERVLLRCLFDMRLVHNVYDSFEDAIGNTPLIKLRRASERTGCNIYGKAEFMEPGGSVKDRAALYLLTDAEKRGTLKLGSIVVEGTAGNTGIGLTLLGNSRGYRTVIVIPETQSEEKKEFLRSCGAELVQVPAAPYRNPNNYVRLSERLAKELGAFWANQFDNPANRRAHEETTGPEIWDQLDGHIDAFNCAVGTGGTLAGVSAFLRAKNPGIKIALTDPQGAALVRYYQCGELVSVGDSITEGIGQSRITGNLEGFVPDMSFEISDAEALQAAYDVVRHEGLHIGLSSGINIAGAIRVAESLGPGHTIVTILCDGGSRYQKKMFQPSFLEQKKLPIPTWLSDSMKPDLAAALSKVYVP

SEQ ID NO: 33900 - protein, 318 aa, Arabidopsis thaliana
MAPSSSSGLTFKLHPLVMLNISDHFTRVKTQLNPPAASCATGNGSNNADAMLLQNPRVYGCVIGLQRGRTVEIFNSFELIFDPALDTLDRSFLEKKQELYKKVFPDFYVLGWYSTGSDATESDMHIHKALMDINESPVYVLLNPAINHAQKDLPVTIYESEFHVIDGIPQSIFVHTSYTIETVEAERISVDHVAHLKPSDGGSAATQLAAHLTGIHSAIKMLNSRIRVLYQHIVAMQKGCDKPCENSVLRQVSSLLRSLPAAESEKFNENFLMEYNDKLLMSYLAMITNCTSNMNEVVDKFNTAYDKHSRRGGRTAFM

SEQ ID NO: 33901 - protein, 638 aa, Ustilago maydis 521
MNRHHPYGGYDERPGRGARGGGNPSMRGRPPHPGGMSPPPSSGYPSYDPAASTMTDSSASYAPQDTYGGANEFAGGPDRHYQIPMSGAPQRGGMSARGGLPGSRPPPPGQTMNTPPSYGYTPASFEKAPYNASAPPASYGQPLQQQTPAYPQDYNAAGPPPSGPPSASFDSQSYAGTPSYGQGFRPDGASQASYGLSRPPFDEDGFRGGRGGRGGRGGRGGGRGGRGGGFGGGGGGRGFDDDEKPCRTLFVRSINFETDSGFVKQQFEQFGQIKTFFDMVNKRGIAFITYYDLRSARDAMLAMKGALFGGRPINIHYSLPREEDKAQRCDRDKNQGTLFTVLKGSRQDLNDDAVREVFAEFGDVKKIRDYPGQKNSRFVEYFDSRACQLAHDQLNARPYLDGQWDLKFAWDVVTDEDLEWAKVPQQGSGQGFQAGPPAPQSGWGRPGPPGGPDLVAPSADYVTPGGSDSNLGYGRPPVPATGAPVDNGWGRRAGSGPASTSVSGPTPAAASGADHGDANRLEQALKVQQLLASLGAASKPPATTATATSTPPPPSVASLPARSPPAAHTSTASSSAASVLPPNIAALLQSAAGAPKPMQPPKPQSAPSNAPVAGQDNGQQSVQQLLSMLNQNRPPPPS

SEQ ID NO: 33902 - protein, 194 aa, Methanocaldococcus jannaschii DSM 2661
MKIACDIPVSEVMSFPVIKATKNMSIYDIANIMTENNIGAVVIVENNKPIGIVTERDIVKRVVSKNLKPKDVLAEEVMSKKIITIPQNASITEAAKIMATHGIKRLPVVKDGELVGIVTQSDIVRVSPELLEIVIEYASITPEEKEVISLDTDEFSEEYINGICENCGYQGRVRLYQGRYLCDECIEEFEEKEE

SEQ ID NO: 33903 - protein, 538 aa, Candida glabrata CBS 138
MSGQRTGSNPRSGYQHVVGMHYAVGPKIGEGSFGVIFEGQNILNSSDGRQGHGSGSGSAHGSGNGNGNSLAGFPVAIKFEPRHSDAPQLRDEFRAYRILNGSKGIPHAYYFGQEGMHNVLIIDLLGPSLEDLFEWCGRKFSIKTTCMLAKQMIERVRIIHDHDLIYRDIKPDNFLISEFQKASNNNGECVKYCAQSAGGDPNLIYMVDFGMAKQYRDPRTKQHIPYRERKSLSGTARYMSINTHFGREQSRRDDLESLGHVFFYFLRGSLPWQGLKAPNNKLKYEKIGLTKQKLNPDELLLSNQIPSQFATYLKYTRSLKFDEDPDYDYLISLMDGVLLSKGYKDDGHYDWMDLNNGAGWDIRVNKRANLHGYGNAQPRNNNNNNNGAKNNGNTGRQRNDSKRTSQQQQVQLAQTAMHSAKNKLATPSKQKEAMSTDKKHLSNLSEHSSDVIYHTLTQPNMNQGYDSMGTQDRRKSQSQHKLQTKRKNSRAHMQYQKGSNNAKDNFFNDQQQRYDSAVERYSIKSEKGLCARICCCFF

SEQ ID NO: 33904 - protein, 1397 aa, Arabidopsis thaliana
MAQTGEDVDKAKSFQVEFACGNGVDDEEKLRSQWATVERLPTFKRVTTALLHTGDDSSDIIDVTKLEDAERRLLIEKLVKQIEADNLRLLRKIRKRIDEVGIELPTVEVRFNDLSVEAECQVVHGKPIPTLWNTIKGSLSKFVCSKKETKIGILKGVSGIVRPGRMTLLLGPPGCGKTTLLQALSGRLSHSVKVGGKVSYNGCLLSEFIPEKTSSYISQNDLHIPELSVRETLDFSACCQGIGSRMEIMKEISRREKLKEIVPDPDIDAYMKAISVEGLKNSMQTDYILKILGLDICADTRAGDATRPGISGGQKRRLTTGEIVVGPATTLLMDEISNGLDSSTTFQIVSCLQQLAHIAGATILISLLQPAPETFELFDDVILLGEGKIIYHAPRADICKFFEGCGFKCPERKGVADFLQEVMSRKDQEQYWCHRSKPYSYISVDSFIKKFNESNLGFLLKEELSKPFDKSQTRKDSLCFRKYSLSKWEMLKACSRREILLMKRNSFIYLFKSGLLVFNALVTMTVFLQAGATRDARHGNYLMGSMFTALFRLLADGLPELTLTISRLGVFCKQKDLYFYPAWAYAIPSIILRIPLSVLDSFIWTVLTYYVIGYSPEVGRFFRHFIILLTFHLSCISMFRAIASICRTFVACSITGAISVLLLALFGGFVIPKSSMPTWLGWGFWLSPLSYAEIGLTANEFFSPRWRKLTSGNITAGEQVLDVRGLNFGRHSYWTAFGALVGFVLFFNALYTLALTYRNNPQRSRAIVSHGKNSQCSEEDFKPCPEITSRAKTGKVILPFKPLTVTFQNVQYYIETPQGKTRQLLFDITGALKPGVLTSLMGVSGAGKTTLLDVLSGRKTRGIIKGEIRVGGYPKVQETFARVSGYCEQFDIHSPNITVEESLKYSAWLRLPYNIDAKTKNELVKEVLETVELEDIKDSMVGLPGISGLSTEQRKRLTIAVELVSNPSIIFLDEPTTGLDARAAAIVMRAVKNVAETGRTVVCTIHQPSIDIFETFDELILMKDGGQLVYYGPLGKHSSKVIKYFESIPGVPKVQKNCNPATWMLDITCKSAEHRLGMDFAQAYKDSTLYKENKMVVEQLSSASLGSEALSFPSRYSQTGWGQLKACLWKQHCSYWRNPSHNLTRIVFILLNSLLCSLLFWQKAKDINNQQDLFSIFGSMYTIVIFSGINNCATVMNFIATERNVFYRERFARMYSSWAYSFSQVLVEVPYSLLQSLLCTIIVYPMIGYHMSVYKMFWSLYSIFCSLLIFNYCGMLMVALTPNIHMALTLRSTFFSMVNLFAGFVMPKQKIPKWWIWMYYLSPTSWVLEGLLSSQYGDVEKEITVFGEKKSVSAFLEDYFGYKHDSLAVVAFVLIAFPIIVASLFAFFMSKLNFQKK

SEQ ID NO: 33905 - protein, 398 aa, Ralstonia eutropha JMP134
MNIITLKPGKEKSLLRRHPWIYATGIATTEGRCEPGATVIVRAADGRFLAKAAYSPESQIRARVWTFDENEPVDHAMFKRRISAAVAHRRQWVKDSDAVRLIFGESDRLPGLIVDYYGNGESGQLVCQFNAAGVEHWKTAIVQALVKETGCPNVYERSDAAVRQREGLELVTGVLAGAEPDPALSVTEHGVRYYVDVRNGHKTGFYVDQRDNRKLVGDLAAGREVLNCFCYTGGFSLAALRGGATSVTSIDSSGEALKIAAGNVTLNGFDENRATWLDADVFKTLREFRAEGRQFDLIVLDPPKFAPSSQHIDRAARAYKEINLVGMQLLRPGGLLFTYSCSGAISMELFQKIVAGAVTDARADARIMRRLSAGTDHPMLAAFPEGEYLKGLLLEKVA

SEQ ID NO: 33906 - protein, 612 aa, Arabidopsis thaliana
MAGGIVSPASLLDLIADIVEIPLNTGMFKKDCADLTRRVCLLTHLLEEIRDSTPIDSAASSSSENDWWSDLVVGLQAAKRLLSTARFQARDSSDGAAKRISFQFQCVTWKLEKALSNLPYDLYDISDEVGEQVELARSQLRRAMQRYGSLNSNKFSSALSEPMERDGFSNVIKIKAEEKLESVSETLHFGEEEEKQSSPPLRRSSSISLAYYLSKDADTDRLDKMVNKNTDESKKSDKLTIPVDFLCPVSLELMKDPVIVATGQTYERAYIQRWIDCGNLTCPKTQQKLENFTLTPNYVLRSLISRWCAEHNIEQPAGYINGRTKNSGDMSVIRALVQRLSSRSTEDRRNAVSEIRSLSKRSTDNRILIAEAGAIPVLVNLLTSEDVATQENAITCVLNLSIYENNKELIMFAGAVTSIVQVLRAGTMEARENAAATLFSLSLADENKIIIGGSGAIPALVDLLENGTPRGKKDAATALFNLCIYHGNKGRAVRAGIVTALVKMLSDSTRHRMVDEALTILSVLANNQDAKSAIVKANTLPALIGILQTDQTRNRENAAAILLSLCKRDTEKLITIGRLGAVVPLMDLSKNGTERGKRKAISLLELLRKACQ

SEQ ID NO: 33907 - protein, 184 aa, Triticum aestivum
  misc_feature (19)..(19): Xaa can be any naturally occurring amino acid
  misc_feature (54)..(54): Xaa can be any naturally occurring amino acid
SGGHINPAVTFGLLLARKXSLPRAFLYMVAQCVGAICGAALVRAVHGGHHYALXGGGANELAPGYSRTAGLIAEIAGTFVLVYTVFSATDPKRIARDPHVPVLAPLLIGFAVLMAHLATIPVTGTGINPARSFGAAVVYNDKKAWDDQWMFWVGPFIGAAVAMVYHQYILRNSSIFRSNYDGAV

SEQ ID NO: 33908 - protein, 185 aa, Oryza sativa Indica Group
MDQEQGERELQLLLPAAASAAAAASRVLCGGGGGDAAAGLGGGGGSVDSSGGAVALDLDLSMSIGPTTRRQQPAAAVPSPSPPPPPPPVVDVRAVRQQTAEQMRQASAHRAYAERVREMARAELELAEREFARARAIWERAREEVERVERMKEIAARRLGIGPAAASAALRDAPATPACSASTPS

SEQ ID NO: 33909 - protein, 209 aa, Brassica napus
  misc_feature (81)..(81): Xaa can be any naturally occurring amino acid
MSLKGTILILGLVWSFQAALGIRFVIDREECFSHKAEYEGDTLHVSFVVIKSDSQWHFNEDGVDLVIHGPTGEQVHDFREXQISAKHDFVVQKKGVYRFCFTNKSPYHETIDFDVQLGHFAYYDQHAKDEHFTPLMEQISKLEEALYNIQFEQHWLEAQTDRQAIVNENMSKRAVHKALFESFALIGASVFQVYLLRRLFERKLGMSRV

SEQ ID NO: 33910 - protein, 195 aa, Burkholderia vietnamiensis G4
MPFNFPIFLTWVRIVLIPLVVGVFYLPDTVMGGAHRNLAAAAIFILAALTDWFDGFLARKWNQTSSFGAFLDPVADKLMVTAALLILVQIARVDAAIALVIVGREIAISALREWMAQIGASKSVAVNQLGKFKTACQMVAIPMLLYYGPLPLGVATIDTRVWGEWLMYLAAVLTIWSMLYYMKLAWPQIRERGGA

SEQ ID NO: 33911 - protein, 359 aa, Azoarcus sp. EbN1
MTPRTPKFHPLKVTEVRRETPESVSLCFEVPAELADDYRFVQGQHLNLKVRVGDEEMRRSYSICAGVDDEELRVAIKKIAGGAFSTWVNDNGIKVGDVLDVMTPEGRFHTPLDPVHAKHYVAFAAGSGITPILSLIKTTLRAEPKSRFTLVYGNRRQGSVMFAEALEDLKNRYLSRFTLYNLFSREEQEVPLFNGRLDAARVAAFLDTLIPVDTIDEAFICGPGGMIDEVEAALHKGGVAHEHIHLERFGVPASAPEHHVEPGDAAQAKVTVIADGLRREMEFRAEDTSILDVALAAGMDLPYSCKGGVCCTCRAKVIEGKVRMDKNFTLEQPDIDAGYILTCQAHPLTERVVITFDER

SEQ ID NO: 33912 - protein, 379 aa, Anaplasma marginale str. St. Maries
MSGNDYYEILEVSRNASAEEIKKSYRKMVFKYHPDKNPGDKKAEEKFKKISEAYEVLSNPEKRAAYDRYGHSTFTSGGASGFDFTSGFSTDFSDIFQDFFGGGFGKSQRASSREHLRGSDLRYDVEVSLEDAFKGIKVPISYVTNVKCSSCSGIGSEGAVNSVKCGNCNGAGSVRTRKGFLTIEEVCNVCNGEGEVIKNKCRRCGGSGRVRNEVSLLVTVPKGIETGNKVRVNGKGEAGFRGAQEGDLYVYIRVKEHKFFTRRSSDLHCSVPIKMTIAALGGEIEMPSIDGSWTKLKIPEGTQSGDQIRMRGKGMPEVNSKDRRGDMYVHVTVETPVKLTKQQVDLLKKFEEESSANCSPKYQGFFQKIKDIWRDISSG

SEQ ID NO: 33913 - protein, 268 aa, Burkholderia vietnamiensis G4
MAKRDIPIRGAADIAKSREAAKLASQVLTMITDYVKPGVTTDELDARCREYIIDELHAIPANIGYHGYPKTLCTSVNHVVCHGIPSSRPMRDGDIVNLDIAVIKDGWFGDTSRMYFVGEPGELARRLVAATYEAMHAGIRAVRPGATLGDVGYAIQQVAHREGFSVVREYCGHGIGDVYHDEPQVLHYGRPGTGVPLRPGMIFTIEPMLNAGKRDTRVLADGWTVVTKDHSLSAQWEHMVVVTEQGVDVLTDDVKPHAFAALTGTQAA

SEQ ID NO: 33914 - protein, 358 aa, Oryza sativa Japonica Group
MSAFVGKYADELIKTAKYIATPGKGILAADESTGTIGKRLASINVENVEPNRQALRELLFTTPGAFQYLSGVILFEETLYQSTAAGTPFVDVLKAGGVVPGIKVDKGTVDIAGTNGETTTQGLDSLGARCAKYYEAGARFAKWRAVLKIGAAGEPSELAVKQNAEGLARYALICQENGLVPIVEPEILTDGAHDIKTCAAVTERVLAAVYKSLNDHKVLLEGTLLKPNMVTPGSDSPKVGAEVIGEYTVAALRRTVPPAVPGIVFLSGGQSEEEASQNLNAMNKLEVLKPWTLTFSFGRALQQSTIKKWGGKKENVAAAQAAFLARCKANSEATLGKYGGAAGDAATSESLYVKGYTY

SEQ ID NO: 33915 - protein, 189 aa, Lilium longiflorum
IFIGANSQGFANTGALVPCVVNFPESRGIVLGLLKGFVGVSGAIFTQLYHAVYGEDSKSLVLLVAWLPAAISLASIHSIRFMKVVRQPNEFKVFCSFLYISVAIAFYLMVIIIIQKTTNLFTRKAYIASAIIILIFLLLPLVIVSRESYHLWIRQRQNLTNSPISITVDNKLDTIVTHPKPIPATTVKW

SEQ ID NO: 33916 - protein, 900 aa, Propionibacterium acnes KPA171202
MLDGPETPEEPDGLETDEDEEDGADVIERVQELIGEAPDSNPDDDLPELPLALYRRYRPETFDEVIGEDHVIEPLKRAILNNRVNHAYLFSGPRGCGKTTTARILARALNCEQGPTPTPCGTCQSCRDLACGGPGSIDVIEIDAASHGGVDDARDLRERAFFAPVHSRYKIYIIDEAHMVTPQGFNALLKLVEEPPPHVKFIFATTEPEKVIGTIRSRTHHYPFRLVPPKVLVEYLAELCGKEGIDVDHAVLPLVVRAGGGSVRDSLSVLDQLLGGAADGHVSYEQAAALLGYTPEALLDEIVDAFAAGDAHQVFATIDKVIEVGQDPRRFAEDLLRRMRDLVIVSAVPDACRSGLIDVSPEQATRLAHQVSGFGAGELTRAAEVLATGLTNMRGTTAPRLHLELMCSRILLPGADTDGRGIHARLERLERRIGVSGPVEEVERAERPVTAQPPTRYADTPQQASPPQHWPAENLQNPERRSAPEHHDAPSPGQRPSGRPRPSRKDYRPGNQLAEQPPSNQHGDDGQMSQGPRQQGGPSTSQRQQPRPQDHQPSQRDRQDTPPAQPQQPSAEQGGRADDAINITTLRREWPQVLEAVKDGGRVAWMVLNQYAQVLEVHGNQATLGFSNIGARENFAAGNYPKVLHDAVVKVLGVDLAFTAVVGEPPAAVRPESHPAEFQSGPAAQEPPDDDPWEQGPHHQDSTRGGEPSDPTHPGRDPQGRPGDRQAISDDASKDAPPPPVTSSHPSEAGDDDPAPDATTEDQSADVRDEVVESGPVAGAPDPDSGGAAEPKPDLVPGQDHVEAAGRAESARQIDPGGASSQGRPSAAAVSTAHRWSERAKGSVRPLEVTSRSAQVEEPPDDGGEWDDTVVEESNESPIDLIMRELGGVVIDTDGDSTAR

SEQ ID NO: 33917 - protein, 101 aa, Arabidopsis thaliana
  misc_feature (35)..(35): Xaa can be any naturally occurring amino acid
  misc_feature (73)..(73): Xaa can be any naturally occurring amino acid
SRDTLGGRILSSMLSSTGGATYPAHATMGAKYTGXKSSAFIPGTRKGNIDITGITITGGRDSLLKVGPPIAKXQAETLDHLPGLSGVEQNNEDDDPLHSKW

SEQ ID NO: 33918 - protein, 260 aa, Triticum aestivum
  misc_feature (216)..(216): Xaa can be any naturally occurring amino acid
  misc_feature (230)..(232): Xaa can be any naturally occurring amino acid
YNKFVQKSRLVPVRNSRDIVDPRVRGRVGEEIPWGEAGADYVVESTGVFTDKDKAAAHLKGGAKKVVISAPSKDAPMFVVGVNEDKYTSDVNIVSNASCTTNCLAPLAKIINDNFGIIEGLMTTVHAITATQKTVDGPSSKDWRGGRAASFNIIPSSTGAAKAVGKVLPELNGKLTGMSFRVPTVDVSVVDLTVRTEKAASYDDIQKAIKAASEGXLKGIMGYVEEDLAXXXFVGDSRSSIFDAKAGIALNDHFRQLVSW

SEQ ID NO: 33919 - protein, 517 aa, Oryza sativa Japonica Group
MASSASTLEIEARDVVKIVLQFCKENSLQQTFQTLQNECQVSLNTVDSIDTFIADINAGRWDAVLPQVAQLKLPRKKLEDLYEQIVLEMAELRELDTARAILRQTQVMGVMKQEQPERYLRLEHLLVRTYFDPNEAYQESTKEKRRAQISQAIASEVSVVPPSRLMALIGQALKWQQHQGLLPPGTQFDLFRGTAAMKQDEEETYPTTLSHQTKFGKKTHPECARFSPDGQYLVSCSVDGIIEVWDYISGKLKKDLQYQADESFMMHDDAVLSVDFSRDSEMLASGSQDGKIKVWRIRTGQCLRRLERAHAKGVTSVTFSRDGTQILSSSFDTTARVHGLKSGKMLKEFRGHNSYVNCAIFSTDGSRVITASSDCTVKVWDTKTTDCLQTFKPPPPLRGGDATVNSVHLSPKNSDHIIVCNKTSSIYIMTLQGQVVKSFSSGKREGGDFLAASVSPKGEWIYCVGEDMNMYCFSYQSGKLEHLMKVHDKDVIGITHHPHRNLIATYAEDCTMKTWKP

SEQ ID NO: 33920 - protein, 617 aa, Phanerochaete chrysosporium
MSRDSHGELVVLNEKAAAAKAHATGGRRRALLYGAIAALLLIVALALGLGLGLGLGLKHHRDSTAPASTNSSGQSLPSLQPTPQNNFVLDGLAGQPPQTRSYDFVISQVLGAPDGVSKPMLVVNGMYPGPTIEVNQGDRIVVNVTNLLENRTTIHWHGLFQNQTNYYDGTAGITECGIPPGQSLVYNFTLGDFSGTTWWHAHYSTQYTDGITGALIVHPASPPPVKFPSWDHELVVQVADLYHTFSSILLASYLSPWGIDGTAGDEPVPDAGVLNGLGQWGGGGDYFNFTLEANKTYRIRLVNTGSFASIRFSVDYHTLSVVEADGTLVQPYDVAGVTLAVAQRYSVLLRTDNSTGGPFWMRAAVQSDMFTYDEPGQNLDIRGVIRYGPTANDTALPVETDDPGVPSQPSLQDMDTAQLVPAVVAPAPPSTRQYPLTIALELADSQLFLGFMNGTSWTPLQGTTTLLQARAAFQGGGVYGTEGGSLQSGGQFMVTEDSVQVVDLLISNLDDGDHPFHLHGHRPWIMGTGPGRYIGQPLNATNPLRRDTFLIPAYNWMVIRFITDNPGLWAFHCHLAWHMAAGLLMQINSLPSKAAQLDIPQSIVSQCAATVDGAGAR

SEQ ID NO: 33921 - protein, 326 aa, Mycobacterium tuberculosis H37Rv
MGANHVRNDPIMARLTVITTGGTISTTAGPDGVLRPTHCGATLIAGLDMDSDIEVVDLMALDSSKLTPADWDRIGAAVQEAFRGGADGVVITHGTDTLEETALWLDLTYAGSRPVVLTGAMLSADAPGADGPANLRDALAVAADPAARDLGVLVSFGGRVLQPLGLHKVANPDLCGFAGESLGFTSGGVRLTRTKTRPYLGDLGAAVAPRVDIVAVYPGSDAVAMDACVAAGARAVVLEALGSGNAGAAVIEGVRRHCRDGSDPVVIAVSTRVAGARVGAGYGPGHDLVEAGAVMVPRLPPSQARVLLMAALAANSPVADVIDRWG

SEQ ID NO: 33922 - protein, 299 aa, Ralstonia eutropha JMP134
MSKIGFIGLGVMGKPMAEHLQAGGHIVYAHTRSGVPQELLDKGMQSCSSAADVARQAEVIFLMLPDTPDVARVLFDKNGVAEGLSAGKIVVDMSSISPIETREFAAKIEKLGCNYVDAPVSGGEVGAKAATLSIMAGGKQDVFDKVLPLLQLMGKNITLVGNAGDGQVAKVANQVIVALTIEAVSEALVLAAKAGADPARVRQALMGGFASSKILEVHGERMIQRTFNPGFRIELHQKDLNLALSTAKQLGLGLPNTASTQQLFNVCVAQGGAGWDHSGLVKAIEHLSSFAIGDTPKKA

SEQ ID NO: 33923 - protein, 83 aa, Oryza sativa Japonica Group
MPANGDGPARGSAAAAASLRRRRTTGGAGAGARGGTSTMLQFYTEEAAGCKMSPNAVLIMSIGFFAVVALLHVFGKLYRTSSN

SEQ ID NO: 33924 - protein, 156 aa, Azoarcus sp. EbN1
MARYDNIPEFETDLDGRGLRVGIVMSRFNQDVCEGLLSACTAELLRLNVSPELMRIATVPGALEIPLALQTMARSGRFDALIALGAVIRGETYHFELVSNETGSGINRVGLDTGMPIANGVLTTEDDDQALARMQEKGADCARTAIEMAKLLKQLQ

SEQ ID NO: 33925 - protein, 369 aa, Azoarcus sp. EbN1
MGRPGAGTSALAPITEIVEDIRAGRMVVLVDEEDRENEGDLVLAAEHVTPEAINFMAKFGRGLICLTLTEARCRQLDLHLMVRDNRSPHGTAFTTSIEAAEGVTTGISAHDRSRTVQAAVARHAKPADIVQPGHIFPLMAQKGGVLIRAGHTEAGCDLAALAGLEPASVICEILKDDGTMARLPDLVEFAKEHGLKIGAIRDLIEYRSANEHLVERVAEKDVETPYGRFRLAAFEDKTSGEVHFALSHGEIRPERETLVRVHEPISVVDFIDPESGRHTFPVNQAMARLAEAEQGVIVLLYRPQSGSELLAGLRGDTSLAAKWDARLFGVGAQILRDLKVGKMRLLASPRKIPSMAGFGLEITGFVERP

SEQ ID NO: 33926 - protein, 504 aa, Triticum aestivum
MAPSYDKTIATAASLAAFLMLVRSLASELLPAEVRDALSSALASLRSRMTWQHTIVIEETEGWSSNRVYNSIKAYLATRINANINMQRLRVSSGDDAEKMVVSMEAGEEMADLYEGAEFKWCLVTREVSGDPNNGGGGAREIRSYEVSFHKRHKEKALKEYLPFIVATAKAIKDQERSLSIYMNERYDEWSPIGLQHPSTFDTLAMDHKQKQSIVDDLNRFIKRKDYYRRIGKAWKRGYLLYGPPGTGKSSLIAAIANHLRFDIYDLELTGVDSNSDLRRLLVGMTNRSILVVEDIDCTIELKQREEDDKEHAKSNSTEKKKAEDKVTLSGLLNFVDGLWSTSGEERILIFTTNYKERLDPALLRPGRMDMHIHMGYCTTEAFRILANNYHSIDYHVTYPEIEALIEEVTVTPAEVAEVLMRNDNTDVALHDLVELLKLKKKDAIEIESKQAEEKKDANEIKTQSMQVDEKKIVDEIKTESVQVEKKDDKKVVVKSEFTENGSG

SEQ ID NO: 33927 - protein, 321 aa, Zea mays
  misc_feature (122)..(122): Xaa can be any naturally occurring amino acid
MDLPVLIVTKDDAITSSPFLGTQINISINQFHNPLASAAIVTGNNNCEMATVETSGTAIGSSGRWALHGKTALVTGGTRGIGRAVVEELAALGAAVHTCSRKAEELGERIKEWEARGFSVTXSVCDLSERDQRERLLREVADRFGGKLNILVNNVGTNIRKPTTEFTAEEYSFLMATNLESAYHLCQIAHPLLKLSGSGSIIFISSVAGAIGIFSGTIYAMTKGAINQLTKNLACEWAKDNIRANSVAPWYITTSLTEGILANKNFEEQVVSRTPLGRVGEPGEVSALVAFLCMPGSTYISGQTIAVDGGMTVNGFYPPKP

SEQ ID NO: 33928 - protein, 99 aa, Glycine max
  misc_feature (51)..(52): Xaa can be any naturally occurring amino acid
  misc_feature (66)..(66): Xaa can be any naturally occurring amino acid
  misc_feature (79)..(79): Xaa can be any naturally occurring amino acid
  misc_feature (93)..(93): Xaa can be any naturally occurring amino acid
  misc_feature (96)..(96): Xaa can be any naturally occurring amino acid
MFAEENGLKGDPRLQAISQAIRVVPHFPKHGIMFQDITTLLLDHKAFKDTXXIFVDRYRDMHISVXAGIEARGFMFGPXIALGIVAKFVPLRXPRXLAG

SEQ ID NO: 33929 - protein, 387 aa, Synechococcus elongatus PCC 6301
MSQRLAPLQRNVFADMDRAKAVAIAAGREVIDLSLGSSDLPAPDHVVAVIAASLQDPSTHGYLLHQGTLPFRQVAAAWYERKFGLGVDPETEVLLLIGSQEGTAHLPLAVMEPGEIALLQDPGYPSHAGGVYLAAGEIYRLPTTADRGFLPDFSTIPTEILSRSRLLVLSYPHNPTTAIAPLAFFEEAVAFCRHHQLVLAHDFPYPDLGFDGVEVPSIFQADRQKQQAIEFFSLSKSYNMGGFRVGFAIGNAELIGALRRLKAVVDFNQYQGILAGAIAALTGPQACVEATRQRFRDRRDIFINALAATGWTIPKPVSTMYLWAPLPEPWQTRSLEFCEKLVAETGVAASPGIGFGDCGEGFVRFALVHDRDRLEEAARRITQFLAR

SEQ ID NO: 33930 - protein, 827 aa, Cryptococcus neoformans var. neoformans B-3501A
MAEQPAQAPAAAPVKKEKIVPPSPPLKIRDRDRGYEYMRVGFLGEGGFARVYEVQDQRASRRAVKVVSKASIKTKKNKTKLWAEIKLHQMLAHPNIVRFDDCFEDEENVYMILELCHHGSLMDLLRRRKRYTEPEARYYLVQLIAACQYMHQTNVIHRDLKLGNLFLDENMDIKVGDFGLAALIEKPGDRKKTICGTPNYIAPEVLFDTANGHSFEVDVWSVGVILYTLLIGKPPFQTKDVKAIYKRIRENRYEFPPEKEISPSAQELITLILNTNPDKRPNLDTILSHRWFLDGPFPAYIPASANDFAPDYRHISSSQSRRNFAALCHKSKIGVAQSINVEPARSRSALGPSIMQQERDFKNAVQPDSPISALLNSARQPLIQASASAIKEPSLLRKLSAAGAASTLSPVRKGAIGKENHELGRRPVAMERVGEESEEERDAEEVKPKYNGITRESELAAQKARIVSQMAAAERQVYAEAMEKASESAASGKRPVYQESRSRVAAASRGTLPLAATTGQATVSTFSAASSDTVSKSGSRFVAYESSRPEKTRDFKTSLFETFGQNLSTALVMAQTEEGFTSPSIEAKPQPPRVFVVSWLDYCTKYGMGFAMTDGTVSVHFNDSTSLVLAPGKRYFDDIRPAGADDLSQNIRRNYSIERYPSDLKNKVYLLKHFENYMLDKLFGDQPYTFENKELTTEMVFVVRYLRMKHVILFRLSNDVLQFNFYDHTKLILSREGLVVTVIDRHSVMRTWSLEELLRPLDDDLSPKDKKRIEGIVHKVQYAKDVLAKIKSHTSSSKAAAASSSVPVSANTRSAAAIEREMGRPIR

SEQ ID NO: 33931 - protein, 252 aa, Lactococcus lactis subsp. lactis
MCYNKSMTKVNEERVQEIFNSISSDYDKMNAIISFKQHDLWRAKTMKRMGDLTGLSILDLCCGTGDWTFDLSESVGPSGKVIGLDFSENMLEIAKAKLKEEAKKNIEFLQGNAMALPFEKGSFDVVTIGYGLRNTPDYLTVLKEIFRVLKPGGRVVCIETSHPTLPIYKQAFELYFKNVMPFLGKVFAKSLKEYQWLQKSAEDFPDAKTLEELFRKAGFVAVEYQKHGGGAIASHFATKSQKPKSNIRIGKK

SEQ ID NO: 33932 - protein, 465 aa, Ostreococcus tauri
MRFAAASSAPSSARAPFNLSPSLFRVRLVPGRDDVFDVRVDRDRPRRARVRGHVLTTASARLDRYRLVKTSHPTPQRATRGVHRASVTTTMKIAVFGSGSFGTAMASVVARNGHDVIILTRREDVATCINENGRNPQHLTAYELPKNVRATMDAEEAISNAGAIVHAIPMQSTEEFLDGVKDLVKRSGALFVNTSKGLHGETLELMHDVLKRSLGSNHPCAFFGGPTFAEQLMNGTPSGGVMAARDMATAERASALFAGPKMRVYPSTDVVGVEIGGALKNVIAILAGGLEGMGLGVNAQTLLITRGCREMTRLGVAMGAKEHTMAGLSGIGDLMLTCLGDASRNKAVGIAFGRGQKVEDILSERAQSLKGVAEGVATAPAAERLARKLGVAAPMITTCAQCLRGELDAKAALMQCMTLPIRPDEPLDDNKGVAARVISFVTHGTCALLGAFTASWIRSRSRDRA

SEQ ID NO: 33933 - protein, 267 aa, Mycobacterium tuberculosis H37Rv
MSLPKPNNQTTVVITGASSGIGVELARGLAGRGFPLMLVARRRERLDELADQLRQEHCVGVEVLPLDLADTQARAQLADRLRSDAIAGLCNSAGFGTSGRFWELPFARESEEVVLNALALMELTHAALPGMVKRGAGAVLNIASIAGFQPIPYMAVYSATKAFVLTFSEAVQEELHGTGVSVTALCPGPVPTEWAEIASAERFSIPLAQVSPHDVAEAAIAGMLSGKRTVVPGIVPKFVSTSGRFAPRSLLLPAIRIGNRLRGGPSR

SEQ ID NO: 33934 - protein, 271 aa, Gloeobacter violaceus PCC 7421
MATHVSGLFVYPVKSCRGIALEAAELGTRGIRLDREWMVVNERGTFISQRSYVRLALVETALTEARLRLSAPEMGYIEVPLAHEPGPAAEVTVWGDRCAAVDQGEEAARWFGELLKTPCRLVRMAPDWVRPVNPRYAPPGSQVGFADGYPLLVLSEASLADLNTRLAEPLPMDRFRPNLVVTGCEAYAEDTWPAVRVGEVTLRAAKPCVRCKITTIDQQTARPTGEEPLRTLATYRQIDKGQIFGQNMVHASPGRIALGDALEVAALAGPV

SEQ ID NO: 33935 - protein, 289 aa, Medicago truncatula
MEAKEQDVSLGANKFPERQPLGIAAQSQDDPKDYQEPPPAPLFEPSELTSWSFYRAGIAEFVATFLFLYITVLTVMGVVRADSKCKTVGIQGIAWAFGGMIFALVYCTAGISGGHINPAVTFGLFLARKLSLTRALFYMVMQCLGAICGAGVVKGFEGKTRFGDLKGGANFVAPGYTKGDGLGAEIVGTFILVYTVFSATDAKRSARDSHVPILAPLPIGFAVFLVHLATIPITGTGINPARSLGAAIIFNKDLGWDDHWIFWVGPFIGAALAALYHVVVIRAIPFKSK

SEQ ID NO: 33936 - protein, 283 aa, Brassica napus
MEGKEEDVRVGANKFPERQPIGTSAQTDKDYKEPPPAPLFEPGELSSWSFWRAGIAEFIATFLFLYITVLTVMGVKRAPNMCASVGIQGIAWAFGGMIFALVYCTAGISGGHINPAVTFGLFLARKLSLTRAVFYIVMQCLGAVCGAGVVKGFQPTPYQTLGGGANTVAPGYSKGSGLGAEIIGTFVLVYTVFSATDAKRSARDSHVPILAPLPIGFAVFLVHLATIPITGTGINPARSLGAAIIYNKDHSWDDHWIFWVGPFIGAALAALYHQLVIQAIPFK

SEQ ID NO: 33937 - protein, 327 aa, Gloeobacter violaceus PCC 7421
MKAFVLAAGKGTRLRPFTDDIPKPLVPVLNRPVMARVLDLCRTHGFDEVVANLHYKGEKISRHFEDGSQYGVRLDYSWEKELMGTAGGVRRQAEFLGDGTFLVISGDVVTDLDITRLVHFHKAHGAIATMAVKEVGDPSRFGIVVTDAAGQIQSFQEKPAAGTERSNLANTGIYVFEPEVFDWIPEGQFYDFGKDLFPALVEKGAPVFAMGTGDYWSDVGTLGQYLYTHWDLLCHPHLKQRIGKGTVIEPGAILSSHALIGENCHIERGAVVMGYSCIGDGCVVRSGATVFDSIVWAAEQISLTVADELVRSIYGDDKQVALGVPTL

SEQ ID NO: 33938 - protein, 369 aa, Candida albicans
MTATPVYFDISCNGKPKGRVVFKLYDDVVPKTAANFRSLCTGDKGISPKSGKPLSYKDSIFHRVIKDFMCQGGDFTAPSDHLGTGGESIYGEKFEDENFKLNHNKPFLLSMANSGPNTNGSQFFITTVPTPHLDGKHVVFGEVIEGKSIVRQLERSEKGANDRPVEDWKIADCGELPANYEPVASGADDGTGDTYEEILTDNDTIDINNPQSVFAAVSKIKDIGTKLLKEGKLEKSYEKYTKANSYLNDYFPEGLSPEDLSTLHGLKLSCYLNAALVALKLKHGKDAIAAANNALEVEQIDDKSKTKALYRKGMGYILVKDEEQAQKILEEALELEPNDAAIQKGLQEAKHNIKLRRDKQKKAMAKFFS

SEQ ID NO: 33939 - protein, 359 aa, Gloeobacter violaceus PCC 7421
MSPYRVTLIRGDGIGPEVTQAARIVLDATGIDFEWVVVDAGAEVMEKSGTPLPAPVIEAVRASDAAIKGPITTPAGSGIRSVNVALRRALDLYANLRPARTLPGVHSRYDNIDLVVVRENTEDLYSGIEFEKNSPQALEVIEMLMRLGGKKIFPRSGLAVKPISSEASERIARFAFEYARRHARRKVTAVHKANILKHTDGLFLEAARQVASEYPDVEFEDRIVDNLCMQLVQRPESYDVLVLPNLYGDIVSDLTAGLVGGLGVAPGANIGDRSAVFEAIHGSAPRYAGQNKVNPSALILSGALLLRHLGEQEAAVRVEQAVAAVIAEGRSVTYDLAPAGATPAGTRQMAEAIAQKVAG

SEQ ID NO: 33940 - protein, 458 aa, Pseudomonas putida GB-1
MSVPPRAVQLNEANAFLKEHPEVLYVDLLIADMNGVVRGKRIERTSLHKVYEKGINLPASLFALDINGSTVESTGLGLDIGDADRICYPIPDTLCNEPWQKRPTAQLLMTMHELEGEPFFADPREVLRQVVSKFDELGLTICAAFELEFYLIDQENVNGRPQPPRSPISGKRPQSTQVYLIDDLDEYADCLQDILEGAKEQGIPADAIVKESAPAQFEVNLHHVADPLKACDYAVLLKRLIKNIAYDHEMDTTFMAKPYPGQAGNGLHVHISVLDKDGNNIFTSEDPEQNAALRHAVGGVLETLPASMAFLCPNVNSYRRFGAQFYVPNAPSWGLDNRTVALRVPTGSADAVRLEHRVAGADANPYLMMAAVLAGVHHGLTNKIEPGAPIEGNSYEQLEQSLPNNLRDALRELDDSEILNKYIDPKYIDIFVACKESELEEFEHSISDLEYNWYLHTV

SEQ ID NO: 33941 - protein, 197 aa, Zea mays
MAVLLWRCICGPQQSFSKNRGASTPSPLAGRRSKYSGQSVKAMPMRLLTVGKKRSRGTQLLVEEYKEKLGHYCEFEDTLIRSNPKLTSDVKVQVEAEDTAMMQQLKSDDFVVVLDENGKDVISEQIADLIGDAGNTGSSRLTFCIGGPYGLGLQVRERADATIRLSSLVLNHQVALIVLMEQLYRAWTIIKGQKYHH

SEQ ID NO: 33942 - protein, 248 aa, Bacillus anthracis str. Sterne
MIIRNEQDLEGLRKIGRIVALAREEMKKEAKPGMTTKELDLIGKKVLDEHGAISAPEKEYDFPGVTCISVNEEVAHGIPGDRVLKEGDLVNVDVSAALDGYYADTGISFVLGEDEAKEKLCQAAVDAFWAAMKKVKAGSKQNQIGRAVSNFAHKNGYNVIQNLTGHGIGLSLHEAPNHILSYFDPMDNALLKDGLVIAVEPFISMKADHIIERGDDGWTFVTPDKSLVAQCEHTVVVTRGEPIILTEI

SEQ ID NO: 33943 - protein, 453 aa, Pseudomonas putida GB-1
MSVNNPQTREWQTLSGEHHLAPFSDYKQLKEKGPRIITKAQGVHLWDSEGHKILDGMAGLWCVAVGYGREELVQAAEKQMRELPYYNLFFQTAHPPALELAKAITDVAPQGMTHVFFTGSGSEGNDTVLRMVRHYWALKGKPHKQTIIGRINGYHGSTFAGACLGGMSGMHEQGGLPIPGIVHIPQPYWFGEGGDMTPDAFGVWAAEQLEKKILEVGEDNVAAFIAEPIQGAGGVIIPPETYWPKVKEILAKYDILFVADEVICGFGRTGEWFGSDYYDLKPDLMTIAKGLTSGYIPMGGVIVRDTVAKVISEGGDFNHGFTYSGHPVAAAVGLENLRILRDEKIVEKARTEAAPYLQKRLRELQDHPLVGEVRGLGMLGAIELVKDKATRSRYEGKGVGMICRTFCFDNGLIMRAVGDTMIIAPPLVISHAEIDELVEKARKCLDLTLEAIN

SEQ ID NO: 33944 - protein, 377 aa, Anaplasma marginale str. St. Maries
MEVRVFLTAPSRGSQVNLIGRVFGFGNNLVERAVLEIRRCAPVILHKSGRYALVFPSELSEDHSFATLTEFSSKLHLLLTVRRMAAVAGGRALSSALANGFTLADIAAALSTSTSLPPGVQVTSSSSPLDGHAIDLMKLAKLLPSALIADMEFAHDGEMEQWCAQNNILCLACDALSGYRKEYSLREVCRSDLCLNNAPASKILVYRSNLGEPEHYAIIIGDPSFENPVVRLHSSCYTGDLLGSISCDCRGQLLHTIQFLGSGSGGIVLYISQEGRGIGLANKIRAYNLQTQNALDTVDANRFLGFDDDERVFLPAARILDELGISKFQMLTSNPSKVSSMCDHGFTVTKMIPLSVGTHERNIDYIKTKIERLGHVN

SEQ ID NO: 33945 - protein, 255 aa, Bordetella petrii
MTKRLENKVAFITGAAGGQGRAAAVVFAREGAKVAVVDVDEKGIEETARLVKETGGEAIAIRCDVSNEEQVKGAIQKTVDTFGKLTTLYNNAGIAHKNFMILAHELSVEEWEKIQNVNTKGMFLVVKYGIPELLKAGGGTIINTSSTAGLINSPGGPSYTASKGAIISFTRHLAATYAKKGIRANAIAPGYVITLMTKAMEDLLPEVDKVASEATPLGRGAQPEEIANVALFLASDESSFVTGAVIVADGGMTIV

SEQ ID NO: 33946 - protein, 430 aa, Staphylococcus aureus subsp. aureus NCTC 8325
MAFEFRLPDIGEGIHEGEIVKWFVKAGDTIEEDDVLAEVQNDKSVVEIPSPASGTVEEVMVEEGTVAVVGDVIVKIDAPDAEDMQFKGHDDDSSSKEEPAKEEAPAEQAPVATQTEEVDENRTVKAMPSVRKYAREKGVNIKAVSGSGKNGRITKEDVDAYLNGGAPTASNESAASATSEEVAETPAAPAAVTLEGDFPETTEKIPAMRRAIAKAMVNSKHTAPHVTLMDEIDVQALWDHRKKFKEIAAEQGTKLTFLPYVVKALVSALKKYPALNTSFNEEAGEIVHKHYWNIGIAADTDRGLLVPVVKHADRKSIFQISDEINELAVKARDGKLTADEMKGATCTISNIGSAGGQWFTPVINHPEVAILGIGRIAQKPIVKDGEIVAAPVLALSLSFDHRQIDGATGQNAMNHIKRLLNNPELLLMEG

SEQ ID NO: 33947 - protein, 468 aa, Staphylococcus aureus subsp. aureus NCTC 8325
MVVGDFPIETDTIVIGAGPGGYVAAIRAAQLGQKVTIVEKGNLGGVCLNVGCIPSKALLHASHRFVEAQHSENLGVIAESVSLNFQKVQEFKSSVVNKLTGGVESLLKGNKVNIVKGEAYFVDNNSLRVMDEKSAQTYNFKNAIIATGSRPIEIPNFKFGKRVIDSTGALNLQEVPGKLVVVGGGYIGSELGTAFANFGSEVTILEGAKDILGGFEKQMTQPVKKGMKEKGVEIVTEAMAKSAEETDNGVKVTYEAKGEEKTIEADYVLVTVGRRPNTDELGLEELGVKFADRGLLEVDKQSRTSISNIYAIGDIVPGLPLAHKASYEAKVAAEAIDGQAAEVDYIGMPAVCFTEPELATVGYSEAQAKEEGLAIKASKFPYAANGRALSLDDTNGFVKLITLKEDDTLIGAQVVGTGASDIISELGLAIEAGMNAEDIALTIHAHPTLGEMTMEAAEKAIGYPIHTM

SEQ ID NO: 33948 - protein, 250 aa, Triticum aestivum
  misc_feature (215)..(215): Xaa can be any naturally occurring amino acid
MVKLAFGSFGDSFSATSVRSYVAEFIATLLFVFAGVGSAISYGQLTQGGALDPAGLVAIAIAHAFALFVGVAMAANISGGHLNPAVTFGLAVGGHVTILTGLFYWVAQLLGATVACLLLQFVTHGQPMPTHAVSGISEVEGVVMEIVITFALVYTVYATAADPKKGSLGTIAPMAIGFIVGRPNLRRRALSAAGPMNPARSFGPAVAAGNFSGHXWVYWVGPLIGGGLAGLVYGDVFIASYQPVGHQDYP

SEQ ID NO: 33949 - protein, 385 aa, Anaplasma marginale str. St. Maries
MKSIKTLPWVQNSSVRGCRVLLRVDFNVPVEHGQVRDRTRIERVAPTVDYLVKAGAKVIMVSHFGRPSCVDADFSLEPLVGTISEVLGVPVTFVGDCFGERVCTVVNALPWGSVVLLENLRFHAGEEKNDPAFAKQLASMADLYVNDAFSCAHRLHASIDAITKFLPAAAGLNLQDELHYLGNIVSEHPVAAVIGGAKTSSKIPMLRNLAQKVDFLVLGGGLSNSFLRASGHKIGSSVYEPCDDAVHAVLESARKSNCCVIVPRDHVVARNLDCSAQTKQNKDVGEEDCIFDIGTQTSAEVAEVLGKCKTVFWNGPMGVFERAAFATGTSDLIRNLVCLKKEKGVSTIVGGGDSIFAIKASGYSAEDFSYVSTGGGALLQFLSVA

SEQ ID NO: 33950 - protein, 294 aa, Glycine max
MEQYEKVEKIGEGTYGVVYKARDRVTNETIALKKIRLEQEDEGVPSTAIREISLLKEMQHRNIVRLQDVVHSEKRLYLVFEYLDLDLKKHMDSSPEFVKDPRQVKMFLYQILCGIAYCHSHRVLHRDLKPQNLLIDRRTNSLKLADFGLARAFGIPVRTFTHEVVTLWYRAPEILLGSRHYSTPVDVWSVGCIFAEMVNRRPLFPGDSEIDELFKIFRILGTPNEDTWPGVTSLPDFKSTFPKWPSKDLANVVPNLDAAGLNLLSSMLCLDPSKRITARSAVEHEYFKDIKFVP

SEQ ID NO: 33951 - protein, 166 aa, Sinapis alba
MASPDVEYRCFVGGLAWATDDRALETAFSQYGEVLDSKIINDRETGRSRGFGFVTFKDEKSMKDAIEGMNGQDLDGRSITVNEAQSRGSGGGGGGRGGGGGYRSGGGGGYGGGGGGYGGGGREGGYSGGGGGYSSRGGGGGGYGGGGRRDGGEGGGYGGSGGGGGW

SEQ ID NO: 33952 - protein, 400 aa, Bordetella petrii
MAKMRKVTTVRGYGAFVGANHLEVEETTGTGQDKTGTKKVIAFKKAIIAAGSQAVRLPFMPDDPRVVDSTGALALKEVPKRMLILGGGIIGLEMGTVYSTLGARLDVVEMMDGLMQGADRDLVKIWQKMNAKRFDNIMLKTKTVGAKATPEGIEVTFAAAEEGGTAPAPQMYDLVLQAVGRTPNGKKIAAEKAGVAVTDRGFINVDIQMRTNVPHIFAIGDIVGQPMLAHKAVHEAHVAAEVIAGELQGNKELASAAFNARVIPSVAYTDPEVAWVGLTEDQAKAQGIKVKKGLFPWSASGRAIANGRDEGVTKLLFDDSPEAGSGDGHAGRGHGKILGGGMVGTHAGDMIGEIALAIEMGADAVDIGKTIHPHPTLGESIGMAAEVAHGSCTDVPPARK

SEQ ID NO: 33953 - protein, 172 aa, Brassica napus
  misc_feature (143)..(143): Xaa can be any naturally occurring amino acid
MFPSLALATAPMPLTIISATRRSQVTQLNAKKTKPEKKRATTTTSTSGFSGGTAKELTWQCIEGCGACCKLAKDFAFATPDDDPDDVELYRSMIGDDGWCINYDKATCKCSIYAGSFFSKSFVFFSLIWRVKQCSIFVTLPVXNRPYFCRVEPEVFKTLYGIEEKKFSKETC

SEQ ID NO: 33954 - protein, 222 aa, Synechococcus elongatus PCC 6301
MLLLRPFLSADFSRLGDDVRAVDQAGADWIHVDVMDGRFVPNITIGPLIVEALRPVTQKPLDVHLMIVEPEKYVPDFAKAGADIISVQAEACPHLHRNLAQIKDLGKQAGVVLNPSTPVETLEYVLELCDLILIMSVNPGFGGQSFIPAVLPKIRKLRAMCDERGLDPWIEVDGGLKANNTWQVLEAGANAIVAGSAVFNAPDYAEAIAAIRNSKRPELVTA

SEQ ID NO: 33955 - protein, 169 aa, Sinapis alba
MASPDVEYRCFVGGLAWATDERSLETAFSQFGELVDSKIINDRETGRSRGFGFVTFKDEKSMKDAIEGMNGQDLDGRSITVNEAQSRGSGAGGGGRGGGGGYRGGGGYGGGGGGYGGGRREGGGYSGGGGGYSSRGGGGGGYGGGGRRDGGGYGGGEGGGYGGGGGGGW

SEQ ID NO: 33956 - protein, 593 aa, Listeria monocytogenes str. 4b H7858
MKQLDIQELEALAADIRAFLITSTSKSGGHIGPNLGVVELTIALHYSFNSPKDKFIWDVGHQSYVHKILTGRASQFGTLREHGGLDGFPKRKESIHDVFETGHSSTSLSAAAGMVIARDIKKEEFYVIPIIGDGALTGGMALEALNHIGDMGKDMIVILNDNDMSIAPNVGAIHNILGKLRTSDTFKQTKAKVDGTFFEELGFMYLGPINGHDIEEVITNLELAKRTKGPVLLHIVTKKGKGYQPAELDSRGTWHGTGPYKVETGSFIKPAKRAASWSSVISNELIRLAEKDERIVAITPAMPVGSKLEKFAKAFPERFFDVGIAEQHATTMAAGLATQGMKPFLTIYSTFLQRAYDQLVHDVCRQKLNVVIGIDRAGLVGADGETHQGIFDISFLNSIPNMTISMPKDEVEARQLMDTAFSYNDGPFAIRYPRGEAPGAQVAESNTLIPIGKWETIIQPIDAVILTFGPTIRLALKAAEQLELEGYHVGVINARYIKPLDEALLHQILKQKIPILTVEESLLKGGFGASVLEFIEASNYSDVVMHRIGLPDEFISHGSVSIILESFGISTTGIVLKIKEMLAQSGKLRAKRL

SEQ ID NO: 33957 - protein, 491 aa, Bordetella petrii
MVRATCRAAQAAAPAGVVRAHGETAWVPHPCHGRPVMKEVDLFVIGGGSGGVRAARIAAGHGARVALAESSRIGGTCVIRGCVPKKLMVLASRCSQEIDVATAFGWTVGERRFDWERLRSNIAAEVSRLEAAYTNGLLQAGVSVLYDRATLEDRGVVRLAGSGEAIRARRILIATGARPSTAEELPGAELASDSDAFFEWHLQPARVLVQGAGYIALELGCLLQRLGSQVTLVMRGTTVLRGFDNGLREHLQQALFETGMAIVPRCTVTGLTRHADGSIQAKLSDGSSAAFDAVLRATGRQPNTRELNLEQVGVATTASGAIVVDEWSQTSVAGVYAIGDVTARALLTPAAVREGHALADTLFGGRKVPVAHDLIPTAVFTTPEAATVGLGEEGAAARFGAIDVYEARFKPMKHAMSAQPGHMLIKVIVDRASDRVLGVHIVGPEAAEMIQLAGIALQMGATKAQFDAVLPVHPTAAEEIVTLRAPTRRHG

SEQ ID NO: 33958 - protein, 612 aa, Ustilago maydis 521
MDEAALRAMMPISFGKRRAQQARWAAASATNADANASVNAEGLAAVGQDKEENDLSCSVLGKRVAGTDEADADADQDDGLTPEERAANREAERQENERRAKGIASDDSDDSDDQDSDDDQIGPPLPPRTSSSRIPPRSMPPITQTATLSGIHAKTLSALAVDASGSRFALGSYDSYLSLYDFGGMTSSLEPFRHFEPTHETYPIVDLSFNTNSSHLLVISATREAKVFTRDAAEIGTCRKGDPYLRDMRRTSGHVSALTCGMFDSHELAKFYTGASDGTVRIWSEESMHRAQHDMIVLKSKSRGTRTKVTAIACERERIWASGEDGALRMWDLRENLNGRPRHCVDAAHEPDSWTSCIATSGETVVTRGGDATVKVWDARKPTRPVVERADLANASAHTGVILDPFNSRSLITGVSDRVQARRNGGHDDLVSADDRTDSSIVVLDVLDLSTLCTHTTSSTPVRLHWSSHTDQLFATHRNGSLSILYNPTRSTNGITLALARRAHSRPQSPTADSYAIATHTTSTAPSESAKRRRLARARQDPHQTLLPQPPLHGPGKAGRIGAGVQQSSVQNLYRNPDDLNIDPREALLKYANRTAHTEHHLDPHHQYNPPP

SEQ ID NO: 33959 - protein, 172 aa, Oryza sativa Japonica Group
MLRAAGKRLLGVGLRPAGGGAGEAAAAAAASAVAVVRRRGYHERVVDHYDNPRNVGTFDKDDPDVGTGLVGAPACGDVMKLQIRVDEESGRIVDACFKTFGCGSAIASSSVASEWVKGKQMEDAASIKNSEIAKHLSLPPVKLHCSMLAEDAIKAAVKDYEAKKAKLDKGNE

SEQ ID NO: 33960 - protein, 516 aa, Juglans regia
MEVESANKDMRAAQRSTLIRIVLVASIAAGVQFGWALQLSLLTPYVQLLGIPHTWAAFIWLCGPISGMLVQPIVGYYSDRCTSRFGRRRPFIAVGACFVAMAVFLIGYAADLGHLCGDHVDKPTRPRAIAFFVVGFWVLDVSNNMLQGPCRALLADLSGNDQKKMRTSNALFSFFMAVGNVLGYAAGSYTRFYKIFPFTKTKACDVYCANLKSCFFLSIALLSTVTILALTSVKERALSSQPKPENAAGEDEERVTESAGLPFFGEMWSAFKGLQRPMRILLLVTCLNWIAWFPFLLFDTDWMGKEVYGGTVERSGGKIVRSGVRAGALGLMLNSVVWGFTSLGVNVISRGIGGVKRLWGIVNFLLALCMAMTVLITKLAESARHTAAANGGATLSPPPAGVKAGALALFAVLGIPLAVTYSIPFALASIFSHASGAGQGLSLGVLNLAIVFPQMLVSVASGPFDALFGGGNLPAFVVGAISAAASGILSLTMLPFPTTDLLCFLKMQYPQFPAFH

SEQ ID NO: 33961 - protein, 316 aa, Methanocaldococcus jannaschii DSM 2661
MVKLSGVYKGMRKGYGETLIELGKKYENLVVLDADLSGSTQTAMFAKEFPERFFNAGVAEQNMIGMAAGLATTGKIVFASSFSMFASGRAWEIIRNLVAYPKLNVKIVATHAGITVGEDGASHQMCEDIAIMRAIPNMVVIAPTDYYHTKNVIRTIAEYKGPVYVRMPRRDTEIIYENEEEATFEIGKGKILVDGEDLTIIATGEEVPEALRAGEILKENGISAEIVEMATIKPIDEEIIKKSKDFVVTVEDHSIIGGLGGAVAEVIASNGLNKKLLRIGINDVFGRSGKADELLKYYGLDGESIAKRIMEEMKKE

SEQ ID NO: 33962 - protein, 234 aa, Methanocaldococcus jannaschii DSM 2661
MIKIGASILSADFGHLREEIKKAEEAGVDFFHVDMMDGHFVPNISMGIGIAKHVKKLTELPVEVHLMVENVDLFVNEFEEMDYITFHIEAVKFPFRIINRIKSIGAKPIVALNPATPLDAIEYILGDVYAVLVMTVEPGFSGQKFIPVMTKKIRKLKSMIVENGYDTKIFVDGGINVETAPLAVKAGADVLVAASAIFGKDDVKTAVKNLREAALEALNKDFLTKSFNSNEEKQ

SEQ ID NO: 33963 - protein, 828 aa, Oryza sativa Japonica Group
MASVDLTPRQARKAYGGDGGTYYEWSPADLPMLELANIGGAKLSLNAGGLALPSFSDSGKVAYVLQGKGTCGIVLPEASKEKVIAVKEGDSLALPFGVVTWWHNLPESPIELVILFLGDTSKAHKAGQFTNMQLTGATGIFTGFFTEFVGRAWDLAESDAVKLVSSQPASGIVKIKSGQKLPEPSAADREGMALNCLEAPLDVDIKNGGRVVVLNTANLPMVKEVGLGADLVRIDGHSMCSPGFSCDSAYQVTYFIRGSGRVQVVGADGKRVLDTHVEGGNLFIVPRFCVVSKIADASGLQWFSIITTPNPIFSHLAGKTSVWKAISPEVLEASFNATPEMEKLFRNRPKITDQKREHKLHYRTRRAEELINIRLEWKQTIERGATRLRRAQPPPGSPSTYGRCRGTSPRVSRTLLVDPDLALDGQGPGGAAAAVAEAFERYRSLVFSPWAHAARNASGGYDVGKLTVVVASADEKLELGVDESYTIYVAAAGGVNSIVGGATIEANTIYGAIRGLETFSQLCVFNYDTKNVEVRHAPWYIEDEPRFAFRGLLLDTSRHFLPVDVIKQVIDSMSFSKLFFQFTYKRCSLISRLKLPDSKAMLGKENVIALQGMCSDYYLHLLGIHVMAEIDVPGHAESWGKGYPKLWPSPKCREPLDVTSNFTFEVISGILSDMRKIFPFGLFHLGGDEVYTGCWNATPHVKQWEETFNSFKENLNPLTVVHNWLGPGVCPKVVEKGFRCIMSNQGVWYLDHLDVPWQDFYTSEPLAGINNTAQQKLVLGGEVCMWGETADTSDVQQTIWPRAAAAAAPVTNSYARRPPIGPGSCFIQ

SEQ ID NO: 33964 - protein, 483 aa, Ostreococcus tauri
MIPAAFDDDLMISFDDDEEDVGEDDKEMEERALIEATVARLRSRQALGKTLMTEKPKAPVAMTAGAKAARKLGRNTVKKSDWQSFVDWKTLEHQEFETLSDEEFAKLSKKLALEPQWRPMVSYLKSLGLKTRDLEKVAINCTDLLNRPVSRVISRVEYLEGELGLEKKNLRQIVNKDPRILLQRNRHSIPRCRYLTKIGLPQEKLADVLGKQPSILHLSVQKGLMPRVQYLKDEVGVSAEDIPLLIQRSPAVLTFSIENQIQPRVEFLYDLGISKENVVKMLTRHPQMLQYSFENLEEKLKFLGDIGMDDNEAALTVTRLSQFFSLSVEDSLRPKFKYMTDELGGTKDTCVKYPAYFSLSLDNRIRPRHKFLEQFDLAPDPFPMKLLSVRDDEFVLRASKSLNEFEEYKTQMVPIFTAQTAREKSLRMNSSMAQHEKLLLERRRVEFIRRNQQETARQREMSDRVAKARQSLRILRNSQHRSR

SEQ ID NO: 33965 - protein, 370 aa, Methanocaldococcus jannaschii DSM 2661
MLSKRLLNFESFEVMDILALAQKLESEGKKVIHLEIGEPDFNTPKPIVDEGIKSLKEGKTHYTDSRGILELREKISELYKDKYKADIIPDNIIITGGSSLGLFFALSSIIDDGDEVLIQNPCYPCYKNFIRFLGAKPVFCDFTVESLEEALSDKTKAIIINSPSNPLGEVIDREIYEFAYENIPYIISDEIYNGLVYEGKCYSAIEFDENLEKTILINGFSKLYAMTGWRIGYVISNDEIIEAILKLQQNLFISAPTISQYAALKAFEKETEREINSMIKEFDRRRRLVLKYVKDFGWEVNNPIGAYYVFPNIGEDGREFAYKLLKEKFVALTPGIGFGSKGKNYIRISYANSYENIKEGLERIKEFLNK

SEQ ID NO: 33966 - protein, 815 aa, Arabidopsis thaliana
MANQAESSDSKGTKKDFSTAILEKKKAANRLVVDEAINDDNSVVSLHPDTMEKLQLFRGDTILIKGKKRKDTVCIALADETCDEPKIRMNKVVRSNLRVRLGDVISVHQCPDVKYGNRVHILPLDDTIEGVSGNIFDAYLKPYFLEAYRPVRKGDLFLVRGGMRSIEFKVIETDPAEYCVVAPDTEIFCEGEPIKREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEIGRLEVLRIHTKNMKLAEDVDLERVSKDTHGYVGADLAALCTEAALQCIREKMDVIDLDDEEIDAEILNSMAVSNDHFQTALGNSNPSALRETVVEVPNVSWEDIGGLENVKRELQETVQYPVEHPEKFEKFGMSPSKGVLFYGPPGCGKTLLAKAIANECQANFISIKGPELLTMWFGESEANVREIFDKARQSAPCVLFFDELDSIATQRGNSVGDAGGAADRVLNQLLTEMDGMNAKKTVFIIGATNRPDIIDPALLRPGRLDQLIYIPLPDEESRYQIFKSCLRKSPVAKDVDLRALAKYTQGFSGADITEICQRSCKYAIRENIEKDIEKERKRAESPEAMEEDEEEIAEIKAGHFEESMKYARRSVSDADIRKYQAFAQTLQQSRGFGSEFRFPDAPTGTTGAFPGAAATVGGVDPFATSGGAADDDDLYS

SEQ ID NO: 33967 - protein, 429 aa, Mycobacterium tuberculosis H37Rv
MSAELSQSPSSSPLFSLSGADIDRAAKRIAPVVTPTPLQPSDRLSAITGATVYLKREDLQTVRSYKLRGAYNLLVQLSDEELAAGVVCSSAGNHAQGFAYACRCLGVHGRVYVPAKTPKQKRDRIRYHGGEFIDLIVGGSTYDLAAAAALEDVERTGATLVPPFDDLRTIAGQGTIAVEVLGQLEDEPDLVVVPVGGGGCIAGITTYLAERTTNTAVLGVEPAGAAAMMAALAAGEPVTLDHVDQFVDGAAVNRAGTLTYAALAAAGDMVSLTTVDEGAVCTAMLDLYQNEGIIAEPAGALSVAGLLEADIEPGSTVVCLISGGNNDVSRYGEVLERSLVHLGLKHYFLVDFPQEPGALRRFLDDVLGPNDDITLFEYVKRNNRETGEALVGIELGSAADLDGLLARMRATDIHVEALEPGSPAYRYLL

SEQ ID NO: 33968 - protein, 181 aa, Aspergillus fumigatus
MEDIHSGPATNTNPIVFFDIALGGVPLGRIKMELFADVTPRTAENFRRFCTGESKNSQGKPQGYKNSKFHRVIKDFMIQGGDFVNGDGTGSCTIYGTPKFADENFVLKHDRAGVLSMANSGPNTNGCQFFITTTATPFLNGKHVVFGQVVDGMDIVRMIENTRTIRDKPSQDVIITQCGEM

SEQ ID NO: 33969 - protein, 494 aa, Geobacillus stearothermophilus
MKRKTKIVCTIGPASESVDKLVQLMEAGMNVARLNFSHGDHEEHGRRIANIREAAKRTGRTVAILLDTKGPEIRTHNMENGAIELKEGSKLVISMSEVLGTPEKISVTYPSLIDDVSVGAKILLDDGLISLEVNAVDKQAGEIVTTVLNGGVLKNKKGVNVPGVKVNLPGITEKDRADILFGIRQGIDFIAASFVRRASDVLEIRELLEAHDALHIQIIAKIENEEGVANIDEILEAADGLMVARGDLGVEIPAEEVPLIQKLLIKKCNMLGKPVITATQMLDSMQRNPRPTRAEASDVANAIFDGTDAVMLSGETAAGQYPVEAVKTMHQIALRTEQALEHRDILSQRTKESQTTITDAIGQSVAHTALNLDVAAIVTPTVSGKTPQMVAKYRPKAPIIAVTSNEAVSRRLALVWGVYTKEAPHVNTTDEMLDVAVDAAVRSGLVKHGDLVVITAGVPVGETGSTNLMKVHVISDLLAKGQGIGASRRSARPL

SEQ ID NO: 33970 - protein, 137 aa, Physcomitrella patens subsp. patens
MSKSLGIPVKLLHEAEGHIVTVELKSGEVYRGSLIECEDNWNSQLESITYTAKDGKVSQLEHVFIRGSKVRYMIIPDMLKNAPMFKRLDAKIKGKGSSGVGVGRGRASTMQAKARSAARGSVPPPMGGRGAAPPMRR

SEQ ID NO: 33971 - protein, 471 aa, Magnaporthe grisea 70-15
MPPARTARGQLVSNENDENAGSTRMTRTKAKAAALNVDELALPTKQLQTKKGVAGKPAPTTRTTRNALGDVSNVTKVDAGRKAVGGKAGAVAKAAAPAGVQKSSARTAPTRSALSSKPANVTNGNAEKQSGRGTLSKRKAPAQAAANNIKEESTLEGEPARKQARVAATAAVDTKRAAPAKELKCVEPELKPTREFIRDPRLLAGEVPPGVIDLSMDDYDDPLMVAEYAEEIFSYMLNLELSSMPNPNYMDHQDDVEWKTRGILIDWLIEVHTRFHLVPETLFLAVNIVDRFLSEKVVQLDRLQLVGITAMFIASKYEEVMSPHVTNFRHVTDDGFSESEILSAERFILSTLNYDLSYPNPMNFLRRVSKADNYDTPCRTIGKYLMEISLLDHRFLQYRPSLVAASAMALSRIILDRGEWDKTISYYSGYNEDDVEPVVNLMVDYLSRPVIHEAFFKKYASKKFFKAIDQL

SEQ ID NO: 33972 - protein, 101 aa, Streptococcus thermophilus
TKQAEGLGIPLKSVDDIDSIDVTVDGADEVDPQLNGIKGGGGALLMEKIVATPTKKYIWVVDESKMVDQLGAFKLPVELFNMALIACISTLNLRAISHHSE

SEQ ID NO: 33973 - protein, 432 aa, Oryza sativa Japonica Group
MAMSSSRSAAAIRGRRVGALARARRHATRAMASLFGHVEPASKDPILGVTEAFLADPSPDKVNVGVGAYRDDNGKPVVLECVREAERRIAGNLNMEYLPMGGSIKMIEESLKLAYGEDSDFIKDKRIAAVQALSGTGACRLFADFQRRFLPNSQIYIPTPTWSNHHNIWRDAQVPQRTFTYYHPESRGLDFAGLMDDIKNAPNGSFFLLHACAHNPTGVDPTEEQWREISYQFKIKNHFPFFDMAYQGFASGDPERDAKAIRIFLEDGHQIGCAQSYAKNMGLYGQRAGCLSILCEDEMQAVSVKSQLQQIARPMYSNPPVHGALVVSIILNDPELKSLWLKEVKGMADRIIGMRKALRENLEGLGSPLSWDHITNQIGMFCYSGMTPEQVDRLTNEYHIYMTRNGRISMAGVTTGNVAYLANAIHEVTKTK

SEQ ID NO: 33974 - protein, 156 aa, Ustilago maydis
TPAGRLKCELFSDIVPRTSENFRQLCTGEFRPNHVPEGYKNSIFHRIIKDFMCQGGDFINADGTGSRSIYGDKFDDENFTLKHDKAGLLSMANSGPGTNGCQFFITAQPCPFLDGKHVVFGKVVDGLLTLRKMENVPTGANNRPKMAVRITQCGEM

SEQ ID NO: 33975 - protein, 346 aa, Prochlorococcus marinus str. MIT 9312
MFGLIGHSTSFEDAKRKASLLGFDHIADGDLDVWCTAPPQLVENVEVKSATGISIEGSYIDSCFVPEMLSRFKTARRKVLNAMELAQKKGINITALGGFTSIIFENFNLLQHKQIRNTSLEWERFTTGNTHTAWVICRQLEINAPRIGIDLKTATVAVIGATGDIGSAVCRWLVNKTGISELLMVARQQQPLTLLQKELDGGTIKSLDEALPQADIVVWVASMPKTIEIEIENLKKPCLMIDGGYPKNLDEKFKGKNIHVLKGGIVEFFNDIGWNMMELAEMQNPQREMFACFAEAMILEFEKCHTNFSWGRNNISLEKMEFIGAASLKHGFSAIGLDKQPKVLTV

SEQ ID NO: 33976 - protein, 384 aa, Thermotoga maritima
  misc_feature (1)..(1): Xaa can be any naturally occurring amino acid
  misc_feature (21)..(21): Xaa can be any naturally occurring amino acid
  misc_feature (38)..(38): Xaa can be any naturally occurring amino acid
  misc_feature (46)..(46): Xaa can be any naturally occurring amino acid
  misc_feature (106)..(106): Xaa can be any naturally occurring amino acid
  misc_feature (111)..(111): Xaa can be any naturally occurring amino acid
  misc_feature (146)..(146): Xaa can be any naturally occurring amino acid
  misc_feature (251)..(251): Xaa can be any naturally occurring amino acid
  misc_feature (265)..(265): Xaa can be any naturally occurring amino acid
  misc_feature (277)..(277): Xaa can be any naturally occurring amino acid
  misc_feature (338)..(338): Xaa can be any naturally occurring amino acid
XRVYFDNNATTRVDDRVLEEXIVFYREKYGNPNSAHGXGIEANLHXEKAREKVAKVLGVSPSEIFFTSCATESINWILKTVAETFEKRKRTIITTPIEHKAVLETXKYLSXKGFKVKYVPVDSRGVVKLEELEKLVDEDTFLVSIXAANNEVGTIQPVEDVTRIVKKKNKETLVHVDAVQTIGKIPFSLEKLEVDYASFSAHKFHGPKGVGITYIRKGVPIRPLIHGGGQERGLRSGTQNVPGIVGAARAXEIAVEELSEAAKHXEKLRSKLVSGLXNLGAHIITPLEISLPNTLSVSFPNIRGSTLQNLLSGYGIYVSTSSACTSKDERLRHVLDAXGVDRRIAQGAIRISLCKYNTEEEVDYFLKKIEEILSFLDLTGNNRR

SEQ ID NO: 33977 - protein, 90 aa, Malus xiaojinensis
TGVRMGALGLMLNSVILGITSVLMEKLCRKWGAGFVWGISSILMTLCFFAMLVITFVNKSIGVGGHDLPPDGIVIAALVVFAVLGIPLAI

SEQ ID NO: 33978 - protein, 891 aa, Thermobifida fusca YX
MPKYVYDFTEGNKDLKDLLGGKGANLAEMTNLGLPVPPGFTITTEACRHYLEHGTMPPGLDAQIEEKLAALEATMGKRLGQPDNPLLVSVRSGAKFSMPGMMETVLNIGLNDESVKGLAAQSGNERFAWDSYRRLIQMFGKTVLGIDGDLFEDAIDDLKARKGVTSDLDLDAADLAGLVDTFKTIVREATDAEFPTDPREQMRLAIEAVFKSWNAPRAVLYRRQERIPSDLGTAVNICSMVFGNLGMDSGTGVAFTRDPATGQQGVYGDYLQNAQGEDVVAGIRNTIPLTELERIDPKSYAELLEIMEKLERHYRDLCDIEFTIERGKLWMLQTRVGKRTAAAAFRIANQLVDQGLITLEEAVNRVSGEQLAQLMFPRFDEKAERDLLGRGMNASPGAAVGRAVFDSATAVAWSRNGEKVILCRRETNPDDLEGMLAAQGILTSRGGKTSHAAVVARGMGKTCVCGAEELDIDTKNRQLTAPDGRVIKEGDVISIDGTTGEVFLGEVPVVASPIVRYFEGELDPSSAEADDLVRAVDRIMRYADAKRRMAVRANADTPEDAARARRMGAQGIGLCRTEHMFLGDRRALVERLILADTDQERDEALAALLPLQREDFTGIFEAMDDLPVTVRLLDPPLHEFLPDITELSVRVAVAEARGEKNEGDLRLLQAVHRLHEQNPMLGLRGVRLGLVVPGLFTMQVRAIAEAAAARIKQGGRPRPEIMIPLVGTVQELEIIREESVQVIREVAAEHGVELDIPIGTMIELPRAALTAGQIAESAEFFSFGTNDLTQTTWGFSRDDVEASFFSTYLEKGVFGVSPFESLDVDGVGRLVRIAAEEGRATRPGLKLGVCGEHGGDPASVHFFHEVGLDYVSCSPFRVPVARLEAGRAALR

SEQ ID NO: 33979 - protein, 199 aa, Triticum aestivum
MGKSKSKGAKFAAVKKIISKKTIKKYKEEVLDPRKKDTEKEKLGRNVPQVSSALFFSYNMALGPPYRVIVDTNFINFSIQNKLDLEKGMMDCLYAKCTPCITDCVMAELEKLGQKYRVALRIAKDPRFQRLACTHKGTYADDCIVERITQHKCYIVATCDRDLKRRIRKVPGVPIMYITQHRYSIERLPEATIGGAPRI

SEQ ID NO: 33980 - protein, 361 aa, Azoarcus sp. EbN1
MAGIETRRACAMNSGNTAGAAEGGSRAATGEGQPALPRIALLGTGGTIAAVASDATQLHDYTVGATTDELLAAVPQLRALAEVGGEQLANVDSRDIDNALLLKIARRVDALLGQPDVDGIVITHGTDTLEETAYFLNLVLKSAKPVVLAGAMRPASALSADGPLNLYNAFLVATCAAAHGKGVLVMMNDRIGAARFVTKAATTVPDAFRAFEQGNLGEVAVGSVHFFTAPLCRHTVDSEFSLAAIGELPHVDILYDHQGAGLHQYRAAISAGARGIVIAGCGNGSLSPAARAGAEEAARHGVAVVRSSRVGQGVVTTSADDALLGTVAANSLNPHKARILLMLALGRSHDAGELQRCFDQY

SEQ ID NO: 33981 - protein, 643 aa, Azoarcus sp. EbN1
MEERLKSVAGLARSVAHQLAALNPARFPLILGGDHAIAIGTWPAIASRVATRGTLGLIWIDAHLDSHTGASTHSGNIHGMPLAAVLGEGDSLLTAIPGPRLDPHNVCIIGARSWEPEEFERLQRLGVTIFDMATIRERGLSAVFSDALGVVRRNTAAFGVTLDLDALDPTSFPAVTCLESGGLAADELSDALLALRACPDFAALEIVEYVPGLDPLGAGAAWIAEFAGAALGPGTALLRAKEQHFGAHNYAPLPVVFHRGQGVWLWDVEGRRYLDMMSAYSAVSFGHGHPRLLRALNDQAQRLALTSRAYSTDRLPLLLERLCTMFGYERALPVNTGLEAVETALKTVRKWAYKVKGVAPDRAGIIACEGNFHGRSIAIVGMSSEAQYRDGFGPFPPGFTLVPYADADALEAAITPDTAAFLVEAVQGEGGIIVPPDGYLARCAEICRRNNVLLVVDEVQTGLGRTGRLLACEHEGVHPDGVILGKALGGGLLPVSAFLADAAVMDVLHPGDHGSTFGGNPLGAAVALEVLDLLEETRPWENAARLGEHLMRRLADGAPPCVKAVRGRGLLVGIELDPRILDAATGAELLLARGIATKDTHHTVLRFAPPLVIDDAVLDGGIDVILDTLATASRRREHGPLHG

SEQ ID NO: 33982 - protein, 245 aa, Prochlorococcus marinus str. MIT 9312
MILRTFKSDIAIIKERDPAARGILEIFLCYPGFQSIVIHRLTHQLWQLKIPLIPRLLSHLNRLVTGIEIHPGAKIGKRVFIDHGMGVVIGETAEIGNNCLLYQGVTLGGTGKSHGKRHPTLMENVVVGAGAKVLGSITVGSNTRIGAGSVVVRNVEGNSTVVGVPGRVVHQSGVKVNPLAHSALPDTEANVIKNLMDRIDSLENEILKLQKTLLCLANSESIDISKLGEAQNLKDKEIIEFLGDD

SEQ ID NO: 33983 - protein, 544 aa, Glycine max
MATSLSVSPSLSLNTLFIAKALPLSRPSFLSLPLPKSLLSLSTRRRTFIVRAESQNGRDPVPAHYDFDLFTIGAGSGGVRARRFAANYGASVAICELPFSTISSETTGVGGTCVIRGCVPKKLLVYASKFSHEFEESNGFGWRYDSEPKHDWSSFIANKNAELQRLTGIYKNILNNAGVKLIEGHGKMIDPHTVDVNGKLYSAKHILVAVGGRPFIPDIPGKELAIDSDAALDLPTKPVKIAIVGGGYIALEFAGIFNGLKSEVHVFIRQKKVLRGFDEEIRDFVEEQMSVRGIEFHTEESPQAITKSADGSFSLKTNKGTVDGFSHIMFATGRRPNTQNLGLESVGVKLAKDGAIEVDEYSQTSVYSIWAVGDVTNRINLTPVALMEGGALVKTLFQDNPTKPDYRAVPSAVFSQPPIGQVGLTEEQAVQQYGDIDIFTANFRPLKATLSGLPDRVFMKLVVCAKTNEVLGLHMCGEDAPEIVQGFAVALKARLTKADFDATVGIHPSAAEEFVTMRTPTRKIRKSESSEGKSGSQAKAAAGV

SEQ ID NO: 33984 - protein, 90 aa, Triticum aestivum
  misc_feature (66)..(66): Xaa can be any naturally occurring amino acid
MAQPAFLSSLRSRLGSAPPPPPNHRLQPRRGYHVELGAREKALLEEDVALKRFKSYKNSVKQVSKXGNALTLAVVLACSYELAVLATSTK

SEQ ID NO: 33985 - protein, 218 aa, Brassica napus
GRLDGWASWSSSVTSRSYRTGYSASWSPVNGSRHRSLSFLSASPQGLKAHELCVRFQRKSGRSSVFMQDGAIVTNSDSTESSKSSFKGLKDEVLSVLSEEAAKVGSESDGQNQSTVSITVVGASGDLAKKKIFPALFALYYEDCLPEHFTIYGYSRSKMTDVELRNMVSKTLTCRIDKRANCGEKMEEFLKRCFYHSGQYDSQEHFTELDKKLKEHEA

SEQ ID NO: 33986 - protein, 449 aa, Burkholderia cepacia
MQKYDFDLFVIGAGSGGVRAARIAAGHGAKVAIAEEYRFGGTCVIRGCVPKKLLMYASQYGQGFEDAAGFGWHSAATSHSWTSLIAAKDAEIARLEGVYQRLIENANVEIFKGRAQIAGPNRVTVTGASVSARTILIATGARPVMPPVAGANLMITSDDVFDLPVGPPRIAIIGGGYIACEFAGIFNGLGRHVVQLHRGSQVLRGFDDELREHLGDELKKSGIDLRLGVDVVAVERQRGALSVQLTTGDAMEVDAVMAATGRLPNTWGLGLETVDVGLDQNGAIKVDEYSRTSSPGIYAVGDVTNRLNLTPVAIHEGHAFADTVFGGKALPTEHENVPFAVFSQPQAASVGLSEAQARDRYSNVEIYGSAFRPMRAALSGRDEKALVKLVVNGSNDRVVGAHIVGADAAEIIQGIAVAIKARATKADFDATLGVHPTLAEEFVTLRNRR

SEQ ID NO: 33987 - protein, 355 aa, Physcomitrella patens subsp. patens
MSAYWGKYADELIRTAKYVATPGKGILAADESTTTIDARLSSINVENTEANRQALREMLFTAPGVHQYLSGVLMLEETLYQKTVAGKPFVKLLKEGGVMTGIKVDTGTIPLAGTNDETMTQGHDGLGARCKKYYDAGARFAKWRAVLKIGHTEPSELSVQQNAQGLARYAILCQENGLVPIVEPEVISDGTHDIRKCAEVTERVLSACYKALNDQHVLLEGTLLKPNMVTSGSDAPKVSSDIVAKFTVRCLQRTVPPAVPGIMFLSGGQSEEEATLNLNAMNALQTLKPWTLSFSYGRALQESVLKTWAGEKKNWVAAQRVLYNRAKANSEAVLGKYRGDSGGEAGNLFVRDYKY

SEQ ID NO: 33988 - protein, 334 aa, Arabidopsis thaliana
MVKKGGTKRKIAIETIQKRDSLRVTCTKRREGLYSKASQLCLLSDAQIAILATPPSSESNVSFYSFGHSSVDAVVSAFLSGQRPVPKDNKETREDVGICLTRNNLGLGFWWNDESLARSENPQEISEAIDSMRTLLRNLKELRADEALACNQAFVNDREDLKNNDKCDFVSDHETHDQTLILQSASPICCIPENLNEITQEPNQTLNIQSSTSAICCVPDNSPENFNEITEEQDQIRSICETFCVMDNNAALPEMNLDYDQDIGFDTPFESALNDWFSDNTTHQEISASILNAVVDDQVSVDLTPFSYFQRCLDGDNLRFSDCFKDFANTISAL

SEQ ID NO: 33989 - protein, 313 aa, Gloeobacter violaceus PCC 7421
MSASLGATRFRPDLLSLDDLDEAQLHALLTLAHQLKRGERVANLHGKVLGLVFLKASTRTRVSFTVAMYQLGGQVIDLSPSNTQVGRGEPVRDTARVLGRYVDGLAIRTFAQTELEEYAHYAGIPVINALTDHEHPCQVVADLLTIRENFGRLAGLKLAYVGDGNNVAHSLLLGCAKVGMSIAVATPEGFTPDPAVSARASEIAGRTGAEVQILRDPFEAARGAHILYTDVWTSMGQEAETQHRLQLFEQYQINAALLNCAAAEAIVLHCLPAHRGEEITDEVMEGPRSRIWDEAENRLHAQKAVLAALMGGR

SEQ ID NO: 33990 - protein, 311 aa, Oryza sativa Indica Group
MAALAQLAGAAVRVALAALLALLLPAYRVYRLTASFLGALLAAAAADDVAGKVVLITGASSGIGEHLAYEYARRGAYLALVARREESLREVGDAALAAGSPGVLVVAGDVSSPDDCRKFVDDTIRYFGRLDHLVNNASIWQVGKFEELTDVNHFRKLMASKAAAANLYETLRMELAGDGIAITEVIPGVVESEITKGKMLTKEGDMRVDQDERDAILGAAPVERAGEFARAAVRGVCGGERYVFEPRWYRAAYTLRVCFPEALEWCARLLTVWRLGPATTDTVGRWLLLGVPGQRWLSQPASLRSPEIKAR

SEQ ID NO: 33991 - protein, 513 aa, Fulvimarina pelagi HTCC2506
MSEDNLIDVLVIGGGINGAGIARDLAGRGLSVILCEKDDLAEGTSSRSGKLVHGGLRYLEYYEFRLVREALIEREVLLNAASHIIWPMRFVLPHSPEDRPAWLVRLGLFLYDHLGGRKRLPGTRMLDLKRDPEGAPILDKYTKGFEYSDCWVDDARLVVLNAVGAAEMGAEILPRTACTSARRDGETWTAELKSETTGATRKVRARCIVNAAGPWVNDIVGRVAGRNSRRNVRLVKGSHIIVRKFWEGPQAYLVQNHDKRVIFINPYEGDKALIGTTDIAFDGRAEDATADESEIEYLMAAVNRYFKEKLRREDILETFSGVRPLFDDGQGNPSAVTRDYSFDLDEDGGAPMLNVYGGKITTFRELAEHAAGKIAKFFPKIGKDWTADTPMPGGEIENADFIAFVEKMRARFPGFPRDLLIHYGRLYGARMEKFIGGAKTPDDLGRHFGALLYEAEVRYLVKHEWAMRPEDVLWRRTKQRLHLTKDEQEAFAGWFEDTVRSSGVGGGFHAAAQ

SEQ ID NO: 33992 - protein, 179 aa, Vitis vinifera
MGREEEEEEEVRTPSSPPQSQSSHMLVLSILSKRRTWVCLFILVYAALLFFSWNLLKTILSWYNNSMSSSSPPSSFGWPALYASVLLGVVFGLLSMVAALAVAVPATLVTWITVLVLLTFCGKPRRTLVVEGRMITAEITGFVLKILLKEGNVVAAICAVLGYFALVRRRGEVDLDKFG

SEQ ID NO: 33993 - protein, 404 aa, Porphyromonas gingivalis W83
MYDIQKIREDFPILHTRVHGKPLIYLDNAATTQKPIAVLDQIERAYRTFNANIHRGVHHLSQVATEQHENARKRIARYIGAEDPKEVLFTRGTTEAINLVASSFGQAFVRSGDEIIISTLEHHSNIVPWQLLAERTGARLRVIRLTESGELDVEHFRSLLNERTKIVSIAHVSNVLGTINPIRRITDLAHAAGVPVLVDGAQAIAHCRVDVRELGADFYAFSGHKVYAPTGIGVLYGKAEWLEKIPPYHGGGEMIAKVTFEKTTYNELPYKFEAGTPDYVGSTALATALDYIEGLGLEAIAAHEDKLLRMATEGVRAFPNARIIGEAEHKSGVLSFLIGDIHPYDLGMLLDRLGIAIRTGHHCAEPLLESMGLNATARASFALYNTEEEVEQFLQALKRVVSMF

SEQ ID NO: 33994 - protein, 512 aa, Physcomitrella patens subsp. patens
MANYIIASNALVLLAFVTFFFVYFLRAFILRDKKLRPKYPPSPWKWPILGNLPQLLRGGPACHTTFRLLAKELGPVYNVWLGGSFPMVIVTGEETVHEALIKQSSVFSSRPKLLSWQHISAGFKTTMTSPFGPHWQKLRKTISVDLLGPSKLASYKPIRDSEIQKLLARLREQAHANAGLVSPLDQLRTSAVDVIMRIGFGEEFALMEAVNSNRRHAKILVIDSSVVARTLLFPLARSANRNIETVADNTVSLVMPIVQQRKRYLQDHPATETRTFVDALISCKGESALTDLEIVWNVVELMVGGTDNTSHILEWALANMVKYPHIQEKVYTEVRCAMGPNLERRLVEESELDKLPYLQAVVKESMRRHMMTPLAIPKLAAQDCKLSGYDIPKGTMVVFHAGALAMDDDIWTDPLNFRPERFLAGTGSSNAPVTQTHKHAFMPFGAGRRSCPGAAMGFLHLHHLFANLIYAFEWGPESPRKAVDFTEKFRMVVTMKNPLRATIKERTHFRMM

SEQ ID NO: 33995 - protein, 180 aa, Medicago sativa
MALISSAAVTTVNRASSAQANLVAPFTGLKSSAGFPVTKKTNNDITSIASNGGRVNCMQVWPPVGKKKFETLSYLPPLTEEQLAKEVEYLIRKGWIPCLEFELEKGFVYRENHRSPGYYDGRYWTMWRLPLFGATDSSQVLKELADCKAEYPDSFIRIIGFDNVRQVQCISFIAHTPKNY

SEQ ID NO: 33996 - protein, 142 aa, Symbiobacterium thermophilum IAM 14863
MRLRDLMTTDVRTCAPDTPVSEVARIMEEADCGFVPVVDGGRVAGVITDRDIVLRAVARGRDIRTTTARECMTSPAVTVGPDTDAHAAADLMADKQIRRLCVVDGGRLVGVVALGDLATERIHVDEAGEALSSISEPAQPAH

SEQ ID NO: 33997 - protein, 251 aa, Triticum aestivum
  misc_feature (215)..(215): Xaa can be any naturally occurring amino acid
MPVSRIAVGSHREVYEVGALKAALAEFISTLIFVFAGQGSGMAFSKLSPDGAATPAGLISAAIAHAFALFVAVSVGANISGGHVNPAVTFGAFVGGNITLFRGLLYWVAQLLGSTAACFLLRFSTGGLPTGTFGLTGIGAWEAVVLEIVMTFGLVYTVYATAVDPKKGSLGTIAPIAIGFIVGANILVGGAFSGASMNPAVSFGPALVSWEWGYXQWVYWVGPLIGGGLAGVIYELLFISRTHEQLPTTDY

SEQ ID NO: 33998 - protein, 112 aa, Brassica napus
MESSRGGGQGGIQQLLAAEQEAQHIVNAARTAKMARLKQAKEEAEKEIAEYKAKTEQDFQRKLEETSGDSGANVKRLEQETDAKIEQLKNEASRISNDVVEMLLKHVTTVKN

SEQ ID NO: 33999 - protein, 181 aa, Lactuca sativa
MASISSSAIATVNRTTSTQASLAAPFTGLKSNVAFPVTKKANNDFSSLPSNGGRVQCMKVWPPIGLKKYETLSYLPPLSDEALSKEIDYLIRNKWIPCLEFELEHGFVYREHHHSPGYYDGRYWTMWKLPMFGCTDSAQVMKEVGECKKEYPNAFIRVIGFDNIRQVQCISFIVAKPPGVL

SEQ ID NO: 34000 - protein, 158 aa, Prochlorococcus marinus str. MIT 9312
MAIFEGSFTSASTLKVGIVIARFNDLITNKILSGCLDCLKRHGLDTSELSNQVDIVWVPGSFELPIAAKTLMKKKSYDVVIALGAVIRGETSHYDVVISEASKGISQVSNENNVPIIFGVLTTDTMQQALERAGIKNNLGWNYALQAIEMGSLIKNLN

SEQ ID NO: 34001 - protein, 597 aa, Thermobifida fusca YX
MNLPVLSRDSALRPVLDRFRVMIPARADLARMRHAPGRNLLAGVTVAVVALPLALGFGISSGLGAQAGLVTAIVAGALAAFFGGSNLQVSGPTGAMTVVLVPIVAQHGPSGVLTVGLMAGLMLVLLALLRAGRYVRYIPASVVEGFTIGIAAVIALQQVPAALGVPVPEGDRVLVVAWQAVLDFAAHPEWTAVAIALGVVVVMLVGARWRPTVPFSLMAVVLATVLVEVTPLHAERIGDLPAGLPAPSLGFLDLSQVGTLVAPAAAVAALAALESLLSATVADGMSVNQRHDPDRELFGQGVANIAAPLFGGVPATAAIARTAVNVRSGASSRLAAITHALVLAGIVYLAAPLVERIPLAALAGVLLATAVRMVEVGSVRAMVRATRSDGVVLVLTAVVTLTVDLVVAVLVGMLVAGALALASLARNASLDQEELARHLPPGDHTEEERALLAKHIVAYRIDGPLFFAAAHRFLLELSEVADVRVVILRMARVSTIDATGAQVLGDAVDRLQARGITVMMSGLRPGQLRPLESLGTLPRLREAGCVFETTPEAIQAALTMLHHAGVIPSSLRSAEAAPQGAAVLSSPGHQAPAPGKA

SEQ ID NO: 34002 - protein, 180 aa, Stellaria longipes
MASSIMSSAAVATRSNGAQASMVAPFTGLKSNASFPVSRKTNLDITSIASNGGRVRCMQVWPPINMKKYETLSYLPDLSSEQLLSEIEYLLKNGWVPCLEFETEHGFVYREHTSSPGYYDGRYWTMWKLPMFGCTDATQVAAEVQEAKKAYPDAHIRIIGFDNVRQVQCISFIAYKPEAF

SEQ ID NO: 34003 - protein, 168 aa, Saccharum sp.
MALTVMASSATAAAPFQGLKSTASLPVARRSTTSLAKVSNGGRIRCMQVWPAYGNKKFETLSYLPPLTQEQLLKQVDYLLRNNWVPCLEFSKEGFVYRENSTSPCYYDGRYWTMWKLPMFGCTDASQVYKELQEAIASYPELRAILGFDNIRQTQWLTFIAYKPAGSE

SEQ ID NO: 34004 - protein, 182 aa, Manihot esculenta
MASSMLSTATVASINRVSPAQATMVAPFTGLKSTPVFPTTRKTNSDITSITSNGGKVQCMKVWPTLGMKKFETLSYLPPLTREQLASEVEYLLRSGWIPCLEFELEHGLVYREHARVPGYYDGRYWTMWKLPMFGCTDAAQVLKELDELIKHHPDGYARIIGFDNVRQVQCISFLAYKPPGA

SEQ ID NO: 34005 - protein, 488 aa, Triticum aestivum
ELSAVYKGQEIRAHKGAIVAMKFSSDGQYLATGGEDGVVRVWRVVEGERPDELDFAEDDPSCVFFTVNENSELAPVNSSEGTKSKQDKSSKGQADPACVVIPHRTFALSQVPVHEFYGHDDAILDLSWSKNGDLISASMDKTARLWRVGCNSCLKVFYHNNYVTCVQFHPTSDNYFISGCIDGLVRIWDVRKCLVVDWANSKEIITAVCYRPDGKGVVVGTITGNCRYYDASENRLELESQVSLNGRKKSPLKRIVGFQYCPSDPKKLMVTSGDSQVRILDGVHVISNYKGLQSSSQVAASFTPDGDHIISASDDSRIYMWNHVNQLAPVTSRVKTVWSYERFFSNDASIAIPWNASQSRNSISLACNIPSLRQEVSGDLCDIQDSSTSRCQTEDCLEDDNMFQLPSGNFTLSRAFLAESAPRGTATWPEEHLASNSTTASMLRKSQYKFLKASCQNAATHAWGQVIVTASWDGHIRSFQNYGLPVQV

SEQ ID NO: 34006 - protein, 333 aa, Cryptococcus neoformans var. neoformans B-3501A
MAPASHFTFNNGKKIPSIGLGTWQSEPGQVAKAVESALKSGYRHIDCAWAYGNEKEVGEGLKASGVPREEIHITSKLFELHHHPEHVELACKDTLKNLGVEYLDLYLLHWNINFQVDAPKGTVPTFDHAVKADNGKIKLDVALADNVMPTWREMEKLVEKGLVKSIGISNFNIHRTEKLLKEAKIKPVADQVELSIQCPQHELVAYLKSKDILPQGYSPLGGTGKSNLRENDVVQKIADKYKVQTANILLSWLVMRGINPVPKSVTPERIANNLKLVDLSQEDFKELEKLAESHPPKRVCDQSEDFEPKYDIFQENDPEFSDKAQFAKLGLKL

SEQ ID NO: 34007 - protein, 128 aa, Brassica napus
MLKFLSKVKIEFNTLDPRLASCVEFLAQCNARKAKESNPNCQVLVKRRTDDQPPQISVTFVNGVEEAFDAAATSAQSIRKMILDKGQYLETEQMFREAGEQWPVIIPEEEIHQEAPGVKPRKAEDKKQ

SEQ ID NO: 34008 - protein, 586 aa, Prochlorococcus marinus str. MIT 9312
MALLVKKFGGTSVGDIKKIQNIATSICQSKEAGNEIVVVVSAMGHTTDNLNSIAESISKNPNRRELDMLLSTGEQVTIALLSMALNEYGIPAISMTGSQVGIITESIHGKARILDIQTGRIQNYIDQGFVVVVAGFQGTTLSHTGSMEITTLGRGGSDTSAVALSTALGAETCEIYTDVPGVLTTDPRIVPNAKLLDSISCEEMLELASVGASVLHPRAVEIARNYGIKLCVKSSQSNSSGTLLESQIQPLPLKRGSLELTKTVNSLEVLENQAVFSLSNIPDRPGIAAQIFEKLSEASINVDLIIQATNDGNNNDITFTVSALEAQKTAEQCELITSQLGGEYNLKTNMTKLSIQGAGIMGRPSVSADLFDTLSQANINVRLIATSEIKVSCVIEINNIPKAIRFVAEKFKLSDTQIFVNPIYEKQDQPEVRGIALDKNQVQVSFRKLPDRPGVAASICLALAENNLLFDTIVQSERISSLKAKDISLTMNKQDREKAKLVFEALTKKLPGSYIEDGPAIAKVSTVGAGMAFKVGTAGKIFRALANQNINIEMIATSEIRTSCIVLEKDCDKAVNAIHNHFELEK

SEQ ID NO: 34009 - protein, 201 aa, Azoarcus evansii
MPCYEIDGLRPVVHPSAYVHPDAVLVGDVHIGARCYVAPLASLRGDFGPIILREGANVQDCCVMHGFPGIDTLVEENGHVGHGAILHSCHVGRNALVGMNAVVMDRAVIGESSIVAACSFVKAGMEIPPQVLVAGVPAKVVRTLTRQEMDWKVEGTRCYHDLAARSLTTLKPCEPLTEAEADRPAMVLPEVVPLFELKRRS

SEQ ID NO: 34010 - protein, 487 aa, Blumeria graminis
MSQVDVENITVEALPKLLETDSRVKVAGIDADGILRGKVISKDKFLGVAADGFGFCSVLFGWDMHDRMYSKELKICSARNGCNDILARPDLSTFRRIPWEDNIPFFLVTFIDPVTVKPIIACPRGLLKCTINNLKTQGIQAMAGVEIEFSQFKLPSEISGAQSKNVSIASFLKDHNINALEPLTDGMFGYSLTRMAQNKEYFYSIFDTCEKFRCGIESWHTESGPGVFEAALKFSEIQQMADKATLFKYLVKSIAIPYGITPCFMAKPRQGMLGNSGHIHISLIDNNGNNLFARAARDEGAKYQDIAHLSDLGRQFLAGILDGLTDIMPMLAPNINSYKRLVENFWAPVTVSWGLEHRAASIRVIAPPTSKSGATRIEVRVPGADINPSYALAAILALGWRGVEKKLEISIPPLQTGLNVGETSDSGIRLAKSLREATEIFMRPESIAREVFGNDFVDHYGGTRENEYRLWDEAVTDWETQRYIETV

SEQ ID NO: 34011 - protein, 424 aa, Oryza sativa
  misc_feature (255)..(255): Xaa can be any naturally occurring amino acid
MAAAVAASSSSSSSSCAAVGVATASHPHRHRQARFVVSPPAPASPAALLWRRPRRVAPTTFCSAPSLGRVGWPRREGAAWLLSFRAGPVSSPSSAAAGDPSQALSALLPLVVAATAVAALGNPATFSWVSKEYYAPALGGIMLSIGIKLSIDDFALAFKRPVPLTIGYMAQYIVKPLMGVLIARAFGMPSAFFAGFVLTCCVSGAQLSSYASFLSKGDVALSILLTSCSTISSVVVTPVLTGLLIGSVVPVDGIXAMAKSILQVVLVPVTLGLLLNTYAKAVVNVIQPVMPFVAMLCTSLCIGSPLAINRSKILSSEGFLLLLPIVTFHIAAFIVGYWISKLPMLRQEEPVCRTISVCTGMQSSTLAGLLATQFLGSSQAVPAACSVVIMAIFGLTLASYWGNGLRIRDIGSRFVPQASAGVSS

SEQ ID NO: 34012 - protein, 462 aa, Streptomyces sp. KO-3988
MPELPAIRRAPRRLPLAGHAVPLLVQPLEFLKSLPALGDMVRVRMGPDDAYVPCDPALFRQILKDTRLYDKGGLFYDRGREAVGNGLVTSRWADHRRQRPLMQPSFDHRHIGHYAELMADETEALMRSWRSGEVVDVDKAMARLTLRITTRSLFSVPADHTLVAQVEKWLPILMDGFFRRMFVPARVLSLVPGKMNRQYPPPIAEMRKLTEEIIDEVRRKKDEDPGLLAGLMNARDETTGAPLGTQEIFDQVLILLIAGSETTATALAFTFHLLGAHPEIGARLREEVDGALGGRTPRFEDLSGLTFTRQVLMESLRLYPPAWMFTRSTTTACELGGHAFPEGTTFLLSPYILQHDPELFPRPERFDPDRWRPGAMSDVARRSVLPFGAGGRKCIGDQFALNEAMLAVAAIAGRWNLTPVGDRPIRPIARATLKTGPLPMRLQERPHEPVRNATTTDLRDQR

SEQ ID NO: 34013 - protein, 399 aa, Caulobacter crescentus CB15
MNIHEHQAKAVLAEFGAPVPRGFAAFTPDEAAAAAEKLGGPVFVVKSQIHAGGRGKGKFEGLGPDAKGGVRVVKSVEEVRSNAEEMLGRVLVTHQTGPKGKQVNRLYIEEGAAIAKEFYLSLLVDRASSKVSVVASTEGGMDIEDVAHSTPEKIHTFTIDPATGVWPTHHRALAKALGLTGGLAKEAASLLNQLYTAFMAKDMAMLEINPLIVTADDHLRVLDAKLSFDGNSLFRHPDIKALRDESEEDPKEIEASKYDLAYIALDGEIGCMVNGAGLAMATMDIIKLYGAEPANFLDVGGGASKEKVTAAFKIITADPAVKGILVNIFGGIMRCDIIAEGVIAAVKEVGLQVPLVVRLEGTNVELGKKIISESGLNVIAANDLSDGAEKIVAAVKGAR

SEQ ID NO: 34014 - protein, 530 aa, Solanum lycopersicum
MADVEGSPGSSMHGVTGREPVLAFSVASPMVPTDTSAKFSVPVDTEHKAKQFKFYSFSKPHGLTFQLSWISFFTCFVSTFAAAPLVPIIRDNLNLTKMDVGNAGVASVSGSILSRLTMGAVCDLLGPRYGCAFLIMLSAPTVFCMSFVSSAGGYVAVRFMIGFSLATFVSCQYWMSTMFNSKIIGLVNGTAAGWGNMGGGATQLIMPLLYDIIRRAGATPFTAWRIAFFIPGWLHVVMGILVLTLGQDLPDGNRGTLQKTGTVAKDKFGNILWYAATNYRTWIFVLLYGYSMGVELSTDNVIAEYFFDRFDLKLSTAGIIAATFGMANLLARPFGGFSSDYAAKKFGMRGRLWVLWILQTLGGVFCVLLGRSNSLPLAVTFMILFSIGAQAACGATFGIIPFISRRSLGIISGMTGAGGNFGSGLTQLLFFTSSKYSTATGLTYMGFMIIGCTLPVTFCHFPQWGSMFLPPTKDPVKGTEEHYYTSEYTEAERQKGMHQNSLKFAENCRSERGKRVGSAPTPPNLTPNRV

SEQ ID NO: 34015 - protein, 186 aa, Oryza sativa
  misc_feature (53)..(53): Xaa can be any naturally occurring amino acid
  misc_feature (105)..(105): Xaa can be any naturally occurring amino acid
  misc_feature (124)..(124): Xaa can be any naturally occurring amino acid
DTIGQVCTKKQAGTGPEFLEHCWPTGCLIFFSPFSSRHPGDRRAPQGFVAAAXSGDGVYSAAATTLPYEDADGLIKYFAVDDSRGRVFVFSVAVDALLELEPRVXNEPPITALLVYLSPRHTSXFLFTGHADGSIAAHRLVESSHYLFSLHLCREMMFHCIFIGCCIYYCLFVAISSFQLLHSPTA

SEQ ID NO: 34016 - protein, 402 aa, Caulobacter crescentus CB15
MADINTPALGESVTEATVARWTKKVGEAVKKDEILVELETDKVSLEVASPADGVLSAIGAAEGATVVPGTVLGVVAEGATASAAPAAAPAPKAEAPKPAPAAPAPAAAPAAAPVSPAPARIAAESGLDLSKVAGTGKDGRVTKGDALAALEARASAPAPAAAAAAPRALHEREERVKMTRLRQTIARRLKEAQNSAAMLTTFNEVDMSAVMALRAQYKDVFEKQHGVKLGFMSFFVKAVVAALKAIPDVNAEIDGQDVIYKNHYDIGVAVGTDKGLVVPVVRDADALNLAGIEKTIGDLGKRARNGQLAIEDMQGGTFTITNGGIYGSLMSTPILNAPQSGILGMHAIKERPMVINGKIEIRPMMYLALSYDHRIVDGAGAVTFLVKVKEAIEDPQRLLLEL

SEQ ID NO: 34017 - protein, 530 aa, Solanum lycopersicum
MTDVEGSPGSSMHGVTGREPVLAFSVASPMVPTDTSAKFSVPVDTEHKAKQFKFYSFSKPHGLTFQLSWISFFTCFVSTFAAAPLVPIIRDNLNLTKMDVGNAGVASVSGSILSRLTMGAVCDLLGPRYGCAFLIMLSAPTVFCMSFVSSAGGYVAVRFMIGFSLATFVSCQYWMSTMFNSKIIGLVNGTAAGWGNMGGGATQLIMPLLYDIIRRAGAIPFTAWRIAFFIPGWLHVVMGILVLTLGQDLPDGNRGTLQKTGTVAKDKFGNILWYAATNYRTWIFVLLYGYSMGVELSTDNVIAEYFFDRFDLKLSTAGIIAATFGMANLLARPFGGFSSDYAAKKFGMRGRLWVLWILQTLGGVFCVLLGRSNSLPLAVTFMILFSIGAQAACGATFGIIPFISRRSLGIISGMTGAGGNFGSGLTQLLFFTSSKYSTATGLTYMGFMIIGCTLPVTFCHFPQWGSMFLPPTKDPVKGTEEHYYTSEYTEAERQKGMHQNSLKFAENCRSERGKRVGSAPTPPNLTPNRV

SEQ ID NO: 34018 - protein, 337 aa, Ustilago maydis 521
MSQVNIGINGFGRIGRIVFRNSVVHNTANVVAINDPFIDLEYMVYMLKYDSTHGVFNGDISTKDGKLIVNGKSIAVFAEKDPSNIPWGQAGAHYVVESTGVFTTIDKASAHIKGGAKKVVISAPSADAPMYVCGVNLDAYDPKAQVVSNASCTTNCLAPLAKVIHDKFGIVEGLMTTVHATTATQKTVDGPSAKDWRGGRAAAANIIPSSTGAAKAVGKVIPSLNGKLTGMAFRVPTTNVSVVDLTARLEKGASYDEIKAEVKRASENELKGILGYTEDAVVSQDFIGNSHSSIFDAAAGISLNNNFVKLVSWYDNEWGYSNRCLDLLVFMAQKDSA

SEQ ID NO: 34019 - protein, 475 aa, Caulobacter crescentus CB15
MARPEGDRPMAQYDVVIIGGGPGGYNAAIRAGQLGLKVAIVEGRGKLGGTCLNVGCMPSKALLHASELYAAATGPEFAKLGIEVKPKLNLSQMMAQKAESVEALTKGVEFLMKKNKVEYVKGWGRIDGVGKVVVKAEDGSETTLETKNIVIATGSEPTPLPGVSVDNKRIIDSTGALSLPEVPKRLVVVGAGVIGLELGSVWKRLGAEVTVVEYLDRILPGTDTEVANAFQKILVKQGFKFQLGAKVTGAEAGAKGVKLSFEPVAGGEAQTIEADYVLVAIGRRPYTQGLGLETVGVTPDKRGMIANDHFKTGVAGVWVIGDVTSGPMLAHKAEDEGVACIEMIAGKAGHVNYGIIPGVVYTSPEVATVGKTEDELKAEGVAYKVGKFPFLANSRAKINHETDGFVKILADAKTDRILGAHMIGPNVGDMIAEYCVAMEFGGASEDVARTCHPHPTRSEALRQAAMGVEGWTMQA

SEQ ID NO: 34020 - protein, 411 aa, Aeropyrum pernix K1
MPRFSCYEVRSEFPELERGIVYLDNAASTLKPRRVVEAMREFSYRSYANVHRGVHRLSMEASKAYEDAHEVVARLVGGSWDEVVFTRNTTEAMQLAALTLAYNGLLRGGEVLVTAADHHSTLLPWVRAARLGGGRARILPLDGRGVPRWDLLEDYITEDTRAVAVGHVSNVTGVVAPVEDIVKAAKKVGALVVLDSAQGVPHLPVDFRRMGVDMAAFSGHKMLGPTGIGVLWARRDLLEELEPPLGGGGTVSRVRLQGGSVEIEWEEPPWKFEAGTPPIIEAVGLAEAANMLMEIGMEHVARHEDELTSHTMKLLEPLYSEGLIRYVGPDKPGERHGIVSITTHLKSPDELGLLLDRRGIAVRTGLHCAHILHDHVDASMGSVWASFYIYNCKEDAERLAEALEEILTTRR

SEQ ID NO: 34021 - protein, 472 aa, Zea mays
  misc_feature (449)..(449): Xaa can be any naturally occurring amino acid
MEAADYGLLFVGGISWETSEERLREYFGRFGEVTEAVIMRDRSTGRARGFGFVVFADAAVAERVTMDKHTIDGRMVEAKKAVPRDDHSIVSKSNGSSTGSPGPGRTRKIFVGGLPSSVTEADFRRYFEQFGIITDVVVMYDHNTQRPRGFGFITYDSEDAVDKALHKSFHELNGKMVEVKRAVPKEQSPGPVVRSPVGVGQNYATNRVHSFLNGFNQGYNPNPVGGYGMRVDGRYGLLSGARNGFSFFGPGYGMGMNVEGGMSGTFGASPCFISNSNGRQMGSLFNASSNRLGSPIGYLGLNDVPGSMLSSMSRNVWGNGSLNYPSNPTNMSAFTSPGNGSQVSLTGDNWGGLPSVHGMGNISSLGSGNLARGAGDNNFGLLSGSYGRSNSTGTIGEPFSAAGNTYDVNNPDTYGSSSIYGGTAWRFTSSEVDMPFGHDIGNFDPTIKXDMSASHMCNYPVNNNQPSRGITS

SEQ ID NO: 34022 - protein, 392 aa, Gloeobacter violaceus PCC 7421
MVPPVKHRLSERALAVVPSLIRDASRYCDELGALNLAQGLPDFAAPAFLKEAAQRAIAADRNQYCDPWGLAQLREAIAAKCTRDNALAVDPATQVTVCCGATEGINLALMALLDPGDEVVVFSPFYENYRPNLATVEAKPRYVPLSAPDWRVDEAVLERAFAGTAPRAVIVNNPANPTGKVWSRQELELVARYCERHDAYAITDEIYEYILYDGAEHISLASLAGMAERTVTVSGLSKTFCVTGWRLGYVIASEPLTAAIRRLHDFLTICAPAPMQHAAVAALEAPADYYADLRRLYQAKRDRLVTALYRSGFEPVRPAGAYYVWTDAGVLGAKNALAAAGRLAVEAGIAAVPGDCFLPPGHPNCNLRFCYAKSDETLAAAVERLDRWSGHG

SEQ ID NO: 34023 - protein, 450 aa, Leuconostoc mesenteroides subsp. mesenteroides ATCC 8293
MDDKHKGQGLPNLPLSTIWMLSFGFLGVQMAFSLQSSQMGRIFQTLGADPTKLGFFFILPPLAGLFVQPLVGYFSDRTWTKRFGRRMPYLLVGALVSVIVMFLLPNSGSFGFSTTAALWFGAITILFMDLSSNVAMQPFKMVVGDMVNEDQKSYAYSIQSFLSNTGSVLATIFPFLLTAIGVANTADKGQVPASVIISFYVGAVVLVVFSLVAVFNVKEYDDATYELYHGYALNTPNDNDGGFLTLLKRAPKTFWMVTVTQFFCWMAFQYLWTYGTGAVADNVFHATDPTTAGYQNGGNWFGILSAVYAIAAVLWSLVLSKIPAEKNKFGYALSLLLGSTGFISVFFIHSQYLLIASFILIGISWAGMMAYPFIMVTNALNGDHMGTYLGLFNGSICLPQIVASVASFVVFPALGSHFPSMILVSGVLMLLGAVSVGFIKEIHSNPVNAH

SEQ ID NO: 34024 - protein, 347 aa, Physcomitrella patens subsp. patens
MASFGTLSSTQPHNPNKSFEVNQPPTDGISSLAFSPKANYLVATSWDNQVRCWEIQSNGSSVPKAAISHESPVLCSAWKEDGSTVFSGGCDKQAKMWPILSGGQAVTVGMHDAPIKSISWISEMNLLVTGSWDKTLKYWDLRAQTPAHTQQLPERCYAMSVRHPLMVVATADRNIVVYNLASPQTEFKRIQSPLKYQTRCVATFPGKEGFLVGSIEGRVAVQHIDDAQQSKNFTFKCHRDNNDIYAVNSIDFHPVHGTFATSGSDGAFNFWDKDSKQRLKAMQRCNQPIPCSTFNHDGTIFAYGVSYDWSKGAENHNPSQARNYILLHPTQDSEVKAKARVAASGRK

SEQ ID NO: 34025 - protein, 454 aa, Leuconostoc mesenteroides subsp. mesenteroides ATCC 8293
MSSNEHKKGQLPMLTSMQLFLMTFGYAGVQVAFSVQTGNMGRIFQTLGSDPTKLGFFFILPPLAGMITQPLIGLFSDKTWLPKLGRRMPYLIGGCLVSLIVLLLLPNTGSFGFGYGSMTALWFGAVTVLFMDLSANVSMQPFKMIIPDMVNEKQTDKAWSLQNIWGSLGGVIAFVFPFILTSFGVANTAARGVVPDSVKISFYVAAAILLLSTIFTIINVKEYDPETLAYYHGFRSDDKTHESFIDILKHAPKVFWTLGIVEFFVWFGIPYMWTYSTGALSENIWHVSDPASAGYQAAGNWFGILQAVYSVVAIVVGILFQRLNDKTRKMTYFLSLIAGGLGFIIVAYGHTHVSSLIGFVLIGIGWIALISIPFTILTNALDGKHDGVYLGLFNCFICIPQIVASVASFAIFPAVGKSMAHMLAIAGVFLMIGGCLIWIVKEEKTQVDMTQKGE

SEQ ID NO: 34026 - protein, 331 aa, Cryptococcus neoformans var. neoformans B-3501A
MSTDKKDITSWASKDGSFKRQVSSFRDFIEPGGKFAPEKGRYHLYVSLACPWAHRTLIVRKLKGLEDFLDVSTVHPHMLEGGWHFVPKDKASAKPAPASAHDNDTFPNATSDPLFGFSHLRDLYFKAQPDYSARFTVPVVWDKKENTIVNNESSEIIRFFNTAFNGELPADKAKLDLYPEDLKKEIDELNEWVYNDINNGVYKSGFASTQEAYEAAVKSLAKALQKVEDRLSDGREFLMGDRLTEADVRLYTTIIRYDPVYYVHFKCNFGLIRHDYPNLHKWLQRLYWNHPAFKDTTDFDHIKEHYYYSHAQINPNRIVPFGPNVNIEPLK

SEQ ID NO: 34027 - protein, 448 aa, Burkholderia sp. 383
MSTPATDDWVARSLRAVWHPCTQMKHHERLPLIPVARGAGLWLYDRDGRRYFDAISSWWVNLFGHANPDINAALKDQLDTLEHAMLAGCTHEPAIELAERLHTLTARTLGHAFFASDGASAVEIALKMSFHAWRNRGRANKQEFVCVANSYHGETIGALGVTDVALFKDAYDPLIRHAHVVASPDARGALAGETAADVAGRALADVRRLFVERGDRIAALIVEPLVQCAAGMAMHDPSYVRGLRALCDEFGVHLIADEIAVGCGRTGTFFACEQAGVWPDFMCLSKGISGGYLPLSLVLTRDDVFNAFYDDDTTRGFLHSHSYTGNPLACRAAVATLDLFERDDVIAANARKSATLRAALAPLDAHPQVRHLRERGTLFAFDVALDGDGARGFSRRFFERALERELLLRPIGTTVYLMPPYVMSDDDIAWLAQSTRDTLDATLEDITR

SEQ ID NO: 34028 - protein, 391 aa, Thermobifida fusca YX
MRALTWQGPRDVRVETVPDPTIEEPTDAIIRITSSGLCGSDLHLYEVMAPFMREGDILGHEPMGVVEAVGDAVTTLRPGDRVVVPFNIACGHCFMCVQGLQAQCETTQVRETGMGGRLFGYSSLYGSVPGAQAEYLRVPHADYGPIKVPKGPPDDRFVYLSDVLATAWQAVRYAAVPPGGSLAVLGLGPIGDMCCRVAQHLGAGQVFGVDVVPERLSRAARRGVTTFHFDEDTVDAIRDLTDGRGPDAVIDAVGMEAHGSPITRTAQRLTALLPSKAGAALITTAGVDRLTALHTAITLVRRGGTISLSGVYGGIADPLPMLTLFDKQVQIRMGQANVRRWVDEILPLLTDDDPLGVDSFATHRLPLAEAPYAYAAFQHKDNGMVKTLFHP

SEQ ID NO: 34029 - protein, 470 aa, Pseudomonas fluorescens Pf-5
MADAGTVLQRGLSTRHIRFIALGSAIGTGLFYGSAAAIQRAGPSVLLAYLIGGAAIYLTMRALGEMAVRTPVSGSFGHYASSYLGRFAGFLTGWSYAFSMLMVCLADVTAFGVYMGLWFPDTPRWIWVLSIVLGIGALNLCSVKVFGELEFWLSLLKVGAIVAMIVGGFTLLFFGIQLGEEQSRGGLANLWEYGGFFPNGVEGMIASFTIVMFAFGGIEVIGITAGEAKDPQRMIPKAINSVPLRILIFYVLTLLILLTLAPWSSIGSHGSPFVQIFSSLGISSAATVLNIVVISAVVSAINSDIFSAGRMMYGMAAIGQAPAVFARTSRFGVPWMTVLVMSVALLLGVLLNYWIPQELFLIFASLVTFSVVWVWLMILLSQMAMRRGMSAREIHELKFPLPLGTAGQACAVVFMLFIFGVLGAFADTRLALYVGLGWLALLSLAYWIWIKPDTTGSAAAESGIGTQEKG

SEQ ID NO: 34030 - protein, 350 aa, Streptomyces sp. KO-3988
MSEQQIAVLRPREQPGANGVTAVAQPNIALIKYWGKRDEHLFLPWTSSLSMTLDIFPTTTRVHLDAEATDDEVTFNGAPAAGEERRRITGFLDLVRQRAGLTHRAVVDTRNTVPTGAGLASSAGGFAALAVAAATAYGLDLDDTGLSRLARRGSGSASRSIFGGFAVWNAGTPTAPPAEADLSSYAEPVPVGDLDPALVIAVVNAGPKDVSSRAAMRRTVETSPLFEPWAASSRDDLTEMRQALLRADLDAVGEIAERNSLGMHATMLSARPAVRYLSPASLTVLDSVLRLRRDGISAYATMDAGPNVKVLCRRADADLVAEAVRAAAAGGTVHIAGTGQGARLIDEDGR

SEQ ID NO: 34031 - protein, 579 aa, Prochlorococcus marinus str. MIT 9312
MPNIHKPFHQKYRPSNLDELVGQNFISITLKQALLTKKISPAYLFNGPRGTGKTSSARIFAKSLNCQAFEEPTIHPCGKCDLCRQITDGNALDIIEIDAASNTGVENIREIIERARFAPTQARWKVYVIDECHMLSTAASNALLKTIEEPPSRVVFILATTNPERVLNTIQSRCQKFDFRRISPSDIFQHLSEIAEKESIKYEVQALNIIAKRSNGGMRDAQSLLEQLNLLPEGITINNIKNLLGEVSEIELTNLIKSLIENNPESLIITCNKLYDDGNEPYQIIIGLLNITRDLLLHTTNNKYSDLYYTSDGFQDELDKISKTINKSTIINWHNHLRNIEYQLKTSDNPRLWLEIHLTGLLDNHKINSIDNKQEKIKRKVIINEENNSNEIQKPSIKENISREQLISKKVEKVEKVENFNGLEKENMGNISKNSQNNLGSNNLKDKWELILSKLELPSTRMLLSQQAELESFDSEKITIALAPNWENMIKSRKVIIENTVKKIFGDQIILNFSTKQLIQSNKTNTPEVSQNEVKNLKLTKKNELKTNSSTKISNEETYDDSSKNLANFFNGEIIDLDE

SEQ ID NO: 34032 - protein, 360 aa, Azoarcus evansii
MTTHRTPKFHPLKVAEVRRETPEAVSLRFEIPAELAEDYRFEQGQHLNLKVMVNGEELRRSYSICSGVDDNELRVAIKKIGGGVFSTWANDGGIRVGDVLEVMTPEGRFHTPLDPAHAKHYVAFAAGSGITPILSLVKTTLAAEPHSRFTLVYSNRRQASVMFAETLEDLKNRHMARFTLYNLFSREEQEVPLFNGRLDGERVRQFLDTLIPVDTIDEAFICGPGAMIDEVEAALQAAGLAHEHIHLERFGVPASAPEHHVEPGDATQAKVTVIADGLTREMEFRAEDPSILDVALRAGMDLPYSCKVGVCCTCRAKLLEGKVRMDKNFTLEQPDVDAGYILTCQAHPLIDRVVISFDER

SEQ ID NO: 34033 - protein, 226 aa, Ostreococcus tauri
MWLFRKQKTPQELLRDNKRSLDRSIREIERERTQMMNQEKKLIAEIKRVAKANQMGAVKVMAKDLVRTRHSITKFYALKSQLQGVSLRMQTLKSSQAMADAMRGVTKAMKSMNARLNLPSLTNILKEFERQNEKMEMTTEVMGDAVDDAFAGEDEEEETEELVNAVLDELGCNVGAELISAPATKVGVASESKAERAAVLEGGASEPTAGSGLDDDLQARLDALRK

SEQ ID NO: 34034 - protein, 331 aa, Streptococcus pyogenes SSI-1
MSIRSLFGGLREKILGKNMKIVFPEGNDERVVRAAARLKFEGLLEPIILGQSEEVRNLLTKLGFADQDYTIINPNEYADFDKMKEAFVDIRKGKATLEDADKMLRDVNYFGVMLVKMGLADGMVSGAIHSTADTVRPALQIIKTKPGISRTSGVFLMNRENTSERYVFADCAINIDPTAQELAEIAVNTAETAKIFDIDPKIAMLSFSTKGSGKAPQVDKVREATEIAKGLNPDLALDGELQFDAAFVPETAAIKAPDSAVAGQANTFIFPDLQSGNIGYKIAQRLGMFDAIGPILQGLNKPVNDLSRGSSAEDIYKLAIITAAQAIESQG

SEQ ID NO: 34035 - protein, 616 aa, Physcomitrella patens subsp. patens
MVVLLLLAVPAWSTFVVEESALMVTSPESLKGKHQSAIGNFGVPQYGGTLSGTVSYPSVNSKACETFSTAQFKSAPGQRPIFALVDRGDCYFATKVWYAQQAGAAAVLVADNKQEKLITMDSPEEDPAASQFIQNITIPSALITKDLGDSLKKALSDKEMVSIKLDWRESLPHPDKRVEYEFWTNSNDECGPKCDAQVEFVRNYKGVAQMLEQGGYTQFTPHYITWYCPQAFIESKQCKSQCINNGRYCAPDPEQDFSVGYDGKQVVIENLRQLCVFKVTNDTGKPWKWWDFVTDFQIRCPMKEKKYGPECAEEVIKSLSIDVGAVQKCMGDPNADQDHPILKHEQDAQVVGQGDRGDVTILPTLIINNRQYRGKLDKSAVLKAICSGFEEASDPPVCLSDTLQTNECLENNGGCWSSGDLTACQDTFRGRVCQCPLVKGVQFEGDGYTHCEAKGPGRCKISNGECWQESRNGVTKSACQVSVSAGCKCPEGFEGDGKNTTTGCVDINECTRKTKCQCSECSCTNTWGGYDCQCGGDLLYIGEHDTCISKCVQPSKLGWFVTLIVLAGLAVLGVGGYVVYKYRLRSYMDSEIRAIMAQYMPLDSQNESQIHMADEI

SEQ ID NO: 34036 - protein, 640 aa, Trichodesmium erythraeum IMS101
MEIPFNITLLIILTVASGIASQVVAAYLKVPAIVFLLLFGILVGKDGLGLVHPNLLGSGLEVIVSLFVALILFEGGLNLKLRELGRVSGSIRNLVTIGTLITLIGGGMAAHWLGEFPWPIAFLYASLVVVTGPTVVGPLLKQVSVDRKLATLLEGEGVLIDPIGAILAVLVLNIVLNEGAAPIGLFRDLVVRLGMGTIIGGTGGWLLGFSLKRAKFLSEELANLVVLAALWGMFGLAEVVGSESGLMATVVAGIVVGAAEIPELRLIRRFKGQLTMLGVSVLFILLAADLSLASVVALGWGSIFTVLSLMFLVRPLNILICTWNSQLNWRQKMFVSWVAPRGIVSASVSSLFAILLTQNGINGGDSIKALVFLTIMMTVFSQGLTAKFVAQFLGITSSAATGAVIVGSNPLSRLIGKIFKDRGESMVLIDTDEESCKQAEKEGLQAYKSSALDVNVLEEAGLESVGTFLAMTNNGEVNLVLAQRAAEEFKPPRVLAVYPKSPQQKNHHNKEKVQQAFTTELNLKSWNQYLDDQEVKLGETVLKELGFEFQKTHLKALIQSGALIPLLVERQGSLQVLPASENWQPRDQIIYLLHDPKPKLLKRLSGSQQTALTIERHPAVEEVPIPNVVLESNSDKIPAK

SEQ ID NO: 34037 - protein, 540 aa, Ostreococcus tauri
MTMSETKGDHGYEYDVVVIGGGSGGLAAAKEAAKHGAKTACLDFVKPSPAGTTWGLGGTCVNVGCIPKKLMHQAGLLGESFSDAREYGWKLASEGHDWPKMVEQIQNHIGSLNFGYRTTLREKNVTYINAYGKFKDAHTIVATKKNGTEQIITTDKVVIAVGGRPAYPDAPGAKECCITSDDIFSKPDAPGKTLCVGASYISLETAGFLTALGFDTSVAIRSIPLRGFDQEVAEKICKYMGKHGTRFLRDSQPSQFEKQEDGKIKVTFENTMFGNTFEETFDTVVCAVGRDAVTEGLDLPAAGVEFNAKNGKIPCVDEQTNVPNIYAIGDVLDTRQELTPVAIKAGVRLMRRVFADTPYKEKMNYDLVPTTVFTPLEYGTIGMSEELAVETYGADNVECYISYFKPLEWTVNHEEHNGVPVRDDNACFVKLITNLADDERVVGFHYLGPNAGEVTQGYAVAMKMGATKRDFDETVGIHPTVSEEFTILEITKRSGPPYAWIKSRSSIPARSAAFSIRWLAFAMKLESPLRLPRSVGTSAK

SEQ ID NO: 34038 - protein, 459 aa, Thiomicrospira crunogena XCL-2
MNGKIVQIIGPVIDVEFKGADLPKIYDALKVDELDLTLEVQQQVGDNVVRAIAMGSSDGLKRGMAVSNTGEAISVPVGKPTLGRIFDVLGNPIDNAGPVESEEKMTIHRPAPAFDELAASQELLETGVKVIDLICPFAKGGKVGLFGGAGVGKTVNMMELIRNIAIEHSGYSVFAGVGERTREGNDFYYEMEESGVLDKVALVYGQMNEPPGNRLRVALTGLTMAEYFRDEGRDILFFVDNIYRYTLAGTEVSALLGRMPSAVGYQPTLSQEMGQIQERITSTKTGSITSIQAVYVPADDLTDPAPATTFAHLDATVVLNRSIAETGIYPAIDPLDSTSRQLDPLVVGSEHYDTARGVQETLQRYKELKDIIAILGMDELSEEDRSLVARARKMQRFFSQPYFVAKVFTGEDGRYVPLKETLRGFKMIISGELDDIPEQAFMYAGDIDEVLEKAKKYKD

SEQ ID NO: 34039 - protein, 220 aa, Edwardsiella tarda
AETLQRLNPETTLFLVASKTFTTQETMTNAHSARDWFLQAAGDERHVAKHFAALSTNAQAVAAFGIDTANMFEFWDWVGGRYSLWSAIGLSIALSIGYDNFEQLLAGAHAMDRHFASAPLQQNLPVLLALIGIWYNNFFGAETEAILPYDQYMHRFPAYFQQGNMESNGKYVDRNGQAVDYQTGPIIWGEPGTNGQHAFYQLIHQGTKLIPCDFIAPAIS

SEQ ID NO: 34040 - protein, 562 aa, Ostreococcus tauri
MRATIDALARAFSIGLFDVDEQGELEINGIFILGVALLFGVLRLIIVAPAAYRSASQYNRHASPKFQFIDDARAVRRGPSLEEIPSVCADMRASFRSGHTLPMRKRKEQLGQLLKMLKEREDEILDALREDLSREHVEAFYYDFALPRAEIRAMLRNIRSWTGRSLVKAFNVITWPSKQWMERQPLGCALVCSSWNFPFLLSLVPVAGAIAAGNAVVLKPSNDSKASTALLVKLVREYCDPRVVQCVGSEVPGNGVDVMQTVLKEKFDVIFFTGSSKVGKIVARAAAENLTPCILELGGKNPVVVTDCADVDLAAKQCVWGRVINCGQQCISPEYVLCHESRCDEFERMCSKWAAKFVPDVTLNGAMARIGGPDPESRMKAIAKLIDDAKAGVAGDTVVYGGTYDVKRRLVEPTVIKCGEKSPFMEAELFAPILCVHSYKTLGQAVDTIQAQMKPLTMYVFSRSAKKTRFLLDNTHAGGVTVNGTLTHCAHDRLPFGGVGDSGYGRYHGRYSVECFQREKPVLQKTRWGRCLGLGLLSDPSFLYSPQAEWKTKCVRAVASLM

SEQ ID NO: 34041 - protein, 333 aa, Ostreococcus tauri
MLGASARRAARARATASVVREALWRTARAWSTATTTGASGSATDEKSRGVNERETSSSSSSSSSSSSSARTASFGYEDVAYDDKEDLVRGVFERVAPSYDVMNDLMSAGVHRLWKDYFVSRVGAFAGMTHLDVAGGTGDVAFRVLRALQRAERDAELDGQVLDAKTRGKVIVSDINPAMLREGMKRATTRGIAQNQLEWLEGNAEKLPVEDGSVDVYTIAFGLRNVTDTRAAIADAYRCLKPGGKYMILEFSRVENDVLRSVYDFYSFNIIPKLGEIVARDRGSYQYLVESIRKFPPQEELKSMMQGVGFRHVSYENLTGGMVAMHVGYKDQA

SEQ ID NO: 34042 - protein, 696 aa, Fulvimarina pelagi HTCC2506
MLSALQDRALELGAARLAEQQGNWRAAIDDDYVYWLVLDCPGKSVNTIDRDVLTELSHHIDHIIDQKPSAVVIRSAKVAGFAAGADINQFVGATTGDIRGMLKEGHLVLDRLADLQAKTIAVIHGHCLGGGLELALACDMRIAVKDASLGFPEVMLGLHPGLGGTYRSTMKADPVEAMTLMLTGKSINAKKAKAIGLVDAVVEERHVGAAVDAALHNDIEPTSHGVKHQAFSLKPARTLAAKQMRKKTAEKAPKDTYPAPYALIDLWEEYGGSEQAMQEGELSSFAKLIESETSRNLVRVFFLREKMRGLRTGKSGVKHVHVIGAGAMGGEIAAWAAKQGFRVTLGDVALKPMGKAIKAAFKMLQGVLKDPLKVRDALDRLIPDTDGLGISRADIVIEAVPEKLDLKRKIYADIEPKLKPGAILATNTSALPLPDLAEGLSDPSRFVGLHFFNPVSRMQLIEIVSHDRISEETTSRATNFAVELSRLPAPVKSAPGFLVNRALLPYMAEALIMVDEGIPKERIDDRAEKFGMPMGPVELNDQVGLDVALDVSESLRERLGGVFPSTPGWLKKMVEDGKLGRKTGQGLYELDDKGKPQKKPVESLKDGSKDDPDLIDRLILPMLNAIVACLREGVITDEDVADGAMIFGTGFAPFRGGPINYAKKRGVDEIVAKMNALKEKHGERFTPDAGWDRLRG

SEQ ID NO: 34043 - protein, 348 aa, Gloeobacter violaceus PCC 7421
MDTTPLTPLTKGITLYQHILSQQALNPDATGEFSGLMVQISLAAKLISRQLAQAGLVENVLGFTGETNVQGEAVRHLDQYANETFIRVFQNTNLVCLLVSEELEDPLPLSNQCPIGSYALVIDPVDGSSNIDVNVSVASIFSVQRRNPRATDETSSLLQKGTGQVAAGYVLYGPNTMFVYTSSQGVHGFTLDAGLGEFVLSHPNIRIPERGDYYSINDAYSAEWQPGTRAFIDYLKQAKSRGEKAYSARYIGSLAADVHRTLLTGGIFLYPGTVAKPKGKLRLLYEAQPLALIAEQAGGKASTGTERILDIEPKTLHQRVPLVIGSPYEVDLAVAFARGEKQTVVAGS

SEQ ID NO: 34044 - protein, 235 aa, Spinacia oleracea
MRSQIYRSATKAARSFLSSSKNASSRFLPEGRTVAATAAVSLRVKAPYLASFGGANASGTWMSTALAIPAAAYLLQDQEACAAEFERTFIAIKPDGVQRGLISEIVARFERKGFKLVAIKVVIPSKDFAQKHYHDLSERPFFNGLCDFLSSGPVVAMVWEGEGVIKYGRKLIGATDPQKSEPGTIRGDLAVVVGRNIIHGSDGPETAKDEIKLWFKPEELVNYTHNAEKWIYGDN

SEQ ID NO: 34045 - protein, 161 aa, Zea mays
GDCDGHVGLGVKCAKEVATAIRGAIILAKLSVVPVRRGYWGNKIGQPHTVPCKVTGKCGSVTVRMVPAPRGSGIVAARVPKKVLQFAGIEDVFTSSRGSTKTLGNFVKATFDCLMKTYGFLTPEFWSQTKFSMTPFQQYTDLLAKPTKGLVLEAPTETVEA

SEQ ID NO: 34046 - protein, 528 aa, Candida tropicalis
MAIVDTAIDGINYFLSLSLTQQITILVVFPFIYNIAWQLLYSLRKDRVPMVFYWIPWFGSAASYGMQPYEFFEKCRLKYGDVFSFMLLGKVMTVYLGPKGHEFIYNAKLSDVSAEEAYTHLTTPVFGKGVIFDCPNSRLMEQKKFAKFALTTDSFKTYVPKIREEVLNYFVNDVSFKTKERDHGVASVMKTQPEITIFTASRCLFGDEMRKSFDRSFAQLYADLDKGFTPINFVFPNLPLPHYWRRDAAQRKISAHYMKEIKRRRESGDIDPKRDLIDSLLVNSTYKDGVKMTDQEIANLLIGVLMGGQHTSASTSAWFLLHLAEQPQLQDDLYEELTNLLKEKGGDLNDLTYEDLQKLPLVNNTIKETLRMHMPLHSIFRKVMNPLRVPNTKYVIPKGHYVLVSAGYAHTSDRWFEHPEHFNPRRWESDDTKASAVSFNSEDTVDYGFGKISKGVSSPYLPFGGGRHRCIGEQFAYVQLGTILTTYIYNFKWRLNGDKVPDVDYQSMVTLPLEPAEIVWEKRDTCMV

SEQ ID NO: 34047 - protein, 396 aa, Marchantia polymorpha
MASMVAASSALGASCSLAAVPSQATTSSNNAAQAVILRSAKLGGRSSSILGQSLAGLSVKSVAHKAVASRSRVASTRAELGDSLEEFLFKNTKNINLRQLMLSMGLAIKKISFKVRTASCGATACVNTFGDEQLAVDMLANKVLFEALLHSHVCKYACSEEEPNLVDMGGPTEGGFSVAFDPLDGSSIVDTNFTVGTIFGVWPGDKLTGVTGREQVAAAMGIYGPRTTYVLCLAEVPGTHEFLLMDDGTWQHVKETTTIGEGKLFSPGNLRATYDNPEYEKLINYYVSEKYTLRYTGGMVPDVNQIIVKEKGIFTNVISPTTKAKLRLLFEVAPLGLLVEKAGGYSSDGKISVLDKVVVNTDDRTQVAYGSRNEIIRFEEALHGTSRVAALVGASA

SEQ ID NO: 34048 - protein, 388 aa, Leuconostoc mesenteroides subsp. mesenteroides ATCC 8293
MDKKRHLLFIIGTAWMIDALDVALLSFIMPLIKNEWDVGSTELGLAAAVTSIGMIVGSIVCGKLADKYGRKNIIIGTLLIFSLGNLALIFAPNILWFMVIRFITGIGLGGELPVAATIIADNYTGTKRSQMLLLADSFWAYGWILASLISFLIIPRFGWRAAVALAALFAFYALALRKHLPNEPINKKSHEGTFKELLSSKHRSRLIVLSIMWFIVMLTYYGIFLWLPTVLTMRGFSIVNSLGYTLIMSIAQLPGYYLAAYLMNKMSRKKILAIYLLGTLISSFVFGFGTNIALILVAGAFMSFFDLGAWGTLISLTPAQFPEKIRGTAMGTAQAVGRVGATVGPFLVGWLFDFKLGISVIFSVFAVLLIIAIVVLLIGVKDNLEDEY

SEQ ID NO: 34049 - protein, 512 aa, Borrelia burgdorferi
MMNAQAILVLDFGSQYSQLIARRIREIGVYTKVIPYYTPLKEIKNMNISGIILSGSPASVYSKEAPTLDMEIFNLKIPVLGICYGMQIIVKLFGGLVSKDSKQEYGRSEIFLKDEKSLLFSELPNKFQIIMSHGDSIEKIPDNFKQLAFTKNCIASISNETQKIYGLQFHPEVTHSEFGDQILKNFVFKICQAQINWSLEGNLETIVKKIKLKVGSKKVILGLSGGTDSLVCALLIKKAINENLICVFVNTGLLRKNENKKILELKHQYDLNIKYIDASTKFLNRLKNISDPEEKRKIIGKEFVDVFEKITLEDQNIEYLAQGTIYSDVIESKSKDSSSSKIKSHHNVGGLPDKMSLKLLEPLNEFFKDEIIQIGINLGIKKESLYRHPFPGPGLAIRIIGEVTQEKINILQEADNILTEELFINDLYYQIRQAFVVLLPVKSVGVMGDQRTYEYTAVIRCVNTQDFMTAEWTELPYSFLKKVSSRIINEVRGINRVCYDISSKPPSTIEWE

SEQ ID NO: 34050 - protein, 182 aa, Oryza sativa Japonica Group
MAQMEFEPDKVGTVTVNGKVYSFRRVHWHAPSEHTINGEKHPLELQMVHAAADGSLAVIAILYKYGAPDSFYFQLKRKLAELAADGCSFGEENAQVALGLVHLRSLQKRTGSYFRYAGSLTAPPCTEDVFWSVLGKIRQISQEQVALITALLPAGGARPTQPLNGRTVQFYNPPNSTISFKV

SEQ ID NO: 34051 - protein, 163 aa, Brassica napus
  misc_feature (6)..(7): Xaa can be any naturally occurring amino acid
  misc_feature (77)..(77): Xaa can be any naturally occurring amino acid
QRKALXXIHYSLQESNSDCRIVRDLGFPRVMIHLASNQDLEVREFALRGLLELTREESDRNLDRADVNLRQLLEERXRRIIAMSEEDLCAAREERELVDILWTVCYDEPSLLRERGLVYLPCDDEMAPDVVRDRFEPPLRAWAARRDDEINEPPVPLLLGPAQ

SEQ ID NO: 34052 - protein, 305 aa, Trichodesmium erythraeum IMS101
MSIIIFGSVNIDLIATTPRLPTPGETINGNNFFTAGGGKGANQAVAAAGLGIPTKIVGRVGNDSFGQQLLVSLSTANVDTTDVLVDENTHTGVAVIAVGASGENNIIVVPGANHSINNTDVERLKNLLSDVTALLLQLEIPVEVAISAAKVAQEMGVKVILDPAPMPANFPNDFYNLIDIITPNEIEASQLVGFEVNNQETAMEAAVELCHRGVKNAVVKIGDRGVICATKEEAFFQPAFVVKTIDTVAAGDAFNGGLAAALDTGLSLKEAVKWGAAAGALCTTKPGAQPAMPDRKTFDNFLLKR

SEQ ID NO: 34053 - protein, 579 aa, Ostreococcus tauri
MGDMAPEPARASAPSAAVDAARDAEQRAPRSPAPAPSSANDDGVRPRRYDNWGARSVECYEKLEQIGEGTYGQVSERKRTRAGTGSEGDARVERTRTPNARELDRSTTQRRCDAVYMARCKETMDIVALKKIRMDNEKEGFPITAIREIKILKKLRHRNVVDLKEIVTSKASASNGHKGSIYLVFEYMDHDLTGLAERPGMKFSVPQIKCYMKQLLMGLHYCHNNNILHRDIKGSNLLINNNGVLKLADFGLAKPITNENAQPLTNRVITLWYRPPELLLGATQYGPSVDMWSAGCIFAELIHGKPILPGKSEMEQMDIIFKLCGSPTPENWPDADKLPYAKHFTQKKTYPRRLREVFSQFTPSAKDLLEKFLTLDPAKRISAKDALMHDWFWEVPKPCEPEDLPRYEPSHEYQTKKRRQEAKRAEQQNKRQRMDGHRPPPPMDDQKPASGPDVRPRGHAGPPGGMRPGMPPSGRYGAGGSASGWSSGGQQKQSYAQRSIGRQPTSGYGSIGGGMNRLGGSGGSYSNLNITTGTSGGSYSGYRGGSKTAGWAGGGQKAGSQKAGWANVSKDAKDGERRN

SEQ ID NO: 34054 - protein, 198 aa, Platanus x acerifolia
LGALLEEREGRLSDEEIVDYLVALLVGGYETTSTTMTLAVKFLTDTPLALAQLKKEHDEIMARKQNEALQWSDYKSMPFTQCVINETLRVANIVSGVFRRAIKDVNIKGYTIPKGWKVFASFRAVHMDQHHYKEARTFNPWRWQQEASPTTPAENVFTPFGGGPRLCPGYELAGVEISIFLHHLVTMFSWVPAGEDRL

SEQ ID NO: 34055 - protein, 413 aa, Listeria monocytogenes str. 4b H7858
MLVYLIIGAILFFVMRALGELLIHNPTTGSFTEFAEQFIGPWAGFITGWTYWFCWIVTGIAEITAVGMYVKFWVPDLPQWIPALACVLILLLFNLATVKAFGEIEFWFAIIKVVVIIALIVIGFVLVFIGYKHGTSTASFSNLVDYGGFFPNGIAGFLLAFQMATFSFVGIELVGVTAGEADDPERTLPKAINNIPIRILIFYIGALLVLMSIYPWSNIDPNTSPFVSVFTMIGIPAAAGIINFVVLTAAMSSCNSGIFSTSRMLYTLSAEGKAPKKMHHLSSNGVPATALITSTACLLIGVFLNYFLPEQVFILVTSIATICFIWVWGVILVAHLRFRHKHPEIAEKSKFKMPLSPLMNWVSLIFFGGLLVILGFAADTRIALFVTPVWFLILGIAYQVLKASNRKTKIRHN

SEQ ID NO: 34056 - protein, 433 aa, Oryza sativa Japonica Group
MAHGGGEEEEERVLSHGDVVLLRCDLTILRGPHFLNDRIIAFYLAHLAADHHDDDLLLLPPSVPYLLSNLPDPASVAAVADPLRLASRRLVLLPVNDNPDVSHAEGGSHWTLLVLDNSNAVSGPRFVHHDSLPPTNLPSARRLAAVLRPLLPASAIPLIEGPTPRQTNGYDCGVFVLAVARAICNWWPTRARHSNSDSDWLEAVKREPFNSTSFSPFDCIYQSACHSTRLWDLVRYAKPQEGCCCEACGFQAFFQIELEDSGTHTAYDQKKADTGKGACWDNLTVSQSVRKPNVSAKNSLSYDGYSWRKYGQKQVKGSEFPRSYYKCTHPTCPVKRKVEMTPDGRIAEIVYNENKLEGCDQAIGSDAVVEALRGGCHCLDGFRNGNEISDCKKRLFRFGVRFHDGSCKRILAQPHNIINLGSHLVAEYVQEKQ

SEQ ID NO: 34057 - protein, 146 aa, Physcomitrella patens subsp. patens
AGSAGAPHAARGALVPGVRSYHEKVVDHYDNPRNVGSFDKNDPNVGTGLVGAPACGDVMKLQIKVDDKTGEIVDACFKTFGCGSAIASSSVASEWIKGKPMEEAVSIRNSDIAKHLSLPPVKLHCSMLAEDAIKAAVKDYKAKKAK

SEQ ID NO: 34058 - protein, 282 aa, Listeria monocytogenes str. 4b H7858
MNLSVYVASAFSKNNKGGNKAGVVLNEPTLATAQKMAIAKQLGYAETAFLTESNCADYKLEYFTPKEEVDLCGHATIGTFAILMHLNKIHKSQYTIETNSGVLTITIKDGTIFMEQNQPTFYDTIPPNKLTGCFNLNLLNTNYPIQIVSTGLKDILIPIKSEADLYALEPNFEEVKKVSKHYEVVGMHLYTFNADQIICRNFAPLYDINEEAATGTSNGALACYLYKNHYLRKENYVFEQGYSLHSPSEIFVNLVISNKDEIEKVYVGGKGYYCEMQDLSME

SEQ ID NO: 34059 - protein, 740 aa, Ostreococcus tauri
MATLDVRAPRARSTTQFERGVVIDARFRPFGAPLGFLTACKKLGVEARMGEQVKTAPATATCASVDGAREVVGVLPALAALEDACAGTGLVGSDAAETEAVMEWVTRSGDLAPGGGFEAQCKSVNEYLATRTYLVGHDVTLADLALWGELSTNRQWPVVEKKGGCENVSRWMSAMNADADAKSVVDAVNAGNPILNKKATTVTETGKVVGAKTSGSFEIDLPGAEMGKVVTRFPPEPSGILHIGHAKAALLNHYFARAYKGKLIVRFDDTNPDKENDDFVEGIMRDIKTLGLDPDVVTYTSDSFDAILAMGEKLIKEGKIYIDTTDVDTMRTERMNRIESKCRSQTVEENLRLWREMKKGSEEGAACAARFKIDMASNNGCMRDPVAFRCNVETPHHRTGTKYKVYPTYDCACPFVDAHEGVTHALRTSEYADREDQYKWIQEAMGVRAVHIWEYSRLNLEYTTLSKRKLQWFVDNGHATGWDDPRFPTVQGVVRRGMQVGALKEFMVSQGASKNVNLMEWTKLWAMNKKIIDPIAPRHVCIDDENAVVVKVLNGPAGEEWFTVNKHNKNPDVGIKVVLRMNEIIIEQADAQLIKEGEECTLMGWGNAFFKNIVKEDDVVKSIECEINPEGDVKTTKLKMTWLANWKELVPVIIKDFDYLITKRKPEEEDKFEDIVNTTTEITVNAKGDGNLRTYNKGTVIQLDRKGYYIVDRVYVNASVPMILLSIPDGKKASWGVAAK

SEQ ID NO: 34060 - protein, 260 aa, Panax quinquefolius
IAPGVNIIAGWTGKVGPSGLPDDSRHVEFNIISGTSMSCPHLSGLAALVKSAHPEWSPAAIRSALMTTAYTTYKNGETIQDIATGMPSTPFDYGAGHVTPVAAFDPGLVYNATVEDYLDFLCALNYSSNLIKAVTKQDFTCKLDKKYSVGDLNYPSFAVHLQTASGKSGSNSTPTIVKYTRTLTNVGTPAAYKVSVSSETQYVKIVVEPETLVFSKSNEKKNYTVTFSTTSMLSGTTSFARLEWSGGKYTIGSPIAFSWT

SEQ ID NO: 34061 - protein, 825 aa, Oryza sativa
MKNRHHAGKNVSLSQFYADQLNLYMLHESDRKYKRLTTICDMSRCFRNCVTSSNVKLFHRKQEEYNIFVQGINNNNLNRRNMNLFCSKCTPPNGTVFLENGLNPASTSNWMYTDNNTVYGGLFSGCGGGQISCIAYPPGDDFSTETITLSSLNAVEIGSHLPREEQIPRPASAFVSAAGDVEPGRRINGGDSASAGAAEDGFVREIRWPRLPTSPREARGGYRFAMRGGMVRFSGLIERASRHGLDGQMLNVAIRCASTSVAQRSSGGFWTWLTGARSNALPPPDFTLPGVTIPPPLPDLVEPGKTKITTLANGVKIASETTPGPSCSVGVYVNCGSVHEAPETLGATQLLKKMAYTTTTNRSHLRVVREIEAVGGNVKASANREMMSYSYAALKTYMPEMVEVLIDCVRNPAFLDWEVKEQIMKLKAELAEASSNPETFLLEALHSTGYSGALATPLIASESSVSRLNTNVLEYFLAENYTAPRIVLAATGVDHDELVSIAEPLLSDMPGVTGPAKPKSTYVGGEYRRTADSSNTDVALAFEVPGGWLKEKEFVTVSTLLGGGGTYSWGRHGKGLHSSLNHLANEFDQIRSIAAFKDVHSNTGIFGIHTSTDAAFVPKAIDLATRELTSLATPGKVDQTQLDRAKATAKSAILMNLESKASATEDMGRQILAFGERKPVEHLLKAVDGVTLKDITALAEKIISSPLTMASHGNEYHILPFSATFVHLSWNFLCCFHQFYGPVNFRALFRWRPGPVQNTGLLAKSLTRMLKEMRPKRGNCCEPSLFHNSNHVLHAVWTVNSRLFGSMIEFEEIELMSRRQRAKSS

SEQ ID NO: 34062 - protein, 510 aa, Lactuca sativa
MVPQVVMVPLQDMAVVVKDLEEAVRVVVLAVLRDMEVVVVLVTAVMGVVGDMNVARINMCHGTREWHKSVIERVRRLNEEKGFAVAIMMDTEGSEIHMGDLGGASSAKAEDGEIWTFSVRAYDSPRPERTINVNYDGFAEDVKVGDELLVDGGMVRFEVIEKIGPDVKCRCTDPGLLLPRANLTFWRDGSLVRERNAMLPTISSKDWLDIDFGIAEGVDFIAISFVKSAEVINHLKSYIAARSRDSDIAVIAKIESIDSLKNLEEIIRASDGAMVARGDLGAQIPLEQVPSAQQNIVQVCRQLNKPVIVASQLLESMIEYPTPTRAEVADVSEAVRQRADALMLSGESAMGQYPEKALAVLRSVSVRIEKWWREEKHHEAMELPAIGSTYSDSISEEICNSAAKMANNLGVDALFVYTKDGHMASLLSRCRPDCPIFAFTTTSFGQKTFKLLRLNLQWGLITICLGFSDDMESNLNKTFSLLKARGIAKSGDLVIAVSDMLKSIQVMNVP

SEQ ID NO: 34063 - protein, 459 aa, Prochlorococcus marinus str. MIT 9312
MIKKILEFQFDLIVVGAGSGGLAAAKRAASYGAKVAIIEVNKIGGTCVIRGCVPKKLMVYAAKSKKNMDSSEGYGLKSEGISFESDILLKNVREEVSRLSDLHRNSLNKLDVTVFEGLGRFTAQNELEIICPKTKKIINKISSKKILISVGGKPKKLNIPGMDLAWTSDDIFELENFPKSILIVGGGYIACEFASIFRNLGTEVTQLIRGQRLLNGFDEDLSSCLEESPTFTGINIIFNTQLKSIRRVNGNLESTLDSGEKILTNNILIATGREPNLIPLNLDFLNLKMDGQYLDVNELNQTSNANIFAVGDIINRPNLTPVAIEQGRVFSDNFFNDQKRKVNYENIPKAVFTIPEISTVGLSEKRAKEVYSEKNIKIFKCKFTPMSNTFKEKKTKCMLKIVVNSITDKVLGCHMFGETSSEIIQMVSIALNAGITKKDFDTTMALHPTISEEFVTMYG

SEQ ID NO: 34064 - protein, 349 aa, Leuconostoc mesenteroides subsp. mesenteroides ATCC 8293
MKAAVWHGVKDVRVEDVELKPTKSNEVVVRVAYAGICGSDLHEYLEGPVFIPVDQPDELTGGQAPLTMGHEFSGVIEKVGPDVANFKVGDHVSINPTVTKGISSDDLDVYDGYSFIGLSTDGGFTSYVNVPEDNLYHLPEEFSLKLAATIEPTAVAVQAIKEADLRFGEKVVIFGAGPIGVLVAAAAKAAGATKIVAVDLSEIRLRKALEMGATDVINPSQVPDTVAAIKNIIPGGADASFEVAGVQPTFEQAIDATRPRGSVVIVSIFAKPISFNPMQLMNAGVKLTTTIAYSKETFQQTVALVSSGQINVEPVITDTISLDSIVSDGFESLTSDKSQAKILIDLSKD

SEQ ID NO: 34065 - protein, 149 aa, Zea mays
  misc_feature (122)..(122): Xaa can be any naturally occurring amino acid
  misc_feature (124)..(124): Xaa can be any naturally occurring amino acid
MLGRFTHTFKTLVPVLRASYHENVINRFENPKNVGSLDAKKKNVGTGLAGHPACGDIMKLQIEVGEDGKTIEKAVFKTYGCGSAIASSDYATELLQGMTVEDALNIKNGEIAGYLKLPPVNXHXAVCLAEDAIKKAIHNFKEKNPEQKE

SEQ ID NO: 34066 - protein, 231 aa, Plantago major
MSTALSQLSCFSSITTHRRSQLNFRSATNFRPGKILNASSSDGRGIEVSDLENKTIPSYKEDASTLHDGSSIKSHPVVESSVVSGLTDLDEQKQVVSPPQKAAKIHDFCFGIPFGGLVLSGGLLGFVFSRNLATLSSGVLFGGALLGLSTFSLKVWRQGKSSIPFILGQAVLAVALLLKNLKTYSLNPKLFPTGFNIVVSAAMLCFYCYVVLSGGNPPPKKLKSSAVGAAY

SEQ ID NO: 34067 - protein, 509 aa, Fulvimarina pelagi HTCC2506
MDIRPAEISDILKNQIKNFGAEAEVSEVGQVLSIGDGIARVYGLDNCQAGEMVEFSDGIQGMVLNLEADNVGVVVFGSDRNIKEGDTVKRTGAIVEVPVGKGLLGRVVDGLGNPIDGKGPIESSENRRVDVKAPGIIPRKSVHEPMSTGLKAIDALIPIGRGQRELVIGDRQTGKSAILLDTILNQKPAHDEGRENDKLFCIYVAVGQKRSTVAQFVRTLEERGALQYSIVVAATASDPAPMQYIAPFVGCTIGEYFRDNGMHAMIGYDDLSKQAVAYRQISLLLRRPPGREAYPGDVFYLHSRLLERAAKLSDDHGAGSLTALPVIETQAGDVSAYIPTNVISITDGQIFLETTLFYQGVRPAVNVGLSVSRVGSSAQIKAMKQVAGSIKGELAQYREMEAFAQFGSDLDASTQRLLKRGQRLTELLKQPQFSPLKTEEQVVVIYAGTNGYLDDLKVDQVGDFEEGLLNAMRNDHKDVLDAIAEKKALSDEIKDKLKSAVDKFKKNFA

SEQ ID NO: 34068 - protein, 484 aa, Fulvimarina pelagi HTCC2506
MADTDNQNRPKGRVAQVIGPVVDVEFDDHLPAILNSLECDNNGNRLVLEVAQHLGENTVRTIAMDLTEGLVRGQPVSDTGNPIRVPVGDATLGRILNVIGEPIDEVGPVNSNETRAIHQSAPDYIDQSPESQILVTGIKVIDLLTPYARGGKIGLFGGAGVGKTVLIQELINNVAKAHGGYSVFAGVGERTREGNDLYHEMIESGVNVDPHKNDGSAEGSKAALVFGQMNEPPGARARVALTGLTIAEHFRDAGQDVLFFVDNIFRFTQAGSEVSALLGRIPSAVGYQPTLATDMGQMQERITTTNKGSITSVQAIYVPADDLTDPAPATTFTHLDATTVLNRSISEKGIYPAVDPLDSTSRMLQPMIVGEEHYQVAREVQEILQKYKSLQDIIAILGMDELSEEDKLTVQRARKIERFFSQPFAVAEIFTNTPGELVPLEDTIRSFKGLVEGEYDHLPESAFYMVGSIEQAIEKAQKQASQAA

SEQ ID NO: 34069 - protein, 401 aa, Leuconostoc mesenteroides subsp. mesenteroides ATCC 8293
MEKENVMTKPINHQVIKTEASGIRLVLDLVKKPADQMIELTVGEIDLPTPAATKEAGKQAISNNVTKYTENMGFLSLRRVISDYIKKFYEVSYSPESEILVTVGASQGIDLTVRALIDAGDEVLLIGPAYPAYIQAVVLAGAIPVVVDTRSTHFRLSPEQLGSAISSKTKLVILNYPNNPTGIVLSKEELSSLASVIQQNDLYVLTDDVYQRLTYDQDCAPSIASASLMKERTIIVNGLSKSHSMTGWRIGYLAGPKVLIQEIYKIQQANVGCASSISQMAALTALTTDIEAPKTYIRVFRKRRDYVLQRLDEMSLNYTKPDGAFYVFIDVKAFGMSSWDFVAFTINESDLVLVHGSAFTEAGEGYVRLSFANEMQVLVEAMNRLEKTVDVLTTKKSAHLS

SEQ ID NO: 34070 - protein, 96 aa, Zea mays
  misc_feature (74)..(74): Xaa can be any naturally occurring amino acid
MGARVQALSKIACSRLQKELAEWQVNPPAGFKHRITDDLQRWVIDVTGAAGTLYTGETYKLQVDFPEHYPMEAXSVIFLHPAPMPFDQKLTRSSGL

SEQ ID NO: 34071 - protein, 514 aa, Salmonella typhimurium
MAESQPLSVAPEGAEYLRAVLRAPVYEAAQVTPLQKMEKLSSRLDNVILVKREDRQPVHSFKLRGAYAMMTGLTEEQKAHGVITASAGNHAQGVAFSSARLGVKSLIVMPKATADIKVDAVRGLGGEVLLHGANFDEAKAKAIELAQQQGFTWVPPFDHPMVIAGQGTLALELLQQDSHLDRVFVPVGGGGLAAGVAVLIKQLMPQIKVIAVEAEDSACLKAALEAGHPVDLPRVGLFAEGVAVKRIGDETFRLCQEYLDDIITVDSDAICAAMKDLFEDVRAVAEPSGALALAGMKKYIAQHNIRGERLAHVLSGANVNFHGLRYVSERCELGEQREGLLTVTIPEEKGNFPKFCQLLGGRMVTEFNYRFADAKNACIFVGVRVSQGLEERKEIITQLCDGGYSVVDLSDDEMAKLHVRYMVGGRPSKPLQERLYSFEFPESPGALLKFLHTLGTHWNISLFHYRSHGTDYGRVLAAFELGDHEPDFETRLHELGYECHDESNNPAFRFFLAG

SEQ ID NO: 34072 - protein, 255 aa, Klebsiella pneumoniae
MRHPLVMGNWKLNGSRHMVNELVANLRTELAGVSGCAVAIAPPEMYLDLAKRAAEGSHIHLGAQNVDVNLSGAFTGETSAEMLKDIGAQYIIIGHSERRTYHKESDELIAKKFAVLKEQGLTPVLCIGETEAENEAGKTEEVCARQIDAVLKTQGAAVFEGVVIAYEPVWAIGTGKSATPAQAQAVHKFIRDHIAKADAKIAEQVIIQYGGSVNAGNAAELFTQPDIDGALVGGASLKADAFAVIVKAAEAAKKA

SEQ ID NO: 34073 - protein, 418 aa, Bordetella petrii
MSYQHIKVPAGGQKITVNADYSLNVPDQAIVPYIEGDGTGADITPVMIKVVDAAVQKAYGGKRKIHWMEVYAGEKATKVYGPDVWLPDETLEVVKDYVVSIKGPLTTPVGGGIRSLNVALRQQLDLYVCLRPVRYFKGVPSPVREPEKTDMVIFRENSEDIYAGIEYQAETEQAKELIQFLQTKLGVKKIRFPNTSSIGIKPVSREGTERLVRKAMQYAIDNDRASVTLVHKGNIMKFTEGGFRDWGYELAQKEFGAQLIDGGPWCKFKNPKTGREIIVKDSIADAFLQQILLRPAEYDVIATLNLNGDYISDALAAQVGGIGIAPGANLSDSVAMFEATHGTAPKYAGKDYVNPGSEILSAEMMLRHMGWTEAADLIIASMEKSILSKQVTYDFARLLEGATQVSCSGFGQVMIDNM

SEQ ID NO: 34074 - protein, 306 aa, Photobacterium profundum SS9
MKIAFFGECMVELSGRPLQRTFGGDTLNTALYLSRLGASRHHTVSYATALGVDKISQDMLASWQEENIGTDLVRKIEGKLPGLYLVETEPNGERHFHYWRNDSAAKFYFSEQLSPLEQAIDSHQFDALYISGISLAILAEDAKTVLITLLEKHKAAGGKVLFDNNYRPQLWTEKQAQYWYAQVLPFVDIALITEDDDLRVWGKTNIVERCKQYGCNEVVIKRGCEPCKIVTNLQSDVAETSYVAANRVEHVVDTCAAGDSFAAGYLAGRLNGESASSSAELGHRLASTVIQYPGAIIPLDAMKDIL

SEQ ID NO: 34075 - protein, 325 aa, Pseudomonas fluorescens Pf-5
MAKRIQFRAHGGPEVLEYVDYQPAEPGPQQVRVSNKAIGLNFIDTYFRSGLYAPPALPSGLGAEGAGVVEAVGSAVTRFKVGDRVAYGSGPLGAYSDVHVLPEANLVRLPDAISFEQAAGVMLKGLTVQYLLRQTYELQGGETVLFHAAAGGVGSLACQWAKALGVKLIGTVSSPEKAAIAKALGAWETIDYSHEDVARRVLELTGGKKCPVVYDGVGKDTWLTSLDCLAPRGLMVSFGNASGAVDGVNLGILSAKGSLYVTRPTLASYANNAENLQRMADDLFGMIASGKLKIEIGQRFALVDAAKAHIELSARRTTGSTVLLP

SEQ ID NO: 34076 - protein, 181 aa, Methanosarcina acetivorans C2A
MRIYFNGKTPKISETAFVANSADIIGNVEVESFSSIWFNAVIRGDQNKIKIGNRTSIQDGVVIHADPENGVQIGDNVSVGHGAVLHGCRIEDNVLIGMNATVLNGAEIGKNSIVGANALVPQGKKFPPNSLIIGVPGTIKRETNEAEVEAIKENADEYVEMAKEYREEMKKFAFAASNSMT

SEQ ID NO: 34077 - protein, 208 aa, Lentinula edodes
KQMKLIHHGGYNDSERDSYKEIIFSNTIQSMRAILDAMPSLDLFLNPSNDARRATILSLPVQLEVDVMPRDVGDSIRGLWSDPAVKEAVKRSREFQLNDSAVYYFNSIDRMSGPGYMPSDQDILRSRVKTTGITETTFQVGELTYKLFDVGGQRSERKKWIHCFENVTALVFLVSLSEYDQMLYEDESVNRMQEALTLFDSICNSRWF

SEQ ID NO: 34078 - protein, 403 aa, Campylobacter coli RM2228
MLELNKIYQAKQKIADFVSKTPFIHSSFLSELCKSEVYLKNENLQITGAYKIRGAYNKIANLDPEAKKAGVIAASAGNHAQGVAISAKKFDTKAIIVMPESTPLLKVSATKSLGAEVILKGDNFDEAYAFATNYAKENGLSFIHPFEDELVMAGQGTLMLEMLDDVSDLDTIIAPVGGGGLISGIASAAKQINPNIKIIAVGAKGAPAMHDSFKAKEVKNSKSVRTIADGIAVRDANPINLGIILECVNEFVQVDDEEIANAVLFLLEKHKIIVEGAGAASVAALLHQKIDIKDSKKIGVVLSGGNIDVQMLNIIIEKGLFKAYRKMQINVTLIDKPGSLLNLTDSLKSANANIVKIDYDRFSTKLDYGDAMISITLETKGKEHQEEVRNILKDKGFDFYETF

SEQ ID NO: 34079 - protein, 226 aa, Glycine max
MCCLRQTQLENVYHPCSDARIQRSDGFTFGIAFSSRDSFFYNQNQSLQLSPCDRRLSLSSSNAQLALFRPRVDEISLLTINTSSFFPDSYGGYMVAFAGKKYAARSPLAFVANSTYTVTSFTLVLEFQRGRLHNLYWKRDGCSSCKGKSNLVCLNKQDCAIRTSSCKGRGGAVDCSLGIQLAFSGTDRHLRVLNSWFEVENLRQYSLYGLYSNLRDSLTSQYNKFF

SEQ ID NO: 34080 - protein, 525 aa, Bradyrhizobium japonicum USDA 110
MAPLKSVSGIIVSTFEWIIALLLGAVALSALARRIKVPYPTFLAIGGALIAFVPNSPTWTLEPDLALALFVAPVLLDAAFDTSLRDLRNNWVPVSTLVVAAVGLTTVGVAYVAHRLMPDMPWAAAIALGAIVAPPDAAAAVAILSQVKLPHRMVKVLEGESLLNDATSLLIYRIAVGAVVMQHLKWSEVAPTIALALVGSVLAGLLAGRIIPLFLQRVKEAPSAIILQFATTFMVWIAAEHLGLSGILTIVVYAITMARTAGAHMPARLRVPSYAVWETMVFVLNVLAFMLIGMQMRPIWTRLDADVRWEYCVAAAWILLTVVLVRLLWVTFYRTTLRALIAHGLYHPKDPKQVASPKGGLIISWCGMRGLVTLATAFALPENFPYRDFIVFIAFAVVLGSLVIQGLTLRPLILAFGLKDDDPVGIEVARGRAVAYRAALDAIESDPSEEAEILRLEYRAILMQADDDPNGGIASGELPADPLRRRAIEAARKSIFDLRATEVIGDDAFHRLEEELDRAELSAGG

SEQ ID NO: 34081 - protein, 159 aa, Plantago major
AKSQAHTRSILLRQSPVFSSSKSSRKMTIKQQWEGLLGNYSRFLHPEKPLPKHWDSSDVETFIKLDPVHGHTLKTAEKVAEFGTAGAIVGAASTAARAWRWSKSPHGTLLSLAFGAVVGGTLGLEIGSHYYQLYRLNPMAAQVKFYEWLQDKAAREGPH

SEQ ID NO: 34082 - protein, 325 aa, Porphyromonas gingivalis W83
MHTFEDLREIIEQEIASQPYDQRKPDGLFQPISYILRLGGKRVRPTLACIACEMFGGDYKPALEVAMAIETYHNFTLLHDDLMDKSSMRRGKETVHHRWGDNTAILSGDAMTVAAYEHLAKVDSRLLPVLLPLFNRMAMEICQGQQYDMDFERRDFVAEDEYLEMIRLKTAVLLATALKMGAIAGGADIEKADILYRYGIHIGLSFQLEDDLLDVYGDPIILGKKIGDDIACNKKTMLLIKALEMAQGEELNLLRESLLMPDVQCEEKIRAVTGIYNRLGIRPIVEDLIDYHNGLAEKALDELGLDEITTKPLRELIGTLRNRKS

SEQ ID NO: 34083 - protein, 475 aa, Leuconostoc mesenteroides subsp. mesenteroides ATCC 8293
MEQADFGVVGLAVMGRNLALNIESRGYRVAVYNRSRERTDDLVQKHEDKAFIPSYTTEEFVETIKKPRRILLMVKAGKGTDAVIDELLPHLEKGDMLIDGGNTYFEDTIRRSDKLAQEGINFIGMGVSGGELGALQGPSLMPGGQREAYDLVAPILTQIAAKAPEDGKPTVTYIGPNGAGHYVKMVHNGIEYGDMQLIAESYDILKRVLHLNQEQLSQTFSGWNEGELNSYLVEITADILTRKDDLGTDKPIVDVILDRAGNKGTGKWSSQSALEVGAPQSLITESVYARYISAMKDDRVAASKTLQGPDYSFSGDEQSTVEDIRKALYFGKIMSYAQGFDQLRMASEHYDWHLPFGELAQLWRAGAIIRAQFLQRITDAFTTQADLHNLLLDPYFQHIAEEYQNAARRVVALAVTAGVPTPSLSAAVAYYDSYRSAVLPANLTQAQRDYFGAHTYERTDKPAGEMYHYPWYDEA

SEQ ID NO: 34084 - protein, 262 aa, Oryza sativa Japonica Group
MAHHRVTDDMSSVTGVKYMLNDSDKHRQNNNIGYYLKEAVSEGGTAFDKAYGTSLFQYLGQDGNEPSNTLFNQAMASHSVVITNKLLQFFRGFDAGAGVDVLVDVGGGVGATLRMITARHPHLRGVNYDLPHVIAQAPPVEGVEHIGGSMFDHVPSGSAILLKWILHLWGDEECVKILKNCYKALPAKGKVILVEYVLPASPEATLAAQEAFRLDVMMLNRLAGGKERTQQEFTDLAVDAGFSGDCKPTYIFTNVWALEFTK

SEQ ID NO: 34085 - protein, 404 aa, Symbiobacterium thermophilum IAM 14863
MARIRQDFPILHQEMNGHPLVYLDNAATTQKPRQVIQALVEYYEGYNANVHRGIHTLAERATEAYEEARAKIARFIGSPSPNQVVFTRNGTEALNMIAYGWLRHRLRPGDVIVTSGMEHHSNLLPWQQAAQATGAQIKYIELLPDGTLNQEHYDRLLSEGNVRFVAFSGASNVLGTLNPVKEMVAKAHAVGARVAVDAVQVVPHMPVNVVDWDADWIAVAGHKMLAPTGTGFLWGKMELLEEMEPTYFGGSMISEAHLTGAKWAQPPAKFEAGTPNIADFIAFGAAVDYLADLGMENVYAHEKALTEYAWERLSAIDGMRLFGPRQPRAGLISFEVAGIHPHDLSAVLNAEGVAIRVGHHCAQPLMEILDVPATNRASFYIYNTQAEVDRLVESILHAKEFFGA

SEQ ID NO: 34086 - protein, 544 aa, Cryptococcus neoformans var. neoformans B-3501A
MATEEIHSLYDTILILDFGSQYSHLITRRCRELNVYCEMLPCTQKVSDLSWKPKGVILSGSPYSVYAPDAPHVDPEVFTLGVPILGICYGLQEIARVHGGSVDAHTHREYGYAKIEVVKTGKKEQDALFEGIEMEADGGLQVWMSHGDQLTSLPPNFVTIASTPTSPYTSVAHESKPIYGVQFHPEVSHSPKGKEVIAAFVKNICSVRDGWSMESFIPKEIARIRQICGEKGQVIGAVSGGVDSTVAAKLMHEAIGDRFHAIMVDNGVLRKDEAKKVHKMLTVDLGVNLTVVDASELFLARLKGVEDPERKRKIIGNTFIEVFEAEAAKLEAAAEKELAEKGGEAKGKIEWLLQGTLYPDVIESISFKGPSATIKTHHNVGGLLEDMKLKLIEPLRELFKDEVRALGRLLNIPEHLVGRHPFPGPGLAIRILGEVTREQIAILQHADDIYIEEVRAAGLYDQISQAFVALLPVKAVGVAGDARTYDQVVAVRAVSTEDFMTADWFVFPPQVLKRISSRITNEVKGVNRVVYDITSKPPGTVEWL

SEQ ID NO: 34087 - protein, 244 aa, Brassica napus
GRVGKAGNILLDEKWVPKIADFGMARLFQEDATHVNTRVAGTNGYMAPEYVMHGALSVKADVFSFGVVVLELISGQKNSSFSLKHVDQTLLEWAYRLYKKGRTMEMVDPDIAASADPEQVRLCVQIGLLCVQGDPHQRPAMRRVSLLLSRKPGHLEEPERPGVPGSRYRRRTHHRPSGTSSVGTLSTTGSSTDSFGSNLNTNSGTGTGRATPVSSRTPTRGHATRSAGASSSSDPHGKRPMTSY

SEQ ID NO: 34088 - protein, 475 aa, Arabidopsis thaliana
MNLQMESVKPLDVVSSGKGKLRRTFAKVINMKKLTGVVPEGNNKVERVKKSQEKVKLDKDLAKNAANLSESFDKLEEEYEKRLAMEALLAKLFATISSIKSGYAQLQYAQSPYDPNGIQKADNLVVAELKTLSELKQSFLKKQLDPNPDRTLVLAEIQELRSVLKTYEIMGKKLECQLKLKDSEIIFLKEKFQESMTQNKLMEKRLNQSGQLCNPLDHNLHLSAVSSTHFVTYLHHTVKSIRGFVKLMVEQMKLAAWDIDMAAELIQPDVLYYKQDHKCFALEHYVCKIMLEAFQLPYFSNESSKKTSREDKAMFFERFTELRSMKPREYLASRPKSRLAKFCRTKYLQLIHPKMEQAFFGHLHQRNQVTAGEFPETSLCTAFLEMAKRVWLLHCLAFSFDPEASIFQVSRGCRFSEVYMKSVSEEAFFSPEQEESSSETEPGVAFTVVPGFRIGKTTIQCEVYLSRSCQRRQSR

SEQ ID NO: 34089 - protein, 240 aa, Glycine max
  misc_feature (84)..(84): Xaa can be any naturally occurring amino acid
  misc_feature (111)..(111): Xaa can be any naturally occurring amino acid
  misc_feature (193)..(193): Xaa can be any naturally occurring amino acid
  misc_feature (214)..(214): Xaa can be any naturally occurring amino acid
FYITPWVFVVGRNRIQGRAAASKSSLCSSSCPSVSIRPPARPEPSRRPLPRITPSKGSTRPPLPPGFLSARGDYTIRITTILIXQLPRDDEKPMKKMTVTPHPRKGVEQPXEPQDFGRELPTDPRGGPAPVLPFPPPMYLPLMPAPPPPPDGNQEVEALLALVVENHNVLEKLHNKEATMREASPKRAKELRXKEFELPYHNSSSCTNYREGCXDCYGSGVHDPLPCSQGGKKGPRGVFC

SEQ ID NO: 34090 - protein, 860 aa, Cryptococcus neoformans var. neoformans B-3501A
MTTDQLHERDVFPRPSHHDIQSTWEKLFSDPLISLTRLKSRSLDKAGLGPAGPDGGVILRSVYWRFYHSLLPPPTSLDLFPQALEASRESYNALRRRYLIAPDGRWASDCSGFDESLSPTSPTHRTSPRIASPVHGSPLQPSDGWDPLSLSTSSPWKTWFAHTELRATIRQDVERTFPDMPYFQLERVQRCMTTALFIFAVLNPDVGYRQGMHELFACCFMAVDRDSLKVVNKADGQQKEAMIKTLDRRYVEHDAFELFLAIMKNAKAFYEWRAEEGPIVSIPLQPINPIDTFDCQRSRTATAPQAPIIVRCNNLHTSLLRRIDPQLYERLETEGVEAQIWAIRWIRLIFTRELPFNVAMRLWDGIFAEDPGLQLLDHICIAMLLLVRNELIDADYPSLLTNLLHYPAPSSAYPFEPFLILAQALFLRSDTSPAAGVEIVIQNQDLLDVKAAPKNQEMDVNGPRSHNSRFADGRGNGRTMSGTVKERLQKGGMGGLAQGLFERAQAAGLDKAFISTVNDFRKNLPDSTTAYSYLPNLPFSPSHSPGPRTSSPFSAIPNSASALPSRSFLSHSPSTTNSIPPSRPALQSRSSTDSHASQISVKTIKDAEREMAELRLAMLGMGKAMSEWLDVLNNPEQHLEKSERENAWKGLERVKETLIDAAGKEVDEIVKEWGWHEGLEASSSRSSTPAPSIMVPPLEAPVTEPEPSPATVVAASGPSNIEFEEATPTPLSVAVMPTTPRFLSASRHSVSPASQDNSSATSGGEKRSLTQTVRGDGPISGLPRVPHTAPINSESTKYRPEEAGRPASAGLGIISVDEEEHSKDQLPANVDPLAGLGTKVRNSRRQAGAGVDPLLGMDIQ

SEQ ID NO: 34091 - protein, 522 aa, Pseudomonas fluorescens Pf-5
MAWPDRQSLLPLLSWLPRQTRASVGRDLLVGLSGAILALPQSIAYALIAGLPPEYGLYAAIVPVLIACLWGSSWHLICGPTAAISIVLYASVSPLAVPASEDYITLILLLTLLAGVFQWLLGMLRFGALVNFVSHSVVLGFTLGAAVVIALGQLPNLLGLELPNQATALNSLSQLLQHLGEVDRPSLLLGLGTLALGVAFKLLAPRWPGLLLSLVFSALVVWLLPGVFGHVQLVSAFVGRLPPFSPLPLDLELILRLLPSAVAVGMLGLVTSLSIARSLSARSEQLLDANQEVRAQGLSNMVGAFFSGYLSSGSFTRSGLSYEAGACSPLAGVFSALWVALFAVAGAGLIAHIPIPAMAGSILLICWGLVDHRGIRALFRVSRAEFVVMSLTCVATLLLELQTAIYAGVLASLFFYLKRTSQPRVQQSSEGDEDILRVGGSIFFGASHYLQVRMQRCHAPRLVIDARQINFIDYSGVEMLHQEARRLRRQERSLILRRARQAVKEELIKLEGPERCPIHFED

SEQ ID NO: 34092 - protein, 367 aa, Zea mays
SRLRRRHYPSSLHTRAPIRVTGSLPPRPNHARAASPVARGGVAVAAVSSPAVSAVAGKDAKQAPKDFLHINDFDKDTIMNILNRAIEVKAAIKSGDRSFQPFNGKSMAMIFAKPSMRTRVSFEAGFFLLGGHAIYLGPDDIQMGKREETRDVARVLSGYNDIIMARVFAHQDILDLAKYAAVPVINGLTDYNHPCQIMADALTMLEHVGRIENTKVVYVGDGNNIVHSWLLLAAVLPFHFVCACPKGFEPDAKTVEVARSAGISKIEITNDPREAVKGADVVYTDVWASMGQKEEADYRKQKFQGFTVDEALMEIAGPQAYLMHCLPAERGVEVTDGAIEAPNSIVFPQAENRMHAQNAIMLHVLGA

SEQ ID NO: 34093 - protein, 568 aa, Oryza sativa
MASSALICDTEQWKGLQAHVGAIQKTHLRDLMDDAERCKAMTAEYEGIFLDYSRQRATGETMEKLFKLAEAAKLKEKIEKMFSGDKINSTENRSVLHVALRAPRDEVIKSDGVNVVPEVWGVKDKIKQFSETFRSGSWVGATGKALTNVVSVGIGGSFLGPLFVHAALQTDPEAAESAKGRQLRFLANVDPVDVARSIKDLDPETTLVVVVSKTFTTAETMLNARTLQWSGLSLLLGPDAVAKHMIAVSTNLELVEKFGIDPKNAFAFWDWVGGRYSVCSAVGVLPLSLQYGFPIVQKFLEGAASIDKHFRSSSFEKNIPVLLGLLSVWNVSFLGYPARAILPYSQALEKFAPHIQQLSMESNGKGVSIDGVQLSFETGEIDFGEPGTNGQHSFYQLIHQGRVIPCDFIGVVKSQQPVYLKGEIVSNHDELMSNFFAQPDALAYGKTPEQLHSEKVPEHLISHKTFQGNRPSLSLLLPSLSAYEIGQLLSIYEHRIAVQGFLWGINSFDQWGVELGKSLASQVRKSLHASRMEGKPVQGFNSSTASLLTRYLAVEPSTPYNTTTMPKV

SEQ ID NO: 34094 - protein, 276 aa, Streptomyces coelicolor A3(2)
MISIPAYTLNDGTSLPALGLGTWPMKDEEAERAVRAALETGYRLIDTATNYRNETGVGRGVASAGLPREEIVVTTKLPGRHHGYEETLASFEESRARLGLEYVDLYLIHWPLPRVDKYVDSWKAMVKLREDGLVRSVGVSNFTAEHIERLERETGVLPSVNQIELHPLLPQDELRAYHERKGIRTESWSPLGRGSDLLDDPAVAAVAAAHGVTPAQAVLRWHTQLGAVPIPKSADPARQRANLDVFGFELDAEQLRAVADRVHRRIGGDPEVHEEF

SEQ ID NO: 34095 - protein, 486 aa, Ostreococcus tauri
MRSSSPLAARSNVLARGSSTNATRSTSDASALGLIDYLNDSWTAWEATESSVKILEAAGYVRISEHAEWSDLRAGGKYYVTRNQSALVAFAVGGKYAPGNGFNVIAAHTDSPCPKLKPVTKIKKGGFMQVGVQTYGGGLWHTWFDRDLSVAGRVLVRRGEKLSHELVRVDRPIIRIPTLAIHLDREISTNGFKPNTETNFAPILATAIRGELETTTEGAAHHALLLSVLAEELGCKPDDIADFELNVCDTQPSVIGGAAREFIFSGRLDNLASSYCGVQALVAATSDAKLANQPGVHMVALFDNEEVGSNSYYGGASPMMFDSIKRAAKALSKSAPGEGGEGLVERTIRNSFLVSADMAHALHPNYMDKHEENHQPKMHKGMVVKHNANQRYATTAVTGYLFRECAKMENVPTQDFVVRNDMGCGSTIGPIVAAGVGIRTVDVGIPQLSMHSVREMCGVEDIDICLRHFTAFYDNFAKVDSTVTVD

SEQ ID NO: 34096 - protein, 243 aa, Physcomitrella patens subsp. patens
MPVVEATHRVDKFSKSDIIVSPSILSANFAILGDQIKAVENAGCDWIHVDVMDGRFVPNITIGPLVVDAIRPVTDLPLDVHLMIVEPEQRVPDFIKAGADIVSVHCENASTIHLHRTINQIKSLGAKAGVVLNPGTPLSQIEYVLDCVDLILIMSVNPGFGGQSFIESQVKKIADLRKMCAEKGVNPWIEVDGGVTPKNAYKVIEAGANALVAGSAVFGAKDYAEAIKGIKTSKRPQEATVAA

SEQ ID NO: 34097 - protein, 236 aa, Ostreococcus tauri
MSVSRNIADVLQRVASACARSGRDGGSVRVVAVSKTKPSDAVKACYDAGHRSFGENYVQELIDKAPTLPDDVRWHFVGHLQSNKAKALLEGVPSLAMLETIDSEKLANKVNNAVPERRANALDVMVQVNTSGEESKHGCEPADAVKLARHIVDNCPRLRFAGLMTIGMPDYTSRPECFETLVECRRQVCAELGLDESACELSMGMSGDFEQAIEMGSTNVRVGSTIFGAREYPNKA

SEQ ID NO: 34098 - protein, 263 aa, Streptomyces coelicolor A3(2)
MSTTGTTPATTGYAAEFAGRTALVTGAASGIGLATARRLGAGGARVVVADFNAEGAEKAAAELRAGGVEAAAVELDVTRPESVEAAVGFAVDTFGSLDLAVNNAGIGGPSAPTGEYDVAAYQRVVRTNLDGVFYSMRYELPAIEAAGKGGSIVNVASILGSVGFAGSPAYVAAKHGVVGLTKAAAAEYAARGIRINAVGPGFIDTPLLKTMDEAAYKGLVALHPAGRLGRSEEVAELIAFLLSDRASFVAGSYHLVDGAYTAV

SEQ ID NO: 34099 - protein, 490 aa, Oryza sativa Japonica Group
MFRLRSSARLLRELREASRSSGRRREWLSGGAVASAARTTSLLHPLPGLDVPQCLPDQLGVQPTRVTTLPNGVRVASEDLPGPSACVGVFVDSGSVYETAETAGVSHLLERLSFKDTAHRSHLQIVQDVEATGGNIGASASREQTVYSYETLKAYLPQAIEVLIDCVRNPLFLQDEVERQVAFAREEVQELQKNPERFLQESLNLVGYTGALANPLVAPEESLTRINGSIIQKFYHENFTADRLVVAASGVDHQYLLDVAEPLLSDWHKGSPVERPESKYIGGDFRHRADSEMTHVALAFEVPGGWLEERDATIMTVVQTLMGGGGSFSSGGPGKGMHSRLYLRVLTKYHTVESFSVFSNAFDRSGLFGIYLTTPSDFVAKAVDIATKELIAIATPGQVTDIELARAKNSTISAVLMNLESRVIVAEDIGRQILTYGCRKPVDHFLQCMDEMTLDDITAFAKKMLSSPPTMASWGDVDKVPPYEFVCKRF

SEQ ID NO: 34100 - protein, 119 aa, Glycine max
  misc_feature (76)..(76): Xaa can be any naturally occurring amino acid
MNRGGGFHITIQAPVNIALIKYWGKRNEELVLPLNDSIAITIDELSATTHITIGPDVSTDSVTLNGVGIDIAGSAXFRNVFQQIREYSNRKRKLKGEHASKGWHTKNESSTNFPTSAGL

SEQ ID NO: 34101 - protein, 220 aa, Brassica napus
RSEGQKTAAIEILQQFDWQVPDWVIVPGGNLGNIYAFYKGFKMCQELGLVDRIPRMVCAQAANANPLYLHYKSGWKDFKPMTASTTFASAIQIGDPVSIDRAVYALKKCDGIVEEATEEELMDAMAQADSTGMFICPHTGVALTALFKLRNRGVIAPTDRTVVVSTAHGLKFTQSKIDYHSKAIPDMACRFSNPPVEVKADFGAVMDVLKSYLGSQTLRS

SEQ ID NO: 34102 - protein, 510 aa, Magnaporthe grisea 70-15
MTNALEAPTKHGIARLDYYVALVAAALKILLFPAYKSTDFEVHRNWLAITHSLHPWQWYYERTSEWTLDYPPFFAYFEWVLSQVARLVDPAMLRIKNLEYDSWQTIYFQRWTVIVTELFLVYALQLFVDSTSGSHRRAAHAAAISILLSPALLIIDHIHFQYNGVMYGLLIASLSLARTKSGLLGSGFIFAALLCMKHIYAYLAPAYVVFLLRAYCLHPKSIFRIQFFNCLKLGGGILAIVVAAFGPFAVKGQMQQVLSRLFPFARGLCHAYWAPNVWAMYSFMDRVLIIAAPKLGLPVKSEALASVTRGLIGDSSFAVLPNITPRMCFVLTLVFQALPLARLFKKPTWDNFVGAVTLCGYASFLFGWHVHEKAILLVIIPFSLIALKDRRYLSAFRPLAVAGHVSLFPLLFTPAEFPIKTAYTVFWLILFLIVFDRLAPASSRPRFFLFDRLNTLYIAVSIPLIVYCSLVHQVVFDKSYEFLPLMFTSSYTAVGVFGSWIGFMVVYFAS

SEQ ID NO: 34103 - protein, 323 aa, Vibrio cholerae O1 biovar eltor str. N16961
MNALVRLSSNHILRSDSMSRVWLTGDAVVDLIPDGQQHYLKCPGGAPANVAVAIARLCGRSAFFGRVGNDPFGRFMQQTLTDEQVDCQHLYFDPVHRTSTVVVDLDEHGERSFTFMVKPSADQFLQLSDIPSFQNGEWLHVCSIALANQPSRSSTFAAIAQMKEVGGYVSFDPNLREEVWSEPQELQATVMRAVGLADVVKFSEEELQFLTGTQSIEEGLQAIADFQIPLVVVTLGAKGALVVTPNSRQIVSGKAVKPIDTTGAGDAFVGGLLYRLSVAQDWHNQATILDAVKWANGCGALATTQKGAMTALPNQAALYAFLE

SEQ ID NO: 34104 - protein, 161 aa, Bradyrhizobium japonicum USDA 110
MAIQTGDKLPEAKFRVMTAEGPQVKTTDDIFKGKKVALFAVPGAYTGTCHKMHLPSIFLNAYAIKDKGVDTIAIISVNDAFVMNAWKRDTDQRDEAVFLADGNADFTKAIGMELDASANGLGIRSKRYSMLVEDGVVKKLNLEAMPGKVEVSGGDTLLGQL

SEQ ID NO: 34105 - protein, 512 aa, Vibrio cholerae O1 biovar eltor str. N16961
MNARSTRFTQDEVLDLIIVGGGINGAGIAADATGRGLKVGLYDAKDFASATSSASSKLVHGGLRYLEHYEFRLVSEALAEREVLLKKAPHIVTPMRFRLPHRPFLRPAWMIRAGLFLYDNLGKRTSLPASHKVNLKAGSVTKPEMQIGFEYSDCWVDDARLVILNAMQAQEQGAEVLNYCTVEKAERMGDLWHVTLLDEQTQQRFERRSHALVNAAGPWVKQFLNENAHVSSPYGIRLIQGSHIIVPRIHDEPQAYILQNEDKRIVFVIPYLDDYSMIGTTDVEYKGDPRKVAITDAERDYLISIVNKHFMREIARSDIIAEFSGVRPLCDDESNSPQAITRDYTLSLDQQADEAPLLSIFGGKLTTYRKLGEAAMKHLAPFFPKMKAPWTADAPLPGGENFDYAALKNQLVAAFPFITESVIERWLRSYGSRTTQLLAGVTGIEDLGIAFSGELYQREIDYLCEKEFARHAQDIFWRRSKLGLNHDTSVVEEVESYLQQKFHAEQPLKATV

SEQ ID NO: 34106 - protein, 178 aa, Fulvimarina pelagi HTCC2506
MPAGDRVGTISKTKGETMTIAVGDPLPNASFRTKTADGMNDLSTDDIFKGKTVVLFGVPGAFTPTCSMNHLPGFLDENAEIRAKGVDEIAVVSMNDPFVMAVWEEAKEASGKILFLSDGNGEFIRAAGLDADLSAAGMGTRSKRFSMIVKDGVVSSLAIEDSPGEAEKTSARNILAQL

SEQ ID NO: 34107 - protein, 314 aa, Fulvimarina pelagi HTCC2506
MRLLSIGEVMIEMSGGWHGSSESEAWRLGFAGDTLNTLWYVRAGLDPERDEASYFTTLGDDGFSDRIAEFLGSNGIEIGAIRRIPGKRPGLYLIEQKDGDRRFTYWRDTSAARQLADDEDALRQAIASADCIYLSGITLAILPAAGRALLVDLCGEANSAGKTVAFDPNIRPALWSGLEDAREAVMRLAAAATIVLPSFDDETAVFGDADPQTTIERYRAAGVAEIAVKNGPHAIAFCSNDEEGTVDALPNVKPVDATGAGDSFNGAYLGARLTGASMREAVEAGRDMAARVVGVHGALADFADPSGRWSAKRG

SEQ ID NO: 34108 - protein, 518 aa, Fulvimarina pelagi HTCC2506
MTALPDTVLIVDFGSQVTQLIARRVREAGVYSEIVPFQSAEESFRKLKPKAVILSGSPASTGDIDSPKAPQVIFDSGLPVLGICYGQMTMCVQMGGKAEPSDHREYGRAFLNIEKDCALFKDLWPAGTRHQVWMSHGDRVIQMPPGFEIFAKSPGAPYAVFGNEERRMYGLMFHPEVVHTTDGAQLIANFVHKVAGLKGDWTMAAFRDKAIAEIREKVGDGKVICGLSGGVDSSVAAVLIHEAIGDQLTCIFVDHGLLRLNEAEEVVSMFRDHYNIPLVHVQAEDTFVDALEGEMDPEVKRKTIGRLFIETFEAEAKKLGGADFLAQGTLYPDVIESVSFTGGPSVTIKSHHNVGGLPERMNMQLVEPLRELFKDEVRILGKELGLPESFVGRQPFPGPGLAIRCPGGITRDKLRVLREADAIYLDEIRKAGLYDAIWQAFAVLLPVQTVGVMGDGRTYEFVCALRAVTSVDGMTADFYHFDMEFLGNAATRIINEVKGINRVVYDVTSKPPGTIEWE

SEQ ID NO: 34109 - protein, 287 aa, Glycine max
  misc_feature (271)..(271): Xaa can be any naturally occurring amino acid
MVSDASKKKAAQKKAAAAAKRGGKAAAAAVMDASSKAADKVANGIADIQISDRTCTGVLCSHPLSRDIRQSLSVTFHGHDLIVDSELELNYGRRYGLLGLNGCGKSTLLTAIGCRELPIPDHMDIYHLTREIDASDMSALEAVISCDEERLKLEKEAEVLAAQDDGGGESLERIYERLDALDAATAEKRAAEILHGLGFDKQMQAKKTRDFSGGWRMRIALARALFMNPTILLLDEPTNHLDLEACVWLEESLKKVERILVVISHSQDFFXGVCTNINHMQSKKLKI

SEQ ID NO: 34110 - protein, 373 aa, Streptomyces hygroscopicus subsp. limoneus
MDGVRAVLLAGGEGRRMGPLGRGRLKPLVPFGGTSRLIDFSIANVHRSGLRDVLLLSQYEERRLMDDLHLVWNGRHRGFRIDFGPYDAVYRRSPGKLPEQLPERIWPLERGTADALLTKAEYVFRQGDAEASEILVLHADHVYRFDYGDMIREHRASKAALTVSYQRIERRYVHLFGMVEFDGDGLLTAFEEKPDDPTSDLVFAAFCLFDAATLRRYLEQLRGTDWQHDISRDVIPAMLAGGELIRGYEVKSYWEDIGTVDRYHRAHRGLLRADPTLALSDMPLTVAPEVPRHLVPGGPGRRASVVAADVANEGEIVSSVVYPGARIGVDAHVVDCVVLPGARVPDGTHLASAIVLEDGSVQQCEAEREEVAL

SEQ ID NO: 34111 - protein, 357 aa, Glycine max
MEQRLANTWRMPLNDKKFIETALLSDLRLDGRRPSDYRKLTVKLAKQDGSAEVHLGQTHVMTFVTAQLVRPYRDRPNEGSLSIFTEFSPMADPSFDPGRPSDAAVELGRVVDRGLRESRAIDTESLCVLSGKLVWAIRVDIHILDNAGNLVDAANIAALASLLTFRRPECSLAGEDGQDVVVHPPEERDPIPFIIHHLPIAVTFGFFSNENLLVIDPTHHEECVMTGRMTATLNSNGDVCAIQKPGGESVSHSVIMHCLKLAHVKATDITTKIRDAVEIHNNERALRKIKRHSSSVAVDVCGEKQNQLDASHLDKLKLEEEEESPMECEASPSGQEQSKDGVSKNFTGGPSSWYDTS

SEQ ID NO: 34112 - protein, 433 aa, Streptomyces hygroscopicus subsp. limoneus
MTAMTKERSMATTKRLPAPQDAAQYQLGDITLVRGEGIRAWDAEGREFLDCVSGTFNLLLGHNHPEVMAAVREQTERLVFASSSFQTEPTNRVIQELAAISPPNLTRVNLRSSGGSTANEGAIKMAQLHTGRRDVIVPFRAHLGQSLATASLNGTTKMRAPFPHRYPGGLHVPGPYCFRCFYRQTPETCGMLCVDRIEDFITYASSGSVACVVIEPISGAGGNIVPPAGYLQELRRFCDEREIVLIFDEIQTGLGRTGQMFAADHFGVQPHMMTLAKGLTGSGLPMAAILTEERMADWDRSLHSFTYGSHTLSAAAALATLEIVQRPGFLENVRASGDVLLGRLRDLQKDNPVIGDVRGVGLMLGVELVEPDGSKAVARAHAYQRSLQDHGILTRVSEHGEGSTIELRPPLILTPADAHMVADRFGEALEGIA

SEQ ID NO: 34113 - protein, 250 aa, marine gamma proteobacterium HTCC2143
MRRSLVVGNWKMMGSRAGVTKLLEELKGYLVASDRASIAICPPYVFLPQVSEDLRESGLRWGSQNLSQYDEGAFTGEVSASMLKDFGCDYTIVGHSERRSLFGEGDADVAAKFVAAQSARLTPILCVGESLQQRDSGDALEWVKQQIIAVVDVAGIDAFADAVVAYEPIWAIGTGKTATPEQAQQVHAHIRGVIASLHPGVADSLRILYGGSVKADNASELFANPDIDGALVGGASLIAADFAAICRAAE

SEQ ID NO: 34114 - protein, 280 aa, Campylobacter coli RM2228
MQELISYIQKAVIEISNALKFPDTSYSQNQNSTGDTQLKFDVLSDEIITNTLSQCPSIKAIISEEKDEILNINENAKFIVAYDPLDGSSLMDVNFAIGSIFAIYEEKASAKNLKAALYSMYGARLELVICEDKPKLYRLDKNNEFVFVKDLQMQEKGKINATGGTQKFWEEKHAKFIKKLFDEGYRLRYSGAMVSDINQILLKGGGIFSYPATSDAPKGKLRAFFEVFPLAFIIEKAGGKTTNGKNHSLLELDFDEIHATTPCFFGSKYEISELLKAYNE

SEQ ID NO: 34115 - protein, 437 aa, Haemophilus influenzae
MEILMKSGDLNKYDLVKNALVLVLAGGRGSRLHELTDKRAKPALYFGGNRRIIDFALSNCINSDLNRIGVVTQYAAHSLLLHLQTGWSFLPQERGEFVDMLPARQQIDDSTWYRGTADAVYQNMAIIKNHYRPKYILILAGDHIYKQDYSVMLMDHVNSGAKCTVGCIEVPRSEAHEFGVMAVNENLKVKAFVEKPKDPPAMVGKPDVSLASMGIYVFDADYLYKMLEQEVNTPQTSHDFGKDVLPKCLEEGALYAHPFSRSCMGRNTEGEIYWRDVGTLDSFWQSNIDLVSENPQLDIYDQSWPIRGNPIQAYPSKFFYKHSNVHPVDNSLIGGGCVITDASISNSVLFDHIKIDAFSKVDHCVVLPQVKIGKNCVLKNCIIDRECEIPDGMQIGVDMEEDKKRFRISSTGKVILVTSKMLKILEGHEIGEEGHLD

SEQ ID NO: 34116 - protein, 493 aa, Oryza sativa
  misc_feature (27)..(27): Xaa can be any naturally occurring amino acid
MFSHGADSAHDAGAVSTGAFRVPYLLXWPYGGKRVYLTGSFTRWTEHLPMSPVEGCPTVFQAICSLSPGIHQYKFCVDGEWRHDERQPTITGDYGVVNTLCLTRDFDQINTILSPSTPGSRMNMDVDNDNFQRTVSLSDGIIQEGPQRISEAAIQISRCRVADFLNGQTGYDLLPDSGKVIALDVNLPVKQSFHILHEQGIPVAPLWDSFRGQFVGLLSPLDFILILRELETHGSNLTEEQLETHTISAWKEAKRQTYARNEGSWRANHHLVHATPYESLREIAMKILQNGVSTVPIMFSSSPDGSYPQLLHLASLSGILKCICRYFKNSQGNLPILSQPVCTIPLGTWVPKIGDPNGRPLAMLRPNTSLSAALNLLVQAGVSSIPIVDDNDSLLDTYSRSDITALAKDKVYTHIRLDEMTIHQALQLGQDANSPFGFFNGQRCQMCLRSDTLLKVMERLANPGVRRVFIVEAGSKRVEGIISLSDIFKFLLS

SEQ ID NO: 34117 - protein, 219 aa, Ostreococcus tauri
  misc_feature (218)..(219): Xaa can be any naturally occurring amino acid
MREDVPANANASCVGVGDEAAGKAKGCEGCPNQAACASGAAKKASEEGDVDALRVAERLREVKRKILVLSGKGGVGKSTFAAQLAFGLARDGRDVGLLDVDICGPSVPLMLGEVGSEVHKSNSGWSPVYVEENLAVMSIGFLLPNPDDAVIWRGPRKNGLIKQFLGDTEWGALDYLIVDAPPGTSDEHLSVVQYMKEAGVDGALIVTTPQEVAMATCXX

SEQ ID NO: 34118 - protein, 482 aa, Polaromonas sp. JS666
MNNFNNLINGQWLAGNSTSANRNPSNLADVIGEYAQADAAGLDAAVQAAQAAFPAWSTSGIQARSDALDRIGTEILARREELGTLLSREEGKTKPEGIGEATRAGQIFKFFAGECLRLSGETVPSVRPGIGVEITREPVGVVGLITPWNFPIAIPAWKVAPALAFGNCVVLKPADLVPGSAWALAEIISRSGIPAGVFNLVMGPGRVIGDALVNHPGINAISFTGSVGVGSRIAEACAKNLKKVQLEMGGKNPQVILDDADLTQAVELSAQSAFYSTGQRCTASSRLIVTDGIYPAFVKALQERMTRIKVGDALTTGTDMGPVSSQAQLEQDLSYIAIGKAEGATLAFGGNRVPCHTGSGAEGYFMAPALFSESTAGMRINREEIFGPVASIIRVKDYEAALAAANDTPFGLSAGIATTSLKYATHFKRHSQAGMVMVNLPTAGVDYHVPFGGRKGSSYGPREQGRYAQEFFTTVKTAYTLA

SEQ ID NO: 34119 - protein, 103 aa, Triticum aestivum
  misc_feature (68)..(68): Xaa can be any naturally occurring amino acid
MAPTVMASSATSVAPFQGLKSTAGLPVSRRSNGASLGSVSNGGRIRCMQVWPIEGIKKFETLSYLPPXSTREALLKARSNYLIRSKWVPLPPSSSKGLGFNFR

SEQ ID NO: 34120 - protein, 335 aa, Triticum aestivum
  misc_feature (29)..(29): Xaa can be any naturally occurring amino acid
MMMDGGAAGTSNGGSGADGDAARRNNTKXMPKYSKFTQQELPACKPILTPKWVVSVFFLVGVVFVPVGVVSLLAAQDVVEIIDRYDHACVPPNMTDNKLAYIQNETIPKDCTRILTVTKEMKQPIYVYYQLDNFYQNHRRYVKSRNDAQLRDYKKSNTTTSCDPERFTADGKPIVPCGLIAWSLFNDTYSFTRGKDNLTVDKKDISWKSDREHKFANNVYPSNFQNGALIGGKKLNSSIPLSEQEDLIVWIRTAALPTFRKLYGRIYVDLKANDTIIVRLSNTSSYSSVAKKVGPFPAPAGGKIWFGTGDFGLLLNQELGHYFLGLVPLNGNPLP

SEQ ID NO: 34121 - protein, 396 aa, Staphylococcus aureus subsp. aureus Mu50
MTKSEKIIELTNHYGAHNYLPLPIVISEAEGVWVKDPEGNKYMDMLSAYSAVNQGHRHPKIIQALKDQADKVTLVSRAFHSDNLGEWYEKICKLAGKDKALPMNTGAEAVETALKAARRWAYDVKGIEPNKAEIIAFNGNFHGRTMAPVSLSSEAEYQRGYGPLLDGFRKVDFGDVDALKAAINENTAAVLVEPIQGEAGINIPPEGYLKAIRELCDEHNVLFIADEIQAGLGRSGKLFATDWDNVKPDVYILGKALGGGVFPISVVLADKEVLDVFTPGSHGSTFGGNPLACAASIAALDVIVDEDLPGRSLELGDYFKEQLKQIDHPSIKEVRGRGLFIGVELNESARPYCEALKEEGLLCKETHDTVIRFAPPLIITKEELDLALEKIRHVFQ

SEQ ID NO: 34122 - protein, 414 aa, Staphylococcus aureus subsp. aureus Mu50
MTENNNLVTSTQGIIKEALHKLGFDEGMYDLIKEPLRMLQVRIPVRMDDGTVKTFTGYRAQHNDAVGPTKGGVRFHPDVDEEEVKALSMWMTLKCGIVNLPYGGGKGGIVCDPRQMSIHEVERLSRGYVRAISQFVGPNKDIPAPDVFTNSQIMAWMMDEYSALDKFNSPGFITGKPIVLGGSHGRDRSTALGVVIAIEQAAKRRNMQIEGAKVVIQGFGNAGSFLAKFLYDLGAKIVGISDAYGALHDPNGLDIDYLLDRRDSFGTVTNLFEETISNKELFELDCDILVPAAISNQITEDNAHDIKASIVVEAANGPTTPEATRILTERGILLVPDVLASAGGVTVSYFEWVQNNQGYYWSEEEVNEKLREKLEAAFDTIYELSQNRKIDMRLAAYIIGIKRTAEAARYRGWA

SEQ ID NO: 34123 - protein, 433 aa, Synechocystis sp. PCC 6803
MTTATTTAPEFISACTKLVSKEGNTEYPLKALHICEETFAPLEVAYDYDLIRRHVTRETIEAGPNSIWRYRAFLPVTGKDVIDVGTGMTPLVKSHRLARRLGLKNLYIKNDAVNMPTLSFKDRVVSVALTRARELGFTTVSCASTGNLANSTAAIAAHAGLDCCVFIPADLEAGKVLGTLIYNPTLMAVKGNYDQVNRLCCEVGNSYGWGFVNINLRPYYSEGSKTLGFEVAEQLGWKLPDHIVAPLASGSLFTKIHKGFQEFIKVGLVDDKPVRFSGAQAEGCSPIATAFQEGRDFVKPVKPNTIAKSIAIGNPADGVYALDIARKTNGNIESVNDAEIIEGIKLLAETEGIFTETAGGTTVAVLKKLVEAGKIDPEETTVVYITGNGLKTQEAVQSHVGEPLTIDANLDSFERALERSRTLERLEWQQVLV

SEQ ID NO: 34124 - protein, 449 aa, Porphyromonas gingivalis W83
MRYDLAIIGGGPAGYTAAERAAKGGLKTLLIEKNALGGVCLNEGCIPTKTLLYSAKVLHQIATASKYAVSGTADGLDLGKVIARKGKIIRKLTAGIRSRLTEAGVEMVTAEATVTGCDADGIIGITAGEAQYKAANLLLCTGSETFIPPIPGVEQTEYWTNREALQNKEIPTSLVIIGGGVIGMEFASFFNGIGTQVHVVEMLPEILNGIDPEHAAMLRAHYEKEGIKFYLGHKVTSVRNGAVTVEYEGESKEIEGERILMSVGRRPVLQGFESLGLVLAGKGVKTNERMQTSLPNVYAAGDITGFSLLAHTAVREAEVAVDQILGKTDETMSYRAVPGVVYTNPEVAGVGETEESLRKAGRAYTVRRLPMAFSGRFVAENEQGNGECKLLLDEENRLIGAHLIGNPAGELIVTAAMAIETGMTDRQIERIIFPHPTVGEILKETLAGG

SEQ ID NO: 34125 - protein, 122 aa, Glycine max
AGEISESVVEGETATTDPHMHRSLKGRQISMIAIAGTIGTGLFLGSGRALANGGPVGALIGYTVVGILVGCMMYSLGEMMVYDPSAGGFIEFSARYVDPAVGFAVGWQFWFQTAITAPVEVV

SEQ ID NO: 34126 - protein, 130 aa, Zea mays
KRNPFLGFGFCCKQKATRLGSSTLASERDAHLSVKRRRGLDQSRRRTPPWRRLAAAQEGRFSVPEAAPFTAVLKYAAEEFKVPPQTSAIITNDGIGINPQQSAGNVFLKHGSELRLIPRDRVGAVVMSSG

SEQ ID NO: 34127 - protein, 446 aa, Leuconostoc mesenteroides subsp. mesenteroides ATCC 8293
MNYDVIFIGSGHAAWHGAQTLARSGKKVALVEENKVAGTCTNFGCNAKILLDGPAEMMHHLNHYHGIGINDTPNIIWPELMAYKHQVIDPLSGGLAHMLSVDGIDIINGHAKFLNNEKIVVVDQVYQAEKFVIATGQRPAKLPISGSEFMKDSTDFLDLPDMPKSILFVGAGYIAMEFASIAHAAGSDVTLIEYGNHVLNGFDEVYSQKVIEDMTEKGIHFTFNQAVSSVSLLANGQYQVDTAQGETYYVDYVMDTTGRVPNIEELALDDINVLYDKQGILVNDHLQTSIDNIYASGDVISKAIPRLTPTATFESNYIASVLLGNQEPINYPVVPTVAFTLPRVAQIGVTIDEAAKDENLQVHEIPYGRVMRFQTLNDVHAAIKIIVNKNKQLVGAALIGDFAPEVVNALVPVINQQYTSSDIKSQIYAFPTDSGIILPMIANYLA

SEQ ID NO: 34128 - protein, 734 aa, Schizosaccharomyces pombe 972h-
MPPEAKRIVVKGFDPRKSRQRQETYYVTMIDRLNMALQVVMAGLGLKTGYQELYSGVENLTRADQASRCFNILQHHMSSGIQLLKDSAESFIQLEGTETDTNACTVVVGCWNKWLERVEIVQNIFYYMDKTFLSHHPDYPTIEELSLSLFREKLMAVKNIQIPFLNSLLQSFENLHSSKSTDHAYLQDAMLMLHRTEMYSSVFVPMYLVMLSRFYDTESSQKIQELPLEEYLEYAMSSLEREDAYVEKFDIVRDKKSIRETVQRCLITSHLDTLTKGISQFIEKRDAHSCKLLYALLQFNHETEYLIQPWSDCLVDVGFKLVNDESKDDTLVQELLSFHKFLQVVVDESFLHDETLSYAMRKAFETFINGAKGSQREAPARLIAKYIDYLLRVGEQASGGKPLKEVFSEILDLFRYIASKDIFEAYYKLDIAKRLLLNKSASAQNELMLLDMLKKTCGSQFTHSLEGMFRDVNISKEFTSSFRHSKAAHNLHRDLYVNVLSQAYWPSYPESHIRLPDDMQQDLDCFEKFYLSKQVGKKISWYASLGHCIVKARFPLGNKELSISLFQACVLLQFNNCLGGEGISYQDLKKSTELSDIDLTRTLQSLSCARIRPLVMVPKSKKPSPDTMFYVNEKFTDKLYRVKINQIYLKEERQENSDVQEQVVRDRQFELQASIVRVMKQKEKMKHDDLVQYVINNVKDRGIPLVSDVKTAIEKLLEKEYLEREDNDIYTYVT

SEQ ID NO: 34129 - protein, 112 aa, Oryza sativa
IPAAVYMLQDQEAHAAEMERTFIAIKPDGVQRGLVWEGEGVIKYGRKLIGATDPQKSEPGTIRGDLAVVVGRNIIHGSDGPETAKAEIGLWFEPRELVSYTSNEEKWIYGVN

SEQ ID NO: 34130 - protein, 302 aa, Burkholderia sp. 383
MSGGTFPAFVSAGDILTDMVRAGDAQWTSVPGGAGWNVARAVARLGVPSALAGSIGEDCFSDVLWHTSEAAGLDLRFLQRVARPPLLAIVHETRPPAYFFIGEASADLAFDPAQLPAGWTDHVKWAHFGCISLVREPLAGTLAALAADLHARGVKISFDPNVRNLMTAAFQPTLAKMAALADLIKVSDEDLRHLFGGDGPDAIGAVRALNPHAAVLVTRGAQAATLYADGDVHEASPPRVEVADTVGAGDASIGGMLFSLMAAPQRSWREHLVFALAAGAAACRHTGAHAPTLDEVVALIER

SEQ ID NO: 34131 - protein, 535 aa, marine gamma proteobacterium HTCC2143
MSILNSIINPRAATFNENSEHMQELVDDLHQKLAAIKLGGGEKYQLRHKDRGKLLVRERINALLDPGSPFLELSQLAAFNVYDEEVNAAGIITGVGRVNGQECMIVANDATVKGGSYYPLSVKKHLRAQTIAEQNHLPCIYLVDSGGANLPRQDEVFPDREHFGRIFFNQANMSAQNIPQIAVVMGSCTAGGAYVPAMADESIIVKEQGTIFLAGPPLVKAATGEIVSAEELGGADVHCRTSGVSDHYAQNDHHALQIARQCIDNFNRVKPIAMNVREVREPLYDSKEIYGIVPKDARQPYDVRDVIARIVDGSEFNEFKALYGTTLVCGFAHLFGYPVGIVANNGILFSESAQKGAHFIELCAQRKIPLIFLQNINGFMVGQQYEAGGIAKHGAKMVMAVACAQVPKLTLLIGGSFGAGNYGMCGRAYDPRFMFMWPNARISVMGGEQAAGVLAQIKKDQKNSRDESWSEAEESAFKQPILDTYDEQGHPYYASARLWDDGIIDPAETRMVLGLALSASLNKPIEDTRFGVFRM

SEQ ID NO: 34132 - protein, 181 aa, Pseudomonas fluorescens Pf-5
MAIRSYQNHTPNLGERAFVDHSAVVIGDVEIGADSSVWPLTVIRGDMHRIRIGARTSVQDASVLHITHAGPFNPDGFPLLIGDDVTIAHKVMLHGCSIGNRVLIGMGSIVMDGAVVEDDVIVGAGSLVPPGKRLESGFLYVGSPVKQARPLTDKERAFFTYSAANYVKLKDLHLAEGYDRP

SEQ ID NO: 34133 - protein, 529 aa, Cryptococcus neoformans var. neoformans B-3501A
MPVPDNTSPRYSLQPPCGLPAPFRLPLRQLEDNGANQVGDIGSVRRSTATDNDGSGDTLMSCFGTLTIPSLPLKDESAEVVGSAHDNHTGVQTKCYPGPKLSDRATQGPDAGPLIDRFSCLFQDQYDCRFNPKGIVSLGVAENFLMQQQCMELFSSALHSNITPLDLSYGDSLWGSRRINKALSAFFNEWFNPAEKVLPEQIITGVGCSAVLDQLFHTILDENEAVLLAAPYYTGFDRDLISRGRVKLIPVHLSPERAFGPESLELFEEVYDKITAQGITIRAVIVCNPQNPLGRTYPRETLLAYAKFCQNKDLHLVSDEIYALSVYNNKDFPEALPFTSMLSLNVQEELGINFDKSRLHVVYGMSKDFCANGLRVGSLVSQHNPFLLRSMANTSMLMKLSSPADVIWSSLLQDKIALKKFITTNRQLLGEAQAFIRKWFEDRGVPVADHNAGNFVWVNLGAALEFDDVTTEKQIFQKLLDGGVYIAPGSAYHYHIPGWYRVTFSVARDNLLVGLGRIEKLLGLRLVKS

SEQ ID NO: 34134 - protein, 364 aa, uncultured marine group II euryarchaeote DeepAnt-JyKC7
MFDMAGDDAVQFGLGEPDFQPPDIAIEAFSKAMKDGHNKYTTTAGLPALRLKIAEGWQHLVPSLDASSVCMTMSGTNALLDIFLALVDPADEVLLPEPYFPLYPTDVVICGGEPILYPCLFERGFVPTVEDLESRVTDKTVAILYNFPSNPTGGNVTTEERDELVDFARRHDLWVITDEVYDRIVYDTEHVSFIGAGYDKVIMINSFSKTFAMTGWRIGYILSENAEAMEQIAKMQYYVTACSNDAMQYAVLEALNEASDYPEHMRDEFQARRDLICDRLNAMPGVSCHIPTGAFYVFPKVEAAGLNSEEIALALLEGGVLCSPGSAFGAAGEGHLRFAYTIGREGISRGMDRVEKVLAELRGE

SEQ ID NO: 34135 - protein, 351 aa, Oryza sativa Indica Group
MWILASLFFDWAIFFFSSLNQLGIHASKFVTFEGAKELAYQYAAQGACLALVARRKKALEGVAAAALERGSPDVLVLPADVSDADQSRRAVEETVAHFGKLNHLVANAGIWSSCSFDEVTNITAFTKMMDVNFWGSVYPTYYALPHLKASKGKLVVSCSAAGTVATSRMSFYNATKAAQLRFYETLRTELGSEVGITVLTPGYVESEITKGKGIQSGGDVAVNEEARDEQIGVFPVGRVAELGEVAMDGIRAGDWYVTWPSLFRPLQLVACLAPGVLDWACRALYGTRKGARPPLGKRIMEATGMKRLFPEALRRNPAIKTEDEEYCDGEEGYGAADDAAAAYLLQCRKGL

SEQ ID NO: 34136 - protein, 240 aa, Polaromonas sp. JS666
MSQKPTSHPYKPNMTQDELKALVGQAALPYVEPGSIVGVGTGSTVNKFIDALATMKDRIAGAVSSSVASTERLQAIGIKVFDATEVDELAVYIDGADEIDHAGYMIKGGGAALTREKIVAAQSRKFVCIADESKLVQTLGSFPLPVEVIPMAARRIARQFAALGGTATLRSKGGAESGEPLVTDNGQHILDVTGLKITDPLGFESQVNQWPGVVTVGVFAFQKAHVCLLGASDGVRTLVF

SEQ ID NO: 34137 - protein, 57 aa, Zea mays
  misc_feature (7)..(7): Xaa can be any naturally occurring amino acid
VNPDDEXSGQCFLTGLVIRNLSISTSNWRCTKTLADYLTERDIMGVYDLDTRGGARY

SEQ ID NO: 34138 - protein, 446 aa, Streptomyces coelicolor A3(2)
MGHADTLLAMGGAFVAAAFLARLGGRIGLPTIPLFMLAGILLGPHTPGFVLVEDAHDFEMLSALGLVLLLFYLGLEFHLDDLRSGGKRLLTAGGIYLLLNVGAGLGFGFVLGWGVREALVLAGVLGISSSAIVTKILIDLGRIGRPETRLILGVIVVEDIFLALYLAALQPVISGAHGVADTALQAGKAFGFLLVLAAAARYGTRLVGRLIHTRDNELLVISFLGAAVLVAGVSEVLGVADAIGAFMVGLILAGTPSGPRIRELVHPLRDAFAAIFFFAFGLAIDPGDLASVAGPVAAAAALTVVMNIVAGLCVARVYHYGSEPAAEIATTLVARGEFALILAAMAAGAGLDAQLAPFIAGYVLVLAVLGPIVAGRAHVLAAALRAVGGLLPGTRTPVAAADGGAGGAETEDEDDGRPEPGPVPVPAQASPAFGSSSSPEHTEAGH

SEQ ID NO: 34139 - protein, 283 aa, Methanosarcina acetivorans C2A
MKIIGGPASQLLASRTARALGTEPVLCEFNRFPDGELYLRIADEIENEKVTIIQSTPTDSDFVALLQLIDACEGAAEINVVIPYMGYARQDKKFKPGESISARAIARCINASRIFTINIHERSILDHFPCPAVNLDAASLVGEYIAGSGLENPMLVAPDEGAQGLVKNVAAGHGFDHDHLQKTRLSGDTVVIKTKNLDVTGRHVVLVDDMIATGGTMAESVRMLKAQGAIDVHLACVHPVLTRNAALRLFNAGVKDIIATDTLEKAESLLSVAPLIAEALKRL

SEQ ID NO: 34140 - protein, 386 aa, Oryza sativa Indica Group
MGRVYLAIHGVLMHVVAALVVLVYIPLSVPVRLFLWAFVKPLRREQLRGKVVLITGASSGIGEELAYQYASKGASLALVARRKQALKSVAAAARERGAPDVLVLHADVSDAGQSRRAVEETIAHYGKLNHLVANAGIWSTCPFDEITNITAFTTIMISCTGYFEACNNKSKGIVYMNFKDVNFWGAVYPTYYALPHLKASRGKLVVCSSAAGTVATSRMSFYNASKAAVLRFYETLRAELGSEVGVTILTHGYVESEMTMGKAVQKDGVLVVDEEARDVQIGVFPVGSVSAMCRVAMDGIRRGDRYVTWPSMYRPLQLVACLAPEIVSWLSYAMYNTKAGGGAPLSKRALDATGARRFFPEGLRRNPVVIKTDEECDGDEGVAACN

SEQ ID NO: 34141 - protein, 514 aa, Streptococcus pyogenes SSI-1
MSILEVKQLSHGFGDRAIFENVSFRLLKGEHIGLVGANGEGKSTFMSIVTGHLQPDEGKVEWSKYVTAGYLDQHTVLESGQTVRDVLRTAFDELFKTENRINEIYVSMADDKADIAVLMEEVGELQDRLESRDFYTLDAKIDEVARALGVMDFGMESDVTSLSGGQRTKVLLAKLLLEKPDILLLDEPTNHLDAEHIEWLKRYLQHYENAFVLISHDISFLNDVINIVYHVENQSLVRYTGDYYQFQAVYEMKQSQLEAAYERQQKEIANLQDFVNRNKARVATRNMAMSRQKKLDKMDIIELQAEKPKPNFEFKQARTPSRFIFQTKNLVIGYDYPLTKEPLNITFERNQKIAIVGANGIGKSTLLKSLLGVIEPLEGHIVTGDFLEVGYFEQEVTGVNRQTPLEVVWDAFPALNQAEVRAALARCGLTSKHIESQIQVLSGGEQAKVRFCLLMNRENNVLILDEPTNHLDIDAKNELKRALKAYKGSILMVCHEPDFYNGWVTDTWDFSKLT

SEQ ID NO: 34142 - protein, 293 aa, Streptomyces nogalater
MKGIILAGGTGSRLHPTTLAVSKQLLPVGDKPMIYYPLSVLMLAGVTDILIISTPHELPRMRRLFGDGAQLGLRLAYAEQEKPRGIAEAFLIGADHVGSDAVALALGDNIFHGSSFQGVLRKEAEELDGCVLFGYPVKDPQRYGVGEANASGRLVSIEEKPVRPRSNRAITGLYFYDNEVVDIARRLRPSARGELEITDINRTYMERGRARLVDLGRGFAWLDTGTPESLLQASQYVSALEERQGIRIACIEEVALRMGFINAQACYELGARLSGSGYGQYVMAIAEECTGRV

SEQ ID NO: 34143 - protein, 189 aa, Synechocystis sp. PCC 6803
MTPERVPSVVFKTRVRDESVPGPNPYRWEDKTTEQIFGGKKVVLFSLPGAFTPTCSSNHLPRYEQLFEEFQALGVDDIICLSVNDAFVMFQWGKQIGADKVKLLPDGNGEFTRKMGMLVEKSNLGFGMRSWRYSMFVNDGKIEKMFIEPEFGDNCPVDPFECSDADTMLAYLKGAEAPGVSEPVKAFVG

SEQ ID NO: 34144 - protein, 107 aa, Triticum aestivum
  misc_feature (9)..(9): Xaa can be any naturally occurring amino acid
SAAVYLGFXTQTQGISLEAQAQRAIPLATALDNGRPTLVEFYADWCTSCQAMAPDLAELKKNYGGSVNFAMLNVDNNKWLPEVLRYRVDGIPHFVYLDDTGTAIAVT

SEQ ID NO: 34145 - protein, 363 aa, Xylella fastidiosa Ann-1
MADIIPTAWQPFKSETPLTTFPFRFPAEWEPQSAILIAWPHANTDWSAHLADVEETYIALVAAITRFQMVIICVLDDDLQTYTEARLRSASVAMQQVRFTVASYNDTWLRDSGPITLIGINGDFRLLDFRFTGWGGKFEAKADDQLVSALHANGLFKNTQMHSINFALEGGAIETDGAGTLLTTWRCLHERHPQRTRTTLDANLTAWLAQNRVLWLEHGYLEGDDTDAHIDTLARFASTDSIVYQSCDNTTDSHYAELQAMANELTALRTTEGRPYRLFPLPWTKPILDQDRRLPASYANFLIIEGAVLMPTYDDPADTIAQSVLAEAFPTREIVPVPCRPLIWQNGSLHCITMQIPAGLLAT

SEQ ID NO: 34146 - protein, 264 aa, Fulvimarina pelagi HTCC2506
MQSATIDGLSVHVDLTVGAGSGAPAIVFSNSLGTDFRIWDDVVAALAGRYTILRYDSRGHGLTDIGETPYSMSGLSTDLAALMDAFGISDAVVVGLSVGGMIAQDLALSRPDLLRGLVLSNTAHKIGDAAAWNQRIDTIRADGLDAIAEATMEKWFTPGFRRADNSAYQVNRNMFLRAPLEGYIATCHALSKADYSDTVGDLSVPALCIAGDQDGSTPAELVKSLSDKIAGSQFEVIENAAHIPCVEQPEAYADRLEGFIAGLR

SEQ ID NO: 34147 - protein, 473 aa, Hydrogenophilus thermoluteolus
MRHTKIVATLGPASSDPATLERLLLAGVDVVRLNFSHGTADEHRARASLVRALAQQTQRPVGILGDLQGPKIRIGRFTTNAVTLSKGQRFRLDCDLAPGDATRVGLDYPELIDDVEVGDILLLDDGKIRLQIVEKCADALITQVLVGGTLSNHKGINKLGGGLSAPALTAKDRAVPISRSLPKSASITVAVSFVKHAEEMHEARHLARAAGSRARLIAKIERVEAIANLDAILEASDGVMVARGDLAVEVGDAAVPALQKRILRRAREMNRLSITATQMMESMVHSPVPTRAEVSDVANAVLDGTDAVMLSAETAAGQYPVEAVEAMARVCAEADASNDAHLDQELLGRRFHRVDEAIAVSAVWSGYHLGVKAIVALTQSGATALWMSRIASILPIYALTPDPVTFGHLTLFRQVTPVRFDLNPASDPAMLLTQIRTLLVSNGWAAPGETIAVTFGEPMGQPGGSNTLKIVTL

SEQ ID NO: 34148 - protein, 434 aa, Schizosaccharomyces pombe 972h-
MGMGSKLDVSSSLNSSSSNMDRDRSESPKRHVNGSNSLKRGLHFDGEHTERDPHLGNGQKYTQQERRVYVGNLSYQVRWFELKEFMGQVGNVLNCEILNLPNGLSKGCAIIEYSTAEEARTAIKTLSNQKFMGRLVYIREDREQNARFGSSSVSPSASSNGKDSEPDRQLFVGNVSSISNPLYSFPRTLLPYNVRWQDLKDLFRQAGSVIRADIQMNQEGRSRGIGIVVMSSMKEAMHAIQMLHNTDFMGRTLEVRLDRFAHHKIEDLVYHAYPHGPCSDCIYVGNLPWATSDRNLLDLFTDIGSVIRARIAYEPTGRSKGFGVVQFENENDAASSIEKLNGYRYGGRPLQLSYAHYATPLPAVPTVLSGLPSVAYTPPVMHIPTTNSPLTPQSFTNSFLGYLPISMPVANMPAIAPISVALPENNIEHSLEPS

SEQ ID NO: 34149 - protein, 263 aa, Hordeum vulgare subsp. vulgare
MPHNVFLHSALVQSRKIDTKKKSRVQEAVYYYNIESILALIISFFINICVTTVFAKGFYGSEQADNIGLENAGQYLQEKYGTALFPVLYIWAIGLLASGQSSTITGTYAGQFVMGGFLNLRLKKWLRAVITRSFAIIPTMIVALFFDTEDPTMDVLNESLNVLQSIQIPFALIPLITLVSSEQLMGSFVVGPITKVISWIVTIFLMLINGYLILSFYTEEVRGAVVRSSLCVVLAVYLAFIVYLILRNTTQYSRLRSSVSKSS

SEQ ID NO: 34150 - protein, 422 aa, Polaromonas sp. JS666
MALIVHKYGGTSMGSTERIRNVAKRVAKWARAGHQMVVVPSAMSGETNRLLGLAKELAPARPGDDYHRELDALAATGEQASSALLAIALQSEGMQAVSYAGWQVTIKTNNAYTKARIESIDDERVRADLDAGKVVIITGFQGVDEGGNVTTLGRGGSDTSAVAIAAALKAHECLIYTDVDGVYTTDPRVVPEARRLHTVSFEEMLEMASMGSKVLQIRSVEFAGKYKVPLRVLSSFTDWDIDINEEARSGTLISFEEDENMEQAIVSGIAFNRDEAKISVLGVPDTPGIAYQILGAVADANIEVDVIIQNISKDGKTDFSFTVHRNDYSKAVDLLKTQVLPKLGAQEVTGDAKICKVSIVGIGMRSHVGVASKMFRVLSEEGINIQMISTSEIKTSVVIDEKYMELAVRALHKAFDLDQPAA

SEQ ID NO: 34151 - protein, 367 aa, Prochlorococcus marinus str. MIT 9312
MVLLNKIKNKLRINYRKKRWPGLIDAYKQYLPVTKKTPIISLNEGNTPLIFSDSISKLIGNGTKVFLKYDGLNPTGSFKDRGMTMAISKAKEEGREAVICASTGNTSAAAAAYASRGGLKPYVLIPEGFVAQGKLAQALMYGAEIISINGNFDKALEIVRDLSAEHPIELVNSVNPYRIQGQKTAAFEIVDDLGIAPDWLCIPMGNAGNITAYWMGFKEYSKIKRNLKLPIMMGFQSEGSAPLVQNIIIKEPETIATAIRIGNPVNREKAKKVKKESKGDFQSVTDEEIINAYKILAKEGVFCEPASAASVAGLIKNKNRIQKESTIVCVLTGNGLKDPDCAINNNDAIFRKNIEPSLKNITKILGY

SEQ ID NO: 34152 - protein, 430 aa, Zea mays
  misc_feature (51)..(51): Xaa can be any naturally occurring amino acid
  misc_feature (72)..(72): Xaa can be any naturally occurring amino acid
MRSTMKAQHANGRGSRSPFLTSYALTLAFITFVSVLYFKDFSSTLHRPFLXPPPPPRRPRQKPGGAPRGGGXLPFAVGAAPAGCDVGRGEWVYDDAARPWYQEEECPYIQPQLTCQAHGRPDRAYQHWRWQPRGCSLPSFNATLMLEMLRGKRMLFVGDSLNRGQYVSLVCLLHRIIPESSKSMETVDSLTVFKAKDYNATIEFYWAPFLAESNSDDAVVHRIADRIVRGTSIEKHAKFWKGADILVFNTYLWWMTGQKMKILRNSFEDKSKDIIEMETEEAYEMVLNAVLKWVESNMNPRTSRTFFVTMSPTHTRSRDWGDDTDGNCYNQTAPIEDLSYWGPDTSKGLMRVIGEVFSASKSRIPVGVVNITQLSEYRKDAHTQIYKKQWNPLTPEQVADPKSYADCTHWCLPGLQDTWNELLYSKLFFP

SEQ ID NO: 34153 - protein, 511 aa, Pseudomonas fluorescens Pf-5
MRAAQLKSVLPRELLASVVVFLVALPLCMGIAIASGLPPAKGLITGIIGGLVVGWLAGSPLQVSGPAAGLAVLVFELVRQHGVAMLGPILLLAGLLQLLAGRLRLGCWFRVTAPAVVYGMLAGIGVLIVLSQVHVMLDAAPQASGLDNLVGFPQALAQALPSLGWQAGLLGLATIAVMWGWDKWRPQALRFIPGALLGVGLATLASLLLALPVKRVEVPANLAEAIDWLRPADLLNLADPNLLIAAFAVAFIASAETLLSAAAVDRMHSGQRSDFDRELSAQGVGNMLCGLLGALPMTGVIVRSSANVQAGAQTRYSTIFHGLWLLGFVLVLSSVLQSIPVASLAGVLVYTGFKLVDLKVFRGLGRYGRMPMLTYAVTALAIVFSDLLTGVLIGFALTLAKLAFKASRLKISLIDLAEEGEMELRLVGAATFLKVPALTRVLATIPPATTVHVPLSNLSYIDHACLELLEDWNRANSAKGSRLVIETRGLKRRLEGRLTTTSGVGAAAARG

SEQ ID NO: 34154 - protein, 622 aa, Ostreococcus tauri
  misc_feature (622)..(622): Xaa can be any naturally occurring amino acid
MVGGRGRWVGLGAAAPEADGSSREVDANAMGGRDEVREVREDVSDAEVKEMRYALATEEKEREEREAQAKALAEQAVLATEAYEKDEELAQSAMNSAQEKQAAVLEAVTKSDAWATRLAEVTAFVEAERAGARARGENEEEVLNSATCTIGPEMSWCDEDSTSLADALVRARASFETAEQTRKELEIELENAETFAKEAADAAKRSKELARIAHESADKAMEKVTAKMEAVVALNEKLKTMEIKIGEQQAETLIVPQEGDAVAAIVLSPEALLKKKQDLKNEVKQDLAEKRAAKDEDSDDEGSSESAKKSNQFASAGYFSAPKVTGDVDASLLKKIVTAIMLFSAATLMLPTSPMKAIRTQIYTSIVSVRDTVGASINVVQKGATSAYERIIPEDERKTIAHATEEAEETGMTDVLWLLFASVFAVTIVSKIPGGSPVLRFLLGGAIIGPFGLRMIHHVSSVKVLAEFGVVFLLFNIGLELSYERLVSMAKFIFGLGSAQMFLTTAVGAAVAVACGLAVPAAVIVGLGLAFSSTAVALQVLADRGESASRHGRATFSVLLFQDLMVVLVFMLVPLLAGPDSGSFTALATSLAKAVLKTIVGIVGIIGIGRIVLRPVFNRVAX

SEQ ID NO: 34155 - protein, 915 aa, Chlorobium tepidum TLS
MPNSHANEESAAAKKYIYSFAGGAAEGDASMKNLLGGKGANLAEMANIGLPVPPGFTLSTEVCAYYYDHQKTYPANLFETEIPAALKKVEDYLGKKFGDPENPLLVSVRSGARASMPGMMDTILNLGLNDKTVEGLARKSGNPRFAWDCYRRFVSMYGDVVLDLKPADKKQIDPFEEILEQKKQELGIHLDTELGVDDLKDLVGKYKKAILEKTGKTFPENPEEQLRGAISAVFNSWNNERAIVYRKLNHIPGWWGTACNVQAMVFGNMGEDCGTGVAFTRDAATGDNIFYGEFLMNAQGEDVVAGTRTPLKIEQLAQEKPAIYNQLEEIRSILEKHYRDMMDIEFTIENDKLFMLQCRVGKRTGLAAIKIAVDMYNEGLIDEKEVLRRIEPEQLNQLLRPVFDLKEKKAAIDSGRLLATGLNAGPGAATGRVYFNADDAMEANARGEKVILVRIETSPEDIKGMNAAEGILTERGGMTSHAALVARQMGKVCVAGCGTLRIDYKAGEMRVAGKDIVIKEGEYISIDGTTGEVIAGEVKTKNSEILEVLIDKTLDPADAPTFRIYNQLMQWADKYRKLNIRTNADQPDQAEIAITFGAEGIGLCRTEHMFFGGDRIDAMREMILADDIAGRKVALDKLLPYQRDDFYGLFKAMGSRPVTVRLLDPPLHEFLPHTDAEIDDLAGKIGKTSAEIKARIESLHEFNPMLGLRGCRLGILHPEIIVMQVRAIIEAACRIKQEGQEIVPEIMVPLVSTVKELEITSEVIHKTARSVISEQGVGVKYLVGTMIEVPRAAITSDQIAQAADFFSYGTNDLTQMGLGMSRDDSGQFLPIYQQQEIFARNPFESIDIDGVGRLVSISAKEGRSVKPDLKLGICGEHGGDPATVEFCHKTGLNYVSCSPFRVPIARLAAARAALL

SEQ ID NO: 34156 - protein, 166 aa, Oryza sativa Indica Group
MKEGGGGGGERRNILAKTIDRCRSSLGHRTTRRPASAAAGGGYGGAAVPAGFFAVLVGPEKERFAVRARCANHPLFRALLDQAETEYGFAGCEGPLELPCDVDAFMDVMWEMEQADPAASPRCGARFGGPAAAGSGRGYGGHGHHHQHQGYQMMSTPARLLVAGRS

SEQ ID NO: 34157 - protein, 248 aa, Synechococcus sp. CC9605
MGKQGVRRPVIAGNWKMHMTCAQSREFMEAFLPLIADTPDDRDLVLAPPFTALSTMAELSRNSRVCLSSQNVHWEGQGAFTGEISPAMLKEHGVTHTIVGHSEPRKYFSESDEQINHRARSSQSNGLIPIVCVGESDEQRERGEAERVIRRQIEQGLEGLDAEKLVVAYEPIWAIGTGKTCAAEEANRICGLIRSWVGSPDLVIQYGGSVKPSNIDELMGMSDIDGVLVGGASLEPESFGRIANYQAA

SEQ ID NO: 34158 - protein, 302 aa, Actinidia chinensis
MEAFEKLEKVGEGTYGKVYRAREKATGKIVALKKTRLHEDDEGVPPTTLREISLLRMLSRDPHVVRLIDVKQGQNKEGKTVLYLVFEYMDTDLKKFIRPFRQTGENLPTKTVKSLMYQLCKGVAFCHGHGVLHRDLKPHNLLMDRKTMMLKIADLGLARAYTLPIKKYTHEILTLWYRAPEVLLGATHYSTAVDMWSVGCIFAELITKQALFPGDSELQQLLHIFRLLGTPNEQVWPGVSKLMNWHEYPQWSPQKLSSSVPNLDEDGLDLLLKMLQYEPSKRISAKKAMEHPYFDDLDKAYL

SEQ ID NO: 34159 - protein, 209 aa, Dehalococcoides ethenogenes 195
MKSTKALILATLFPVTLFASGCNGGDAAPEVTPMSWDAAPAMQIDPAKQYFATVETTLGSFKIELFASESPVTVNNFVFLAKENYYNGVIFHRIMKAFMIQTGDQTGTGRGGPGYRFADELPVKHSYDPGIVAMANAGPNTNGSQFFICTGAQAKNLDYQPNYTQFGRVIEGMDVITKLASVPVVANSYGEVSTPSNPPKIIKITITEG

SEQ ID NO: 34160 - protein, 319 aa, Oryza sativa Indica Group
MAFMSMERSTWAFTFGILGNLISLMVFLSPLPTFYRVYRKKSTEGFQSTPYVVTLFSCMLWMYYAFVKSGAELLVTINGVGCVIETVYLAMYLAYAPKSARMLTAKMLLGLNIGLFGVIALVTLLLSRGELRVHVLGWICVAVSLSVFAAPLSIIRLVIRTKSVEFMPFSLSFFLVLSAVIWFLYGLLKKDVFVALPNVLGFVFGVAQMALYMAYRSKKPLVASSSSAAVAAGLETKLPEHVKEVQAVAKGAVAAAPEGRISCGAEVHPIDDVMPSEVVEVKVDDEETNRTDEMAGDGDHAMVRTEQIIKPDMAIVVEV

SEQ ID NO: 34161 - protein, 359 aa, Hydrogenophilus thermoluteolus
MSWAHTPTLTQYLIEERRRYPQASGDFNALILDMARACKAIARQVAYGALAKSNHAVTTTINVQGEEQKPLDVISNECFMRLTEWGGYLAAMASEEMDEPYLIPEQYPRGRYLLLFDPLDGSSNIDVNVSVGSIFSVLRAPEGKTEITVDDFLQPGTQQVAAGYAIYGPTTMLVLTVGRGVVGFTLDPDFGEFMLTHPNIRIPESTKEFAINTSNARFWEPPVKRYVDECLKGKTGPRGKDFNMRWVASLVAETHRILSRGGVFLYPRDNKEPKKPGRLRLLYECNPIGMIVEQAGGRASTGYGPVLEVQPTELHQRIGFVFGSREEVERIEQYHNDPDASPVDLPLFAERTLFRDETL

SEQ ID NO: 34162 - protein, 312 aa, Streptoalloteichus hindustanus
MRIFVTGAAGYVGQAVLARLLAAGHDVTAVGHRTPVGWPAGTPSRQADLTDAPAVLRALDGAEAVCHLAGLTRVRGSGVDVDRYYRVNVVGTLNVLDALVARHRAGDGPARLVFLSSGAVYGRTGDAPVREDHPTLPTSAYGATKLAAEQAVGWYAGTGALSAVSLRLFTAAGSVRPGCRPDDSTLVARALSVAAGENAVLPVNGDGSTVRDFVHVADVADAVARAVEAPARRPAEVVNLGAVAASVREVVAAVERVTGRRVPVAHGPANSADQPWLAADTGAARELLGWAPTRSSLERMIEDQWRVGGAGR

SEQ ID NO: 34163 - protein, 294 aa, Hydrogenophilus thermoluteolus
MSAKHPIIAITGSSGAGTSTVMRTFVNIFRREGVKAVLVEGDSFHAYDRAAMRQKMAEEEAKGNRHFSHFGPEANLFGELENLFKTYSETGRGRIRHYVHNEEEAKQYGVAPGCFTDWEEIPEDTDLLFYEGLHGAVVTPEHNIAQYPDLLIGVVPVINLEWIQKLWRDRKERGYSTEAVTDTILRRMPDYVHYIVPQFGRTHVNFQRVPVVDTSNPFIARDIPTADESLVIIRFANPKGIDFPYLLNMINGSFMSRANTIVVPGGKMELAMQLIFTPFVWRFMERRKRALGIA

SEQ ID NO: 34164 - protein, 292 aa, Leuconostoc mesenteroides subsp. mesenteroides ATCC 8293
MDYKTLASGIEMPLLGFGVFQVQEKGAAKQAVLDAIKTGYRLIDTAASYGNEREVGEAILEAINQGIVKREELFVTSKMWVQDVSAQQATAAIQSSLQRLNLDYLDLYLIHQPYNDVFGAWRAMESAYRSGQLKAIGVSNFDIAQLTNLAEFSDIKPMLNQIEVNPFQQNKKDITYFSQYGVQVEAWAPFAEGKNDLFSNILLRKIADKHHKSIAQIVLRWLTQRNIIVVAKSVKPERMAQNLDIFDFKLTHQELAEIETLDTNSSQFFNHADPDMIKWMANREISYDVTFN

SEQ ID NO: 34165 - protein, 401 aa, Brassica napus
MDYMNGPGRHHLFVPGPVNIPEQVIRAMNRNNEDYRSPAIPALTKTLLEDVKKIFKTTSGTPFMFPTTGTGAWESALTNTLSPGDRIVSFLIGQFSLLWIDQQKRLNFNVDVVESDWGQGANLQVLASKLSQDQNHSIKAICIVHNETATGVTNDISAVRTLLDHYKHPALLLVDGVSSICALDFRMDEWGVDVALTGSQKALSLPTGLGIVCASPKALEATKTSKSLKVFFDWNDYLKFYKLGTYWPYTPSIQLLYGLRAALDLIFEEGLDNVIARHARLGKATRLAVEAWGLKNCTQKEEWISNTVTAVMVPPNIDSTEIVKRAWKRYNLSLGLGLNKVAGKVFRIGHLGHLNELQLLGCLAGVEMILKDVGYPVVLGSGVAAASTYLQHQIPLIPSRI

SEQ ID NO: 34166 - protein, 764 aa, Arabidopsis thaliana
MRGNKNYYFLSLLYFLSLPILHFSSCTHKCGDIQIPFPFGIGEIGCYLDEWYQVECRPSATSGKVFPFLPKINMEVVNISLPGTNDDIFYTYPSFSSIRVKSPVASMGCSTDGNDSGLTLNFTETPFFFGDQNNLVAVGCNNKASLTNVEPTMVGCESTCTTSNNSRSIPFFNKVGCSGSVDSVTRDLLPKNYIPVCSTTKIQDDTLICNGEGCCQAKAPVGSQQLIGVTITNSTNGNLTKGGGCKVAFLTDEVYTLSNATDPEQFFSKGVTVSLGWFIQTKNHSFLQSLDCQNRGELDKGKKRTRQCTCDNHIASGMGYASCACASGYKGNPYVSDDCQDINECTEYKNPCGDTRILYRNTCINTSGGHRCIDYHIPEVMLGLGAGFFVLIVGGGIWWWRKLLRKRRMTNRKRKFFKRNGGLLLQQQLNTTQGRVEKTKLFSSRELEKATDNFNDNRVIGQGGQGTVYKGMLVDGRSVAVKKSNVVDEDKLQEFINEVIILSQINHRHVVKLLGCCLETEVPILVYEFIPNGNLFQHLHEEFDDYTALWGVRMRIAVDISGAFSYLHTAACSPIYHRDIKSTNILLDEKYRAKVSDFGTSRSVSIDHTHWTTVISGTVGYVDPEYYGSSHFTEKSDVYSFGVVLVELITGEKPVITLSETQEITGLADYFRLAMRENRLFEIIDARIRNDCKLEQVIAVANLALRCLKKTGKTRPDMREVSTALERICSAPEDFQVQIQIDEEDETTKLFRGYSGSTEIARSM

SEQ ID NO: 34167 - protein, 380 aa, Picea sitchensis
MSKTHSPQTITCKAAVAWGPGEPLSIEEVELAPPQPMEVRIKVISTSLCRSDITFWESRGHIPIFPRIFGHEATGIIESVGEGVTDLHEGDHILTVFTGECKKCRHCKSDKSNMCETLRMERKGLMQSDQKTRFSINGKPIYHFCAVSSFSEYTVLHSGCAIKLSPNVPLGKISVLGCGVAAGLGAAWKVADVGKGSTVVIFGLGTVGLAVAQGAKLRGASRIIGVDINPDKFEMGKVFGITEFINPNDYKQPTQEVIKDITAGGTDYSFECVGDVGVIRTALESCCDGWGMAVIIGVPSGQMELSAHYGPLLSGRTLKGTLLGGWKPKSELPMLIDMYMKKEIQIDEYVTHELPFSDINKAYQLMREGKCLRCVIHVGN

SEQ ID NO: 34168 - protein, 522 aa, Clitoria ternatea
FLLREIGVSILIFMITHLVIRLVLKEKEQRKLPPGPKGWPIVGALPLMGSMPHVTLSEMAKKYGPVMYLKMGTNNMAVASTPSAARAFLKTLDLNFSNRPPNAGATHLAYDAQDMVFADYGSRWKLLRKLSNLHMLGGKALEEWSQVREIEMGHMLRAMYDCSGGGDGNNDNDGNKKKGTRHEPIVVAEMLTYAMANMIGQVILSRRVFETKGSESNEFKDMVVQLMTVAGYFNIGDFIPFLARFDLQGIERGMKTLHNKFDVLLTTMIHEHVASAHKRKGKPDFLDVLMAHHTNESHELSLTNIKALLLNLFTAGTDTSSSIIEWALAEMLINPKIMKKVHEEMDKVIGKDRRLKESDIENLPYLQAICKETYRKHPSTPLNLPRISSQACQVNGYYIPKNTRLSVNIWAIGRDPNVWENPLEFNPERFMGANKTIDPRGNDFELIPFGAGRRICAGTRMGIVLVQYILGTLVHSFDWKLPNGVVELNMEETFGLALQKKIPLSALITPRLPPTAYNVINS

SEQ ID NO: 34169 - protein, 404 aa, Burkholderia pseudomallei K96243
MSTTDHSPIPCPVVVPLDAILPEEPLLMMGAGPVPIPAAVAKANTIVINHLGATMAKIIEQVKEMARYVFQTRTKWVLGVAGPGSAAMEMAVSNLAWAGTKVLSIKNGFFSARMAEMAMRVGADVATIDVPDRSVASLDEIADAIARERPEIVTIVHGETSNTVWNRHLKEIAAIAKAAGALVVVDAVCTLSTMPLDMDAWGIDAVITGGQKGLSSIPGVSLIAFSDQAWERMKSRPEPNTHWCLDMALAENFWHNAGYHYTAPVSGVLALHEALRLVCAETLENRYARHLRCSLALQAGITGMGLELYAPEACRLNSVVGIAAPRGLTPGLICGHISKQYQVEISGSFGLPIVRIGQMGEQCREHNLFRTLHAFGRTMVDLKVAVDLPAGVAALEQALSGRAA

SEQ ID NO: 34170 - protein, 172 aa, Synechococcus sp. CC9605
MDLQSHIRSIPDFPKPGILFRDINPLLRSPEAMAEVISQFGRICDQVKPDLIVGIESRGFIFGAPLASDRRLGFVPVRKPGKLPGEVVGLDYALEYGTDRLEIQADALEHSPRVLVVDDLLATGGTAAATGQLVEQAGGCLVGFAFVIELEGFGGRRALPAGQPVEALLRYG

SEQ ID NO: 34171 - protein, 319 aa, Glycine max
  misc_feature (83)..(83): Xaa can be any naturally occurring amino acid
  misc_feature (89)..(89): Xaa can be any naturally occurring amino acid
  misc_feature (143)..(143): Xaa can be any naturally occurring amino acid
LGVQIVKAPDSVGPKPKQTEAAVPDGRDLLLQHGRLYMDAKPTDPEPAIMIASLANLIENDAFVPAHRPHALSEGVTTYLTPXVAGLIXQKELDYLVGAVSNPKRPFAAIVGGSKVSSKIGVIESLLEKVDILLLGGGMIFTXYNAQGLSVGSSLVEEDKLDLATSLLAKAKEKGVSLLLPSDVVIAHKFAPDANSRVVPASAIPDGWMGLDIGPDSVKSFSEALDTTQTIIWNGPMGVFEFDKFAVGTEAIAKKLADLSGKGVTTIIGGGDSVAAVEKVGVASVMSHISTGGGASLELLEGKELPGVLALDEAVPVAV

SEQ ID NO: 34172 - protein, 514 aa, Verbena x hybrida
MTFSELINILFWDLTAAILLYVALILVCSLYSKPSTVSRNLPPGPKGFPVVGALPLLGNMPHIALAKMAKTYGPVMYLKVGTWGMAVASTPDAARAFLKTLDTTFSDRPPNAGATLLAYNAQDMVFAHYGPRWRLLRKLSNLHMLGAKALEDWADVRSSEVGHMLQAMLTSSLRHEAVALPEMLIYSMANMIGQVILSRRVFETKGKEVNEFKDMVVELMTSAGYFNIGDFIPALAWMDLQGIEKGMKSLHKKFDDLIGRMLDKHLESAHKRNAKPDFLDVILANRHNSEGESLTTTNIKALLLNLFTAGTDTSSSTIEWALAEMIKNPTILKTAHNEMDRVIGRDRRLLESDLPKLPYLQAICKEAYRKHPSTPLNLPRISSQPCIVNGYYIPENTRLSVNIWAIGRDPDVWENPLDFNPDRFLSGKNAKIDPRGNNFELIPFGSGRRICAGARMAMVLVEYILGTLVHSFDWELPVGVDEMDMEEAFGLALQKAVPLAAMVSPRLPPHCYAP

SEQ ID NO: 34173 - protein, 311 aa, Methanosarcina acetivorans C2A
MNILVTGGAGFIGSHLIEKLLGEGNEVICLDNFDNYYDPQIKRNNVELFLENENFQLIEGDIRDKVLLEEIVQTVDYVFHEAAQAGIRISVKEPMRPHEINATGTLNLLEATLNSNVKKIINASSSSVYGKVEYLPFDENHPNHPVSPYGVSKLLAEHYCRVFEELYGLKSVSLRYFTVYGPRMRPDLAINIFTKAALKNETVAIFGDGKKTRDFTYIDDIVRANLICMKKGSDVYNIGSGHSITINELASKIIEINESESEIVYTDSMKGDAEHTLSNSKKAWKEIGWKPEVTIEDGLERYAKWISNSQL

SEQ ID NO: 34174 - protein, 199 aa, Oryza sativa Japonica Group
MDLVPRSKANWDTFSNRAFCEICAEECEAGNRPTGCLSTTGYKNLQLKFFQRTGKKHDQKQLKNHWETLKKEYNLWIELKEKSTGLGWDPIKGTFTADDAWWADHIVFSYTRILLNLPSYRMKRQTKIILACMALHNFIRDSVLRDELFGRCDLDEEFDPNTEQASSSQENGINGLAVDDEDMNAFRDRIANSLTATRA

SEQ ID NO: 34175 - protein, 516 aa, Verbena x hybrida
MTTFSELINILFWDLTAAILLYVALNILVRSLYSKPSTVRRNLPPGPKGFPVVGALPLLGNMPHIALAKMARTYGPVIYLKVGTWGMVVASTPDAAKAFLKTLDTTFSNRPPNAGATLLAYNAQDMVFAHYGPRWRLLRKLSNLHMLGGKALEDWADVRSSEVGHMLQAMLSSSLRHEAVALPEMLIYSMANMIGQVILSRRVFETKGKEVNEFKDMVVELMTSAGYFNVGDFIPALAWMDLQGIEKGMKSLHKKFDDLIGRMLDKHLESAHKRNAKPDFLDVILSNHDNSEGERLTTTNIKALLLNLFTAGTDTSSSTIEWALAEMIKNPTILKTAHNEMDRVIGRDRRLLESDLPKLPYLQAICKEAYRKHPSTPLNLPRISSQPCIVNGYYIPENTRLSVNIWAIGRDPDVWENPLDFNPDRFLSEKNVKIDPRGNNFELIPFGAGRRICAGARMAMVLVEYILGTLVHSFDWELPVGVDEMDMKEAFGIALQKAVPLAAMVTPRLPPHCYAP

SEQ ID NO: 34176 - protein, 276 aa, Herbaspirillum seropedicae
MSKNFDVVVIGGGPGGYIAAIRAAQLGFNTACIDEWKNEKGGPAPGGTCTNVGCIPSKALLQSSEHYEHASHGFAEHGIEVKGLGLNLEKMLGRKNTVVKQNNDGILYLFKKNKVSFFHGRGSFVKGDANGYEIKVAGAAEETITAKHVIVATGSNARALPGAEFDEKLILSNTGALSITEVPKKLGVIGAGVIGLEMGSVWRRLGAEVTVLEALADLPGCSGRADRQGSPEAADQARPGREPGCEDRRHQGWARTAFPSNTPMPRATPTPANSTS

SEQ ID NO: 34177 - protein, 390 aa, Thermoplasma volcanium GSS1
MNCRMKQSTIGRNIVDEISFGAIVKIRDQLLEMQRQGKKVYRLESGDPSFSLPPHVKEAIKQAIENNKTHYTDSTGIPELRKAIAEKLVRKNKIKDATPENVIVSNGGMNALYVTFRSLLSPGDEVIIPDPMWTEIAEIIKLAEGVPIRLPVENYIEEMQKYEDDDKVKAVFVNSPHNPTGLVFTPKQIDGIISFAESKGIFIVSDEAYEDVIFDGREHVSPGSKYDNTISLFSMSKTYAMSGLRIGYAHTNSEILYDRMKKLLRCTINGVNSATQYGAVAALTGPQEFVGQMRSEYQKRRDIIFNAVSKSRYLEPVKPGGTFYLWAKIKEYPKEVKDSWDMTYYLLDKTGVGSSPGPVFGPAGDGYIRFAFSADTEHVREASELIEKFE

SEQ ID NO: 34178 - protein, 373 aa, Oryza sativa
MASSISVMASAGRNRGVGSAKLQGEDFEYFMQTYSIIILGRDSKREKVDLDISGGDLTISRHHAHIFYDFECKRFSLLVLGKCGCTVEGVLHLPGGSPIKLDSQDLLQIGHKKFYFLLPTRSIFGTSSNQHGPSASAAFQPANNGTAADEHNLTASAAAQPAHIGTAAPPPHIGTAQPGQIGIVTLPPAHIQNNAENENIAGIETQEEFMNQNKMPFGELDTCSSHHITIEPTLAPGGQPVNNLAIRPADNNKDQQEVLLKEEEYVLASIGIVISDLCGLKKMIPIEKLHSELVACYSATWPQRQVQMHLAPEAGSSAAGTECKPWLKLMYLLRKYPERFTVMNSSCDEEGRQHRCVCTLYGDGTVCVFLKRT

SEQ ID NO: 34179 - protein, 361 aa, Dehalococcoides ethenogenes 195
MKAIILVGGQGTRLRPLSINTPKSMVPVLNVPFLSHVLRYLSSCGIKDIILTQGHLAAPIEQYFGNGQSLGVNLVYSVEHEALGTAGAIKNAERYLDDTFITLNGDIFTHLDLSAMLRAHRDKKALVSIALTPVDDPTKYGLVETADGGRVSRFLEKPSPAQITTNMINAGTYIIEPEVLKYIPAGENHSFERQLFPRLLNECQAVYAYPSSAYWIDIGSPEKYSQLNRDLLCGEGGDFGFSRGNEIVIGRGCQLHPTARISGPVLVGENCIIGANACIAGPVVIGAECRIEDEATLTESVIWQNVTIGAECKVVSSIIANHCHLKAGGKYENVVLGDNVTAECGCAPEPGSKISPGILMI

SEQ ID NO: 34180 - protein, 407 aa, Vibrio cholerae O1 biovar eltor str. N16961
MQDTLAVILAGGMGSRLSPLTDDRAKPAVPFGGKYRIIDFTLTNCLHSGLRRILVLTQYKSHSLHKHLRNGWSIFNPELGEFITVVPPQMRKGGKWYEGTADALFHNMWLLARSDAKYVVVLSGDHIYRMDYAAMLEEHISKNATLTIACMQVPRHEASAFGVMAIDDDSRITCFVEKPADPPCIPNRPDHSLASMGIYIFNMDVLKKALTEDAEIEQSSHDFGKDVIPKLIATGSVFAYSFCSGKGRVARDCYWRDVGTIDSFYDANMDLLQPVPPMNLYQKNWAIRTYEQQYPPARTVSSATGNEGIFINSIIANGVINSGGSVQHSIISSNVRINDSALIVDSILFDDVEVGEGCKLIHCIIDKHVKIPPYTEIGLNPIEDRKRFHISERGVVVVPESYQFSTE

SEQ ID NO: 34181 - protein, 144 aa, Zea mays
  misc_feature (66)..(66): Xaa can be any naturally occurring amino acid
  misc_feature (97)..(97): Xaa can be any naturally occurring amino acid
  misc_feature (119)..(119): Xaa can be any naturally occurring amino acid
MPPPTDEKPPHAPAPEAGNYYADRVPVVMGETVPDHCFCDAPRESWDSEILCCLARHDELCSIYGXPRLLGTGEPWVLYGTHGERVAAGQGTFANRXVAHAVLQWRENSRYERNCLEPXCSPPAHTASPRRYNLEGICDDVTSQ

SEQ ID NO: 34182 - protein, 146 aa, Mesembryanthemum crystallinum
SVWRAINKQTGEVVAIKKMKKKYYSWEECINLREVKSLRKMSHPNIVKLKEVIREHDILHFVFEYMECNLYQLMKDRGRPFSEVEVRNWCFQVFQGLAYMHQRGYFHRDLKPENLLVSKDLIKVADFGLAREISSAPPYTEYVSTR

SEQ ID NO: 34183 - protein, 297 aa, Herbaspirillum seropedicae
MMIKKIKKAVFPVAGLGSRFLPATKAQPKEMLPIVDKPLIHYAVEEAVAAGITEMVFITGRNKRAIEDHFDKAYELESELEAAGKKKLLEIVQNVVPKSVNCIFIRQSVPLGLGHAVLCARPVVGEEPFAVLLADDFMDTDAGVKPVLAQMTEIYEREGMSMLAVQEVPQSDTKQYGIVSATPYQPNLERVNAIVEKPAPEEAPSTLAVVGRYVLNNRIFDYLENIGRGAGGEIQLTDGIAKLMQAESVLAYRYQGQRYDCGSKLGYLKATVAMGMKHPETGAAFSEFLKDVAGKQA

SEQ ID NO: 34184 - protein, 167 aa, Buchnera aphidicola str. APS (Acyrthosiphon pisum)
MANIEKKNHNDLQEKLITVNRVSKTVKGGRIFSFTALTVVGNGDGKVGFGYGKAREVPAAIQKAMEQARRNMITIPLVNKTLQHSLKGSHTGSNVFMKPASDGTGIIAGGAMRAVLEVAGIHNVLAKTYGSTNPINVVRATMNGLVNMKSPEMIAAKRNKRIKDILG

SEQ ID NO: 34185 - protein, 450 aa, Mycobacterium sp. MCS
MDKNDTSKISLIGSVALGTGVMIGAGIFALVGQVAELAGSAVPWAFVAGAVVAAVSAYSYVRCASANPSSGGIAMILKAAYGPGVVAGTFSLFMYVSMVLAESLLARTFGTYALRPFGLQGSAILVPVLAVLAIVIATSVNLVGNRWVESSATVTAIVKITGIAVLAIAGIYATGLSSLSQVFETGAEATPPRSGILGFLAGVTLCILAYKGFTTITNQGDDIRDPRRNIGRAIVISLVVCAVVYLLLTIAVTGSLSVAEIVDARDYALAEAAEPLFGSWGVRLTVAVAVVATMSGLIASLYSVSRLYDMLRHMHQVPDVPGSVHRPSLLITAAAAIVTAALFDLSRIASLGAMLYLSMDIAIHWGLLRRLRHDVDFKVWVPLLAIALDVVVLVPFVILTARNSLPTLVIFGVVSAVIVLGQQAAVRHRNRSSAAPAAPNDGTDENQDRS

SEQ ID NO: 34186 - protein, 71 aa, Glycine max
MIIPVRCFTCGKVIGNKWDTYLDLLQADYSEGDALDALGLVRYCCRRMLMTHVDLIEKLLNYNTLDKSDPN

SEQ ID NO: 34187 - protein, 330 aa, Arabidopsis thaliana
  misc_feature (244)..(244): Xaa can be any naturally occurring amino acid
MVEPYETRNNGEASQMIRYQSYNHHNSRLPSSLSSPLLDLRVFYVRISNFKVDHSTPEVLTITHIPLDPDSLLEINGVRMSMYSEGVSSQLRRDRVDKKSEVATFISTDNIRLSGSVKFEVYDKDELVLSGTLEMSGSNGFTGESKHSVKRWNMNCEAEITAESGFLKEKHIGGSELSSPLPTIEVYVTGCFSGTPIILTKTLQLGFRKKHGRVTALDSIPEYETDEPHKGNSSELDYQSVLRXLLVGISWFSHVTEYGSYKQEYEGEHSDMYWNREYADGEDGEMSWFNAGVRVGVGIGLGVCVGLGIGVGLLVRTYQSTTRNFRRRII

SEQ ID NO: 34188 - protein, 430 aa, Gibberella zeae PH-1
MGQTLSEPVVEKTSEKGEDERLIYGVSAMQGWRISMEDAHTTVLDLDTAKTHDSKLSFFGVFDGHGGDKVALFTGQNIHNIIFKQDTFKSGDYAQGLKDGFLATDRAILNDPKYEEEVSGCTACVSLIAGNKLYVANAGDSRGVLGIKGRAKPLSQDHKPQLENEKNRITAAGGFVDFGRVNGNLALSRAIGDFEFKKSAELSPENQIVTAYPDVEQHDLTDEDEFLVLACDGIWDCQSSQAVVEFVRRGIAAKQELEKICENMMDNCLASNSETGGVGCDNMTMCIIGFLNGKSKDEWYEEIARRVANGDGPCAPPEYAEFRGPGVHHNFEDSDSGYEMDPENKGRSFGVGGYRGRIIFLGDGTEVLTDSDDTEMFDNADEDKDLASQVSKNPTSAEKDTAPVAAPGAAENASADTKPADSAKTEVKKE

SEQ ID NO: 34189 - protein, 163 aa, Zea mays
  misc_feature (3)..(3): Xaa can be any naturally occurring amino acid
MAXRDKKEEPTELRAPEITLCANNCGFPGNPATQNLCQSCFSASRSPSSPTSSSSSLASAASQPRPAALVVDAAAVEALAAPAAVAAAAGQATEAAARASASRCSSCRKRVGLTGFRCRCGELFCGAHRYSDRHGCSYDYKGAARDAIARENPVVRAAKVVRF

SEQ ID NO: 34190 - protein, 316 aa, Arabidopsis thaliana
MVGGVEELSIEQLASSISTYKEQLEQNFVCGLEFRIGEEKLNVRQLLSEDPRNSEYADMEKELKEVIALTEEVLATAKQNEISLSDAGVSAEATPGSPDLEGAWEKTGLRNDPIHEGKFPVGTKVQAVFSDDGEWYDATIEAHTANGYFVAYDEWGNKEEVDPDNVRPIEQNAIVEAERLAQATKNALKRKIEKAASSDYQTKTLPAKLKIDPNDPEDVKIAKRKKIHAFKSKARFEQLEVVQNKKQNDWQQFQTTKAKTKKVGFFTGRKKESIFKSPEDPFGKVGVTGSGKGLTDFQKREKHLHLKSGNAEGTDE

SEQ ID NO: 34191 - protein, 372 aa, Pseudomonas sp.
MIKSRAAVAFAPNQPLQIVEVDVAPPKAGEVLVRVVATGVCHTDAYTLSGADSEGVFPCILGHEGGGIVEAVGEGVTSLAVGDHVIPLYTAECRECKFFKSGKTNLCQKVRATQGKGLMPDGTSRFSYNGQPIYHYMGCSTFSEYTVLPEISLAKIPKNAPLEKVCLLGCGVTTGIGAVLNTAKVEEGATVAIFGLGGIGLAAIIGAKMAKASRIIAIDINPSKFDVARELGATDFVNPNDHAKPIQDVIVEMTDGGVDYSFECIGNVRLMRAALECCHKGWGESVIIGVAPAGAEINTRPFHLVTGRVWRGSAFGGVKGRTELPSYVEKAQQGEIPLDTFITHTMGLDDINTAFDLMDEGKSIRSVVQLSR

SEQ ID NO: 34192 - protein, 268 aa, Pseudomonas fluorescens Pf-5
MLRSNAHSRFIALVNFILRWDKAHTKSAALYTGVTETETTPLAASTLGIAPIGNPMQLKNPILGLCQQATFMLSAAKVDQCPDDEGFEVAFAGRSNAGKSSALNTLTHASLARTSKTPGRTQLLNFFKLDDDRRLVDLPGYGYAKVPIPLKQHWQRHLEAYLGSRESLKGLILMMDIRHPMTDFDLLMLDWAVASGMPMHILLTKADKLTYGAAKNTLLKVQSQIRKGWGEAVTIQLFSAPKRMGLEEAYTVLAGWMELADKGAEAEA

SEQ ID NO: 34193 - protein, 367 aa, Polaromonas sp. JS666
MTTVISPVEDIVADMRAGRMVILIDEEDRENEGDLVLAADHVSAEAINFMARFGRGLICLTLTRERCELLQLPPMATRNGTKHSTAFTVSIEAAEGVTTGISAADRARTVQAAVAKDAKVSDLVQPGHIFPLQAVDGGVLMRAGHTEAGCDLASMAGCSPAAVICEIMKDDGTMARLPDLLLFAAEHGLKIGTIADLIEHRSRNESLIEKIGSRTLQTAFGEFTVHAFKDKPSQGLHLALVRGQWSADDTVAARVHEPLSVLDALEVQRSMHSWSLDQSLNHIAREGKGVAVLLNCGESAAQLLAQFEGTARASQAPERGRMDLRTYGVGAQILRECGVHKMNLLGNPRRMPSMTGYGLEIVGYITQ

SEQ ID NO: 34194 - protein, 465 aa, Verbena x hybrida
MAALSRVYGPLMHLKMGFVHVVVAASAGAAEQFLKVNDANFSNRPPNAGAKYVAYNYQDLVFAPYGPRWRLLRKICALHLFSAKALEDFRTVRQEEVGILTRALASAGQTPASLGQMLNVCATNAIARVMLGRRVVGHSSGGGDEKAEEFKEMVVELMKLAGVFNIGDFIPPLERFDLQGVTANMKKLHKRFDAFLGAIVEDHKINSLGRSGEPHVDLLSTLISLKDEDDGEEGKINDTEIKALLLNLFSAGTDTTSSTVEWAIAELMRHPKILAQAQQELDSVVGQNRVVSESDLTQLPFLQAIVKETFRLHPSTPLSLPRIAEKSCEINGYFIPKGSTLLVNVWAIARDPNVWADPLEFRPERFMPGGEKPNVDVKGNDFELIPFGAGRRICAGMSLGIRMVQLLTANLIHGFDFELGNGLSAQQLSMEEAYGLTLQRAEPLVVHPKPRLAPHVYQSSVASVG

SEQ ID NO: 34195 - protein, 154 aa, Polaromonas sp. JS666
MFGAEKGSTDKLDGRKFSIGIVQARFNESVTNALAEACKQELAALGVEEKNIKHVKVPGALEVPCALQAMAESDKYDALIALGCIIRGETYHFELVANESGSAVTRLALDYQLPIANAILTTENLAQAEARQIEKGRDAARVAVEMANLLDELA

SEQ ID NO: 34196 - protein, 325 aa, Campylobacter coli RM2228
MIKSIPEWSEQEYLMLSLPHEKSDWKPYLGEIIQAYKDFVKAASEFQKVLLIAPSKSDFAPFENIANVEFFVCDTNDTWIRDFGAIDILEDNRLKALDFTFNAWGNKFQSELDNEVNSKLFKEKFNEKLTKIDFILEGGSIDFNGEGVMLTSSNCLLNENRNSHLDKSQIEAKLKEIFGLKQIIWLENGFIKGDDTDHHIDTLARFIDKNTIAHSICEDEKDEHYIPLQKMKKELEATGFNLVELPLPKPLYYEERRLGATYANFVFVNDALIMPFYKDENDEIIRQRLAKALPKRKIIGVDARVFLRQNGSLHCSCQNRFKGLR

SEQ ID NO: 34197 - protein, 385 aa, Picea sitchensis
MAARGVRSLLRTVSKHGPKPLISGGFTGADSALSTFGRCAGVKRQLGSVAHGETIRATLFPGDGIGPEIADSVKQVFKAASVPIEWEEHFVGKEIDPRTGSFLTWESLESVRRNGIGLKGPMATPIGKGHRSLNLTLRKELGLYANVRPCYSLPGYKTRYDDVNLVTIRENTEGEYSGLEHQVVRGVVESLKIITRQASLRVAEYAFYYAKTHARQRVSSIHKANIMKKTDGLFLQCCREVAEKYPEIQYEEVIIDNCCMMLVKNPTLFDVLVMPNLYGDIISDLCAGLVGGLGLTPSLNIGENGLALAEAVHGSAPDIAGKNLANPTALLLSAVAMLQHLGLQEKADQIHNAILKTIEEGEYRTRDLGGQASTAEYTNAVCEHL

SEQ ID NO: 34198 - protein, 398 aa, Polaromonas sp. JS666
MKIAQRAQRIEPFYVMEVAKAASALAQEFAGSGKPMIFLNIGEPDFTAPPLVQEAAARAIAQGTTQYTQATGLPALRERISGWYASRFGVQVAPSRIIVTAGASAALQLACLALIEAGDEILMPDPSYPCNRHFVSAAEGNAVLIPTTAEERFQLTREKVQAAWNDKTRGVLLASPSNPTGTSIAPEELQRIHEFVHGQGGVTLIDEIYLGLSYEEHFGHSALAMPGELGQSVISINSFSKYFNMTGWRLGWLVVPEALAPVVERIAQNLFICASTVAQYAALACFEPDSLQEYERRRAEFKARRDYFIPELNRLGLRVPVMPDGAFYAYADCTETAARLGVSGSWDLAFELMKRAHLAVTPGRDFGQAAPEKFVRFSTANSMEQLREAVARLRTLLA

SEQ ID NO: 34199 - protein, 192 aa, Brassica napus
MKLKWESISTLHQNVFLVKVLAAVFITGLAFRFYAVRFGQVSVNEISDPQISPPSVIISENEDLLPIDIEVEKCDLFTGKWIRDPLGPIYTNGSCGVVVDSHQNCITNGRPDSGFLYWKWKPNDCSLPRFDALRFLQLMRNKSWAFIGDSISRNHVESLLCMLSTVEKPVEVYHDEEYRSKRWLFPLHNLTI

SEQ ID NO: 34200 - protein, 340 aa, Synechococcus sp. CC9605
MRIGINGFGRIGRLVFRALWSRPGIELVHVNDPAGDAATAAHLLEFDSVHGRWDRGITSSADWFSVEGSALTWSSEKDPTAVPWIDRGVEMVLEASGKIKTPETLNPYFEQVGLKRVVVACPVKGVVAGEDALNIVYGINHHLYEPARHKLVTAASCTTNCLAPVVKVVHESFGIEHGLITTIHDITNTQVPIDSFKTDLRRARSGLTSLIPTTTGSAKAIAMIFPELKGKLNGHAVRVPLLNGSLTDAVFELKQSVTVEQVNAAFHAAAGGPLKGILGYEERPLVSCDYTNDNRSSIVDALSTMVVDGNQLKVFAWYDNEWGYSCRMADLTCHVVGLEA

SEQ ID NO: 34201 - protein, 336 aa, Ostreococcus tauri
MSFPPRTLTGAISYCIALGVSYAAFTAVVERYRAAQFTFYAPQTRVMSTTKWTRAIAPGITMPMLAFGTYRLRGETCRDAVRDALRCGFQHVDTASVYGNERDVGEALRACHREVSERIFVTSKIAPSEMRSEEEAAAAIAGVNERLGRTPDLVLVHWPGRDKESPDSERHRDARRWTWRALENALKMGQCRAIGVSNYELSHLRELLQFCDVKPAVNQIELHARFPQTELRAFCESVGVHVVGYSPLGVGALLDDDRVKAYAATIGLRPAPALVRWTLSMGASVVVKSSAAERTEENFTAISDLDDDFVHEAAEKLETAFASERVKFCWNPSSVR

SEQ ID NO: 34202 - protein, 157 aa, Triticum aestivum
  misc_feature (40)..(40): Xaa can be any naturally occurring amino acid
  misc_feature (63)..(63): Xaa can be any naturally occurring amino acid
  misc_feature (124)..(124): Xaa can be any naturally occurring amino acid
  misc_feature (148)..(148): Xaa can be any naturally occurring amino acid
MVAQGRPAAQSREGPILCVNNCGFFGSAATMNMCSKCHKXMAMKQEQAKLAASSFDSIVNGGXAHVEAKTLITAQPADIAGPSEAAMENPKGPSRCSTCRKRVGLTGFNCRCGNLYCATHRYSXDKHECKFDYRAAAMDAIAKANPVXVKAEKLDKI

SEQ ID NO: 34203 - protein, 328 aa, Petunia integrifolia subsp. inflata
MAVNGVSSGGLIVSFGEMLIDFVPTVSGVSLAEAPGFLKAPGGAPANVAIAVTRLGGNSAFVGKLGDDEFGHMLAGILKENGVKAEGINFDTGARTALAFVTLRADGEREFMFYRNPSADMLLTPDELNLDVIRSAKIFHYGSISLIVEPCRSAHLKAMEVAKEAGALLSYDPNLRLPLWPSAEEARKQIKSIWDKADVIKVSDNELEFLTGSDKIDDESAMSLWHPNLKLLLVTLGEKGCRYYTKNFHGGVEGFHVKTVDTTGAGDSFVGALLTKIVDDQSILEDEARLKEVLTFACACGAITTTKKGAIPALPTESEALTLLKRGA

SEQ ID NO: 34204 - protein, 606 aa, Yarrowia lipolytica CLIB122
MGDSDQHEHGHVSPELATAHSPPLTSALQPTSSTSSIEEGPAAASNEEKTESDKRAPLNVPPVADTPPQTSPETTHNKCPPPPASQTPPKSPPKDDTSDVKGTDSASGANGDTDDNTENTNNTNNTTNTTNTNHTNHTNTNTNDKTDVTSGNAHEIPSNTSGKTSPAANTPTTTTTPTATNPIHIPGLTNTKPVSLSGTSSPVAHNTYTAASTVNMGKSGHASDAGSAQETGSTSGATTGSVAIATCGGREINPHVLYVAGVDASVKESILLDLFKVTGPIKSIKIFPDRQKANINFAFIEYEDKEAAQLAMQTLNNRQIHGQEISVSFAFQTKVERDYNLFVGDLGADVNDEMLHKHFAHIPGLLDARVMWDMTTGRSRGYGFVSFETKQGAERGLIENGSVLGSRVIRANWASSRRSNMQGQSGPQGGRNMGGHMGGHMGGGMGGGMGGMGGMGGMGGMGGMGGMGGMGGFNNGMGNFGPYGNQGMGGHNHGPGNHNMMNNRNYRDRSDRSDRSDRSDRNDRDRGGDKMGLPKTVYIGNLPNMHPSELIPLLQNFGYVVEFKHHSNYAFVSYDSHKRAQIAMMQLNGYNIHGRTLKCGWGRDRR

SEQ ID NO: 34205 - protein, 282 aa, Picea sitchensis
MTKAERRESEQQGFAPKDYTDPPPAALIETSEFKLWSFYRALIAEFVATLLFLYITIATVIGHSRTSTNCGSVGVLGIAWSFGGMIFVLVYCTAGISGGHINPAVTFGLFLARKVSLPRAILYMIAQCLGAICGTGLVKAFQKSFYDRYGGGANYVHHGYTKGVGLAAEIIGTFVLVYTVFSATDPKRSARDSHVPVLAPLPIGFAVFMVHLATIPITGTGINPARSFGAAVIYGHKQSWDDHWIFWVGPFAGAALAAAYHQYILRAAAIKALGSFRSNANV

SEQ ID NO: 34206 - protein, 494 aa, Verbena x hybrida
MSIESLPLFLVLFSILCTVITLILTTNYSRKSSKLPPGPFQYPIIGNIFELGSQPHRSLAKLSQKYGPVMSLKLGSITSIIISSPETAKSVLQKHDSVFSSRTVPASLQSVHHHKFSMGWLPDDNQWRKLRKISKEQMFSVQSLNASQELRMEKLQKLGDYVQECSETGRVVDIGDAAFTTSLNLMSGTLFSAEFAQFDSDSSQEMKDVFWGVMKCIGTPNFADYFPVLRVADPQGILREIKFYFQKLFDIFDDIIDGKLKSRGEQKSHDLVEALIDINQRDEAELSRKDIKHLLLDLFVAGTDTTSTTVEWAMSELLRNPEKLSRVRDEITDLVGKDGQIQESDISQLPYLQAVVKETFRFHPPAPFLAPHKAKADVEINGYIIPKNAQILVNVWASGRDPNVWPNADSFVPERFLDSNFDQIDFRGNDFELIPFGAGRRICPGLPLAYRMVHLMLVTLVHKFSWKLEKMDMNEKFGLTLQKAVPLRATPTKL

SEQ ID NO: 34207 - protein, 468 aa, Lactobacillus brevis
MAMLYGKHPHETDETLTPIFGATAERHDLPKYKLAKHALEPREADRLVRDQLLDEGNSRLNLATFCQTYMEPEAVELMKDTLEKNAIDKSEYPRTAEIENRCVNIIANLWHAPEAESFTGTSTIGSSEACMLAGLAMKFAWRKRAKANGLDLNAHHPNIVTSAGYQVCWEKFCVYWDIDMHVVPMDDDHMSLNVDHVLDYVDDYTIGIVGIMGITYTGQYDDLARLDAVVERYNRTTKFPVYIHVDAASGGFYTPFIEPELKWDFRLNNVISINASGHKYGLVYPGVGWVIWRDQQYLPKELVFKVSYLGGELPTMAINFSHSASQLIGQYYNFIRFGFDGYREIQEKTHDVARYLAKSLTKLGGFSLINDGHELPLICYELTADSDREWTLYDLSDRLLMKGWQVPTYPLPKNMADRVIQRIVVRADFGMSMAHDFIDDLTQAIHDLDQAHIVFHSDPQPKKYGFTH

SEQ ID NO: 34208 - protein, 380 aa, Nicotiana tabacum
MSSTVGQVIRCKAAVAWEAGKPLVMEEVEVAPPQKMEVRLKILYTSLCHTDVYFWEAKGQNPVFPRILGHEAAGIVESVGEGVTELAPGDHVLPVFTGECKDCAHCKSEESNMCSLLRINTDRGVMIQDGQSRFSINGKPIYHFVGTSTFSEYTVVHVGCVAKINPLAPLDKVCVLSCGISTGLGATLNVAKPTKGSSVAIFGLGAVGLAAAEGARIAGASRIIGVDLNASRFELAKKFGVTEFVNPKDHNKPIQEVIAEMTDGGVDRSVECTGHIDAMISAFECVHDGWGVAVLVGVPHKEAVFKTHPMKLLNERTLKGTFFGNYKPRSDLPSVVEKYMNKELELEKFITHKLPFAEINKAFDLMLKGEGLRCIINMED

SEQ ID NO: 34209 - protein, 172 aa, Mesembryanthemum crystallinum
IGEGTYGKVYRAREKATGKIVALKKTRLHEDDEGVPPTTLREVSLLRMLSRDPHVVRLMDVKQGQNKEGKTVLYLVFEYMDTDLKKYIRSFRSMGQTVPPQNVKSLMYQLCKGVAFCHGHGVIHRDLKPHNLLMDRKDMTLKIADLGLARAFIIPIKKYTHEILTLWYRTPE

SEQ ID NO: 34210 - protein, 545 aa, Nicotiana tabacum
MVKICCIGAGYVGGPTMAVIALKCPSIEVAVVDISVPRITAWNSDQLPIYEPGLEDVVKECRGRNLFFSTDVEKHVREADIVFVSVNTPTKTRGLGAGKAADLTYWESAARMIADVSKSDKIVVEKSTVPVKTAEAIEKILTHNSKGINFQILSNPEFLAEGTAIEDLFKPDRVLIGGRETPGGQKAIQALKDVYAQWVPEDRILTTNLWSAELSKLAANAFLAQRISSVNAMSALCEATGANVSQVAYAVGKDSRIGPKFLNASVGFGGSCFQKDILNLVYICECNGLPEVAEYWKQVIKINDYQKTRFVNRVVASMFNTVSGKKVAVLGFAFKKDTGDTRETPAIDVCKGLLGDKAKLSIYDPQVNEDQIQRDLSMNKFDWDHPLHLQPMSPTTVKQVSVVWDAYTATKDAHAVCILTEWDEFKTLDYQKIYDNMQKPAFIFDGRNVVDLEKLREIGFIVYSIGKPLDAWLKDMPLSLNCITWLEWLCSDIKYISYMRQSAGILTIFFFYHVQFLFCFIPCRLRDHHCHYQIRQCAVQCFFCI

SEQ ID NO: 34211 - protein, 280 aa, Glycine max
VWIASSAGGVLGNLLGGIFIGRFSPQSMFLYFGLLLALQFFITISVRESSLGLPKSPSGGIRKQLSQLLVALRKPEISYSISWFTASYAIIPALTGTMFFYQTQYLKIDSSVLGISKVFGQATMLLWGIIYNQYFKSVPPRKLISAIQAMMAFLMISDFLFVRGFYRQMGVPDSLYVVIFSGFLEVLFFFKILPFSVLIAQMCPPGCEGSIMAFLMSCVALALIVSGYLGVALASCIKVTASDFSGLPLGLLIQAACTLVPTFWSSCIPDKVESKAKRKD

SEQ ID NO: 34212 - protein, 486 aa, Vibrio cholerae O1 biovar eltor str. N16961
MCKTKIVATLGPASQTRETLTQLIQAGVNVVRLNFSHGSAEEHIARAEMVREIAQQLNVSVGVLVDLQGPKIRIACFAEGAIQLSAGDTFILDGHLDGQAGTQERVGLDYPELIDDLNVGNILLLDDGRIQLEVTAVDMQARLVHTIALNSGKLSNRKGINLLGGGLSAPALTEKDKLDIITAAELQADFLAVSFPRNAEDIEYARQLATQAGCHAHIVAKVERAEVVASEEAMDSVIRASDVIMVARGDLGVEIGDARLPSVQKALIARAKHLGKPVITATQMMESMIENPLPTRAEVLDVANAVIDGTDAIMLSAESAAGRYPVETVQAMVRIAQGVEHETHCAQNCWDALQHLCSDAGKSFALSSMISASKVNKDLGVAIVTEQGETPLLMSRCQSQATIWAVSDKPALLRKLAILRGVTPTYFPHLDKQGDIATQLIHLLRKPAQEKKIASILVTQLESVEGVGHVNVCRLLNLAQQEALFA

SEQ ID NO: 34213 - protein, 2731 aa, Pseudomonas syringae
MCRAWTPTSMNERYGNNLPGSCCALSNRIDWTSPSRSTPSGKKAAVNRFQYFCRSLPVTTFTVPLILSDASPAALAATAQRLRAEHETRSFAEWQVFCRQQLTRDHAEYRAAILATDQASLLKGLDMLARGRASRHLVLGRADQLRQPVLVFPGQGPLWPRMTTRLSATLPSYQQALHRHGDLIEARIGWNPARALAEGERIERLLRIQPLQFALACSLAETWQAFGIEPAAVIGHSVGEAAAAHVGGYLDEASGAALTVLWGETLTAIEGQGGMLSVAAALDDIKPLLDDQESLSVAAINAPRSVTLSGTLMALDALQARLTDAGFWAWRVPGGQVAGHGPQVEPLRDAVTSRAPAKVMDGQIPYYSSVSGGRQNGEHLDVDYWFRVLRETVRFQDSLQALIADGHRLFIEVSPHPVLTSLIDEALRGAGVVGGAVATLDQRKDDRESLLQAMAHAFVHGAPVDWSQVIERLLPEGSTSAQLAPGEPTAATAGDDTLAAANLSQLGEPEQCRLLLKLLAQEMETLIGQPFASETQAFRDCGFTSLHVVEFAQAVSAAVGVSLPVTLVYDHPTPRAVVTYLRGVLGLQSPSQRQAAPIVTGSHHDEPIAIIGMSCRYPGGANSPEALWTLLMQERDAISEYPTDRGWDTTKLYDSEPGRFGKISTRTSGFLHDASAFDPAFFGISPREALTLEPQQRLLLEVCWEALERAGIDPASLHGSLTGVYAGIMGTEYGTQIQHASEDVTGYGYMGTATCVAAGRVSYCLGLQGPALAIDTACSSSLVAIHTACEALRSNDCQLALAGGVTVMPTPGVLIDFSQQRVLAPDGRCKAFSASADGVGLGEGVGMLVLERLSQAQAKGRLILGVIRGSAVNQDGASNGLTAPNGTAQQQVIRHALANAGLQPEDVDAVDAHGTGTRLGDPIEANALLATYGQRPAERPLLLGSIKSNTGHTQAAAGVASLMKMVMALRTGTLPRSLHITAPSTEVDWSTGAIELLSERRPWPNVADRPRRAGISSFGVSGTNAHLIVEEYVAPAATSACQVPETQASLWPLAAKSTEALRDVAARLHGHVLEQAHLAPDDIGYTLGVSRSGFPFRAALRGTSREALLEALHALASGTDHPCLLQGAAQVRGRKRVFIFPGQGSQWAGMGMELYAAFAVYRQTIDQVETALQPYVDWSLVAVLRGEEGAPSLERIDVVQPALFAVMVAIARLWQSLGCTPDAVIGHSQGEIAAAYIAGALKLEDAVKILAIRSQLMLAQAGTGAMATVVLPEQQAAELAARVDASLTLAVFNSPSSTVISGATNAIARLLETCKRERIVARRVAVDVAGHSPQIEVLRPQLLARFADLRPQATQIPFHSTVAGRNPAVSLDGRQLDAGYWCDNLCLPVRFADTVQALSSAGDVTFIECSPHPVLLPPLEETIGDQTSSLGSLQRNKPAVDCLVAGISQLYLEGHSLSWRALYPQGRIVELPTYPFDHKPFWLTGQGPTDVTGAGQRATQHPLLSAAVDLPEGGLLLTGTLGLGAHPWLADHAAAGVVLLPGTAYLDMLVFAAAQTDCTQLLELTLQAPLVLEQQGQIDLLLTVSRAEAEGLRQASLYARRHGDATAGWTLHANAQMVPMPPQILIPLDQAWPPTAAIPLDSAALYERLSEAGYEYGLAFRGLTAAWQDGERTYVEVSLPETLPSGTHVLHPALLDAALHPLALADEEAAAPLRLPFAFAGVSVTADRPRQLRAVLQRTQAETYSISAYDETGNSLLHIAALQLRPASRDTLRDLARVQPAHDLLRLTWSQLSARPRVQRAVTRWVRIGTAEPGLSSAPTYPSLTALGQALESSTTPPDVLVWHLPEVQGANSALATRQLCVEVIAQLQVWLAEERLADTRLLVVTRKANATVAGEAVDPAHAALWGLLHSAQNENPGRLLLLDTEGPLADPAPLQAVLASDQRQLALRRGQLLVPHLTRSGPNSVLTPPLGGGAWRLEITRAGNLDDLALQPEHQAEAPLENGQIRLAVRAAGVNFYDVVCALGLIPPQHKLGTEAAGIVTEVGTGVTDLRPGDRVLVMSEGAFGPLLVANQRAARKLPADWTFAQAAGFPVAFLTAYYSLVRLAQVRPGDKVLIHAAAGGVGQAAIQLAKHLGAEVFATAHPDKWPILKALGIAPDHIATSRDLSFAGRFGALLGEAGMDVVLNSLTGEAIDVSLALLGRGGRFIELGKTEVREPAAVALQYPGRHYHYLDRPDQDPQDTGRMLDELLGLVHDRILTPLPVTAFDLRDAVQALRWMQQGRHTGKVVLTLPRTLDPDGTVLITGGTGTLGSLAARHLVATGQARHLVLASRSGTQADGALALRQELEAAGAQVRLAACDLADPESVERLLNSLPAEHPLTAIIHTAGVLADATLPNLGPEELERVFVPKADAAWMLHERTRQLDLAAFVLYSSSAGTLGSPGQANYAAANRFLDALAQTRQRQGLPATSLAWGWWQPVTGLSSRLTAADNARIARTGFAPITPEHGHALLDTAIAAPQAFFVAAPLNPQTLRKNAQAGTLHPLFERLGGGSPGARGSEGPAKVQDLRQLLAGLDPQARTKQLQTVIATQVAAILGLDGPGQVLPEATFKESGIDSLMALELRNRLATAAGLRLAATLTYDQPTPAALAAYLNDALFPDGGAPDADTAAIDEPKVRALLASLSLSALREADLLAPMLQLALHPSGTAPPQATDLATASADELVALALRTQE

SEQ ID NO: 34214 - protein, 524 aa, Nicotiana tabacum
MVKICCIGAGYVGGPTMAVIALKCPSIEVAVVDISVPRITAWNSDQLPIYEPGLEDVVKECRGRNLFFSTDVEKHVREADIVFVSVNTPTKTRGLGAGKAADLTYWESAARMIADVSKSDKIVVEKSTVPVKTAEAIEKILTHNSKGINFQILSNPEFLAEGTAIEDLFKPDRVLIGGRETPGGQKAIQALKDVYAQWVPEDRILTTNLWSAELSKLAANAFLAQRISSVNAMSALCEATGANVSQVAYAVGKDSRIGPKFLNASVGFGGSCFQKDILNLVYICECNGLPEVAEYWKQVIKINDYQKTRFVNRVVASMFNTVSGKKVAVLGFAFKKDTGDTRETPAIDVCKGLLGDKAKLSIYDPQVNEDQIQRDLSMNKFDWDHPLHLQPMSPTTVKQVSVVWDAYTATKDAHAVCILTEWDEFKTLDYQKIYDNMQKPAFIFDGRNVVDMEKLREIGFIVYSIGKPLDAWLKDMPLSLNCITWLEWLCSDIKDISYMRQSAGILTIFFFYHVQFCFVLSHVG

SEQ ID NO: 34215 - protein, 348 aa, Dehalococcoides ethenogenes 195
MKQGVIEHYRKYLPVTDKTPPLTLGEGDTPLVRCPKLEKELGIAELYFKLEGCNPTGSFKDRGMVMAVAKAIEDGFKAVVCASTGNTSASATAYAAASGLESIIIIPSGKIALGKLAQAIVYGAKIIQIKGNFDQALQIVFKLTEKHKVALVNSVNPYRIEGQKTSAFEIVDALGKAPDFLFIPVGNAGNITAYWKGFKEYHQLGKAASLPKMMGFQAEGAAPIVRGHAIAEPETLATAIRIGNPASWKKAEEARDQSGGIIDMVSDAEIMAAYHKMASAGIFGEPASAAPLAGLIKRIKGGQDFSSSQVVCVVTGNGLKDSNIAIKGAGGFSETEASLGAVEKVLGW

SEQ ID NO: 34216 - protein, 511 aa, Desulfococcus oleovorans Hxd3
MTKATPPCMLMILDGWGLNPETKGNAVAAARTPHLDRLFSEYPHTRLVCSGEAVGLPPGYMGNSEVGHLNIGAGRVVYQELMRINVAIQDGSFFKNTVIVQLMDQVTKKQGRLHLIGLLSDGGVHSHLDHLKALVRMASNKNLPVLIHTILDGRDTPPDSGKTYMADLCEFLADYPSASVATVCGRFYAMDRDTRWDRTKKAYDLYTLGEGTRESDPVTAVKNAYLRGETDEFVTPVIIASGSQDGGTVADNDGILFFNFRADRMREIVRAFTDPDFSFFNRKKTPAVAPPVCMTLYDKTFPLPVAFPPENPPNTLGEVISRQGYSQLRIAETEKYAHVTYFFNGGVETPFTGEDRKLIPSPREVATYDMKPEMSAPQVANTLAEEIIKQKYDFIVVNFANMDMVGHTGIFAAAVAACETVDACIGKIIPLFLKSGGVVLVTADHGNSEQMEDQNGHPFTAHTTNPVPLILVDENRKQIILKEGKLADIGPTILFIMKIDQPAEMTGNSLL

SEQ ID NO: 34217 - protein, 463 aa, delta proteobacterium MLMS-1
MPQRQVMTLPNLLTAFRFAVVPFIMLCLLPGAGELAGLIAFALFVIGALSDLADGYVARVMQSETVLGKLMDPLADKVLIAVALIMLIPLGKVAAWVAFLIIARELVITGFRGVAADAGIVIAAGGLGKIKSVFQYVALSILIFPAALLPLPWLHDLGGALLLLAMVLTVWSGVDYFVRFRKALSEQFAKRLTSWLPLNSLPRLGLNCWLKAPGAWGLVWKMTPCSGWELYFRELLKWHRRVNLVARAPEPELLELHFLDSLTILPLCRFEPPPTGSPVVTDHEVRLPPVAPSPARTAAGLPGTADSAKDAGSLLDIGSGAGFPGLVLKCCRPELALTLLEPRQKRVAFLRQVLRVTGLKAGCEVLAQRLVPGGGALAQRRWPLITGRAVASVADFLDLCAPLSPPGGRVICMKGRRAAAEVEQWHRLKRPGEYRLDQEKEVHLPFSGVLRRLLIFVKEQPAE

SEQ ID NO: 34218 - protein, 283 aa, Rhodococcus equi
MRLLVTGGAGYVGSVCTTVLLERGHEVVVVDDLSTGNADAVPAGAEFIEGDIAAVAGSVLGSGNSTPRFDGVLHFAAQSLVGESVERPEQYWQGNVVTTLALLEAMRLSGTPRLVFSSTAATYGEPERTPITEDAPTRPTNPYGATKLAIDHAITSYANAHSLAATSLRYFNVAGAYRGAGENRVVETHLIPLVLQVALGQREKISVFGTDWPTKDGTAVRDYIHVLDLADAHLLALESSVPGHHRIYNLGSGAGFHCPRSHFGLRAGDRPAHRRRGRPPTRG

SEQ ID NO: 34219 - protein, 290 aa, Schizosaccharomyces pombe 972h-
MSSAVTPSDQGLLPRGPIALEEFVKPFCDRFGLTKLPRHMHVILLSALFYQIINILSPVISRHLSTHYAKLSKKTRLNWDAHVVSSVQSIVLICLGYTCLKEVNAFPDKLFGYSVVAGDIYALTAGYFVWDLYITVRYVHITGIGFVIHAIAALFVITFSYRPYLMYYGPTYLSWELSTPFLNIHYFLDKTNRTGSKFQMINGFILIVTFICVRIAWGWFSAYSTAIEILNHINVAPWALSLFYLAANMSLNCLNLFWVSKMIDAIRRRAHGEKKSTPLQVTSEYAKKNI

SEQ ID NO: 34220 - protein, 532 aa, Zea mays
IMATTTSATTAAAAAATTAKPRGSSSALCQRVAGGGRRRSGVVRCDAAGVEAQAQAVAKAASVAALEQFKISADRYMKERSTIAVIGLSVHTAPVEMREKLAVAEELWPRAIQELTSLNHIEEAAVLSTCNRMEIYVVALSWNRGIREVVDWMSKKSGIPASELREHLFILRSSDATRHLFEVSAGLDSLVLGEGQILAQVKQVVRSGQNSGGLGKNIDRMFKDAITAGKRVRSETNISSGAVSVSSAAVELALMKLPKSEALSARMLLIGAGKMGKLVIKHLVAKGCKKVVVVNRSVERVDAIREEMKDIEIVYRPLSDMYQAAAEADVVFTSTASETSLFAKEHAEALPPVSDTMGGVRLFVDISVPRNVSACVSEVGAARVYNVDDLKEVVEANKEDRLRKAMEAQTIITEELRRFEAWRDSLETVPTIKKLRSYADRIRASELEKCLQKVGEDALTKKMRRAIEELSTGIVNKLLHGPLQHLRCDGSDSRTLDETLENMHALNRMFSLDMEKAIIEQKIKAKVEKTQN

SEQ ID NO: 34221 - protein, 288 aa, Lilium longiflorum
MEGKEEDVKLGANKYSERQPIGTAAQTQDRDYKEPPPAPFFEPGELKSWSFYRAGIAEFVATFLFLYITILTVMGVSKNATNKCVTVGIQGIAWSFGGMIFALVYCTAGISGGHINPAVTFGLFLARKLSLTRAIFYIIMQCLGAICGAGVVKGFQKGLYESNGGGANVVNHGYTKGDGLGAEIIGTFVLVYTVFSATDAKRNARDSHVPILAPLPIGFAVFLVHLATIPITGTGINPARSLGAAIIYNKSHAWHDHWVFWVGPFIGAALAAVYHQIVIRAIPFKSRS

SEQ ID NO: 34222 - protein, 390 aa, Leuconostoc mesenteroides subsp. mesenteroides ATCC 8293
MLAKRVDSLEASPTLAMGKKAKDMIADGIDVVNLSQGEPDFNTPDNIGRAARIAIKDHLTDSYTATNGLVELKNAVVAAAKRDYNVSLLTDQVVITTGAKLALYALMQILVDPGDLVITSAPFWVSYSEQVKLAGGSFKAIVSSDPQFKLTIDVLNKLEEKPKVVILNTPNNPSGAVYSKNELESIISWTKTNDVYLILDEIYGKLVYGDTVFHSGLSLESLVNSKMIIINGVSKAYAMTGWRIGWAIADVSITHAMTKILGHLTSNPTVVAQYAAIEALNGQQKSVETMRKSFESRLNFLYRDLSEIDNISIPFKPSGSFYIFFKIDSKFMKKNNFKNTNEISMALLSEEKLAIPSGEGFGMPGYLRLSYAKSEAELIEAVKRLKHFFS

SEQ ID NO: 34223 - protein, 389 aa, Triticum aestivum
MHPTRSELSHMVDLQAAGLVISVVAAEVGAAKLSDRLGVNLHIKREDLQPVFSFKLRGAYNMMAKLSREQLNNGVICSSAGNHAQGVALSARKLGCDAVIVMPVTTPEIKWRSVERLGATVVLKGDSYDEAQSYAKLRCEQEGRTFIPPFDHPDIIAGQGTVGMEIVRQLQGPLHAIFVPVGGGGLIAGIAAYVKRVRPEVKIIGVEPSDANAMALSLCHGQRVVLKHVGGFADGVAVKVVGEETFRLCQELVDGIVLVSRDAICASIKDMFEENRISLEPAGALALAGAEAYCKYYGLKGETVVAISSGANMNFDRLRLVTELADVGRKREAVLATFLPEEQGSFKKFAELVGRMNITEFKYRYDSNGKEALVLYSVGIYTDHELKAM

SEQ ID NO: 34224 - protein, 313 aa, Oryza sativa
MQASVAVSEALEAGKLSAAPRDGAADFAVAWLAVVVVSLAVAATCVVVSFDAHARQPGRLRRMLDLGPSVRGARLLLAIFAGLLPAAEVIRLPFFSRAVVSPPRHVVPCLAYPLVAHGVAEPCFLATVLLLLRASTGGARLPAAALAVPFACLPFLSAHVAVLVLPAAVAPYPGQLAHAADVDARCAYPAYAAALLVALAALYAPLLLSACWTVAAVAINRRMRARAYALAALVVVPLPVQVVALALSSVWETPRRTSPVAAFLGFLAVGIAAAAALAILVLLPVYDALFLGDDEQLPVAVAAAGEEARELDR

SEQ ID NO: 34225 - protein, 450 aa, Leuconostoc mesenteroides subsp. mesenteroides ATCC 8293
MVDKKKGQGLPNLPLSTIWMLSFGFLGVQMAFSLQSSQMGRIFQTLGADPTKLGFFFILPPLAGLFVQPLVGYFSDRTWTKRFGRRMPYLLVGALVSVIVMFLLPNSGSFGFSTTAGLWFGAITILFMDLSSNVAMQPFKMVVGDMVNEDQKSYAYSIQSFLSNTGSVLATIFPFLLTAIGVANTAPKGQVPASVIISFYVGALVLVVFSLIAVFNVKEYDDATYELYHGYALNTPNDGEGGFLTLLKRAPKTFWMVTLTQFFCWMAFQYLWTYGTGAVADNIFHATDPTTAGYQNGGNWFGIMSAVYAIAAVVWSLVLSKIPANKNKTGYALSLFLGAIGFTSVFFIHSQYLLIGSFILIGISWAGMMAYPFIMVTNALPGDHMGTYLGLFNGSICLPQIVASVASFALFPALGSHFPSMILVSGILMLIGAVSVGFINEIHSNPVDAQ

SEQ ID NO: 34226 - protein, 412 aa, Zea mays
  misc_feature (396)..(396): Xaa can be any naturally occurring amino acid
  misc_feature (400)..(400): Xaa can be any naturally occurring amino acid
MLSTLRVASRRAARPAQYNLAATRAASNWANVPQGPPDAILGITKAFKADKFDKKINLGVGAYRDDAGKPYVLPSVREAEMKVVESKLNKEYAGITGVPEFPPAAAKLAYGANSPALDRITITQTISGTGALRVGAAFLAKFFPGEKKISGRQPSWANHKAVFNHAGLEVEQYRYYDKKTIGLDFEGLIADVKSAPNGSVFLFHACAHNPTGVDPTQEQWKQISDVVKEKGHFAFFDMAYQGFASGDTDKDAFAVRYFVEQGHNIALCQSFAKNMGLYGERVGAFSMVCADADEKKRVDSQLKILIRPLYSNPPIHGARIAAEILNSPTLYKQWLGEVKEMADRIITMRALLKDNLEKLGSKHDWSHITSQIGMFAYTGLTSEEMTRLAEEFSVYXHQDXRISVAGITSENV

SEQ ID NO: 34227 - protein, 448 aa, Xanthobacter autotrophicus Py2
MAKRYDLAIIGTGTAAIVTAHRVRAAGWSVAVADFRPFGGTCALRGCDPKKMMVGGAEAADHAWRMSGRGIEGDATLDWTGLMAFKRSFTDPVPQKREKAFADKGIHAFHGHVRFIGPNALEFGGERIEADRIVIAAGAEAVPLGIPGEQHLITNEGFLELESLPERIVLVGGGYIAAEFSHIAARAGAQVTILQHGKRMLKQFDPDLVGWLMDKFSERGINVRTQAGVTAIEKVSDGYRVRADCPDGELDMDADLVVHAAGRAPALATLDLDAGSVKHHNGRLALNGFLQSVSNPAVYAAGDAAGLGPPLTPVSSHDAKVVSANLLNGNTVRPEYTGVPSVAFTIPPIAAVGMSEAKAREKGLNVRVKTERVDGWFTARQQAETVYGFKTLVDADTDRILGAHLVGPHADEVINIFALAIRQGLTAEQLKTTMFAYPSGASDIGEML

SEQ ID NO: 34228 - protein, 309 aa, Oryza sativa Japonica Group
MEKPEWSMDDFEIGKYIGEGKFGKVYLAREKQSGYVVALKVTFKAKLDKYRFHAHLRREIEIQHGLDHPNVLRLFAWFHDAERVVLVLEYAARGELYKLLRTVRRFSERTAATYVASLAGALAYCHKKQVIHRDIKPENLLLDIEGRLKIADFGWAVRSNAKRHTLCGTIDYLAPEMIEKKAHDHAVDNWTLGILCYEFLYGSPPFEAAEQDDTLRRIVKVDLSFPSTPYVSADAKDLICKVKFVVLIIPIVYVTLKWVELLSFELRVRMQLLVKDSNKRLSLDDIMKHPWIVKNADPSGSCSDQKART

SEQ ID NO: 34229 - protein, 767 aa, Xanthobacter autotrophicus Py2
MNDCCTSSASRDKATVSTSATVPSLAVRPGVTFPDWSVVSSPVVKEALLAMVGSDHVLNRWSGYEAATDRVRVALLQLYAEHGRAPTPSALAKRAGLSEEAVRALLEELRRRDLVVLDGDMIVGAYPFTDRDTGHRVTLDGRTLTAMCAVDALGIGAMTDQDISIVSRCRHCGAPVRITTQERGRALADVEPTTAVVWLSVHYEGGCAANSLCTATSFFCSDDHLAAWRRQRPADEPGFRLSIEEALEAGRAIFGPSLAGIGTIAGHGNNAAETQGEPQSSGDTASPDRPVTHRRLGTNGRNNGSYDLAIIGAGSAGFSAAITAADQGAQVALIGSGTIGGTCVNIGCVPSKTLIRAAETLHNARAAARFAGITAEAELTDWGGTVRQKDALVSELRQAKYADLLPAYNGIAYREGPARIVDGGVQVDGTFVSAGKIIIATGARPAVPVIPGIETVPYLTSTTALDLEALPRSLLVIGGGYIGAELAQMFARAGVEVTLVCRSRLLPEAEPEIGTALTGYFMDESIAVISGITYRTIRKTADGVALTVHRDGKDVTIDADQVLVATGRAPNIEGLGLAEHGIALSPKGGIFVDDRMRTTRSGVYAAGDVTGHDQFVYMAAYGAKLAAKNALNGDSLRYDNSAMPAIVFTDPQVASVGLTEAAARTAGHAVRVSTIGLDQVPRAIAARDTRGLIKLVADAGSGRLLGAHILAPEGADSIQTAALAIRHGLTVDDLADTLFPYLTTVEGLKLAALAFDKDVAKLSCCAG

SEQ ID NO: 34230 - protein, 496 aa, Ralstonia metallidurans CH34
MPGRPIPRKEPRVSLPDFDMVLFGGTGDLARRKLLPALFDAHRTGCLHPSSRILATGSHPHTTEQYKAMLEESVRPGLEHAPPEAWTSFMDRIGYVQADARQPAHFDALAEQVLARKPEVVVCYLATAPHIFVPICEQLGRTGLNAPNVRVVLEKPLGHDLDSSEAINNAVSRYFGEEQIYRIDHYLGKESVQNLMAIRFANALFEPLWRREWVQDVQITIAEELGVETRGDFYDRTGALRDMVQNHLVQLLCMVAMEPPASLSEDAIRDEKIKILKALKPILPQDVAEKTVRGQYRAGAVGGKPVVSYVDEQGIAADSTTETFVAIKAEIANWRWEGVPFYLRTGKRMQSRVAEIVVHFRDVPHAIFPRPLTLSPQNRLVIRLQPEESIRLYFLVKQPGDTVELTPTSLDLDFANSFKMRRAGAYERLLLDVIRGKLGLFVRRDEQVQAWRWVEPILDTWDQSTVPPKPYTAGTWGPAASSALMSRDGALWHEEA

SEQ ID NO: 34231 - protein, 359 aa, Pyrococcus furiosus DSM 3638
MVEKPVVVKFGGTSVRYAFEEALELVANLNENTRTIVVVSALAGVTDCLLRLANGDMSALLEIEEIHEELSQELDVQLDHLMYQLHKTLNSKSSFPSKEAFVDEIASFGERFSAELFSEGLKILGINAKAVDSKDILFAKGDYGNAEVDFKKSVYGAGILYRMLRRGIVPVVTGYYGNLNGFRATFGRGGSDYSATSIARLVNAKATLIMSDVEGIYTADPKLVPSAKLIHYISYREAKIAAKLGMKALHHRAIDPVEGRIPVILGKTRDLKFGTLISHKSQGIPVVVHKLIEDHAEVSVVSTRRSFSLPYEVYEEGDFYFKIKIPKEQFLEVLKDIHRRVVENESLRPSYDSELWAWV

SEQ ID NO: 34232 - protein, 357 aa, Verbena x hybrida
MFSTVAPSPRVEILAGSGIKTIPKEYVRPDEELESIRDVFAEERSIDGPQVPTIDLAEINSENEEIRKKCHDELKKASMEWGVMHLTNHGIPDELINRVRKAGQGFFDLPVEEKEKHANNQEAGNVQGYGSKLANNASGQLEWEDYFFHCVFPEDKRDLSIWPKNPADYIPATSEYARQLRSLATKILSVLSIGLGLEQDRLENEVGGMEELILQKKINYYPKCPQPELALGVEAHTDVSALTFIIHNMVPGLQVFYEGKWVTAKCVPNSIIMHIGDTIEILSNGKYKSILHRGLVNKDKVRISWAVFCEPPKEKIILKPLPEMVSEAEPPLFPPRTFAQHLKHKLFRKTDDEEIDE

SEQ ID NO: 34233 - protein, 231 aa, Polaromonas sp. JS666
MKIFALLPWSDWLAIAWFFSGWIGYAWFAWHYGVKRPSLLQTTNRYRHYWLLQATARDPRVIDGIITQNLSSTPAFFSSTTIIIIGGLFALLGTTDKATELVREIPFAVRTSVLIFDLKVIMMVGVFVYAFFRFSWSMRQYTFVALVIGSMPSPQEFEQGKFDREVFARRASRLVGLAAETFNDGLRGYYFSFAIMAWFFSTIAFALATAVVVLILYNREFDSDVLGVLRE

SEQ ID NO: 34234 - protein, 380 aa, Triticum aestivum
MGRVPQAMRAAKVPRHALVPKPSAASTPTPPPPPPRGPRPADGKPPHGKPPRRTPRPPSEHAGALALPDRPAPPAEKRPITTPAELTAAIRAAVDADVDAAASLALKAAPTIPLPTQSLALLLRRLAAHRSVAAARDLLAALPYSADNPAPRPALLALADACCRRGDPREIGQLLPVLADHGVCADAHVYNALMKGHCADSDTAGLLGVLRRMKDDGVDPDIVTYNTLVYGLARAGLVAKARTYLDAMAAEGLFPDVITYTSLMNGMCVKGDALGALKLLEEMEANGCEPNDRTYNTLLMGLCRNRKLDKAVEVYKSMVGARMKLEPPAYATFIRALCRAGRVPYAYEVFDYGIESKSIPQATAYSELESSLKWLRKMKV

SEQ ID NO: 34235 - protein, 581 aa, Gibberella zeae PH-1
MERSKPQAFLSSYAPRLRAYNNSLLTPVLPSSAPAGPVSRTTKRGTTIINYAEDGYDDLEDDSDDPRRRPTGLRSLRKEDSASRLDLADKVGKDTKEPVEVQGIWRDWIAKHRLLRSDQQNAIQATLPLTLIPIRIDLDVPAFIPPAPYPTPNPNTVDTSLPQYRQQEATVPYKLRDIFCWNLHETLISTDQFAQTLVQDLDLPNRQAAIAEISKQIRTQLEEYSGVALHPLFHSDQQAASAPQPTTTALTPRPSFALKSRDDSPASAIRGPSRPDTPAQTGGAATPSQTQAPDVTAEATPILPDSDDYNPDDTYRCIINLSLNLASMLYTDKFEWSLLHPPGTAEAFAKVTCTDLGLTGEWIPAMTHAIYEAVLRLKKEACEAGGLVAGWGGLQQELPNDAAHGSEAGWRYEPEHLGDDWEPKVEFLSKEEIEKREGDREREVRRLRRETARFSSTTGMLGGTPFGAPMEVEEERMGRGERSKKKRRFRSLSPLGRGGTPGGRGTPDVGGYGGGGGALTDQERFQWRCMHCRIWGTSVWAVRDGPAGPRTLCANCGYLYERDQRLPRQNKNLHLPDVRVV

SEQ ID NO: 34236 - protein, 153 aa, Triticum aestivum
FHRTSLYKKAGWYRSGIPGISSTHASGKITVDQLAMQAIKNVRKRDMDDKARERAQRARIRQHNEDVLRQAAIASTPHSAAAYGQPSEALGRRGRRRAKTKEPTLSSMLKKKVTAKDRIAGRLLNGHARDATIREASNTEDMTYREAFPNQWQ

SEQ ID NO: 34237 - protein, 510 aa, Arabidopsis thaliana
MSNIDIEGILKELPNDGRIPKTKIVCTLGPASRTVSMIEKLLKAGMNVARFNFSHGSHEYHQETLDNLRSAMHNTGILAAVMLDTKGPEIRTGFLKDGNPIQLKEGQEITITTDYDIQGDESTISMSYKKLPLDVKPGNTILCADGSISLAVLSCDPESGTVRCRCENSAMLGERKNVNLPGVVVDLPTLTDKDIEDILGWGVPNSIDMIALSFVRKGSDLVNVRKVLGSHAKSIMLMSKVENQEGVINFDEILRETDAFMVARGDLGMEIPIEKIFLAQKLMIYKCNLAGKPVVTATQMLESMIKSPRPTRAEATDVANAVLDGTDCVMLSGESAAGAYPEIAVKVMAKICIEAESSLDYNTIFKEMIRATPLPMSPLESLASSAVRTANKARAKLIIVLTRGGSTANLVAKYRPAVPILSVVVPVMTTDSFDWSCSDESPARHSLIYRGLIPMLAEGSAKATDSEATEVIIEAALKSATQRGLCNRGDAIVALHRIGAASVIKICVVK

SEQ ID NO: 34238 - protein, 204 aa, Zea mays
  misc_feature (178)..(178): Xaa can be any naturally occurring amino acid
MWASPFALRAKLALNFKGLAYEYVEEDLRSKSDLLLSSNPVHKKVPVLIHNGVPVCESRVIVEYLDEVYSATGPRFLPADPYERAMARFWASFIDEKFLASWLKAGRGKTDEEKAEGLKLTLAAVETLEGAFMECSKGKPFFGGYSVGYLDIALGALVAWMRATEARHGLRLFDDSRXVRCWRSGWSASASWTRSWRSCRTSTG

SEQ ID NO: 34239 - protein, 183 aa, Pyrococcus furiosus DSM 3638
MVGGDRRFKVSKLMAYILRHSPWEFGLEPDEEGFVELADLIRAIKTVYPWVTEEFIKEIVEKDSKGRYEIRGSKIRARYGHSYPVVLKHEEDTESKVLYHGTIRENLKGILKEGIKPMKRQYVHLSLSYEDAYYTGRRHGKDVVVLLIDAECLRRKGYKILKAGKRVRIVKHVPVECISEILD

SEQ ID NO: 34240 - protein, 329 aa, Pyrococcus furiosus DSM 3638
MHPKVQSLLSKFPRVELIPWETPIQYLPNISKLVGADIYVKRDDLTGLGIGGNKIRKLEYLLGDAIIRKADVIITVGAVHSNHAFVTGLAAKKLGFDVVLVLRGKEELRGNYLLDKIMGIETRVYEAKDSFELMKYAEEVAKELEEKGRKPYIIPVGGASPVGTLGYVRASGEIAEQGNRIGVNFDSIVVATGSGGTLAGLSVGLAILRKETRAIGMAVGKFGETMVNKVEELAKATGEFIGVKNLKLKIELYDYSFGEYGKITREVAETIRLVGTKEGVILDPVYTGKAFYGLLDLAKKGELGEKILFIHTGGISGTFHYGDKILSFL

SEQ ID NO: 34241 - protein, 183 aa, Oryza sativa Indica Group
MEKCPNWKFVWENKAPMKVQFFAWLLTKDRFPIKRNLHKKTIVPAPTCELCNSADEKALHLCFQCPFAVTFWSAMNIPSQLDGKHSSDVLPVPALSQPSSSSRLRIFSGTANPTLAQEVAFYLGMELGRVKIKRFTDGGSVRGCDMFLVQATCPPPNENLMELLIMIDGRPPRILRFGWQQQH

SEQ ID NO: 34242 - protein, 364 aa, Dehalococcoides ethenogenes 195
MTNTAYLVLEDGTVFSGKSFGAETEAIGEVVFNTSMNGYQEMLTDPSYTGQIIVPTYPLIGNYGVNPFDNESACIRATAFGVHEECLLPNHYQNNQTIHSFLEESGIPGISGIDTRAITRKLRSAGVMRGMITTTKTPEEALKTIRSAPDYGQIDFVRKISTPSAYEWQKEKPSFAGFHIAVLDCGLKYSILNQLKSHGCKVTVLPCTASPQDIDALNPDGVLLSPGPGNPELLDYLVNTVRYACEKYPVMGICLGNQLIGKAFGAKTFKLKFGHRGGNHPVKDLASGRVYITSQNHGYSLDPATLKEGLEVSHINLNDGTVEGLRHRELPVFSIQYHSEASPGPMDSTYLFKQFVEMIKQTKK

SEQ ID NO: 34243 - protein, 175 aa, Ashbya gossypii ATCC 10895
MGSAPSKILEDLLDDTNFDREEIERLRKRFMKLDRDSSGSIDKNEFMSIPGVSSNPLAGRIMEVFDADNSGDVDFQEFISGLSVFSGRSDKEEKLRFAFKIYDIDKDGYISNGELFIVLKIMVGNNLEDEQLQQVVDRTIMENDVDGDGKLSFEEFKSAVETTEVANSLTLQCDI

SEQ ID NO: 34244 - protein, 770 aa, Herbaspirillum seropedicae
MDSMISKKEEVRQQLRQAALDYHEFPTPGKIAVTPTKLLTNQRDLSLAYSPGVAAACEEIVADPLNAFRYTARGNLVAVISNGTAVLGLGNIGALASKPVMEGKGVLFKKFAGIDVFDIEVNETDPDKLIDVIAALEPTFGGINLEDIKAPECFYIERKLREKMKIPVFHDDQHGTAIIVGAAILNGLKVVGKDIKNVKLVVSGAGAAALACLDLIVDLGFPIENIYVTDLAGVVYKGRKELMDPDKERFARETEARTLAEVIPDADIFLGLSAAGVLKPEMVKQMAARPLVLALANPTPEILPEEVKAVRDDAIIATGRSDYPNQVNNVLCFPYIFRGALDSGATTITREMEIATVHAIAELAQAEQSDIVATTYGIANLSFGPEYIIPKPFDPRLMIKIAPAVARAAESSGVAARPIQDMDAYIEKLEQFVYHSGTFMRPIFQVAKKAAEAKKRIVYAEGEEERVLRAVQVIVDENLAKPILVGRPEVLEQRIQKFGLRLRAGTDFEVINPNFDNRYRDYWQTFLEMSRRKGVTEQYAKLEMRRRHTLIGSMAIHKGDADGMICGTYGTTQLHLHYIDQVLGKREGVNVYAAMNAVILPNRQLVMVDTHVNENPNARELAEITMLAAEEMRRFGLHPRAALLSHSNFGSSNSESARKMREALAILREIAPELEVDGEMHGDTALDSKLLNAVIPDSPLKGDANLLVMPNIDAANIAYNLLKTASGNGVAIGPILLGCAKPVHILTPSATVRRIINMTALCVMDALSER

SEQ ID NO: 34245 - protein, 186 aa, Pseudomonas syringae pv. syringae B728a
MNIPNLITVLRVLLIPIFILLFYMPYHWSYMAASAVFAFAAATDWLDGYLARRLEQSTPFGAFLDPVADKLMVAVALVLLVQAHANLWLTLPAAVIIGREIVISALREWMAEIGARAQVAVSNMGKWKTAAQMLALVILLGNPPAITLWVILGYALLLIAAGLTLWSMVQYLRAAWPHLRTTSEKK

SEQ ID NO: 34246 - protein, 123 aa, Ashbya gossypii ATCC 10895
MLSSFIRATPRAFRYASLQRSTPLASAFVVTPLRFYSAAQLNRDEITKRIINVVKAFDRTPTSAEVTEKSVFSKDLGLDSLDVVELLVSVEEEFDIDIPDKVADEIKSVSEAVDYVASTSDAA

SEQ ID NO: 34247 - protein, 332 aa, delta proteobacterium MLMS-1
MFRLLDYDYDYDNDNDLSDLLLKFVGHGMAKHLLALADFSGEELRALIDRALQMKRESKAGGRHRALEGRSVALIFEKPSTRTRVSFEAAMYGLGGQVIYLSSRDTQLARNEPLKDMARVMARYVDGLVVRTFGQEIVEELARYSAVPVINALTDLHHPCQVLSDLMTVIEHQGELERLKIAWVGDGNNMANSWLQAAARLGFALTLACPEGYEPDADILAAARAAAARPINLVADPREAVADADVVNTDVWASMGQEDEQLHRLQIFRPFQINDELLAEAAPGAIVLHCLPAHRDEEISEAVLEGPRSVVWEQAENKMHIHKAILATFLDR

SEQ ID NO: 34248 - protein, 530 aa, Herbaspirillum seropedicae
MSTHSHSKILILDFGSQVTQLIARRVREAGVFSEVFPHDVTDEFVRNYGAAGVILSGGPNSVTEGDTPRAPQAVFELGVPVLGICYGMQTMAEQLGGKVDNGHLREFGYAEVRAHGHTKLLDNISDFTNAQGHGMLKVWMSHGDKVNEMPAGFKLMASTGNCPIAGMADEERRFYGVQFHPEVTHTVQGKAMLGRFVHEICGCQSDWNMPDYIAEAVEMIRQQVGSDEVILGLSGGVDSSVAAALIHRAIGDQLTCVFVDHGLLRLDEGKMVMEMFAKNLGVKVIHVDATAQFMGHLAGVTDPEAKRKIIGREFVEVFQAESAKLTSAKWLAQGTIYPDVIESAGKGKKTAHTIKSHHNVGGLPETLNLKLLEPLRELFKDEVRELGVALGLPPEMVYRHPFPGPGLGVRILGEVKKEYADLLRRADAIFIEELRNTKDEDGQTWYEKTSQAFAVFLPVKSVGVMGDGRTYEYVVALRAVQTQDFMTAHWAHLPHELLGRVSNRIINEVRGLNRVVYDISGKPPATIEWE

SEQ ID NO: 34249 - protein, 402 aa, delta proteobacterium MLMS-1
MDNNEWMARGERVLMATYGRLPVTMVRGEGCRLFAADGREFLDFVAGIAVCNLGHCHPAITDAVREQVERLVHVSNLYHSQPQIELAETLVAHSFADRVFFCNSGAEANEAAIKLARRAGGEGRYEIISLTGSFHGRTLATVAATGQPRFHEGFEPLPAGFVHAPFGDLDGLRRLIGSQTCAVLCEPLQGEGGVRPLAPEYLAAIRELCDERGLLLIFDEVQVGMGRAGSLLAHQQLGVVPDIATLAKGLGNGLPIGAMLATEQVAAAFTPGSHASTFGGNPVVCAAANAVLEIMLAPGFFAGVRQRGDYLRGRLEELVARYPRQLVEVRGMGLIQGLVLQDDFRARGPEIIKELFAAGLLLNFAGDTALRFLPPLVVSHQEIDRAVELVAAALQKALYKGG

SEQ ID NO: 34250 - protein, 445 aa, Triticum aestivum
  misc_feature (377)..(377): Xaa can be any naturally occurring amino acid
  misc_feature (386)..(386): Xaa can be any naturally occurring amino acid
  misc_feature (421)..(422): Xaa can be any naturally occurring amino acid
  misc_feature (428)..(429): Xaa can be any naturally occurring amino acid
  misc_feature (431)..(431): Xaa can be any naturally occurring amino acid
SITHDPVCSSCRIRHEVKIAVDMVNEALVDRNTAIKMVEPGHLDQLLHPQFANPEAASYKGKVITTGLPASPGAAVGQIVFTAEDAEAWHAQGKSAILVRTETSPEDVGGMHAAAGILTARGGMTSHAAVVARGWGKCCVSGCSSIRVNEIEKVVAIEDKMLYEGDWISLNGSTGEVILGKQPLSPPALSADLETFMSWVDEVRQLKVMANADTPGDALAARKNGAEGIGLCRTEHMFFASDERIKAVRQMIMAPTVELRQKALDRLLPYQRSDFEGIFRAMDGLPVTIRLLDPPLHEFLPEGHVEDIVRELCAESGAAEDDVLARMEKLSEVNPMLGFRGCRLGISYPELTEMQARAIFEAAISMTNQGIQVFPEXMVPLVGTPXELGHQVALIRQIANNVFTNMGKTIDYKAGTMIEIXXAALVAXXIXKQAEFFSFGQRPQM

SEQ ID NO: 34251 - protein, 632 aa, Schizosaccharomyces pombe 972h-
MSIDCLYRRSSLFDTSFVPLHSSIPATSKMSASNSDVNAPISPVVDEGKSELVSPTLERLVAPFNCSPSSTPLQDVAGVGSKMSDTLWMGDLEPWMDATFIQQLWASLNEPVNVKVMRSKASSSETLISYCFVQFSSSAAAERALMKYNNTMIPGAHCTFKLNWATGGGIQHNNFVSRDPEFSIFVGDLLPTTEDSDLFMTFRSIYPSCTSAKIIVDPVTGLSRKYGFVRFSSEKEQQHALMHMQGYLCQGRPLRISVASPKSRASIAADSALGIVPTSTSNRQPNQDLCSMDPLNTTVFVGGLASNLSEKDLQVCFQPFGRILNIKIPFGKGCGFVQYSEKSAAEKAINTMQGALVGTSHIRLAWGHNTLPVSALSQSQSQVSDEGFDRTLSANQIFGMNQSVIGANSGSSNSSGSSLKSAPVSPRTAAAQSLLPNSVVSSINGMNSVNFSTISPPPLSRSASISPTLSGSGSGLTPLSSHFPSAATGLVGGQVYPQSSVLQSSKINGSAKVQPSVKLPEWLQPFSGNNHNSFATQDLLTRVSSLKLVDDEQPASLNGSAFQARASRPWNLGRERQSSLIDLRHELEQNENGLEKSGFGLNLRGRLPPRSYSTFNCTGQYLQPSLRLSRDS

SEQ ID NO: 34252 - protein, 292 aa, delta proteobacterium MLMS-1
MKNSIDKAKTLIEALPYIRSFSNQTVVIKYGGHAMVDDELKKNFALDIILMKYIGINPVVVHGGGPQINLFLEKMRVTPSYIQGMRVTDGETMDVVEMVLVGKVNKEIVSLINYHGGRAVGLSGRDGDLVRAEKMQVLGEQVADAPPELIDLGRVGRVTEINPGILETLDARDFIPVIAPVGVGDDGQAYNINADLVAGAVAAQLKAAKLILLTDVEGVLDAQGRLISSLAAAEVEEKIASGVIKGGMIPKVRCCREAVAGGAGKAHIIDGRKEHAILLEMFTQSGVGTEIM

SEQ ID NO: 34253 - protein, 81 aa, Glycine max
RNPLKPLLLSVRSGAAISMPGMMDTVLNLGLNDEVVAGLAAKSGERFAYDSYRRFLDMFGDVVMDIPHSLFEEEAFGFLQS

SEQ ID NO: 34254 - protein, 342 aa, Cryptococcus neoformans var. neoformans B-3501A
MACNLTTSAIPSLLHSYVPQSLRPFVTLSYPITDPLAHPSAQTLYDKGPRDACFVVFWALAFTVLREAAMKGVFSPFMRICLPSPPRVKGQEREYAKARKKREHTVTRFAEQGWSWLYCSIYWTFGVIVLRQNASPTSPEQLWGTYPVIPLPALTKFYYLSQLGWWFHQLLVINCEKRRKDHWQMFGHHILTITLIVGSYAMNFTSVGVLIHCLMDFCDILLPLAKMFRYLSFTTLCDFTFVVFLISWFITRQVGLFLVIRSTYLDLPKFIPFEWTPEQGRFLTYWTHIGFVSMLSILWILATAWFYMACIVAIRVVRGMGAQDSRSDDGANRARWSECQRV

SEQ ID NO: 34255 - protein, 203 aa, Prochlorococcus marinus str. AS9601
MSIFVGNLPFRAEREDVIQLFAPFGEVLNCSLPLERDTGRKRGFAFIEMADEAIESTAIDGLQGRELMGRPLRINKAEPRSSGGSRRGGRGGGYGGGNNSGGYGGGYGGGNNSGGYGGGYGGGNNSGGYGGGYGGGNNSGGYGGGYGGGNNGSNSSYVNKSSGAEGWEDRSYGNSSENSEYENGRSRRKRGVSNENNASNETN

SEQ ID NO: 34256 - protein, 408 aa, Buchnera aphidicola str. APS (Acyrthosiphon pisum)
MISKKTLITRDNFDKLILPIYNPIPFIPIKGKGSRIWDQKGKEYIDFSGGIAVTSLGHCHPILNKTLKNQSKMLWHLSNIFTNEPALRLAKKLLSSSFASRIFFANSGAEANEAAFKLARYYSSKIYNFKKNKIISFYNSFHGRTFFTVSVGGQSKYSNNFGPKPAGIVHASFNDINSVKNLIDHDTCAVVVELIQGEGGVIPANLTFVQALKELCKQYNVLLIFDEIQTGIGRTGKLFYYEYYAITPDILTIAKSLGGGFPISAMLTTNEVASVIAPGIHGTTYGGNPLACAVAESVIDIINTKKVLSGVEKKSKKIISELNIINKRFKLFTEIRGRGLLIGIVLKPNVSRNIHKILNFSLSEGVIFLTAGNNVIRLAPSLIIKELDIIEGMKRFYRALEKYLSRKE

SEQ ID NO: 34257 - protein, 77 aa, Vitis vinifera
MSDNGRPLPKFGEWDVNDPASAEGFTVIFNKARDEKRTGGQPESPANVENNVKQGVEPSKPQTKKWFCCLQAPRAES

SEQ ID NO: 34258 - protein, 434 aa, Streptococcus thermophilus LMG 18311
MSIITDVYAREVLDSRGNPTLEVEVYTESGAFGRGMVPSGASTGEHEAVELRDGDKARYGGLGTQKAVDNVNNVIAEHIIGFDVRDQQGIDRAMIALDGTPNKGKLGANAILGVSIAVARAAADYLEVPLYSYLGGFNTKVLPTPMMNIINGGSHSDAPIAFQEFMIVPAGAPTFKEALRWGAEIFHALKKILKERGLETAVGDEGGFAPRFDGTEDGVETIIKAIEAAGYVPGKDVFIGLDCASSEFYDAERKVYDYTKFEGEGAAVRTAAEQIDYLEELVNKYPIITIEDGMDENDWDGWKALTERLGDKVQLVGDDFFVTNTAYLEKGIAEHAANSILIKVNQIGTLTETFDAIEMAKEAGYTAVVSHRSGETEDSTIADIAVATNAGQIKTGSLSRTDRIAKYNQLLRIEDQLGEVAEYRGLKSFYNLKK

SEQ ID NO: 34259 - protein, 211 aa, Vitis vinifera
MKIWAPEFGFIVILVLLSVQAVCGIRFVIDREECFSHNVEYEGDTIHASFVVIKVDASWHYNKDGVDLVVKGPSGNQIQDYRDKTSEKFEFMAHEKGLHRFCFTNKSPYHETIDFDVYTGHFAYYDQHAKDEHFNPLLEQISKLEEALYNIQFEQHWLEAQTERQARVNDAMNRRAVYKAFYESAALIGASILQVYLLRRLFERKLGTSRV

SEQ ID NO: 34260 - protein, 387 aa, Streptococcus thermophilus LMG 18311
MNILTVSPFAEKKIKQGKQLLLAEDFPNIAENNQLVYLYSQSKEFLGTGYLSSQNKGIGWFLSPKKQQLTVTYFQGLFEKAKARRQSYYANDLTTAFRLFNQDGDDFGGLTIDLYGDYALFSWYNVFIYSLKDIIVEAFQTVFPEVLGGYEKIRFKGLDFESDHLYGQEAADTFTILENGVTYEVFLNDGLMTGIFLDQHEVRDGLVNGLALGKSVLNMFSYTAAFSVAAAMGGAVETTSVDLAKRSRELSTAHFEANGFSMENHRLVVMDVFDYFKYAKKKGLFYDLIVIDPPSFARNKKRTFSANKDYHKLIAQSLDILSEYGTIIASTNAANMTVQQFKKQLRKGLGDVSADFVNLQQLPVDFAVNPNDPTSNYLKVYTIKVNK

SEQ ID NO: 34261 - protein, 482 aa, Saccharomyces cerevisiae YJM789
MVKRTVATNGDASGAHRAKKMSKTHASHIINAQEDYKHMYLSVQPLDIFCWGTGSMCELGLGPQAKNKEVKRPRLNPFLPRDEAKIISFAVGGMHTLALDEESNVWSWGCNDVGALGRDTSNAKEQLKDMDADDSSDDEDGDLNELESTPAKIPRESFPPLAEGHKVVQLAATDNMSCALFSNGEVYAWGTFRCNEGILGFYQDKIKIQKTPWKVPTFSKYNIVQLAPGKDHILFLDEEGMVFAWGNGQQNQLGRKVMERFRLKTLDPRPFGLRHVKYIASGENHCFALTKDNKLVSWGLNQFGQCGVSEDVEDGALVTKPKRLALPDNVVIRSIAAGEHHSLILSQDGDLYSCGRLDMFEVGIPKDNLPEYTYKDVHGKARAVPLPTKLNNVPKFKSVAAGSHHSVAVAQNGIAYSWGFGETYAVGLGPFEDDTEVPTRIKNTATQDHNIILVGCGGQFSVSGGVKLSDEDAEKRADEMDD

SEQ ID NO: 34262 - protein, 604 aa, Eucommia ulmoides
MDAVTIRVPYRNLKQEVELVGIEEQPPRRVQIDQSSSGNSNGNVSNHSPNSSPSDLAPKQNTLFSLILCCTVAAGVQFGWALQLSLLTPYIQTLGIGHAFSSFIWLCGPITGLVVQPCVGIWSDKCTSKYGRRRPFILVGSLMISIAVIVIGFSADIGYLIGDTEEHCRTFKGTRTRAAFVFIVGFWMLDLANNTVQGPARALLADLAGPDQRNSANAVFCSWMAVGNILGFSAGASGQWHRWFPFLMSRACCEACGNLKAAFLVAVVFLTFCTLVTLHFAKEVPLTTPKQPQRLSDSAPLLGNPRQLSFDFSKQKTEMPLVNSETENKSESDSKTESNGKTEDQKVEKDQFESFNDKPGAVLVNLLTSLRHLPPAMHSVLLVMALTWVSWFPFFLFDTDWMGREVYHGDPKGDAAEVRAYDQGVREGAFGLLLNSVVLGVSSFLIEPMCQRLGSRLVWAMSNFIVFACMAGTAVISLVSDIEFGNEHVVGGKETIKTASLVVFAILGLPLAITYSVPFSVTAELTADAGGGQGLAIGVLNLAIVVPQMIVSLGAGPWDALFGGGNIPAFVLASLSALAAGVIATLKLPDLANSSYSSTGFHFG

SEQ ID NO: 34263 - protein, 427 aa, marine gamma proteobacterium HTCC2143
MGLIALGINHKTANVALRERVAFAPEQMAEALQDVLRDAKLAEAVILSTCNRTEMFVIDHGEGTVDAGESEQRLLAWLASYHQIPTADLSDCYYSFQDQQALRHMIQVASGLDSMVMGEPQIFGQIKSAFAVAQEAESVGGELSRIFPHVFTVAKKVRTDTAIGKNPVSVAFAAASLSRHIFSDLGKVRALLIGAGETIELVARHLSENGVKDIVVANRTLGRARELAQRFGAEAVLLSEIPEQLVRSDIVISSTASQLPILGKGAVEHALKLRKHRPILMVDIAVPRDIEEQVGELSDVYLYTVDDLTDIIDENKRNRESEALKAEELIEQGIENYLQKLRSLDVVTTLKTYRSRSELIRDAELDKALKLLAKGEDAEQVLTIMARNLTNKFMHQPSIEMKKAGASGREELIGWAHELFGLNQEDD

SEQ ID NO: 34264 - protein, 176 aa, Burkholderia sp. 383
MAITLRQTAEAIAEDCRRNAFVKTRCVVVFYRIVHYLACRSRFTLLAGAPLIVLYILLCDWLMGIEIPVKTKIGKGLTIYHGTGLVINGFAVIGDYCTLRHGVTIGNTTRQDGTIDGVPTIGDHVEFGVHSVVLGPIRVGDRVRIGAGAVVLRDVPDGRVAVGVPARILDNGQEPQ

SEQ ID NO: 34265 - protein, 300 aa, Synechococcus sp. CC9605
MSKRHPVVAVTGSSGAGTSTVKRAFEHIFAREGITPAVVEGDSYHRYERMPMKQAMADALAKGENFSHFGPEANLFDKLEELFRTYGETGAGQKRYYLHSVEEAAEHNARLGVNLEPGQFTPWEDIPSGTDVLFYEGLHGGVKGEGYDVAALADLLVGVVPITNLEWIQKIHRDNAERGYSAEAIVDTILRRMPDYINHICPQFSQTDINFQRVPTVDTSNPFICRNIPTPDESFVIIHFRKGAREKWGIDFGYLLNMIHDSFMSSPTSIVVNGGKMGFAMELILTPIIHRMIEEKNKLS

SEQ ID NO: 34266 - protein, 432 aa, Vitis vinifera
MASNRDDPLTFINPSSSPITVSSAEGDSFLLEPASQIGSASGSFQNEGLLSGGDGTSDAEFGFSRPDFRQSPLAGTVQLYDRHVFLCYKHPQVWPPRIEAAEFDRLPRLLSAALMARKSEMKKQTRLTICEGHDGTETSNGDVLIFPDMIRYRRLTHFDVDTFVEEVLVKDGEWQPVTPEKLIGSCIFVCSHGSRDRRCGVCGPAVVARFKEEIESHGLQGKVSVSPCSHIGGHKYAGNVIIFGSNIDGKVSGHWYGYVTPDDVPILLEQHIEKGEIVYGLWRGQMGLSEEEQTKSQELRVQLNGGTGDGKPTKETLQTQTNEMDTAACGSQIEVMACCQENGNSSCCQNPVLSGKMEKLFEREAKVTPEKKKSSKMTISRSSSNKSACTRKVCAMPTWFESWEREDTYAALAVVCAAVSVAIACHCYKQLT

SEQ ID NO: 34267 - protein, 328 aa, Thermoanaerobacterium thermosaccharolyticum
MSIIQSIIEKAKSNKKKIVLPEGAEPRTLKGPDIVLKEGIADLVLLGNADEIRNAAEGLDISKAEIIDPLKSEKFDKYATDFYELRKNKGITLEKAKETIKDNIYFGCMMVKEGYADGLVSGAIHATADLLRPAFQIVKTAPGAKIVSSFFIMEVPNCEFGENGVFLFADCAVNPSPNAEELASIAVQSANTAKTLLGMEPRVAMLSFSTKGSASHELVDKVRTATEIAKNLIPDVAIDGELQLDADVVKEVAELKAPGSPVAGRANVLIFPDLQAGNIGYKLVQRLAKANAIGPITQGMGAPVNDLSRGCSYKDIVDVIATTAVQAQ

SEQ ID NO: 34268 - protein, 357 aa, Synechococcus sp. CC9605
MAQHRVVLLPGDGIGPEITAVARQLLEVVSRRHGFSLSFEEQPIGGSAIDATGEPLPASTLDACKAADAVLLAAIGSPCFDSLPREKRPETGLLGLRAGMELFANLRPVKIVPALIDASSLKREVIEGVDLMVVRELTGGIYFGQPKGRIETEGDERGFNTMTYSASEVDRIAKVAFEIAQERRGRLCSVDKANVLDVSQLWRDRVDAMAPSYGPVEVSHMYVDNAAMQLVRDPRQFDVLLTGNLFGDILSDEAAMLTGSIGMLPSASLGSEGPGLFEPVHGSAPDIAGQDKANPMAMVLSAAMMLRIGLKQAAAADDLEAAVDAVLAGGFRTGDLMAEGCTQLGCRAMGEQLLKAL

SEQ ID NO: 34269 - protein, 244 aa, Photobacterium sp. SKA34
MLTDKVCLVTGGAQGIGRCIVETFANQGAKQVFVCDMNFGAMADLEQQFPNVTALELNVCDRANVSEAITKIAQQYGTIDVLVNNAGITRDNLIENMSENDWDLVVDVNLKGVFNMTQAIAPLMMASGSGSIITMSSVVGTDGNIGQTNYAATKAGVIAMTKSWSKEFARKGAKVRANCVAPGFIETPMTVDLPEKVIDYMVSKTPLKRMGQAQDIANGVLFLASDNSSFITGQTLKVDGGLVI

SEQ ID NO: 34270 - protein, 65 aa, Triticum aestivum
  misc_feature (28)..(28): Xaa can be any naturally occurring amino acid
  misc_feature (34)..(34): Xaa can be any naturally occurring amino acid
  misc_feature (47)..(47): Xaa can be any naturally occurring amino acid
  misc_feature (57)..(57): Xaa can be any naturally occurring amino acid
MVRVATFFGMTFGAFLFWESMDKVHVWXIALHQXDKKQERMEREMGXIRKMQADLIXAKAKESES

SEQ ID NO: 34271 - protein, 114 aa, Leavenworthia stylosa
LVEKFGIDPNNAFAFWDWVGGRYSVCSAVGVLPLSLQYGFSVVEKFLKGASSIDQHFKSTSLEENIPVLLGLLSVWNVSFLGYPARAILPYSQALEKFAPHIQQVSMESNGKGV

SEQ ID NO: 34272 - protein, 184 aa, Synechococcus sp. CC9605
MSESGPGKSSDHPTLLVRDREGHDLLCFLEHLIPIEGQDYALLSPVDTPVSLFRLNDDAEPVPITEVASSEPILSVADVVLQEHDLVLVRSAITLTVSGELEEPDQDELDELEEDDDVDEDAETFELLVSFMVEAEEYGLYIPLDPFLVLVRMVDGQAVLLSDDELDRVQPLIEAELEEREWPD

SEQ ID NO: 34273 - protein, 294 aa, Burkholderia pseudomallei K96243
MLKVTKAVFPVAGLGTRFLPATKASPKEMLPIVDKPLIQYAVEEAIAAGITEMIFVTGRSKRAIEDHFDKSYEIEAELEARGKEKLLTLVRGIKPRHVDCFYVRQAEALGLGHAVLCAQKLVGDSPFAVVLADDLLDGRPPVLRQMIDVFNHYHTSVIGVEQIAPQDSKSYGVIDGKRWEDNLFKLSGIVEKPEPAAAPSNFGVVGRYVLTPRIFDHLRALKPGAGGELQLTDALQSLLKDEQVLAHRYDGLRFDCGSKIGYLKATVEFALRHPEVAPEFERYLSERFPELVAA

SEQ ID NO: 34274 - protein, 418 aa, Prunus persica
  misc_feature (404)..(404): Xaa can be any naturally occurring amino acid
  misc_feature (414)..(414): Xaa can be any naturally occurring amino acid
QLQSWEKTVDCHSPGQGLMPASFKVKTVPLDGMNGEFEEVLDPDFGESAIGRVAPVDSGLWWIILLRAYGKITGDYALQERVDFQTGIRLVLNLCLKNGFDMFPTLLVTDGSCMIDRRMGIHGHPLEIQALFYSALRCSREMLIVNDGTKDLVAAINNRLSALSFHMREYYWVDMKKINEIYRYKTEEYSTDAVNKFNIYPDQIPSWLVDWIPEEGGFLIGNLQPAHMDFRFFTLGNLWSIVSSLGTHKQNEDILNLIEAKWDDFVAQMPLKICYPALEYEEWRIITGGDPKNTPWSYHNGGSWPTLLWQFTLACIKMGRTELAQKAVDLAEKRLSADQWPEYYDTKSGRFIGKQSRLFQTWTIAGYLTSKMLLENPEKASLLLWEEDYELLETCVCALTKTGXKKCSRLAAKXQIVV

SEQ ID NO: 34275 - protein, 118 aa, Zea mays
ESIPLSEQEDLIVWMRTAALPTFRKLYGKIGVDLNEGENITVTLQNNYNTYSFNGKKKLVLSTTSWLGGKNDFLGIAYLTVGGLCFFLALAFTIVYFVKPRQLGDPSYLSWNRNPGGH

SEQ ID NO: 34276 - protein, 637 aa, Emericella nidulans
MDPNNNRPHLNFGYNERAFNPAAANNRAYPTTPSAFPQPIYQSQSPQDYMDAQNGVYGQGYFMPNNYPAQAAYAQPHYGQPNLQSPQPAYQSRMGYNVSPNDGTNGLIQQFSNQDLNSNRTGFFNRSASPAQRPRTAGNTAPGQQQQPGHLAPPVPRSPRLPPENEELQRYPERFSENVHKRGKAAKELVNVFFHENIERARDRNMRSAELDKMMRDPNISQDAKVKEAEMVGKKESTFLRFLRTPETPANFQTIKIIGKGAFGEVKLVQRKSDNKIYALKSLIKSEMFKKDQLAHVRAERDILADSKDNPWLVKLHASFQDPAYLYLLMEFLPGGDLMTMLIKYEIFSEDITRFYMAEIVMAIEAVHKLGFLHRDIKPDNILLDRGGHVKLTDFGLSTGGKKTHDNSYYQNLLKNSTSKDKNRNSGYFNDAINLTVSNRGQINTWRKSRRAMAYSTVGTPDYIAPEIFNGQGYTYLCDWWSVGAIMFECLVGWPPFCAEDTTDTYRKIVNWRECLYFPEELTLSRESEGLIRSFLCDAEHRIGNEGGQYGGATQIKNHPFFRGVVWDQLRKIRAPFEPRLTSNIDVSYFPIDEIPQEDTSAIHRAQARAMPDEQNAEMSLPFIGYTYKAFNAFQAS

SEQ ID NO: 34277 - protein, 334 aa, Prochlorococcus marinus str. AS9601
MSYIQHNSIKNIHKLSIAPMMDCTDKHFRMIMRKISSEALLYTEMIVAQSLVHTNKKENFLDFNGEEHPISIQFGGDDPKILKEAARMAQDWGYDEINFNVGCPSPRVCSGNFGASLMKDPEKVAKCIESLKLNCDLPVTIKHRIGVDNDDSFVKLNNFVRIVANAGADRFTVHARKAILTGLNPKQNRTIPPLNYDVVKKLKNLNPSLLIEINGGLTNIDESLKALNDFDGVMIGRSIYKHPLRWSEIDQKIYGINTKPKSASNIIFSLIPYIEKHLSNGGKSWDICKHLINLVEGIPKAKIWRNQISNKSIKKELNIEYLFKLTTALKEMGY

SEQ ID NO: 34278 - protein, 177 aa, Herbaspirillum seropedicae
MSLNNVPAGRDLPNDFNVIIEIPMNADPIKYEVDKDTGAIFVDRFMGTAMHYPCNYGYIPQTLSQDGDPVDVLVITPFPLIPGVVVRCRPIGVLKMADESGIDAKLLAVPVDKILPIYTHWQKPEDLNELRLNQIKHFFEHYKDLEKGKWVKVEGWEGPDAARAEILAGVEAYKNAK

SEQ ID NO: 34279 - protein, 164 aa, Prochlorococcus marinus str. AS9601
MNQFLSRRIFILIPTMSILKIFFKPMQVLASSLASKEAWNFSRDEWKSRLSPESYYILREEGTERAFSSQLNNEKRKGIFHCAGCDLPLFSSDKKFDSGTGWPSFWDSIQGSVETKVDFKLIVPRTEYHCARCGGHQGHVFNDGPLPTGKRYCNNGLALRFVPD

SEQ ID NO: 34280 - protein, 503 aa, Mycobacterium sp. MCS
MLRRRALTEDAARPEAVARRHEAGGRTARENIADLVDEGSFVEYGRFAIAAQRARRDLDDLIARTPADGLIAGTARIGGAACAVLSYDYTVLAGTQGALGHRKKDRLFDLIERMRLPTVFFAEGGGGRPGDTDFPVASSLDVRAFKLWAGLSGLAPRIAVVKGRCFAGNAVIAGCADLIVATSDTSIGMGGPAMIAGGGLGDVPPDAVGPITTQEPNGVVDIVVDDEAQAVAVARTLIGYFGGPAAPGEAPDQSALRTAVPERARRAYDVAPIIRTLADDGSATFLRERFAREMVTALIRIEGRPVGVLANDTRFMAGAITAAASDKAARFLQLCDAFDIPVLSLVDCPGYMVGPAAEAEALVRRGSRLLVAGAALQVPLIAVVLRRGYGLGAQAMTGGGLHEPLLTVAWPGAHLGPMGLEGAVRLGLRKELEAIADDAEREEAVRRATAAAEDNAKALNAAAVFEIDDVIDPAETRSLVAATLAAASAAPRERHPHRFVDTW

SEQ ID NO: 34281 - protein, 547 aa, Zea mays
  misc_feature (188)..(188): Xaa can be any naturally occurring amino acid
MGLGLGALLKSGGLSVSDHDAIVSINIFIALLCSCIVIGHLLEGNRWVNESITALVMGLITGGVILLVTNGTNSRILVFSEDLFFIYLLPPIIFNAGFQVKKKQFFRNFITIILFGAIGTLISFVIISLGAMGLFKKLDVGPLELGDYLAIGAIFSATDSVCTLQVLNQDETPLLYSLVFGEGVVNDXPTSVVLFNAIENLDIDNFDAIVLLNFVGKFLYLFFTSTILGVATGLLSAYIIKKLCFARHSTDREVSIMILMAYLSYMISMLLDLSGILTVFFCGIVMSHYTWHNVTESSRVTTKHTFATLSFIAEIFLFLYVGMDALDIEKWKLASSSPKKPIALSAIILGLVMVGRAAFVFPLSFLSNLSKKEARPKISFKQQVIIWWAGLMRGAVSIALAYNKFTASGHTEVRVNAIMITSTVIVVLFSTMVFGLLTKPLLSLLIPPRTGLNTSSLLSSQSMLDPLLTSMMGSDFDVGQINSPQYNLQFILTAPARSVHRLWRKFDDRFMRPVFGGRGFVPFVPGSPVERSVPESHLGTVTEAEGS

SEQ ID NO: 34282 - protein, 97 aa, Oryza sativa
AWLLLLKKSGAKYTILYASQPYGLLESPSNLPLGRYLAEKTNTTKPGRGKCDGECLVKSTLLEGSFVGIVLLIILISGLKCMMGIDTPSKFDAPPES

SEQ ID NO: 34283 - protein, 213 aa, Zea mays
MDAADARPSAPSAAAAAVAGASVADEPRDARVVRELLRSMGLGEGEYEPRVVHQFLDLAYRYVGDVLGDAQVYADHAGKAQIDADDVRLAIQAKVLLELARSRNRMPLPKSIAPPGSIPLPPEQDTLLAQNYQLLPPLKPPPQFEETEDENEESNPSLTPNPANSNPTFSQDQRSNEQQHTPQHGQRVSFQLNAVAAAAAKRPRMTVDQLNIG

SEQ ID NO: 34284 - protein, 228 aa, Buchnera aphidicola str. APS (Acyrthosiphon pisum)
MNKFFLAPSILSADFARLGEDIKKVIDAGSDLIHFDVMDNHYVPNLSMGPMILESLRNYNITAPIDVHLMVKPVDNLIPQFAKAGATFITFHPEATLHIERTLNLIKENGCKAGLAFNPATPLNFLDYILEKLDLILLMSVNPGFGNQSFLPSTFNKLREVRKIIDANFSDILLEVDGGVKLDNIADIACAGANVFVMGSGLFKYSNYKLVIEKIRKKLEYAHSRSIH

SEQ ID NO: 34285 - protein, 290 aa, Glycine max
MSITSLTMAESCLLSSPSSLFHTKTKPSLFTPPSKPLTLQFSCLNSSVSLSLAAPTHRSPLVTFVAQTSDWAQQEEEQSLAETEAGLESWEPNGEDAGDESFVEPPEEAKLFVGNLPYDVDSQKLAMLFEQAGTVEIAEVIYNRETDQSRGFGFVTMSTVEEAESAVEKFNRYDIDGRLLTVNKASPRGTRPERPPPRRSFESSLSIYVGNLPWDVDNTRLKQIFSKHGNVVNARVVYDRESGRSRGFGFVTMSDETEMNDAVAALDGESLDGRAIKVSVAEDRPRRGSF

SEQ ID NO: 34286 - protein, 392 aa, Triticum aestivum
  misc_feature (34)..(35): Xaa can be any naturally occurring amino acid
  misc_feature (230)..(230): Xaa can be any naturally occurring amino acid
  misc_feature (234)..(234): Xaa can be any naturally occurring amino acid
  misc_feature (247)..(247): Xaa can be any naturally occurring amino acid
  misc_feature (257)..(257): Xaa can be any naturally occurring amino acid
  misc_feature (274)..(274): Xaa can be any naturally occurring amino acid
  misc_feature (276)..(277): Xaa can be any naturally occurring amino acid
  misc_feature (282)..(282): Xaa can be any naturally occurring amino acid
  misc_feature (297)..(297): Xaa can be any naturally occurring amino acid
  misc_feature (308)..(308): Xaa can be any naturally occurring amino acid
  misc_feature (319)..(319): Xaa can be any naturally occurring amino acid
  misc_feature (323)..(323): Xaa can be any naturally occurring amino acid
  misc_feature (341)..(341): Xaa can be any naturally occurring amino acid
  misc_feature (349)..(349): Xaa can be any naturally occurring amino acid
  misc_feature (366)..(366): Xaa can be any naturally occurring amino acid
  misc_feature (375)..(375): Xaa can be any naturally occurring amino acid
  misc_feature (384)..(384): Xaa can be any naturally occurring amino acid
  misc_feature (388)..(388): Xaa can be any naturally occurring amino acid
REQKLELHRGGGRSRTSGSPGLQEFGTSNRESSXXALQHKKEIAKRLGRPLISTTPYEDVIACDVINPDEIDVEFESVGGLDEVKQALYELVILPLRRPELFAYGKLLSPQKGVLLYGPPGTGKTMLAKAIAKESGAVFINVRISNLMSKWFGDAQKLVSAVFSLANKLQPAIIFIDEVDSFLGQRRNTDHEALTNMKTEFMSLWDGFTTDQNARVMVLAATNRPSELDXAILXRFTQIFEIGVPSXNERTRYLRVXLKGENIESNIDYEYLAXLXXGFTGXNILKTGKQACILSYXGRILNQRERWXPRANSPRPLRXNRTXKKPLSTSRKGEKKAPSGXDIGAPVTXVGIRPSDPEDDQAQSAXFEISKLRSXRIVKNSQSXEPQXPSSP

SEQ ID NO: 34287 - protein, 484 aa, Mycobacterium smegmatis str. MC2 155
MNYQDAIAGLDAKHGILIDGNARGADATFDVHDPATGEVIAAVSDGSAADAVAAVDAAQKAFGAWAATSPRERSEILRRAYELILADIDRLSALVCAENGKSQADARAEVTYAAEFFRWFSEEAVRTDGAFGSNPAGNARTLVTHKPVGVAALVTPWNFPAAMATRKIAPALAAGCTVVLKPAAETPLTALAIAAILTDAGVPAGVVNLVPTSDAGAVVSAWLADARVRKISFTGSTGIGRVLLKQAADRVVNASMELGGNAPFVVTADADIAKAVEGAMLAKFRGAGQVCTAANRFYVHASVHDEFVAAFAAKIEALRVGPAADPASEIGPLVSPRAAQRVSAAIDAAVADGAVVAAKAPTPTEGWFVAPTLLTDVAPDAAILTDEIFGPVAPVVAWEDEDELLRWANDTEYGLAAYVFAGRLQDALRIAERIDAGMVGVNRGAVSDPSAPFGGMKQSGLGREGAREGLQEFQETQYFSVAFD

SEQ ID NO: 34288 - protein, 438 aa, Coccidioides immitis RS
MAEPPPSEAERIYYPESDVEDLEGYRPGGYHPTFIGDTFCGGRYKIVHKLGFGGYSTVWLAHDQQLQCYVSLKILVAGASQGSNENETLCLLTKGEPNCLGRQFIPTLLDQFSFDGPNGYHLCLVGESAGCSIANSKENSTNFMFPRDAARSIAAQLIMGLNYLHANDVCHGDGSWITNFQRIGTPVFRHLHQRMWDMGRGEMPEACEWDVAGGELKALEDMLRAMMAFEPAERPTAKQLMMSEYMVKWAMPAWERQMKRKRAYAVEQSYNSLPSKDSAANKLVHDLHLTGYLSMMCSSTLQLDEDRAASHAAELKRVEKHAHERAAQAAEEVRAERDAERERLQRETDEQAARLALQQEAAEMMARRVREAAERTPQGVDQAHSQGNNGRAEQDGLERQVADVSKSHNEAEGSPVENMDEIEIDVDPTSEASEYKQK

SEQ ID NO: 34289 - protein, 340 aa, Prochlorococcus marinus str. AS9601
MTLRVAINGFGRIGRNFMRCWLSRGAYTNIEVVGINVTSDPKTNAHLLKYDSVLGQLDGVDIQYTDDTFVINNKTIKCFSDRNPMNLPWKEWGVDLVIESTGVFNTDVGASKHLEVGAKKVILTAPGKGDGVGTYVVGVNADTYKHKDYDILSNASCTTNCLAPVVKVLDQTFGINKGLMTTIHSYTGDQRILDNSHRDLRRARAAATNIVPTSTGAAKAVALVYPEMKGKLTGIAMRVPTPNVSAVDFVFESSKSVTAEEVNTALKEASLGSMKGIIKYGDEPLVSSDYAGTNESSIVDSDLTMCIGDNLVKVLAWYDNEWGYSQRVVDLAEIVAKNWE

SEQ ID NO: 34290 - protein, 380 aa, Desulfococcus oleovorans Hxd3
MKALLALEDGRTFACKSFTGPGETGGEIVFNTGMSGYQEVLTDPSYRGQIVTMTYPLIGNYGVNHQDVESDRVQVAGFVVREYQDCPSNFRSEQSLAKYLQSQGVLGITDLDTRALTRHLRTVGALRACISTHELDPAALVEKALAVPSMAGCDLVTGVFSKKPYRWINGAPAAVDMDLADMDERVWHKTGGFRVAAFDFGIKYNILRNLEAAGFQVLVVPAGATAAQVKQVNPDGIFLSNGPGDPEPLTGPVATIRELLDYRPMFGICLGNQLAGLALGGATYKLKFGHRGANQPVKDLETGKIEITSQNHGFAVDIDSLKKENLVVTHINLNDNTLEGFAHKDIPLFTVQYHPEASPGPHDARYLFDRFKALIEKTHA

SEQ ID NO: 34291 - protein, 385 aa, Oryza sativa Japonica Group
MAREPSPEIDDELFNEVYGKAYSGPVATTTNNVTPRVNDEKRPLEREKSDEEDGPPDPNAVPTDFTSREAKVWEAKAKATERNWKKRKEEEMICKICGESGHFTQEGKGKNTSSSPKRDRLRSPVRTTSDIRPRHTDSRWSHSPRSAPRSQSKGYYNERPLDGRSHDDMPKFSKESPQARASANYGAKGRPAQSKSPCQPSYIDDSLRSNDGNNQYAATYVPNTWSTETRGTDSRLSLKFDLPSYPQTLEELEMEFKREAMELAIARDKEEDEENYKHRESLREMRENHMKRVTAMRSMHSRKWDEFLEQSFKRHQQAHPTSYAQTSYPDYDQRATQFAATGPPNDSKSEYPYITDSYSAPRPHAAYSEFEHERHDDFGRTYGRY

SEQ ID NO: 34292 - protein, 181 aa, Vigna radiata
MASSMISSPAVTTVNRAGAAGMVAPFTGLKSLGGFPTRKTNNDITSVANNGGRVQCMQVWPTIGKKKFETLSYLPDLTEEQLGKEVDYLLRSGWIPCLEFELSHKDAFPHRENNRSPGYYDGRYWTMWKLPMYGCTDSSQVLKELREARTLYPDGFVRIVGFDSVRQVQCISFIAYKPPGY

SEQ ID NO: 34293 - protein, 310 aa, marine gamma proteobacterium HTCC2143
MIFTGNANPTLAKSVAAQLHLPLGDADVGQFSDGEVAIEINENVRGADVFIIQSTCQPTNDNLMELIVMIDAMRRSSAGRITAVVPYFGYARQDRRVRSSRVPISAKVVADMMTGVGVDRVLTVDLHAEQIQGFFAVPVDNVYGSPVLLDDINVQNYSNMVVVSPDIGGVVRARAVAKQLDDCDLAIIDKRRPQANEAQVMHIIGEVKGRTCVLVDDMVDTAGTLCKAAAALKENGAEKVVAYCTHPVLSGKALENINNSELDELVVTDTIPLSKEAEACGKIRVLTMANLLAESVRRVSNEESISALFR

SEQ ID NO: 34294 - protein, 258 aa, Triticum aestivum
  misc_feature (189)..(189): Xaa can be any naturally occurring amino acid
  misc_feature (196)..(196): Xaa can be any naturally occurring amino acid
  misc_feature (207)..(207): Xaa can be any naturally occurring amino acid
  misc_feature (238)..(238): Xaa can be any naturally occurring amino acid
MSWCTIYSDPGVDAELIQEMQVKGVQVEELYSLDVDSLMQVQPEYGLILLFKWMPGGNDERTVVCDPNPKLFFARQVITNACATQAILSIVMNGPEIDVGPELSDLKEFTGAFAPDMKGLDINNSVLIRVDHNSFAMPDAFVSDDQVAANYDYEVYHLISYIPSDGVLYGLDGLKEGPITLGRYPAGPXDLGWLKXVPRVIWERIRXKPQSEIRVDLMAIIRNGMGLYNAELKDLEKXRDHILRGLNVGAKTSLKIDP

SEQ ID NO: 34295 - protein, 446 aa, Vitis vinifera
MCRGSTSSDVSDESTCSSLSSSISKPHKANDSRWEAIQVVRAKDGALGLNHFRLLKRLGCGDIGSVYLSELKGTKCYFAMKVMDKGSLASRKKLLRAQTEREILQSLDHPFLPTLYTHFETEKFSCLVMEFCPGGDLHTLRQRQPGKHFSEQAVKFYVAEVLLALEYLHMLGIVYRDLKPENVLVREDGHIMLSDFDLSLRCTVSPTLVKSSSFDTEPLRRNPVYCVQPTCIEPSCIQPSCVAPTTCFSPRLFSSKSKKDRKPKNEIGNQVSPLPELIAEPTGARSMSFVGTHEYLAPEIIKGEGHGSAVDWWTFGIFLYELLFGKTPFKGSGNRATLFNVVGQPLRFPESPVVSFSARDLIRGLLVKEPQHRLAYKRGATEIKQHPFFEGVNWALIRCASPPEIPKPVEIERVPAPAASSSEKAAAAMAGPDQKSCDNYLEFDFF

SEQ ID NO: 34296 - protein, 600 aa, Phanerochaete chrysosporium
MLVSVDALALRTLVYELTYLLYPAVPTAAALLLLQRLGSVWLPTWTIVLLSLCSVPVAHRILLWLKDWRAARKAASMGAILPPRLKGRWPGSIDLLRQLTKTFETGFLSEMLWGYMHVLGQTFEVYILWDSNYVTSDANVIKTILATDFDNFVKGEKLDVCVRPVLGTGVFNSDGEMWKFHRSMTRPFFTRERISHFDLFDRHADATMAKMKARLAEGFAVDFQDLISRFTLDSATEFLFGQCVHSLASVLPYPHDAPAHLQTTGASRTEDFARAFAEAQDAVSFRLRMGWLWPWFELFGSRTKAPMAVVDAFLDPILRDAVARADKIKRENGGRVPEVKGEIEEDETLLDHLVNVVQTKILHDEVLNIMIAGRDTTGGTLTSAVYFLSQYPEVLRRLREEILEKVGPTRRPTYDDIREMKYLRAFINETLRLYPAVPWNVRYPVKDTTIPGPHPDKPYFIPANTPVSYSVHCMHRRTDYWGPDAEAFDPDRFLDARVQRYLTPNPFIFLPFNAGPRICLGQQFAYNEMSFFVIRLLQHFDEVQLCEDALAPDCRVPDAWRGAPGRKGVERFWPKAHLTLYAKGGLWVKMREASTSEAVV

SEQ ID NO: 34297 - protein, 274 aa, Streptococcus thermophilus LMG 18311
MYVGYLGPSGSFTHNAALKAFPEASLVSLGTITEVIKSYEEGRVDYAVIPVENSIEGSVHESLDYLFHQADIRAVAEIVQPIKQQLMASKHHAKIEKIFSHPQAIAQGKKYIKDHFPHAKIETTASTAFAARYVADNPDQPYAAIAPHAAAKEYGLEILAKDIQEIEKNYTRFWLLGSTVPEIPLNQINCKLTLALTLPDNMPGALYKALSTFAWRGIDLTKIESRPLKTVLGEYFFIIDCDYTKKKLAHFALEELTAVGIGYKILGAYQVYQI

SEQ ID NO: 34298 - protein, 363 aa, marine gamma proteobacterium HTCC2143
MGFNCGIVGLPNVGKSTLFNALTKAGIDAENFPFCTIEPNSGIVPIPDPRQDKLADIVSPERVVPTTMEFVDIAGLVEGASKGEGLGNQFLANIRETDAIAHVVRCFENENVIHVANKIDPANDIEIINMELALADLDSVEKQLQRVTRNAKGGDKEAAAQKALIEKLIPHLEEGVSVRSLSLSEAEQAILPSLHLLTTKPTMYIANVDEDGFEDNPFLDVVREIAAAENAALVPICNKLESEIAELDEAEKAEFLEDLGMEEAGLNRVIRAGYELLGLQTYFTAGVQEVRAWTIPIGATAPQAAGVIHTDFQRGFIKAEVVSYSDFVEFSGEQGAKEAGKLRLEGKDYIVKDGDVIHFKFNV

SEQ ID NO: 34299 - protein, 390 aa, Clostridium thermocellum ATCC 27405
MDYRKESLRLHGEWKGKIEVIHKVPVSTKEELSLAYTPGVAEPCLAIQKDVNLSYEYTRRWNLVAVITDGTAVLGLGDIGPEAGMPVMEGKCVLFKKFGDVDAFPLCIKSKDVDEIVKTIKLISGSFGGINLEDISAPRCFEIERRLKEECDIPIFHDDQHGTAVVTVAAMINALKLVNKKIEDIEVVVNGSGAAGIAVTRLLMSMGLKKVILCDTKGAIYDGRDNLNSEKALIAKISNLEKKKGTLEDVIKGADVFIGLSVPGTVTKDMVKSMAKDPIIFAMANPTPEIMPDEAKEAGAKVVGTGRSDFPNQINNVLAFPGIFRGALDVRARDINDEMKIAAAKAIASLVSDEELNPDFILPLPFDPRVGKTVAAAVAEAARKTGVARI

SEQ ID NO: 34300 - protein, 388 aa, Crocosphaera watsonii WH 8501
MKAMILAAGKGTRVRPITHTIPKPLIPILQKPVMEFLLELLRKHGFDEIMVNVSHLAEEIEGYFRDGQRFGVQIGYSFEGKIVDGDLVGEALGSAGGLRRIQDFNPFFDDTFIVLCGDALIDLDLTAAVKYHRDKGAIATIITKSVPKESVSSYGVVVSDEEGRIKTFQEKPSVEEALSTNINTGIYIFEPEIMNYIPPNQKYDIGGELFPMLVEKGAPFYAVNMDFEWVDIGKVPDYWHAVRGVLSREIKNVQIPGIEVKPGIYTGLNVSVNWDKVNIQGPVYIGAMTHIEDGATIIGPSMIGPNCWVCSGATVDNSVIFEYSRLGPGVRLLDKLVFGRYCVDKTGAAIDVQAAALDWLITDSRQTFPDDTQIPQQAIAELLNQDNG

SEQ ID NO: 34301 - protein, 430 aa, Polaromonas sp. JS666
MPSNQPTTNAALMARRKAAVARGVGQTHEIFVSRARNAEFWDVEDRRYIDFAGGIAVLNTGHLHPQVIAAVKTQLDLYTHTCFQVVAYEPYVELSEKLNALAPGNFAKKTLLLSTGAEAVENAVKVARAYTKRPGIIAFTGGYHGRTNMTLGMTGKVAPYKLGFGPFPGEVFHALYPNVLHGVSVDQALHSVELILKNDIEAERVAAFILEPVQGEGGFYIAPPEFITGLKALADRHGILLIADEVQTGAGRTGTWFASEQWPVAPDLITTAKSMAGGFPISGLVGRADVMDAPAPGGLGGTYAGSPIGCAAALAVLKVFEDEKLLERSKALGAHLLKGLRAIAEKEVTIGDVRGLGAMVAMELFENGDVARPNAALTQRVVAEAARRGLILLSCGTYGNVIRILVPLTANDALLDEGLKILADSFSALR

SEQ ID NO: 34302 - protein, 560 aa, Bacillus cereus ATCC 10987
MKFSSKQRKDVLNGVNKQELDVIVIGGGITGSGIALDGATRGLSTIVFEMQDFAAGTSSRSTKLVHGGLRYLKQLEVKMVAEVGKERAIVYENGPHVTTPEWMLLPFHTGGTFGSFSTSIGLRVYDFLAGVKRSERRKMFNREETLKKEPLVKQEGLKGGGYYVEYRTDDARLTIEVMKEAIEHGAKAVNYAKVDSFLYKDGKVCGVRVIDLLDGEVYEVYGKKIVNAAGPWVDTLREKDNSKKGKVLQLSKGVHLVIDQKRFPLGQAIYFDTPDKRMVFAIPRGGKTYVGTTDTFYDKDAAVPQMTTEDRTYIINAINYMFPSVKITEKDIESSWAGVRPLIYEEGKSASEISRKDEIWTSESGLITIAGGKLTGYRKMAEMVVDYVTNLLQKEGHSAYPKSTTKHMPISGGHVDGSKGLPAFIAKKAGEGTKYGLTTAQAEEFAKFYGSNVDVLFELAKKHKDEAKEYNMPLDVLIPLVYAMDYEMTAKPVDFFVRRRGAVFFNIHWVYEWKEAVINYMAAKLGWSKEEQMKYTAELEKALTDAVIPVDQQEHAAALA

SEQ ID NO: 34303 - protein, 492 aa, Polaromonas sp. JS666
MDMKTSPISLLKDPSLFKTDALINGQWVAGGSRFDVNDPSNGQKLADVANLGSQDAEAAIAAANAAWPAWRSKTGKERHAILMKWYQLLMANQEDLGRIMTAEQGKPFAEAKGEVAYGASFVEWFAEEAKRVNGETLPQFDNNRRLMVIKQPIGVCAAITPWNFPLAMITRKVAPALAAGCPVVIKPAELTPLTALAAAELAVRAGIPAGVLNVLTADSANSIAVGKVFCASDVVRHISFTGSTEVGRILMAQSAPSVKKLSLELGGNAPFIVFDDADIDSAVEGAMASKYRNAGQTCVCANRIYVQDGVYDQFVEKFAAKVKLLKVGNGFEDGVVQGPLIEDSAVDKVQRHVADALAKGGKLQAGGHKLQGQFFEPTVISEATADMLCAREETFGPFAPVFRFKAEQEAIDAANNTEFGLASYFYSRDIGRIYRVAEALEYGMVGINAGVIATEHVPFGGVKQSGLGREGSSHGMEEYVEMKYLCLGDILK

SEQ ID NO: 34304 - protein, 178 aa, Burkholderia pseudomallei K96243
MRTTLKRTLDAIAEDRRRNAFFKTRCVVVFFRIANYLACRSRLTLALGAPVIALYIVVCDWIMGIEIPVKTKIGKGLTLYHGTGLVINGYCEIGERCVIRHGVTIGNTLRPDGTYSGVPSVGDDVEFGAHSIALGEIRIGHRARVGAGAVLLRDVPDGGVAVGVPARVLENGKEQSAA

SEQ ID NO: 34305 - protein, 290 aa, Physcomitrella patens subsp. patens
MHEAEEPVPNIDEHDVGNQLAVVDYIEDIYSFYRKSEVQSCVPPDYMSRQSDINEKMRAILIDWLIEVHLKFKLMPETLFLTTNLIDRYLCIQSVSRKNLQLVGVTAMLLAAKYEEIWAPEVNDFVHISDNAYSREEVLTMEKNMLNTLKFNLTVPTPYVFIVRLLKAAACDKQEKTASTQLEMVAWFLVELCLSEYPMIKYAPSLIAAAAVYTAQVTLARQPRWGPALQRHSGYSEAQIKECASLMANLHSKASEGNLTVVHKKYSLAKLLGVAKLPHAASLCAALSSS

SEQ ID NO: 34306 - protein, 209 aa, Physcomitrella patens subsp. patens
MKLFGVVKVLRCSLHLKCLYFPRGCEDLGFVFQVGLLGMARTLQKDLDRIANQADTTTAEGLHSVLTETCLALMRHPEYCTSAFASTDVNRSAAGAEERFNNLSLEERAKFDAETLINVNNLRKKIMAAPKSERLNNEYIVVTILVAADGEFKLPAINSNADLKAALRKLGSIPTDAIQSVEVLWTPQDEDDTLNERELLRDYPLLLSL

SEQ ID NO: 34307 - protein, 138 aa, Triticum aestivum
  misc_feature (104)..(104): Xaa can be any naturally occurring amino acid
  misc_feature (113)..(113): Xaa can be any naturally occurring amino acid
  misc_feature (122)..(122): Xaa can be any naturally occurring amino acid
MSLSNKLSITDVDLKGKRVLIRVDFNVPLDSALKVTNTQRIAGATPTIKYAIENGCKSVILMSHLGRPDGKVQPKYSLKPVVPELEALLGRSVEFASDCVGPRXEDIVNKAQXGQVVLLENXRFHLKEEGSTRTRWNK

SEQ ID NO: 34308 - protein, 320 aa, Dehalococcoides ethenogenes 195
MDNITPEHNKHTNQNIAPDITKLIGNTPLVRLNRIGSGLKAEIVLKLESFNPTHSAKDRPALHMIEKAEQEGKLRPGSIIIESTSGNTGIALAAVCAARGYRLMLTMPESFSLERRRLLRLLGAELVLTPKELGMQGALEKAAELKNKLPETFIPGQFVNPANPESHCQTTAAEIWRDTNGKVDILIAGVGTGGTLSGTAKGLKAVKPSVQIIAVEPVESPVLSGGEPHPHLIQGIGAGFIPRILSVELIDKVIQVPGEEAVKMALRLAREEGIMAGISSGAALWAALETAKQGENCGKLIVAIMPDSGERYLSSLPLGD

SEQ ID NO: 34309 - protein, 456 aa, Rhodococcus opacus
MVVDVTELRARARRHLGPHFTRKDTWESDFPVFVRGEGSYLIDTEGDRFLDGLAGLFCVNIGHGRDDIAKAASEQIGTLAYASNWGSAHIPAIEASALIADLAPGDLGTTFFVNSGSEAVETAVKFARQYHRSQGNPQRTKIISREMAYHGTTLGALSVTQLPKIKDPFGPLLPGVRSVPNTLGYLGDCGPANELDCIAAIEAVIEEEGAETIAAVFAEPVQNGRGALVPPDGYWAALRALCDKHGILLVSDEVICSFGRLGHWFGHGLTGVVPDMITFAKGSTSGYAPLGGLIVREQLVRELYDSPKGGVFTHGATWGGHPVSTAVAVANITAMRDENVLGNVSARGPKLRSALDSLMSSHRCVKDVRGTGFFYAIELMADSDSGREFTEQESLTVLRKVLPEAFARTKVILRGDDRGATMLMISPPLVADDEVLSELLHGIDSMLTDIEKAIQP

SEQ ID NO: 34310 - protein, 332 aa, Clostridium perfringens
MDNKNFQSKTGFNLENTYLTLPNIFFSEQNPKGSKNPKLIKFNTSLAKELGLNEEILNSDFGLNIFAGNETFPGITPIAQAYAGHQFGHFTMLGDGRALLLGEHVTKDGKRYDVQLKGSGRTIYSRGGDGKAALAPMLREYIISEGMHSLGIPTTRSLAVVSTGEEVLREKFEQGAILTRIASSHIRVGTFAYAAQWGTLEDLKSLADYTIKRHFPNIANSENKYILFLEEVINRQAELIVKWQSVGFIHGVMNTDNMVISGETIDYGPCAFMDTYDTNTVFSSIDYAGRYAYGNQPNMALWNLARFSEALLPLLNPNLDEAVNIAKKSISS

SEQ ID NO: 34311 - protein, 466 aa, Oryza sativa
  misc_feature (29)..(29): Xaa can be any naturally occurring amino acid
MNSLQSFLALNPPAAAAALGGARLRPSRXVTACLATPTPTPPTPTSAPLAPAAAAARRELSAASRAVVEDEARYIGRTYNRSRVVLVAGRGCELYDADGREYLDMAAGIAVNALGHADPDWVAAVSAQAATLVHASNVQYTVPQVALAKRLVEASFADRVFFANTGTEANEAAIKFARKFQRVARPDGDAPTEFMSFTNCFHGRTMGSLALTSKVQYREPFAPVMPGATFAEYGNLEEAKKVIQSGKIAAVFVEPVQGEGGIHSATKEFLQGLRDACDEAGALLVFDEVQCGLGRTGYLWAYEAYGVLPDIMTLPKPLAGGLPIGVVLVTEKVASAINFGDHGTTFGGGPLVCQAALTTLDKIQKPGFLAEVAKKGENFKQLLSTKLSGNAHVKEIRGIGLIVGIELDVPAGPLVDACLDRGVIVLTAGKGNVVRLVPPLIISEKELEQAAEVIRDCLPALDASTS

SEQ ID NO: 34312 - protein, 356 aa, Herbaspirillum seropedicae
MKIAILPGDGIGPEIVNEAVRVLNALDEKFEMETAPVGGAGYEAHGHPLPDGTLKLAKEADAILFGAVGDWKYDKLERALRPEQAILGLRKHLQLFANFRPAICYPELTGASSLKPELVANLDILIVRELNGDIYFGQPRGMREAPDGPFKGAREGFDTMRYSEPEIRRIAHVAFQAAAKRGKRLCSVDKANVLETFQFWKDIVTEVGKEYPDVELSHMYVDNAAMQLVKAPKNFDVIVTGNMFGDILSDAAAMLTGSIGMLPSASLDANNKGLYEPSHGSAPDIAGRGIANPLATILSAAMMLRFSLNKAEQADRIENAVKKVLAQGLRTADIYEEGCTKVNTQQMGEAVVKALA

SEQ ID NO: 34313 - protein, 460 aa, Oryza sativa Japonica Group
ASFRTVGAKITQETGDFFVSDAEGDPDKPTDGFSSIDEAIGALHEGKFVIAVDDESGDNEGDLVMAATLADPESIAFMIRNGSGIISVGMKEEDLTRLMIPMMSPIAEIEDISAAASTVTVDARVGISTGVSAADRAKTIFTLASPDSKPTDLRRPGHIFPLKYRNGGVLKRAGHTEASVDLVALAGLRPVSVLSTVINPVDGSMAGMPVLKQMALEHDIPIVSIADLIRYRRKREKLVELIAVSRLPTKWGLFRAYCYQSKLDGTEHIAVAKGDIGDGEDVLVRVHSECLTGDILGSARCDCGNQLDLAMQLIDKAGRGVLVYLRGHEGRGIGLGQKLRAYNLQDDGHDTVQANVELGLAVDSREYGIGAQILRDMGVRTMRLMTNNPAKFVGLKGYGLAVVGRVPVISPITKENQRYLETKRTKMGHVYGSDLPGNVPEEFLNPDDIAGDQDEDDTHN

SEQ ID NO: 34314 - protein, 434 aa, Ashbya gossypii ATCC 10895
MAVEFNLSSKQTVEYEQEYSAHNYHPLPVVFHKASGAHVWDPEGKEYLDFLSAYSAVNQGHCHPEIVQALVDQASRLTLSSRAFSNDCFAAFAKYVTEYFGYGMVLPMNTGAEAVETALKLARRWGYMKKGIAADEAIILGASGNFHGRTFGAISLSTDEEDTRKHFGPFLKNTTAELPDGSGEQIRFGELADLERAFKHAGERIAAVILEPIQGEAGIVVPPEGYLEGVQRLCREHNALFICDEIQTGIGRTGKMLCYEHSEGVRPDIVVLGKAISGGILPVSCVLADKDIMLCFEPGSHGSTYGGNPLSSRVAVAALEVIRKENLVERARVLGEKLRAKLESLQAESNGIISEVRGKGLLSAIVIDPSKANGRTAWDLCLLMKDAGVLAKPTHEHIIRLAPPLVISEEDLMHGVDVIKSSLEKLPTVEKAAH

SEQ ID NO: 34315 - protein, 767 aa, Schizosaccharomyces pombe 972h-
MTTLNTNDKDLPIVKKYDSLNGTWDFLKTGVSQIFERLDEGMTITKYMELYTAIHNYCADASKTITVDNFNDQTANVLGEALYNNLVLYLEEYLARLRKECISQTNHEEQLAAYAKYWTRFTTSARFINHLFGYLNRYWVKLKNRFTETLVYDIYTLCLVSWHHHVFSHIRDSLLQNLLYMFTKKRLYEPTDMKYVEVCVDSITSLSFDKTDMTKPNLSSYKTFFETNFIENTKNFYAKESSEYLASHSITDYLKKAEIRLAEEEELVRLYLHESTLKPLLEATEDVLIAQHEEVLHNDFARMLDQNCSEDIIRMYRLMSRTPNGLQPLRQTFEEFVKRSGFAAVAKIVPQVGGEADVDPKEYMEMLLSTYKASKELVNTAFHGDTDFTKSLDTAFRELVNRNVVCQRSSSRSPELLAKYADSILRKSNKNVDIDDVEDCLSSIIIIFRYVEDKDVFQNFYTKLLAKRLVNGTSNSQDAESSMLSKLKEVCGFEYTSKLQRMFQDISLSQEITEAFWQLPQSRAGNIDFSALVLGTSFWPLSPNNVNFHLPEELVPLYEGFQNYYYSCHNGRKLSWLFHLSKGEIKARINPQTNVTYVFQVSTYQMGVLLLYNHRDSYTYEELAKITGLSTDFLTGILNIFLKAKVLLLGDNDKLGDPNSTYKINENFRMKKIRVQLNLPIRSEQKQESLETHKTIEEDRKLLLQSAIVRIMKARRTLKHVVLVKETIDQIKSRFTPKVSDIKQCIDMLIEKEYLERQGRDEYIYLA

SEQ ID NO: 34316 - protein, 403 aa, Dehalococcoides ethenogenes 195
MPNARVEDAIADIKAGRFVIVVDDYDRENEGDLVMASEMVTPDAINFMAKNARGLICVSLTAERLEQLKIPMMVTENTSPYSTGFTVSVEARKKVTTGISAADRAATVQVLIDPAATREDIAMPGHMFPLRAREGGVLVRAGHTEASMDLTRMAGLYPSGVLCEIMNDDGTMARLPQLEAKAAEWAIKIISVKDIISYRRRTEKMVKKITEAELPTSHGQFKAVAYKSQFDADEHIALVMGDISGPEPVLVRVHSECITGDVFGSKRCDCGEQLDMALNQIAKAGRGVLLYMRQEGRGIGLHNKLCAYALQDKGLDTVEANIELGFAPDLREYGIGAQILVDLGLSKIRMMTNNPKKVVGLEGYGIQVVETVPIIVEPNSFNRHYLETKQKKMGHLLNVDKTN

SEQ ID NO: 34317 - protein, 416 aa, Geobacillus zalihae
MKCCRIMFVLLGLWFVFGLSVPGGRTEAASLRANDAPIVLLHGFTGWGREEMFGFKYWGGVRGDIEQWLNDNGYRTYTLAVGPLSSNWDRACEAYAQLVGGTVDYGAAHAAKHGHARFGRTYPGLLPELKRGGRIHIIAHSQGGQTARMLVSLLENGSQEEREYAKAHNVSLSPLFEGGHHFVLSVTTIATPHDGTTLVNMVDFTDRFFDLQKAVLEAAAVASNVPYTSQVYDFKLDQWGLRRQPGESFDHYFERLKRSPVWTSTDTARYDLSVSGAEKLNQWVQASPNTYYLSFSTERTYRGALTGNHYPELGMNAFSAVVCAPFLGSYRNPTLGIDDRWLENDGIVNTVSMNGPKRGSSDRIVPYDGTLKKGVWNDMGTYNVDHLEIIGVDPNPSFDIRAFYLRLAEQLASLQP

SEQ ID NO: 34318 - protein, 153 aa, Herbaspirillum seropedicae
MKVSEILKVKGNILFTVTPDTPIQEAVAAMAEKDIGSLVVMEYGDLVGMLTFREVLLTLHKNGGELGGSTVRKHMNDAPITVTPDTDLNEVRRIMLEKHARYVPVMEARTVLGVMSFYDVAKAVLDAQGFENKMLKAYIRDWPAEEEEREGNA

SEQ ID NO: 34319 - protein, 349 aa, Herbaspirillum seropedicae
MSFQVTVQPSGRQFTCDADESILTAAIRAGVGLPYGCKNGACSSCKGKLVSGQVEHGPHQERALSAHEQQLGMALFCVAKPQSDVTIEAREVAGAGDIPVRKLPVRVAKLDKVADDVIVLSLQLPANDRLQYKAGQYVEFLLRDGKRRSYSMATAPHKDEHMSLHIRHLPGGLFTDQVFTTLKERDILRIEGPLGTFFLREDSDKPIILLASGTGFAPIKAIVEQLEHAGSKRPVTLYWGGRRPQDLYMDALCQQWEQTLPNFKYVPVVSNAQAEDNWSGRTGFVHRAVMEDFPDLSGHQVYACGAPIVVESAQRDFSAQCGLPQDEFYADSFTSEADLAKPVADSPAA

SEQ ID NO: 34320 - protein, 292 aa, Prochlorococcus marinus str. AS9601
MKKPASLIGNKNKFLVFGCGFSGSYFAKTIKKFGCTVLTSSRSRGMDPNNFVFNSENGVVPDAKIFDGVTHILSCIPPDKNGKDPVLRILKNKLKSLSLEWVGYLSTTGVYGNTNGDWVSEIHKPNPFQKRSYKRLNCEKEWIESGLPIQIFRLPGIYGPGRSTFEAIKNKKIRVISKKNQVFSRIHVADIVNAIIYLLQNKNSLKFYQIINIADDEPCSQLEVIQYCYDLLGLTMPKPILFEDAREELSPIAQSFWMENRRVSNKLLCETLGYKLIYKNYKIGLKNCYLNR

SEQ ID NO: 34321 - protein, 200 aa, Buchnera aphidicola str. APS (Acyrthosiphon pisum)
MKKITIIAVSKNRNINNIEEAIRSGINNFGENYLQESLIKIENLKKYKNITWHFIGKIQSNKTKKIAQNFSWCQTVDREKIAVLLNKFRPKNLPPINVLIQINNLKELQNNRYIDQYQELAQLILSMPNLNLRGIMAVPSIKTNVIENNLQYEKIKTIFNRFKRQYSSVDTLSLGTSVDIKESLLATSNMVRIGRNIFNI

SEQ ID NO: 34322 - protein, 280 aa, Desulfococcus oleovorans Hxd3
MAKLDKTVGFIGGGNMAEAMIGGLLAAGVCEASRVHAADVSRDRLAYLKTTFGIHTTGDNCAVVDGCDVLVLAVKPQVMGSVLSTLDAGCGPRLSKKLVITIAAGIPVQTIEGMLASAPGLAVVRAMPNTPALVGCGMCGMYANPHVTSADRGHARAILEATGRVIEFETEALLDAVTAVSGSGPAYVFYFVEAMVKAGENLGLDTKDAFAMTLQTVKGAVTLMEERGESPKELRQKVTSPGGTTEAALRVLREKEFPEIVMTAIEAACQRAGELSRQYV

SEQ ID NO: 34323 - protein, 213 aa, Glycine max
MAHHEDSSAWNSSKPHPKLNERILSSLSRRTVAAHPWHDLEIGPGAPAVFNCVVEIGKGSKVKYELDKTSGLIKVDRILYSSVVYPHNYGFIPRTICEDSDPMDVLVLMQEPVLPGSFLRARAIGLMPMIDQGERDDKIIAVCADDPEFRHYTDIKELPPHRLAEIRRFFEDYKKNENKIVDVEDFLPAEAAIDAIKYSMDLYAAYIVESLRH

SEQ ID NO: 34324 - protein, 362 aa, Candida albicans
MKGLILVGGYGTRLRPLTLTLPKPLVEFGNRPMILHQIEALAAAGVTDIVLAVNYRPEVMVSTLKKYEEEYGVSITFSVEEEPLGTAGPLKLAEEVLKKDDSPFFVLNSDVICDYPFKELADFHKAHGAAGTIVATKVDEPSKYGVIVHDRDTPNLIDRFVEKPVEFVGNRINAGLYILNPSVIDLIEMRPTSIEKDPFPILVEQKQLYSFDLEGYWMDVGQPKDFLSGTCLYLTSLSKKHPEKLCKEKYVHGGNVLIDPTAKIHPSALIGPNVTIGPNVVVGEGARIQRSVLLANSQVKDHAWVKSTIVGWNSRIGKWARTEGVTVLGDDVQVKNEIYVNGAKVLPHKSISSNVEKESIIM

SEQ ID NO: 34325 - protein, 115 aa, Casuarina equisetifolia
ACLNCINSGIRRMGVITQYQSHTLVQHIQRGWSFFNEEMNEFVDLLPAQQRMKGENWYRGTADAVTQNLDIIRRYKAEYVVILAGDHIYKQDYSRMLIDHVEKGARCTVACMPVP

SEQ ID NO: 34326 - protein, 362 aa, Candida albicans
MKGLILVGGYGTRLRPLTLTLPKPLVEFGNRPMILHQIEALAAAGVTDIVLAVNYRPEVMVSTLKKYEEEYGVSITFSVEEEPLGTAGPLKLAEEVLKKDDSPFFVLNSDVICDYPFKELADFHKAHGAAGTIVATKVDEPSKYGVIVHDRDTPNLIDRFVEKPVEFVGNRINAGLYILNPSVIDLIEMRPTSIEKDPFPILVEQKQLYSFDLEGYWMDVGQPKDFLSGTCLYLTSLSKKHPEKLCKEKYVHGGNVLIDPTAKIHPSALIGPNVTIGPNVVVGEGARIRRSVLLANSQVKDHAWVKSTIVGWNSRIGKWARTEGVTVLGDDVQVKNEIYVNGAKVLPHKSISSNVEKESIIM

SEQ ID NO: 34327 - protein, 456 aa, Xanthobacter autotrophicus Py2
MMYLIAAIAGIAGALFGFDEGVIAGALAPLRRDLGIDPVAEGMMTAAVPFGAFLGAIVGGRLALALGRRRLLLAAAVLFVVGALLSAFAFGLWTLTFARLIIGLGVGVAAMMAPLYISECAPAAQRGMLVSIYQLAITLGILGAYVVGYAFHESWRWMFAVGAVPAIALFVGIFGLSDTPRWLAVRGREAEARAALARVREKSESDPAVKAEFAEILTGATQDENRKARLSDLLTPRVRPALIVAMGLFLLQQLSGINAVIYYAPTVFELSGFSSTTTQILATAGIGVVNVLMTLVGMALIDRLGRRLLLLIGFAGTAVALSVIAIGAATGSEMMGKLALGGLVLYIASFAIAIGPLPWVMMSEVFPLDVRALGMSIASLVNWGFNFLVVFSFPVLVAEFGLAGVFGLYAVVCVVGLAFTQWLVPETSGVSLEEIERHLDSGRPLRDLGRFTPRAA

SEQ ID NO: 34328 - protein, 437 aa, Triticum aestivum
GVDQSMCSGCRLPFNLRRKRHNCYNCALVFCHSCSSKKSLKASLAPNPNKPYRVCDSCYGKLNKGPETDRYSSAKRGAILQGFNDSINDDLETRSNVQLSRLSSMESFKNMDSRYSKKNKKFEFNSSRVSPIPNGSSHWSGLNISKSFGSSKKFFSASVPGSRIASRATSPVSRRTSPPRSTTPTPTLGGLTSPRVVVDGAKPIKDSVSQEVIHLRSQVENLTRKSHLLEVELERTTKQLKEAISIAGEETAKCKAAKEVIKSLTAQLKGMAEKLPEGAGAGAGAGAGAGAVKHSRLPPLSGVPVNDISMATENLGSPRNSGEPYLNGSNGLIVSNGPSSVRNKTHLEVGKNGTRQPDSDSKPESEWVEQDEPGVYITLTALPGGARDLRRVRFSRKRFSETQAEQWWQENRARVYELYNVRVVDKSVTSIDSDVPH

SEQ ID NO: 34329 - protein, 154 aa, Acidaminococcus fermentans
IPLINIVDVPGFLPGTDQEYGGIIRHGAKMLYAYCEATVPKITLVTRKAYGGAYLAMCAQDLGADHVIAWPTAEIAVMGPQGAAKIIFRKDPDVEQKTQEYITNFATPYYAAKHGMVEMVIEPKTTRPILIKALRMLKSKQEDRPTKKHGNIPL

SEQ ID NO: 34330 - protein, 384 aa, Zea mays
MASAAAGAPKRCYYEVLGLSRDCSPTDIKLAFRRLALSLHPDKQPPGSDLALATAAFQELQHAHSVLSDPQERAYYDSHRSQIIFSHPASAGAKSASTVPDLFAFFSSSAFSGFSDTGRGFYKVYGDVFDRVFAQELAYARRMGVPEPAAPPVIGNLDSPYAQGPCCLSARRGIKRVVDMVLKKKLEEEKRKAEEKERRKEEDKRKKERAMAYQEHEWARAEEGLYDEDEEEEMRAKKELSYCAACNKKFKSDKQWKNHEQSKKHRNKIAELRKAFREEESLKKAEEGEGDWNEVDMGFDFKPTQESDDASAFSDAAEELAEEFESNYAGNGHHGKCEVQPEGSVHVNDVDDIMEGPSSFNVNNGAVIMRLIEDIEQVILLASD

SEQ ID NO: 34331 - protein, 588 aa, Petunia integrifolia subsp. inflata
MSSKQTYRVCFCFRRRFRVVAAEAPADIKNLFNEYADSNGVMNVENLHRFLIEVQKEENASLEDASNIMNNLHDLKILNIFHRRGLHLDAFFKYLFADINPPVNPKRKIHHDMNAPLSHYFIYTGHNSYLTGNQLSSDCSDVPIIQALNRGVRVIELDIWPNSSKDDVEVLHGRTLTTPVSLIKCLRSIKEHAFSVSEYPVVITLEDHLTTDLQAKVAEMITQTFGDMLFTPDSECLKDFPSPESLKKRVMISTKPPKEYLQAKEVKEKDSKNGPEADAEAWGREVSDLKARYNDKDDSDEGDGGEDDENEEDPKSQNTAPEYKRLIAIHAGKGKGGLSDWLRVDPDKVRRLSLSEQELAKAVVTHGKEIVRFTQRNMLRIYPKGIRFDSSNYNPFVAWTHGAQMVAFNMQGYGRSLWLMHGMFRANGGCGYVKKPDILLKAGPNNEVFDPEANLPVKTTLKVTVFMGEGWYYDFDHTHFDAYSPPDFYAKIGIAGVPADNVMKKTKTLEDNWIPNWDETFEFPLTVPELALLRVEVHEYDMSEKDDFAGQTCLPVAELRQGIRAVALHNRKGEKYNSVKLLMRFEFI

SEQ ID NO: 34332 - protein, 498 aa, Mesorhizobium loti MAFF303099
MIEYGHFIGGKRVAGTSGRKQDVMQPMDGSVRGTVALASQAELRAAVENAKAAQPKWAATNPQRRVRVLMKFLELVARDYDELADILAREHGKTIADAKGDIQRGLEVVEVCIGAPHMMKGEFTDGAGPGIDVYSMRQPLGVVAGITPFNFPAMIPLWKIAPAIACGNAFILKPSERDPGVPIRIAELFLEAGLPAGILNVVNGDKEVVDAILDDPDIKAVGFVGSTPIAHYIYSRGTAAGKRVQCFGGAKNHMIIMPDADMDQTVDALIGAGYGSAGERCMAISVAVPVGNDTANRLMEKLIPRVESLKVGPSTDSAADFGPLVTAQALERVKGYVDTGVKEGATLVVDGRGFKMQGYEDGYYMGGCLFDNVTADMRIYKEEIFGPVLSVVRAPTYESAIKLANDHEMGNGVAIFTRDGDAARDFASRVQVGMVGVNVPIPVPIAYYTFGGWKASSFGDLNQHGPDAFRFYTKTKTVTSRWPSGIKDGAEFVIPTMN

SEQ ID NO: 34333 - protein, 486 aa, Photobacterium sp. SKA34
MDMKSLYIDGNYVAASSDIQFTTFNPANGQPIATIGQASQADLELAISAAKKGFAIWSAMTATERSRILLRAVTLLRERNDELAVLEVTDTGKPLQEAIAVDIETGADVIEYFAGLAPGLQGEQQPLSENQFFYTRREPLGICAGIGAWNYPIQIAMWKSAPALAAGNAMIFKPSEETPLTVLKLAEIFTEAGLPDGVFNVVQGDYRVGQMLTAHPEIAKVSFTGETGTGKAVMADSADTLKSVTMELGGKSPMIIFDDANVDHAVSAAMVANFYTQGEVCTHGTRVYVHETIYDTFIEQLKRRTELLIVGDPMNMETQIGALISTSHLSKVLSAIDAAKQSGAILLTGGYQYTDNGLAQGNFVQPTVFIDCDESMSHVKNEIFGPVMSVIKFSDETDVIARANNTHYGLAAGVFTQNLARAHRVIHQLQAGICWVNTWGDSPAQMPVGGYKQSGIGRENGIETLQHYTQTKSILIELGDYQSPYA

SEQ ID NO: 34334 - protein, 155 aa, Dehalococcoides ethenogenes 195
MGKEFSGVLNGQGLKVALVVSRFNEFITSKLLSGAKDSLERHGVSADNTDVAWVPGAFEIPLVAQKLAKSGRYDAVICLGAVIRGSTPHFEYVSSEVSKGIARVGLDASLPVIFGVITADSIEQAIERAGTKMGNKGFDAATQAIEVANLMKNLG

SEQ ID NO: 34335 - protein, 400 aa, Herbaspirillum seropedicae
MQYSQSDANKLMYVTNRPELVFTEGHGMWLTDHNGKRYLDYLQGWAVNTLGHAPQCIADALAAQSKKLINPSPAFYNEPSIELAKLLTANSVFDRVFFANSGGEANEGAIKLARKWGKKNPAADGSARFEIITFKHSFHGRTLATMSASGKDGWDTMFAPQVPGFPKAVLNDLESVKALIGEHTVAVMLEPVQGEGGVIPASKEFMQGLRSLTKEKNLLLIVDEVQSGMGRTGQLFAYQHSGIEPDIMTLAKGIGGGVPLAALLAREEIACFEAGEQGGTYNGNPLMTAVGVAVIKELLKPGFMESVRERGQYLRQRSLEISEKYGFEGERGEGLLRALQLGRDIGPQIVEAARNLEPVGLLLNSPRPNLLRFMPALNVTKEEIDQMFSMLEEVLAKIGK

SEQ ID NO: 34336 - protein, 308 aa, Pseudomonas syringae pv. syringae B728a
MPAKLFYTGQVVVDLVMAIDRLPPSGGDVLATSATFEAGGGFNVMAAACRNGLRTVYLGRHGQGRFGDIARQAMRDEGVEISTMPVSGEDTGLAVALVEASAERSFISYVGAEGGLSAEDLHGVQVSAEDYVFVSGYSLAHKNKVTALLAWLGGLPSGTAVVFDPGPLVDALYGVEMRAVLPLISLWSSNREEALRFTQTQTPADALHSLASTLREDALIVMRDGPAGCWIHHAGQTRLIPGFAVTALDTNGAGDAHAGVLLAELARGSSVDRAALRANAAAAIAVTRRGPATAPGREEIDALVGADV

SEQ ID NO: 34337 - protein, 274 aa, Kluyveromyces lactis NRRL Y-1140
MVAPTALKKSDVSEGTVPVTTTSRIVGVDNTEKIDEDDDDADVLIDQDGDAMLVDEENNEESNKKKEDAGVVLDAEGKPRFTSAASSAQTKVKLESRKVSVPPHRMTPLKNNWSKIYPPLVDHLKLQVRMNLKTKSVELRTHPKHTTDPGALQKGADFIKAFTLGFDLDDSIALLRLDDLYIETFEIKDVKTLQGDHLSRAIGRIAGKDGKTKFAIENATRTRIVLADSKIHILGGFTHIRMARESVVSLILGSPPGKVYGNLRTVASRLKERY

SEQ ID NO: 34338 - protein, 387 aa, Prochlorococcus marinus str. AS9601
MAIQQKLSLMIPGPTPVPEKVLQALSKHPIGHRSKEFQDLVESTTKNLQWLHQTQNDVLTITGSGTAAMEAGIINTLSRGDKVICGDNGKFGERWVKVAKEFGLEVIKIDSEWGTPLDPEKFKKVLEEDTQKEIKAVILTHSETSTGVINDLKTISSYIRKHNTALSIVDCVTSLGACNVPVDEWELDIVASGSQKGYMIPPGLSFIAMSQKAWEAAEKSNLPKFYLNLKSYKKSLLSNSNPYTPAVNLVFALDESLKMMKEEGLDNIFFRHNKHKLAMSNAVKALDLKLFADEKYLSPSITAVKTEGIDAEEFRKTIKNNFDILLAGGQDHMKGKIFRVGHLGYVNDRDIITVVSAISNTLLNLGKITAKQAGEALKVASRYLAEN

SEQ ID NO: 34339 - protein, 528 aa, Prochlorococcus marinus str. AS9601
MSQTSLKKERDPSILILDFGSQYSELIARRIRETNVFSLVVSNFISIEDINRINPKGIILSGGPNSVYEQNAPRCDEKIFNLGIPILGICYGMQLMVKELGGTVISATKKAEYGRAPLNIDQESDLLFDVEDKSIMWMSHGDSINCLPDGFNKIAHTENTLHAAISNDVKKLFGVQFHPEVVHSEFGMRVIKNFVYKISCCTADWTTETYIEETIPRIREQVGNKKVLLALSGGVDSSTLAFLLNKAIGNQLTCMFIDQGFMRKGEPEFLMNFFDKKFHIKVEYINARERFIAKLKGITDPEQKRKIIGEEFIRVFEEESNRLGPFQYLAQGTLYPDVIESAGTNIDPKTGERIAVKIKSHHNVGGLPKDLQFKLVEPLRKLFKDEVRKVGAALGLPDEIIKRHPFPGPGLAIRILGEVNNEKLDCLRDADWIVRDEIKKAGLYNDIWQAFAVLLPVKTVGVMGDKRTYSWPIVLRCVSSEDGMTADWSKIPFQILERIANRIVNEVISVNRVVYDITSKPPGTIEWE

SEQ ID NO: 34340 - protein, 315 aa, Glycine max
MAEHLASIFGTEKDRVNCPFYFKIGACRHGDRCSRLHTKPSISPTILLSNMYQRPDMITPGVDAHGHPIDPRKIQDHFEEFYEDLFDELSKYGDIESLNVCDNLADHMVGNVYVQFREEEHAANAVRNLTGRFYAGRPIIVDFSPVTDFREATCRQYEENTCNRGGYCNFMHLKRISRELRRQLFGKSHGRHSRSRSRSPYRHRSHEERSHRSHSRKYDDRDHHHESRSRRHRSTSPRHRRGRSRSRSPGGRRHHSPVRDGSEERRARIEQWNREREDQEPGYKVNAEEINNGNASKHHGHQQQEQEPQSPQEGQ

SEQ ID NO: 34341 - protein, 743 aa, Schizosaccharomyces pombe 972h-
MPVAEIKNATQQPSSTNRVQAYAKLEFEKFSFFVQTLQVTMGRKASNSSDCDVHLGDTKAISRQHAKIFYSFPNQRFEISVMGKNGAFVDGEFVERGKSVPLRSGTRVQIGQISFSFLLPEGSEEDGHLKETGITPLSLQQGKIAYSDEFGGKPTGSFHTVTSNQEKDLLFSHIKHESDLPLGLSPADTNISNATSIIEHPDAANAHTLASLNQPPKHLTVSPSSIQRLSPQPYVRPTSDERPIETDSSVSAPKVANHDEELKQGKSTSPSDTVLHPDLNGSPDTGDATQKPNLSYANLIARTLIANPNKKMTLGDICEWIANNWSYYRHQPPAWHNSIRHNLSLNKAFIRIPRRQNEPGKGSFWMLDPSYIDQFEGNFFRRTKKPTPSATPAAHPDTARENELAAIQTKGISAGKTEQLNPQKETSRSKTHTSRGENVEDRPQSLLQNGIQPIIMRDGKLALNPEFFKNANGEQQAPNEQAVQAISLLQQHINKQLGPAAANNPEQATAIANALAVALAQKLQKQQTQMQGPQQVQQQAKRRKAYTSQQLNPAPTAMPHPNITSPSPSISVTQRPAVNVGPPPYVRPSAPSKLPDTRQSIGDPLPPGAMANVSAGPSSVRSSSYNSTASESKSEITSHQNLHTIPINKPFTSDRPLYSSPNDTLERVETGNQGQRMNSIGNASSFSKRDIMENENGSFDTNAKNGNNVDDSSSVRGMNLPSNSSDALRGVKRPLDETSSSYT

SEQ ID NO: 34342 - protein, 265 aa, Buchnera aphidicola str. APS (Acyrthosiphon pisum)
MQKINFFDTINNIWRKMLDKICQLARSAGHCIMKLYNSQKFINVSYKPDNTPITDVDYAANNIIKKGLSLISPQIPIISEEESYNFEICRNWNSYWLVDPLDGTKEFLKKNGEFTVNISLIEYGVPILGVIYAPFFDVLYSAFYDNAWKEEKFGSKKKINVAQAEAPLLVISRSHPNETLKNYLEKIKCCKIKKMGSSLKFCLIAEGTAQIYPRFGDTHIWDTAAGHAIVIAAGGKVQTWTGGNLNYSLSSRVSFINSGFYASAL

SEQ ID NO: 34343 - protein, 167 aa, Triticum aestivum
  misc_feature (71)..(71): Xaa can be any naturally occurring amino acid
MSFCHFAFRSNGFVVLTMDSADEQNYLTEEAITDLEKKLEQIRDNPEVKGLVTTCKSGIFCSGLDYDHDAXSEEQAENLATGVAKVIRLLFLLQVPTVAAVRGHVTSLGLALALAHDHVFVWDQAVVRLPEAQLGRRLPDYVPTLLRDKLSYARLRKLLMLKSQPCT

SEQ ID NO: 34344 - protein, 404 aa, Neisseria meningitidis MC58
MDKFPKSAKLDHVCYDIRGPVHKKALQLEEEGNKILKLNIGNPAPFGFEAPDEILVDVIRNLPTSQGYCDSKGLYSARKAIVHYYQTKGLRDITVDDVYIGNGVSELITMSMQALLNDGDEILIPAPDYPLWTAAATLAGGTVRHYLCDEENGWFPNLADMEAKITPKTKAIVVINPNNPTGAVYSREILLEIAELARKHGLIIFADEIYDKILYDGAVHHHIAALAPDLLTVTFNGLSKAYRVAGFRQGWMVLNGPKHHAKGYIEGLDMLSSMRLCANTPMQHAIQTALGGYQSINEFILPGGRLLEQRNRAWELVNQIPGVSCVKPMGAMYMFPKIDTEMYRIRDDMKFVYDLLVREKVLLVQGTGFNWIKPDHFRIVTLPYVHQIEEAMGRLARFLQTYRQ

SEQ ID NO: 34345 - protein, 280 aa, Vitis vinifera
  misc_feature (275)..(275): Xaa can be any naturally occurring amino acid
MVAETSTFPIDLTKTRLQLHGESLSSARSTTAFRVAAEIVRRDGPLGLYKGLSPAILRHLFYTPIRIVGYEHLRNAVDGHDSVSLSGKALVGGISGVIAQVVASPADLVKVRMQADGRMVSQGLQSRYSGTFDALNKIIRTEGFRGLWKGVFPNVQRAFLVNMGELACYDHAKHFVIQNQICGDNIYSHTLASIMSGLSATALSCPADVVKTRMMNQAVSQEGKSMYNNSYDCLVKTVRVEGLRALWKGFFPTWARLGPWQFVFWVSYEKFRELXGLSSF

SEQ ID NO: 34346 - protein, 337 aa, Desulfococcus oleovorans Hxd3
MKLGLIGKPGAGKKTLFEALTKSDPDSGHKGDLRIAAIYVPDPRVDVLSAMYSPRKTIYAQIEYCLGRTAGDKDLQLKAVADCDALIQVVRNFPVPGMPDPSPYKDIAAMDEDLMLSDFVVIEKRLERIAADAKRGKKADAQEMALLDQVKQMIENGTPVRTQPEIATAPLLRGFSLLSAKPVLVLINNDEDDTALPAGPPPGGIDLMVVRGKLEHEISRMSDDEAAEFLKEFGIDEPAIHRALRRSYAMLGLISFFTVGEDEVRAWTIKKGALAPEAAGTIHSDMQKGFIRAEVVAYDALMAAGSYAEARKQGTVRLEGKTYEMADGDIVNIRFNV

SEQ ID NO: 34347 - protein, 233 aa, Brassica napus
  misc_feature (204)..(204): Xaa can be any naturally occurring amino acid
  misc_feature (213)..(213): Xaa can be any naturally occurring amino acid
  misc_feature (215)..(215): Xaa can be any naturally occurring amino acid
  misc_feature (228)..(228): Xaa can be any naturally occurring amino acid
MATSLSVSRLLSSSSATAISVSNPLLSPTSVFTAPVSFTRSLAPNLSLKFRSSSHTIVSTTRSFSTTITSAISVGDKLPDSTLSYLDPTTNDVKTVTVSSLTAGKKTILFAVPGAFTPTCSQKHVPGFVSKAAELRSKGVDVIACVSVNDAFVMEAWRKDLGINDEVMLLSDGNGEFTGKLGVELDLRDKPVGLGVRSRRYAIXAEDGVVKVXNXEEGGAFTNSSAEXMLKAL

SEQ ID NO: 34348 - protein, 390 aa, Clostridium thermocellum ATCC 27405
MNIAEMVLPTVRQVPPSGIRKFFDLVNEMKDAISLSIGEPDFVTPWNIREAGIYSLEKGHTHYSPNAGFMELREEICKYQERKYNLKYDPKTQVIVTVGGSEGIDIALRALVGPGDEVIIPEPCFVAYKPCTIFTGATPVIVNLSAENEFRLTPELLEKAITDRTKVLILPYPNNPTGAVMEKKDLEAIVEVLKDKDIIVISDEIYSELTYGVKHVSIASFPEMKDKTVVINGFSKAYAMTGWRLGYCLGHPDLISQMYKIHQYAIMCSPTTAQYAAIEALRNSDDDVEAMVREYNRRRRIMVEGFRSAGLECFEPLGAFYVFPCIESTGMTSYEFSERLLMEEKVAVVPGTAFGECGEGYVRSCYASSMDNIIEAMKRIKRFVERNRKK

SEQ ID NO: 34349 - protein, 522 aa, Magnaporthe grisea 70-15
MFGGLVEVRPLPLAGFLLGVYVAAWFIQAALMDYRIAKRGGGGVKAPRVASNMITAGIWFFWAGWRQMRNDLLSLYNSVYDKHGTPESPNCVEITLTTPGVRFILTREPEHVKTILTSKFSDFGKGYHFHKIWSPFLGDSIFTTDGQLWHDSRSLIRPMFIKEKVRDLDIFDRWTNEMINLLPPPGQSVDIANLLYRMTLDVTTDFLLGESVNALRDEHNEFAYYFNEIQRIQMMLTILVPAAPFLPRHRYYAGIKYIEKFMAPFIEQALALPPDELEKLSKTDKDFTFLHNIARYSRDRKVIRDQIMAVLLAGRDTTAATLSWTIYELCNKPEVVKRLRQEILRVVGPFGNKPTYENLKELKYLTHIINETLRIYPAVPYNIRAALEDSSLPSPDGKPSIAVLKGDIVVYSALSMQRRKDIYPEVSETFPDPAVYCPERWEHWTPKPWTYVPFNGGPRICVGQNFAMTEMAYVLVLIFQKFDRIEYCGDWDAQYHKAEIVGAPGHGVPVTLYPAVDDQVKE

SEQ ID NO: 34350 - protein, 460 aa, Rhodobacter sphaeroides 2.4.1
MNSLSNSLAAADIAHSLHPYTNARAHERNGPLIITRGQGVHVYDSEGREYIEGLAGLWSVAVGFSEPRLAEAAARQMAELPYYHTFAGKAHEPQIRLAEKLVEMTPEALTRVFFTNSGSEANDTVVKLVWFMNNALGRPQKKKFLSRIKGYHGITIASGSLTGLPVNHKGFDLPAIPVVHLGCPHHWRFGAEGESEAEFCARLLREAEETILAEGPETVAAFIGEPVMGAGGVIVPPDGYWSGIEALCRKYDILLVSDEVINGFGRTGARWGCEKFGFTPDILVTSKQLTSSYMPLAAVLMTDKVYQTIADHTETLGTLGHGFTGSGHPVATAVGLENLTVIEERDLMGNAARLERPFQDGLRAFRDNPLVGEVRGTGLIAAIEMVADRATKRSFEPLGKVGARAAAFAAEEGLLCRALGDTLALCPPLIVTEADVGRILERMGRALDRTADWARAEGLI

SEQ ID NO: 34351 - protein, 498 aa, Ralstonia metallidurans CH34
MPVIQPVKRPVIQPVILAGGAGTRLWPLSREQYPKQLLNLVANDTLLEATAARLEGVAARTGRPAGVEAPQIVVCGEEHRFMVADMLKRKGKRARVVSEPCGRNTAPALTMAALHAMASAGEGGDAVLVATPADHSVTDSDAFRDAIAAAVLHAERGAIVTLGVRPTAPETGFGYIRAAVPVPPGGFLIERFVEKPHLELAQHYVDSGEYWWNCGIFVVLASVWLKAVMQLQPEMHARCCAAYETGQPSESGKDDVFRIGQEAFDTCPSDSIDYAVMEKLDGLRGIPGMLVPMDAGWSDVGSWAAIWDIATKDNAGNAGRGRVLFDGASSCLAHSEGRLIACVGVQDVVVVETADAVLVVDKHHVQDVKNVVQRLRQEHGAEIVNHRKVHRPWGCYDSIDHGDRFQVKRIVVEPGASLSLQMHYHRAEHWVVVRGTARVTCGETTSILTENQSTYIPIGTLHRLENPGKTPLEIIEVQSGAYLGEDDIVRVEDNYGRK

SEQ ID NO: 34352 - protein, 417 aa, Physcomitrella patens subsp. patens
MAPSIQDNFPSTPGKVKMERSNYFGWAANRWYTTASAKLFFFSVFLLTITIIISFRTSENGAVGGYVRATYTSFNGGSISPAFKSDHAWDQKVTQSCIRKRVNGLVVLVTGAAGFVGSHVSLVLKKRGDGHVGIDNFNDYYEVSLKRARQQMLLKQSIFVIEDDINNASLLKHLFDMIQFTHVMHLAAQAGVRYAMQNPMSYIHIYGLNSKVPFSESDRTDQPASLYAATKKAGEEVAHTYNHIYGLSITGLRFFTVYGPWGRPDMAYFSFTRDILTGKAINIYKGKHDRDLARDFTFIDDIVKGCVASLDTSGSSTGRRGKKRGSAPFRSFNLGNTSPVTVPSLVECLERHLQVNATKKFIKVPQNGDVPFTHANVSLAQSELGYKPTTDLDTGLKKFVNWYTKYYAVPSAKTRML

SEQ ID NO: 34353 - protein, 281 aa, Ralstonia metallidurans CH34
MTQSNQDNRGAKMQLQGKVAVVTGAGSGIGRAVAQALAQRGCHLALADRNQEGLAETAALPELNSVKVSLHTLDVADRDAVAAFPQTVLAHHDRIDLLVNNAGVALAGSFEQVSETDFDWVMAINFHGVVRMTRAFLPLLHRSDDARIVNISSLFGLISPPGQSAYSASKFAVRGFSNALRHELADSRVGVTVVHPGGIATSIARNARVSADIPQAQMQERLANSQKMLRMPPPKAADIIVRGIEKRSARVLVGSDAVVMSWLERLFPVRYWNLLARRAKL

SEQ ID NO: 34354 - protein, 461 aa, Zea mays
FGSRDCVRLNFSHGTQEDHRKLFNLVKSLSVKYQHQVSIMCDIQGPKIRTGRMEKPFEIRAGEKIDVTPEDVLGTPQLIQIKYATMLKDLDAGDVIFINDGIIKLTVESKSEKALHCVCNAGGQISDRKGCNIPSGNISLDVVTPKDDKDLQLIAELNPEYVASSFIGTAEDVLKVKKVLAGYGNTNIKIISKIERPVALENIDAIIEVTDGLMVARGDLGVEIDTWDVPSAQKMLCQKANAAGKPVIVATQMLESMTQNSRPTRAEANDVYNAVLDGADAVMLSGETATGKYPIAAIQVMDKIVEAAEGHMPERLSTNFLSTKVGMTETIALSVYETAKNFTRIGRKCKIIVITYPPSAYTARMVSKFRPPADVITITSDLRIAREINLLWGVRSVHFPELSEENNMEVRNLTAIKKLIEVGLVQLDNYVICVSRSLFGKHTGACSNVYCLPVLKEEGLL

SEQ ID NO: 34355 - protein, 145 aa, Physcomitrella patens subsp. patens
MAAIIFNLFVINKSGGLIFYKDYGTQGRLDTNDSLRLASLWHSMHAISKELSPVNGCNGIEVLEADTFELHCFQALTGMAQKIFVAAEPGTPGIDSLLKTVYELYTDYVLKNPFYEVEMPIRCELWDLNLALAVRRDGKTGLTGR

SEQ ID NO: 34356 - protein, 160 aa, Mesorhizobium loti MAFF303099
MKISVHAVGRMKAGPERELADRYFERFAKSGPAVGLEFAGITEIAEGRSQSAIERQRDEGSRLQAQLQPGTALILLDERGKSLSSQDLANRIGQLRDGGRKVLVLAIGGADGHDPPLRDQADLVLSFGALTWPHQLVRVMLGEQLYRVATILSGHPYHRA

SEQ ID NO: 34357 - protein, 255 aa, Haemophilus somnus 2336
MARRPLVMGNWKLNGSKAFTKELITGLKDELNAVSGCDVAIAPPVMYLAEAEAALVSSDIALGTQNVDLNKQGAFTGDISTEMLKDFGVKYVIIGHSERRQYHHESDEFIAKKFGVLKDAGLVPVLCIGESEAENEAGKTEEVCARQIDAVMNTLGVEAFNGAVIAYEPIWAIGTGKSATPAQAQAVHAFIRGHIAKQSQAVAERVIIQYGGSINDANAAELFTQPDIDGALVGGASLKASAFAVIVKAAAKAKN

SEQ ID NO: 34358 - protein, 838 aa, Ustilago maydis 521
MKIKLSSSALVLASLSLVYAGDDTCAPPAAANATQAVPVPQSFPVPTYSQAPLAGCYCTCTSGWNPANGPWGGNGAGWGSGSGSGSGSGSGSGSGSGSGFGSGSGSGSGSGSGSGSGTKSPGSGSGSHDGGSNGGGGSHGGGSNGGGNGGGNGGGNGGGNGGGNGGGNGGGNGGGNGGGNGGGNGGGNGGGNGGGNGGGNGGGNGGGNGGGNGGGNGGGNGGGNGGGNGGGNGGGNGGGNGGGNGGGNGGGNGGGNGGGNGGGNGGGNGGGNGGGNGGGNGGGNGGGNGNGNSGIGNGIGNGNGNIGNNNGNNNGNNNSGIANGVGNGNLNLGDNNGNNNGNNNSGIANGVGNGNLNLGDNNGNNNGNNNSGIGNGVGNGNLNPGNNNGNNNGNNNSGILDGALNGNGNIGDNNGNKNGNGNSGILDGTGNGNLNLGDNNGNKNGNNNSGSLDGSGNGNANLGDNNGNQNGNNNSGSGNGDLSGNGNLGSNNGNQNGNGNSGSGNGLVDGNLNAGSNNGDKNGNSNSGLLNGVVDGNANLGSGNGNENGNKNPGSVNGVADGNLNAGSDNGNKNGNENSGLANGVADGNANLGSENGNNNGNKNDGIANGVGTGNANLGSDNGNDSGNNNSGIGNGVAGGNLNAGSGNGDKNGNNNSGLLNGVGDGNLNLAKDAGSNNGNNNDGALNGILNGNANVGGGKIGSNNGNSNTGSGNGSGTGNGNVSLGDNTVGSDNGNGGTGSGQGTGNGNLNLILGSGNKVGSGNQGSGNGNGNIIIGNDQTVGSNQSGSGHGNGNIIIGTGLGLDIGLPGTDNFHIHARRARPLGQRLWTGNTVNVVA

SEQ ID NO: 34359 - protein, 638 aa, Haemophilus influenzae Rd KW20
MIIFSNLSLKRGQTELLENASATINPKQKVGLVGKNGCGKSSLFALLKKELMPEGGEVNYPANWRVSWVNQETPALDISAIDYVIQGDREYCRLQQKLERANERNDGNAIARIHGQLETLDAWTIQSRAASLLHGLGFSQEETIQPVKAFSGGWRMRLNLAQALLCPSDLLLLDEPTNHLDLDAVIWLERWLVQYQGTLVLISHDRDFLDPIVTKILHIENQKLNEYTGDYSSFEVQRATKLAQQTAMYRQQQQKISHLQKYIDRFKAKATKAKQAQSRMKALERMELIAPAYVDNPFTFEFRPPQSLPNPLVMIEQASAGYGIGESAVEILSKIKLNLVPGSRIGLLGKNGAGKSTLIKLLAGELTALSGTVQLAKGVQLGYFAQHQLDTLRADESALWHMQKLAPEQTEQQVRDYLGSFAFHGDKVNQAVKSFSGGEKARLVLALIVWQRPNLLLLDEPTNHLDLDMRQALTEALVDYEGSLVVVSHDRHLLRNTVEEFYLVHDKKVEEFKGDLEDYQKWLSEQNSTSENKVSEKVGDNENSVQNRKEQKRREAELRQQTAPLRKKITQLEEKMNKFSSELANIENQLADTELYNAENKEKLTALLAQQVDVKKALDDVETEWMTAQEELEEMLQA

SEQ ID NO: 34360 - protein, 421 aa, Neisseria meningitidis MC58
MSEALAKETLNPFEIARKQVKTACDRLKTDPAVYEILKSPTRVLEVNFPVKLDDDTVKTFTGYRSQHNNAVGPYKGGVRFHPSVNLDEVKALSIWMTIKCCVAGIPYGGGKGGITLDPRDYSEAELERIARAYAEAIAPLIGEKIDIPAPDVNTNGKIMSWMVDAYENVVKHSAPGVFTGKPVEFGGSLARTEATGYGVNLAAVQALEKLGKDVKGATYAIQGFGNVGYHTGYYAHQSGAKVVAVSTVDVAIYNENGLDMEALFKEFQEKGFITNEAGYGKEITNAELLALDVDVLAPCALENQLTSENAGKVRAKIVVEGANGPTTPEADVILRQNGVLVVPDILANCGGVVVSYFEWVQNLQGYYWEFDEVQEKETVVLRRAFRDIWNLAQEYDVDLRTASYMMSIRRVEKAMKLRGWY

SEQ ID NO: 34361 - protein, 168 aa, Zea mays
  misc_feature (130)..(130): Xaa can be any naturally occurring amino acid
  misc_feature (142)..(142): Xaa can be any naturally occurring amino acid
  misc_feature (151)..(151): Xaa can be any naturally occurring amino acid
MEHKEAGCQQPEGPILCINNCGFFGSAATMNMCSKCHKEMITKQEQAQLAASSIDSIVNGGDGGKGPVIAASVNAVVPQVEQKTIVVQPMLVAETSEAAAVIPKAKEGPDRCAACRKRVGLTGFSCRCGXNMYCSVHRYSDXHDCQFDYRXTAARDAIAKANPVVRAE

SEQ ID NO: 34362 - protein, 152 aa, Prochlorococcus marinus str. AS9601
MTKERTFIAIKPDGVQRGYVSEILGRFEKKGFKLVGLKQLIPSKELAQNHYGVHRERPFFGDLVDFISSGPVVAMVWEGEGVILSARKLIGATKPLEAEPGTIRGDLAIDIGRNIIHGSDGEDTAKFEINLWFNEEELCEWETSDSKWRSEN

SEQ ID NO: 34363 - protein, 758 aa, Herbaspirillum seropedicae
MTQQISAAEQLLRDAAREYHRTPSRGKIEVRPTKPLSNQRDLSLAYSPGVAYPCLDIEADPLKAFDYTSRGNLVAVISNGTAVLGLGNIGPLASKPVMEGKGCLFKKFAGVDVFDIELAENDPDKLVEIIASLEPTLGGINLEDIKAPECFYIEQKLSARMNIPVFHDDQHGTAIISSAALLNGLELVGKDIGKVKIAVSGAGAAAIACVEVMIGLGVKRENVYMVDSKGVIYEGRPGGLDASKQRYAIKTEARTLADVVNGADVFLGCSAPGVLSAEMVKTMADKPIILALANPEPEIRPELAKSVRPDCIIATGRSDYPNQVNNVLCFPYIFRGALDCGATKITEAMKLACVREIADLAKAETSAEVSAAYPGKELVFGADYLIPTPFDSRLILKIAPAVAKAAAESGVATRPIKDYDAYRAELTRFIYQTGMFMQPVFNTAKVAPQRVVYADGQDERVLRAVQFVADEGLAAPILVGAPAAIEAGIKKAGLRIKIGQNVQVIDPATDARVAQYAAQYKDGGEADVRASGSLLAALMVKAGDADAMLCGLDGNYDGHLAHVEKVIGLKQGAQEFAALNAVLLPDQTLFITDTYVNDTPDAEQLARIAQAAAEEVARFGVPPKVAFLSHSNRGSSSRPSARKMAAAHEAFKKLAPEVESAGELHGDAALSEKIRNNAGLADSGLTGAANVLVCPNLDAANILFNVLKTSSGQGTTIGPILLGAAAPVHVLTPSSTVRRVINMTALAAAKAQDGKSKA

SEQ ID NO: 34364 - protein, 382 aa, Oryza sativa Japonica Group
MKEGGGDGGFVRADQIDLKSLDEQLERHLSRAWTMEERKEEAAADQRGSKPPALAAAHYSQNRRQRREEWEIDPAKLVVRGVIARGTFGTVHRGVYDGHDVAVKLLDWGEDGHRSEQDIAALRAAFSQEVSVWHKLDHPNVTKFIGAIMGARDLDIQTESGHLAMPSNICCVVVEYLAGGSLKGFLIKNRRKKLAFKVVVQIALDLARGLSYLHSKKIVHRDVKTENMLLARQELVKIADFGVARLEASNPSDMTRGKPGTLGYMAPEVLNGSPYNRKCDVYSFGICLWEIYCCDMPYPDLSFSEVTSAVVRQNLRPEMPRCCPSSLANVMKRCWDANPDKRPEMAEVVSMLEAIDTSKGGGMIPVDQRQGCLSCFRQYRGP

SEQ ID NO: 34365 - protein, 245 aa, Mycobacterium sp. MCS
MGRVDGKVALISGGARGMGAEHARALVAEGAKVVIGDILDDEGKALADELGDAARYVTLDVTQADQWEAAVATAVNDFGLLNVLVNNAGIVALGQIGKFDMTKFQKVIDVNLTGTFLGMQASVEAMKSAGGGSIINVSSIEGMRGAVMVHPYVASKWAVRGLTKSAALELGPHQIRVNSIHPGFIRTPMTKHFPDNMLTIPLGRPGQSDEVATFVVFLASDESRYATGAEFVMDGGLVNDVPHKI

SEQ ID NO: 34366 - protein, 549 aa, Buchnera aphidicola str. APS (Acyrthosiphon pisum)
MKNINFNNTQSYQDLKNHFRKIKNIHLRDLFASDLNRFKKFSIIFENEMLIDFSKNRITDETLIYLLNLAKETDVKSGIKLMFSGAKINKTENRSVLHIALRNRTNRPIILNNCNIMLEVNALLEKMKNFSKMVIHGEWKGYTGKSISNVVNIGIGGSDLGPYMVTEALRPYKNHLNMYYVSNIDGTHLTEVLKKINPENTIFLIASKTFTTDETITNAHSAKKWFLHYSQDQSALDKHFFALSANIKNALNFGININNIFKFWDWVGGRFSLWSSAGLSIMLSIGFDNFEKFLDGAHAMDNHFYHTNYKENIPILLALISIWYTNFFGSETEAIFPYDQYMHRFSAYFQQSNMESNGKSINRNGQRINYQTGPIIWGEPGTNGQHAFYQLIHQGTRLIPCDFIAPVFSHNDLNNHHMKLISNFFAQTQALAFGQSRDSILHRLILSKKNQDDIKRILPFKICKGNQPTNSILIRKITPYNLGALIALYEHKIFVQGYILNIFSFDQWGVELGKELSQNIYNYLNINVKNKSYDASTEGLINFYKSFMI

SEQ ID NO: 34367 - protein, 446 aa, Magnaporthe grisea 70-15
MFNVARNRVLASAIKTSPRLPGLARPAFAQQQKRALSIHEYLSAELLSKYGVQVPAGRVARSGEEAEQVAKEIGHDDMVIKAQVLAGGRGKGTFDNGLKGGVRVIYSPTEARMFADQMIGHKLITKQTGAQGRPCNAVYICERKFARREFYLAILMDRGSQSPVIVSSSQGGMDIEGVAKENPDAIVTTHIDINTGVTDETARDIAQKLGFSEQCIEDAKDTIQKLYKIFIEKDMTQIEINPLSETSDHKVMCMDAKFGFDDNAEFRQKEIFEKRDTTQEDAEEVRAAESGLNFIKLDGDIGCLVNGAGLAMATMDIIKLNGGSPANFLDVGGGATPAAIKEAFELITSDQKVSAVFVNIFGGIVRCDHIANGLINTVKTLNLKVPIIARLQGTNVEQAHQIINDSGMKIFSIDDLQSAAEKAVQLSKVVKMARDIDVGVEFSLGI

SEQ ID NO: 34368 - protein, 464 aa, Clostridium thermocellum ATCC 27405
MPNMSPKKVPMPEQDPNVRIKNFLEVALGYTEQMAMEEAQRCLNCKHKPCVSGCPVNVKIPEFVQLIAQGKFEEAYNKIRETNNLPAICGRVCPQENQCEKFCVRGIKGEPVAIGRLERFAADWHMKNGTTSYEKPEKNGKRVAVIGSGPASLTCASDLAKLGYEVTIFEAFHVPGGVLMYGIPEFRLPKKLVQEEIETIKQLGVEIKTNMVIGKVYSIDELKAEGYDAIFIGSGAGLPSFMKIPGENLNGVYSANEFLTRINLMKAYEFPNCDTPVKVGKNVAVVGGGNVAMDAARSAKRLGAENVYIVYRRSEAEMPARLEEIHHAKEEGILFKFLTNPTRILGTDDGWVKGMECIEMELGEPDESGRRRPVPKPGSEHVIDVETVIIAIGQTPNPLIASTTPGLATQKWGGIIVDENTGATNIEGVYAGGDAVTGAATVILAMGAGKKAAKAIDEYLKNKK

SEQ ID NO: 34369 - protein, 447 aa, Streptococcus thermophilus LMG 18311
MFMRTLKKVSLAEVNQSIDTPNHNRFWQNLKAFLGPGALVAVGYMDPGNWITSVVGGATYKYSLLFVILISSLIAMQLQQMAGKLGIVTQMDLAQATAFHSPKWLRYTLWVVLELALMATDLAEVLGSGIALNLLFGIPIMVAILVTILDVFLLLLIMKLGFKKIEAIVSTLILTILVIFVYLVALSEPSITGILEGYLPTPTLFGHYAAGHTNHQLTLALGIVGATVMPHNLYLHSSLSQTRKVDHSNDDDVTKAVRFMSWDSNIQLTLAFVVNSLLLILGASLFFGHASDISAFSQMYNALQDSKIAGAVASSTLSTLFALALLASGQNSTITGTLTGQIVMEGFLHMRLPQWVIRLFTRLFALLPVIIVAILYGDQEKTLDQLLVYSQVFLSLALPFSIFPLIYYTSKKSLMGKHVNAKWNTYLGYAIAIVLTILNLKLIFDTF

SEQ ID NO: 34370 - protein, 331 aa, Rhodobacter sphaeroides 2.4.1
MAIELEDLGLSPDVADVMQRLARVGAGIARIISRNGLERDLGAGVGTNAGGDGQKALDVIADDAFRAALEGSAVAYYASEEQDEVVTLGEGSLALAIDPLDGSSNIDVNVSIGTIFSIFPAAAGPEASFLRPGTEQIAGGYIIYGPQCALVCSFGQGVQHWVLDLDAGIFRRMPDIRPLPAETSEFAINASNYRHWPQPIRAFVDDLVAGAEGPRGKNFNMRWIASLVAETHRILMRGGVFLYPGDERKGYERGRLRHVYECAPIAFLIANVGGGATDGCADILTALPDRLHARTPFVFGCASKVARVAAYHDLACEETSALFGSRGLFRS

SEQ ID NO: 34371 - protein, 328 aa, Populus trichocarpa
MASNGVNDKSLIVSFGEMLIDFVPTVSGVSLAEAPGFVKAPGGAPANVAIAVARLGGKAAFVGKLGDDEFGNMLAGILKENGVIATGINFDTGARTALAFVTLRADGEREFMFYRNPSADMLLRPEELNLELIRSAKVFHYGSISLIVEPCRSAHLQAMRVAKDAGALLSYDPNLRLPLWPSAEEAREQILSIWDEADVVKVSDNELEFLTGSDKIDDETAMSLWRPNFKLLLVTLGEKGCNYYTKNFHGSVEAFHVDTVDTTGAGDSFVGALLCKIVDDQSVLEDEPRLREILRFANACGAITTTKKGAIPALPTPADALKLVKEGK

SEQ ID NO: 34372 - protein, 292 aa, Rhodobacter sphaeroides 2.4.1
MSKKYPIISVVGSSGAGTSTVKNTFEQIFRREGVKSVSIEGDAFHRFNRADMKAELERRYAAGDATFSHFSYEANELKELERVFREYGETGRGRTRTYVHDDAEAARTGVAPGNFTQWAPFEDNSDLLFYEGLHGCVVNDEVNLVRHADLKLGVVPVINLEWIQKIHRDRAQRGYTTEAVTDVILRRMYAYVHCIVPQFSETDINFQRVPVVDTSNPFIARWIPTPDESLIVIRFKNPRGIDFPYLTSMIAGSWMSRANSIVVPGNKQDLAMQLILTPLIERMVREARRARA

SEQ ID NO: 34373 - protein, 444 aa, Clostridium thermocellum ATCC 27405
MKLLAGVMEQVIKRNPNEPEFHQAVREVLESLEIVAEKNPEYLKAGIFERIVEPERQIIFRVPWVDDNGKVQVNRGFRVQFNSAIGPYKGGIRFHPSVNLGIIKFLGFEQIFKNSLTGLPMGGGKGGSDFDPKGKSDGEIMRFCQSFMTELYRHIGPDTDVPAGDIGVGAREIGYMFGMYRKIRNEFTGVLTGKGLTWGGSLVRTEATGYGLCYFMEEAMKTIKGKSFEGATVVISGSGNVAIYATEKAQQLGAKVVALSDSNGYVYDPDGIKLDTVKQIKEVERKRISEYVKYHPNAKYTEGCSGIWSVKCDVALPCATQNELDGNAAKTLVENGCYAVGEGANMPCTPEAIDIFMKNGVLYAPGKASNAGGVATSGLEMCQNSMRYSWSFEEVDAKLKDIMVNIFRNVRAVAKEYGQEDNLVLGANIAGFLKVANAMMAQGV

SEQ ID NO: 34374 - protein, 511 aa, Clostridium thermocellum ATCC 27405
MNNELILVLDFGGQYNQLIARRVREANVYCEVLPYNSSIDKIKSKNPKGIIFTGGPASVLDPKAPICDREVFELGIPILGICYGMQLMSHMLGGTVEKAEQREYGKVNITFDTSSMLFEGIEKESTCWMSHTYYVNNLPEGFVKCADTPNCPVAAIENREKKLYGVQFHPEVVHTPKGRDILNNFLYKICGCSGDWKMASFIEHSINSIREKVGDKKVLCALSGGVDSSVAAVLVHKAVGKQLTCIFVDHGLLRKYEGDQVEEVFKKQFDISLIRVNAEDRFLEKLKGVTDPERKRKIIGEEFIRVFEEEAKKIGTVDFLVQGTIYPDVIESGVGDAAVIKSHHNVGGLPDYIDFKEIIEPLRSLFKDEVRKVGIELGIPEDIVMRQPFPGPGLAVRVIGEVTKEKVDILRDADYIFREEIKNAGLDREINQYFAVLTGMRSVGVMGDERTYDYTLALRAVTTIDFMTADWAKIPYDVLEKVSNRIVNEVKHINRIVYDITTKPPATIEWE

SEQ ID NO: 34375 - protein, 333 aa, Rhodobacter sphaeroides 2.4.1
MTIRVAINGFGRIGRNVLRAIVESGRTDIEVVAINDLGQVETNAHLLRFDSVHGRFPAKVTSGDDWIDVGRGPIKVTAIRNPAELPWAGVDMAMECTGIFTTKEKAAAHLQNGAKRVLVSAPCDGADRTIVYGVNHATLTADDLVVSNASCTTNCLSPVAKVLHDAIGIAKGFMTTIHSYTGDQPTLDTMHKDLYRARAAALSMIPTSTGAAKAVGLVLPELKGRLDGVSIRVPTPNVSVVDLVFEAARDTTVEEVNAAIEAAACGPLKGVLGFTTEPNVSSDFNHDPHSSVFHMDQTKVMEGRMVRILSWYDNEWGFSNRMADTAVAMGRLL

SEQ ID NO: 34376 - protein, 527 aa, Saccharum officinarum
MAMATMAMRRAVALGARHIPAAAAASSRVVPLRHMSTDAGAAMEKIRAAGLLRTQGLIAGKWVDAYDGKTIEVQNPATGEVLANVPCMGSRETSDAIASAHSTFYSWSKLTASERSKALRKWYDLIISHKEEPALLMTLEQGKPMKEALGEVNYGASFIEYFAEEAKRIYGDIIPPTLSDRRLLVLKQPVGVVGAITPWNFPLAMITRKVGPALACGCSVVVKPSEFTPLTALAAADLALQAGIPAGALNVVMGNAPEIGDALLQSTQVRKITFTGSTAVGKKLMAGSANTVKKVSLELGGNAPCIVFDDADIDVAVKGSLAAKFRNSGQTCVCANRILVQEGIYEKFATAFIKAVQSLKVGNGLEESTSQGPLINEAAVQKVEKFINDATSKGANVMLGGKRHSLGMSFYEPTVVGNVSNDMLLFREEVFGPVAPLIPFKTEEEAVHMANDTNAGLAAYIFTKSIPRSWRVSESLEYGLVGVNEGIISTEVAPFGGVKQSGLGREGSKYGIDEYLELKYICMGNLG

SEQ ID NO: 34377 - protein, 595 aa, Rhodobacter sphaeroides 2.4.1
MPMVRTLALFLASALPAFAQQASDTLAPEAPTAPAAFGSLSPAAAAAMETRDSGRPVEAEDWMVVAANPLAVEAGAEILRSGGSAADAMVAVQTVLGLVEPQSSGLGGGAFLVWFDAATGAVTTLDARETAPRAATPRLFQTPEGEPLEFLDAVVGGRSVGTPGTPLLLEEAHRRWGRSGWSDLFDPAIRLAEEGFAVSPRLAGLVAEDPEGLSRFPATAAYFLPEGQPLKAGALLKNPDYAETLRRLAAEGADAFYRGPIAEEIVATVRGAEGNPGVLALEDLAAYRVVERPPVCADYRGAEICGMGPPSSGALTVGLILGALEPYDLAALGPENAESWRLIGDATRLAFADRGRYMADRDFVPVPVEGLLDPAYLAARAELLRGDDALPEVAAGTPEWDHAGLLAPDESLELPSTSHISIVDAAGNVLSMTTTIENGFGSRLMTNGFLLNNELTDFSFRTHAEGWPIANRVEPGKRPRSSMAPTIVLRDGKPVLAVGSPGGSTIIGYVAQALIAHLDWGMDVQQAVAMPHLVNTFGPFQIEAGTRAEALSQPLADLGYDVKPVDLTSGLHAISLGERLQGGADPRREGIALGE

SEQ ID NO: 34378 - protein, 538 aa, Datura metel
MGNCNACIRPEEASKADPQTKPKKSRERRPNPYSGSPAPIRVLKDFFPKTRISDKYILGRELGRGEFGVTYLCTDRETREALACKSISKKKLRTAVDIEDVRREVAIMSSLPDHPNIVKLRATYEDNEAVHLVMELCEGGELFDRIVARGHYRERAAAGVARTVAEVVRMCHANGVMHRDLKPENFLFANKKEHSALKAIDFGLSVFFKPGERFSEIVGSPYYMAPEVLKRNYGPEVDIWSAGVILYILLCGVPPFWAETEQGVALAILRGVIDFKREPWPQVSEKAKSLVRQMLEPDPKKRLTAQQVLDHPWIQNAKKASNVPLGDIVRTRLKQFSIMNRFKKKALRVIAEHLKLEEIEVIREMFALMDSDGDGKITYDELKAGLRKVGSQLAEAEMKLLMDVADVDGNGVLDYGEFVAIIIHLQRMENDEHFRRAFMFFDKDGSGYIELDELQEALADESGACDTDVLNEIMSEVDTDKDGQISYEEFVAMMKTGTDWRKASRQYSRERFKSLSVNLMKDGSLQLQDVLSGQTVIV

SEQ ID NO: 34379 - protein, 403 aa, Populus trichocarpa
MASATFSVAKPSLQASGKGFTDFSGLRSSSAFLPFTKKTSDDFVSVVAFQTSMGNSSGGYRKSAAEAKIKVAINGFGRIGRNFLRCWHGRKDSPLDVIAINDTGGVKQASHLLKYDSTLGIFDADVKPVGDNAISVDGKVIKVVSSRNPLDLPWKDMEVDLVIEGTGVFVDREGAGKHITAGAKKVIITAPGKGDIPTYVVGVNADAYNPDEPIISNASCTTNCLAPFVKVLDHKFGIIKGTMTTTHSYTGDQRLLDASHRDLRRARAAALNIVPTSTGAAKAVALVLPTLKGKLNGIALRVPTPNVSVVDLVVQVSKKTFAEEVNEGFRESAEKELKGILSVCDEPLVSVDFRCSDVSSTVDSSLTMVMGDDMVKVIAWYDNEWGYSQRVVDLAHIVADQWK

SEQ ID NO: 34380 - protein, 460 aa, Picea sitchensis
MALASSSPAAAIIAAAPACTPAAAKSSSLTQSLPSTFKRVEISEFAGLKSTSGCITYGRQARENNLNLFDALASQVVAKAGNSGAIKGETVAKLKVAINGFGRIGRNFLRCWHGRKDSPLEVVVVNDSGGVKNASHLLKYDSMLGTFKANVKVVDNKTISVDGKPILVVSSRDPLKLPWAELGIDIVIEGTGVFVDGPGAGKHIQAGARKVIITAPAKGADIPTYVVGVNEGDYSDEVSNIVSNASCTTNCLAPFVKVLDEEFGIVKGTMTTTHSYTGDQRLLDASHRDLRRARAAALNIVPTTTGAAKAVSLVLPQLKGKLNGIALRVPTPNVSVVDLVVNVEKKGISAEDVNAAFRSAADGPLKGILAVCDVPLVSVDFRCSDVSSTVDSSLTMVMGDDMVKVVAWYDNEWGYSQRVVDLAHLVAAKWPGAGKGGSDDPLDEFCKTNPATDECRVYEA

SEQ ID NO: 34381 - protein, 274 aa, Chlorobium tepidum TLS
MKQLENRVAVITGSTKGIGRAIAREFVRQGAKVVITSSRQENVEAALREYPKDLVHGHVSDVSSYASVESLVDAAVRRFGALDCFINNAGISDPFTSVCDSDPAVWSRVIDTNLKGTYNGSRAAARYFLSVGRRGKIINMAGSGTDKGSNTPFISAYGSTKAAIARFTFAMAEEYRNAGLSIMLLHPGLVRTEINHPERTTPELQKQLKTFNIILDIFAQSPDLAVRYAVKMASSWSDGKTGLYLSALDGKRKKMMLLSYPFRKLFNRIDRQTY

SEQ ID NO: 34382 - protein, 253 aa, Bacillus anthracis str. A2012
MGLGYIGLPTSAMFAKYGTEVVGVDIHQKVVDKLNNGEIHIEEPGLGEVVKEVVANGKFRASLTPEEADAFIISVPTPNHDDEHKSCDLSYVLTATEKVLPFVKKGNVIIVESTIAPRSMDDYVKPLVEEAGFTVGEDIYLVHCPERVLPGQILHELVHNNRIVGGVTPACAEAGARVYGVFVEGEIIKTNAKTAEMSKLMENTFRDVNIALANELTKVCNSLDINVLDVIEMANKHPRVNLHYPGPGVAGTV

SEQ ID NO: 34383 - protein, 502 aa, Haemophilus somnus 2336
METVLNFINGNQVASKGTKAWPIYNPATGEQIRQVMMSTAEEVNEAVEVAQKAFPAWAATSPLRRARVMFKFKQLLERDWDDLARLITEEHGKVFSDAQGELTRGLEVVEFACGIPHLVKGEFSEQAGRGIDIHSAMQPLGVCVGITPFNFPAMVPMWMFPIALACGNTFILKPAKADPSLSIRLAELLKEAGLPDGVFNVVHGDRQDNEILLRDPRVKAVSFVGSTTAAAHVHAIGSAHGKRVQALGAAKNHGLVMPDVDIEATANALLGAAFGAAGERCMALPLAVTIDDETADKLVAALKPKVEALRYGPGLTKEGEKENDFGPLITRQHRDNVKRYVDIGVSEGATLVVDGRDKFPAGYENGFFIGGCLFDHVTPDMTIYKEEIFGPVLGIVRAKNFQEAMKLINEHQFGNGAAIFTNNGAAAREFAYQVQAGMVGVNVPIPVPMAFHCFGGWKESAYGALNAYGPDGVRFYTKMKTVTTRWPEKDLSSQAAFSMPTL

SEQ ID NO: 34384 - protein, 298 aa, Brevundimonas vesicularis
MAIVGIRRQTPLVGASCAPDDLRLQVQARLAEVAPAHDGLLSTAAREALLGRGKRVRPVLAMLAAAHVGGDPEDALEYACALEMVHAASLVLDDLPCMDDASLRRGQPTLHHRHGEDTAVLAAVALLNQATRLVLQTAAPAETRLAALDLLTQAIGFDGLSEGQMRDLRDDARDRDESALRQINDLKTGALFVATVRGGGLLGGGDAQDLARLSIFGEAIGFAFQLCDDLLDVCSTVDAAGKDVGQDDDTTTFVDLWGECRTRAAVRQSLGKAVEAVGHDSPLAVYVLDLFQQAELGV

SEQ ID NO: 34385 - protein, 369 aa, Triticum aestivum
MNILGAPTIVPAVILIVLAVLIYRQLSKAKEDDEWEIKCGMPSFTYKELVTATEGFSNKMLLGKGGFGRVYKGVLPTTTQHVAIKRVSPESKQGKKEFMAEIAILGHVRHRNLVQLLGYCRYKQELLLVYDYMPNGSLDRYLYDKTTPTLDWAQRLRIIKGVASGLFYLHEDWEQVIIHRDIKASNVLLDDDMNGRLGDFGLARLHDHGVDAHTTLVAGTWGYIAPELARLGKATKATDVFAFGVFTIEVVCGRKPIGPANTSGGLLALADWVRGTWQGGSIVDAVDPELKDYDRAEVELVLKLGLLCSHSLPRSRPCMRLVMLYLEGGARLPNFHPASLVADGHEDEETDHKALSTSAATTVTILSGR

SEQ ID NO: 34386 - protein, 386 aa, Herbaspirillum seropedicae
MKIHEYQGKEILRQFGVTVPRGIPCMSVDEVEAAAKELGGPVWVVKAQIHAGGRGKGGGVKVAKSIEQVKEYANQIMGMQLVTHQTGPEGQKVRRLLIEEGADIKKELYVSLVTDRVSQKVVLMASSEGGMDIEEVAHSNPEKIHNVIIDPVDGLTDAQADDVAAKIGVPAASIPAARKNLQGLYKAYWETDASLAEINPLILTGDGKVIALDAKFNFDSNALFRHPEIVAYRDLDEEDPAEVEASKFDLAYISLDGNIGCLVNGAGLAMATMDTIKLFGGEPANFLDVGGGATTEKVTEAFKIMLKNPELKAILVNIFGGIMRCDVIAEGVIAASKAVSLKVPLVVRMKGTNEDLGKKLLADSGLPIISADSMEEAAQKVVAAAK

SEQ ID NO: 34387 - protein, 957 aa, Coccidioides immitis RS
MKFAHRYSHTLESEGFPLHWRIRDELAELGLPPEILNHLWLSEDVRDSIGKSDTSIVGFSYSFLSCPSGLAPKLTFLIDPNESHIPESLSAETREYLRILLGTSGKQAASSTSETSVSLAQHVVVSCGLASGEMEVEIPLHSDSEFFQILKEELSILHDLQERERKELDSQVKHLRDSLVETISSHLSWSRPTLSTWREIFRLYIDSQVFFSTDELDSGERTSTVAHQQLVKFQSSLSENNRYKKLGKNGRVVLESFLKINFVLLQSLKFQEINRIALRKILKKFDKRTALRAYPAIPLLEPLLARNVAKILCQTISQELLSIVPQITDYLCPICLSISFKPVRLRCNHVFCIRCLVIMQRAQQNQCALCRREVVMEATSDNLDQELLAFLSTVFPKETRIKQKENERAARMDLYGNTYDACTVIHFCKSTLDPGQVRKFSMGQSQSADGGNGDPHRREHDEANGKRDFYEILGVEPLATTEHLKKAYRKKALELHPDKNYGNIEQCTALFAEVQAAYEVLSDPQERAWYDSNRDAILYSKDNPRGDQHSYNSKVTGTEDILNAMINFNPRTEFSDDSSGFFGGVREIFERLAQEELNACIMDGLESVNYPSFGFKDDDLDSIRPFYGVWSTFSTKKSFAWKDTYKYSEAPDRRVRRLMEKENKRLRDEAIREFNDAVRSLVSFVKKRDPRYKSAVQNELERQRLLRDSAAMQAARSRAANEARLGEYSVPEWAQREQLEEEMFSATSESEQDHFECVVCRKTFKSEKQFEAHERSKKHIKAVRQLRYEMKVEDDHVQINTSESQEGVVCGPEFDTTTARETDTADNLQKETLQCEDIGENATMDNEGTEFSCNSDTPEQPPTIKHPLGESHDSAVDQVGASFANSSIADARPTESTVRKAGKAKQKRAKKAIKTEGQNGNLACGTCGRSFMSRNKLFCHLKEESHGIPSSQVNEKH

SEQ ID NO: 34388 - protein, 360 aa, Wolbachia endosymbiont of Armadillidium vulgare
MFIENRNSNKVERAISEIRSGRPIVIYDESNYLLFAAVEALERDLFNQYKLISSNVYVTLTSSKVKYISQNKEHNSKRLLVNNFDELLYLINCSKEDCIKELQCSKTIDECAIALLKFSELLPYALVADMTFENNHEMQNWCEKNDVIALDTSFINNFQENQDVYEVCKTSLFLKQTQEVDIISYRTESGGREHHAIIIGNPDKDDEPLVRIHSSCYTGDLLDSLSCDCRSQLHQAIQMIADFGSGIILYLMQDGRGIGLANKLRAYSMQRRHNLDTVDANRVLGFEDDERSFAVAVEILKKLDIKKIQLLTNNGRKLSELKNNGIEVTKCLPLIMERNEYNDSYMETKFGRLGHGLRVF

SEQ ID NO: 34389 - protein, 465 aa, Archaeoglobus fulgidus DSM 4304
MWNGPLLNYRDTFPQFRTFVAIVNAINNIRINLISVLTRHHTMKIAILGSGYVGIVTGIGFAELGHEIVFIDVDERKVEMLNSSKPPIYERGLEELMKKNRGKYRATTDYREALESSELTFICVGTPSKGDGSIDLKYAESASKEIGKALKNNDNFHVVVVKSTVVPGTTEDKIKPIIEKESGKKAFEDFGLAMNPEFLREGNAVYDFFNPDRIVIGVKDERTKSVLEELYKPFDCPKLITEIKTAEMIKYASNAFLATKISFANEIGNICKKLRIDVYKVFEGVGLDHRINPSFFRAGIGFGGSCFPKDVRALIRKSEELGENPKILKAVMEVNERQPLKMIELLKKHIPNLRGKKIGVLGLAFKPDTDDVRESRAIPIVKALLEEGAEIIAYDPKAIENFRKFFPQVEYANSAEDVITKSDAVLIVTEWKEFEELDYSGKIVIDGRRVEKAMKEAKIYKGVCW

SEQ ID NO: 34390 - protein, 158 aa, Haemophilus influenzae Rd KW20
MIRIGHGFDVHAFGEDRPLIIGGVEVPYHTGFIAHSDGDVALHALTDAILGAAALGDIGKLFPDTDMQYKNADSRGLLREAFRQVQEKGYKIGNVDITIIAQAPKMRPHIDAMRAKIAEDLQCDIEQVNVKATTTEKLGFTGRQEGIACEAVALLIRQ

SEQ ID NO: 34391 - protein, 477 aa, Neisseria meningitidis MC58
MNEYSQLIKHPDISLPPVSDGIKVDNPATGETLAFVRKTDSDKLKNLIQKAAAAQKLWAAKTALERADVLWRWYFQIKENKEALARLMTMEQGKSLTEARGEIDYAASFVRWFAEEARRIDGDVLTSVKASQKLVVLKQPVGVTAAITPWNFPSAMIARKAAPALAVGCAMIVKPASLTPLSAYALASLAYEAGIPQDLLPVVSGSASEIGHEFATNPIIRKISFTGSTEVGAKIFADSAADIKKLSLELGGNAPFIVFDDADLDKAVEGALASKFRNSGQTCVCTNRVYAQSAIYDEFCRKLSEKAAALKLGNGLEDGVNQGPLIEEKAVEKVEQHIADALAKGASCLTGGKRSALGGTFFEPTVLSGVTAQMAVAREETFGPLCPVFRFETEAEVIEAANNTEYGLAAYLFTADTARQWRVGEALEYGMVGINTGLISNEAAPFGGVKRSGLGREGSKYGADEYLELKYLCMDVG

SEQ ID NO: 34392 - protein, 490 aa, Halobacillus dabanensis
MDLKLQQYINGKWVDAKSDNTRTIINPFNQEIIATVPEGDESDAKAAIAAAREAFDNGEWAFTPATERGAVVRKIAELIERDKEELAYLESLDTGKTVEESRGDMEDIAGVFRYYGELADKDGGELIDSPVPNSISKVVHEPVGVCGQITPWNYPLLQASWKLAPALATGNTLVMKPSEITPLTTIKVFELMEEAGVPAGVANLVLGAGDTIGEELSNNTDVDLISFTGGIATGKKIMQAASVNVKKLALELGGKNPNVIFADADFDLAVDQALNGVFFHAGQICSAGTRLIVEESIHDEFVNALVERVKKFKLGSGFDEDTQMGPLISADHLAKVEKYVEAGIEEGATLAVGGKRPEDPELQKGFFYLPTIFTDCTTDMKVVQEEGFGPVITVEKFRSEEEAVKLSNDSIYGLAGGVFTNDIAKAERCAAKMRMGTVWINEFNLYFPHAPWGGFKQSGIGRELGKLGMEEYTETKHIFQNLKPEPINWF

SEQ ID NO: 34393 - protein, 338 aa, Kluyveromyces lactis NRRL Y-1140
MTGNSVIPIWVDCDPGHDDAVAILLSCFHPSIRLLGISASYGNASPENTLYNTLSLLTAFGKQDEVPVYKGAQRPWVRDVAYAPDIHGETGLDGTTLLPKPKRSFVDADYIKAMENAILANGGNIALVSTGTLTSIATLFKEKPYLKEQVRYISIMGGGLHAGNRNDNDSAEFNIWADPDAADFILNDEDIKHKCILSPLDLTHTCIATEYIDKTILGDGSCKLRKLFYELFLFFAKTYKNKQGFEAGPPVHDPVTLMPLLYLYGHISNDILRFKYGRFDLSIDKNQDSINYGRTIVTQEYPSDSNFGLMVGLQINVDFFWNQVLNAIDVAENYPGSL

SEQ ID NO: 34394 - protein, 672 aa, Ustilago maydis 521
MYDKQVQVVTQSSDPPSIPFRHTLRSIDLVLVRETRSLIQPPTMADTASTSSSSAAYLSGPFPSARALTENDVTPSVPPTRSEEKSAPTHLYTDLPPHLMQADNTPDYLRLILNADVYDLVKQTPLQAGVNLSSKLGCQVLLKREDLQPVFSFKLRGAFNMMQQLDSEQKWKGVIACSAGNHAQGVAMAGAHLKIPCTIVMPKGTPEIKTANVKRLGAKVVLFGQDFDEAKAECTRLSKAYGLTIIPPFDHPRVIAGQGTIAVEICRQTDMSQVDAIFCCVGGGGLLAGVAAYIKRIAPPHVKVIGVETFDADALAQSLEAGHRVLLNEVGLFADGTAVRIVGEECFRICRDTVDGVVRVTNDEICAAIKDTFEDTRSIPEPSGALAVAGMKRYIAAHNLQGSGKKFVALVSGANMNFGRLRFVAERAELGENKEALLSVEIAEEPGAFLKLHNHINPRMVTEFSYRYGDSSKAQILLSFMLNGTNARAASASSESQSHASGAVPVPEVVTNTASTGDASISSSSASIDTDVNQLAQSVAPSTLSTSSELASILAALTADGMTPIDLSGDEVSKSHLRYLVGGKTSVANERIFRFEFPERPGALRKFLVGMQSGWNISLFHYRNHGADMGKILLGIQAPKQDEIKFETFLKELGYQYHEETNNPVLRRYLAQ

SEQ ID NO: 34395 - protein, 1271 aa, Coccidioides immitis RS
MSRAPAGFADFFPTAPSVLQKKRSKAAQDRHAANTPKAADPLPNLGLSSTPDIKGGVGTSADNPVRAVGERSAETTLALGDTNGATSSSSLSTGSSGFFSASAPPGVAKPNGISSCALTPLTNTDSSPPCKIESPLGSKSGSTDAAPQLAPTCEAHGGPEPVTITPLHTPPTPRVQARPANSEVKGHKITYDPDLDRKFPSKARRRKPQYETFGVDDEKDPPPCDPRMAIANYTRGAACKQKTKYRPTPYILRPWAYDPTTSVGPGPPTQIVVTGFDPLTPIAAISALFSSFGDIGEINNRTDPMTGRFLGVCSIKYKDSRAFRGGISLSASQAVRRAYLECKKEQRIGTRRIRVELDRNGVVSGRMVAKLITAQKAEFPSLEESRKESVGDNDNRLPIGDGAKKDNEQSKDNLPPSTAPKGPSGRSSLHPSLLAPDGPRAVLKSPVPSRIEETPILQQIKRDPYIFIAHCYVPVLSTTVPHLERRLKLYDWKAVRCDKTGYYIIFENSRRGELEAERCYRMCHMTALFTYVMNMECQPYGNPNYERSPSPERIKAEKREKAKRERLHREMELDIEEEKRLRVENLDPAREALSVLIIELRDKLLDDVKSRVAAPALYDFLEPDRHNAKRQQLGIPAPEGTGRPSFRIDASTDGTVVHSQPDAYSRHHRPGGVSSLNVLALPRIRKVKGFEQGNAVYIDERRRAKPRKREFRPLYHRLQQLHEIEDSDDDQQVSFARDTEEVESRPLSRLSSESAESDNEDDLMRKSPSLLDAKPLDVPLPESESLAGGIEQSGLPDREKSIIEELERGINTLPTSSKKRKRLIEELATRKKRKEVDNLFELDAKPLESLVEETAQEALPADSTDALRTVTPVLKDKKRKVKGQSGKQIFEERQAPKRKEIDSTQPLLFEESVELLPEGEIEISEPAIEELKPEVEWGVSTDEPRPTAEDDDTIVLDLDGWQSLIKDDEDINFLKKALSEHLAADIGNLAAWTWKHKEIKAINRGGDRGPVHSETRIDGYYVPNPSGSARTEGRKRIRESEKSKYLPHRIKVQKAREERLAKAKNDPHAAAAEAARLLAAKSLSKSTSRSTRVNNRRLIADINAQKQALPMQNGDSDVLRFNQLKKRKKPVRFARSAIHNWGLYAEENISANDMIIEYVGEKVRQQVADMRERRYLKSGIGSSYLFRIDENTVIDATKRGGIARFINHSCTPNCTAKIIKVDGSKRIVIYALRDIDRDEELTYDYKFEREWDSDDRIPCLCGSAGCKGFLN

SEQ ID NO: 34396 - protein, 319 aa, Erwinia carotovora subsp. atroseptica SCRI1043
MSGLVNGKWVNGDVAAEEIKNGAFHREETKFRQTELVPEAGRYQLFVSYLCPWASRTLIFRKLKGLENIISLSIANPRIADNGWEFATPQDAGEHAGEIHYLHQLYTASVPDYTGKVSVPVLWDRVEGRIVNNESADIIRMLNSEFNDLTGNHLDFYPSELHSEIDRWNETVYHNVNNGVYKTGFAKTQEHYNDAVTTLFTTLDELDDHLGSHRYILGDTLTEADWRLFVTLIRFDVAYHGAFKCNLKRIADYPNLSNYLRELYQWPGIAETVNIDHIKAGYYSIAWLNPTQIVPVGPQVDLYQPHNREILGTSRIATR

SEQ ID NO: 34397 - protein, 282 aa, Zea mays
MAGGGQAAISFMTRMAKVAAGLGVAASAASTSFYTVDGGERAVIFDRVRGVLPRTMSEGTHLLVPILQKPFIFDIRTRPHSFSSTSGTKDLQMVSLTLRVLSRPDVEHLPDIFTSLGLEYDEKVLPSIGNEVLKAVVAQFNADQLLTERPHVSALVRESLTKRAREFNIVLDDVAITHLAYGQEFAQAVEKKQVAQQEAERSRFLVARAEQERRAAIVRAEGESESARLISEATTTAGNGLIELRRIEAAKEIASVLSRTPNVSYIPAGDNGQMLLGLNAAR

SEQ ID NO: 34398 - protein, 451 aa, Oryza sativa
  misc_feature (442)..(442): Xaa can be any naturally occurring amino acid
MTEMPPGSSSVLCSCAPLSRLGWLQFPTKLSLAMAASDSDSDADAAAAAAASLLPAPIHLLPPDALHNVLLRLPLRDAVVCRPVSRLFHETLSHNFLALLPSLRLLLLRHPRPEGGGCLHAFDPDRRHWLRLPFSAFLPNQSFSPVASSPSLLYLWLESPSASPASLPSSSSSSSTASTAHPPKSLAVCNPFAGTYSFLPPLGSAWARHGTVLAGPGGVVLVLTGLAALSYTPSGSGKWMKHPLSLPSKPRSPILASGAAAVFALCDVGTPWRSQWKLFSCPLSMLTGGWAPVERSAWGDVFEILKRPRLLAGAGGRRVLMIGGLRSSFAIDAPCSTVLILRLDLATMEWDEAGRMPPNMYRCFTGLCEAAAQGNAMPTAVAGGNNKVKVFGGDGKVWFAGKRVRGKLAMWEEDELGNSGGKWDWVDGVPGYSDGVYRGFVXFDGGFTAMP

SEQ ID NO: 34399 - protein, 193 aa, Arabidopsis thaliana
MGYETKSTLDTERSTAPGTGTTTKSCSMTQVVLRFVLFAATLTSIVVMVTSKQTKNIFLPGTPIRIPAAEFTNSPALIYFVVALSVACFYSIVSTFVTVSAFKKHSCSAVLLLNLAIMDAVMVGIVASATGAGGGVAYLGLKGNKEVRWGKICHIYDKFCRHVGGAIAVSLFASVVLLLLSIISVLSLYKKIR

SEQ ID NO: 34400 - protein, 232 aa, Glycine max
MPKRTTHTYSSEDAAPEGPHSDLFVYYCKHCGSHVLITDTQLQKMPKRKTDKAYVLDKSKHLARLNMKEGGKVVLKRGEGKMEKQFRMNCMGCGLFVCYRAEQELELSSLIYVLDGALSTVAAETNPQDAPVPPCISHLEGGLVQLAIEVEDRAQRSAITRVNADDVRVTVAAPAARGEANNELLEFMGKVLGLRLSQMTLQRGWNNKSKLLVVEDLTARQVYEKLLEAVQP

SEQ ID NO: 34401 - protein, 406 aa, Rhodopirellula baltica SH 1
MSSSIELNTIPEAVEAIARGEVIIVIDAEDRENEGDFICAGEKATPELINFILGGRGQLCVSVLPEVCKRLELTPVVPQNNAPLQTAFMTPIDIATAKTGITAAERSETIRRLTDLEATQEDFVRPGHVYPLLAKEGGVLRRAGHTEAAIDLSRMAGLAPVGVLCEVLNETGDRASRDDLARLAKQHDLKIISIEHLIAHRRVSEKLVSRAATSKLPTRYGDFEVIVYEVNYEAQEPIALVYGDLTAPGTPPLVRMHSSCFTGDLIQSLRCDCGDQLHMALDMISREGRGALIYLPQEGRGIGLAQKIRAYALQDKGMDTVEANHALGFKADMRDYGVGLQILKDLGLSEVRLLTNNPKKTKAFNLRGFDLKVVDQVPIVPPTNEHNVRYLETKREKMGHQLPPLS

SEQ ID NO: 34402 - protein, 362 aa, Oryza sativa Japonica Group
MGVYLSTPKTEKYSGEGGNDRLRYGLASMQGWRTTMEDAHTALPRLDECTSFFGVYDGHGGKAVSKFCAKHLHLQVLKNEAYSSGDLATSVLKSFFRMDEMMKGQRGWRELAELGDKGQKFTGMLEGIIWSPKPGESDKPEDTWTEEGPHSHFPGPTSGSTACVAIIRNDELIVANAGDSRCVLSRKGRAYDLSKDHKPDLDAEKERILNAGGFIVAGRVNGSLNLARAIGDMELKQNEFLPAERQIVTAEPELNTVKLSEDDEFIVLACDGIWDCMSSQEVVDFVHKEMNTEDSLSAVCEKLLDHCLAPVSGGDGCDNMTVIIVKFKKPSKSAATSSTNQSVSSEEMRPNELDDGPSDPNK

SEQ ID NO: 34403 - protein, 302 aa, Burkholderia pseudomallei
MKYDLPGVATLDALLRDQRAAYLRAPYPSWATRADHLRALRKMLLENRDALAAAINADFGHRAKEEVLMSEIWLAKEEIDEALKHGKRWIKPKSRTMNKWLRPARAKVMPQPLGVVGIVVPWNYPVLLAAGPLICALAAGNRAIVKMSELTPRTSQLFEELISKTFARDHVAVVNGDAQIGAAFSGLPFDHLLFTGSTNVGRHVMRAAAEHLTPVTLELGGKSPVIVGPRARFDAAVDAVITGKTLNAGQTCIAPDYVLVPRGKEAEFVARARARMARLYPNLSTNPDYTSIISERHFARLQ

SEQ ID NO: 34404 - protein, 188 aa, Ashbya gossypii ATCC 10895
MLANSSRSLLPSSRRLFSSSAASLGTKVFFDTSINGAKAGRIEFELYDDVVPKTAENFRALCTGEKGWGYKGVPFHRIIPDFMLQGGDTDLTNGFGGKSIYGARFPDENFTKKHTRAGLLSMANAGRNTNGSQFFITTVPCPWLDGKHVVFGEVTKGMDVVKAIESYGTGNGQPSAKVVIEDAGELKE

SEQ ID NO: 34405 - protein, 263 aa, Haemophilus influenzae Rd KW20
MARRPLVMGNWKLNGSKAFTKELIEGLKAELHDVTGCDVAIAPPVMYLGTAEAALSGCGCSCGGKSVIQLGAQNVDINVKGAFTGDISTEMLKDFGAKYIIIGHSERRTYHKESDEFVAKKFGALKEAGLVPVLCIGESEAENEAGKTEEVCARQIDAVINALGVEAFNGAVIAYEPIWAIGTGKSATPAQAQAVHAFIRGHIAAKSQAVAEQVIIQYGGSVNDANAAELFTQPDIDGALVGGASLKAPAFAVIVKAAAAAKN

SEQ ID NO: 34406 - protein, 369 aa, Pseudomonas syringae pv. syringae B728a
MKSRAAVAFEPGKPLQIVEIDVEPPRKGEVLIKITDTGVCHTDAFTLSGDDPEGLFPVVLGHEGAGIVMEVGEGVTSVKVGDHVIPLYTAECGECLFCKSGKTNLCTAVRATQGKGVMPDGTSRFSYNGQPLYHYMGCSTFSEYTVVAEVSVAKINPDANPEHVCLLGCGVTTGIGAVHNTAKVQPGDTVAVFGLGGIGLAAIQGARQAKAGRIIAIDTNPAKFELARSFGATDCVNPKDHEQPIQQVIIEMTGWGVDHSFECIGNVHVMRAALECAHRGWGQSIVIGVAGAGQEISTRPFQLVTGRTWKGSAFGGVKGRSQLPKMVEDAMKGEIELAPFVTHTMGLDRINEAFDLMHEGKSIRTVIKY

SEQ ID NO: 34407 - protein, 216 aa, Pyrococcus horikoshii OT3
MVVIGEKFPEVEVKTTHGVIKLPDYFTKQGKWFILFSHPADFTPVCTTEFYGMQKRVEEFRKLGVEPIGLSVDQVFSHIKWIEWIKDNLSVEIDFPVIADDRGELAEKLGMIPSGATITARAVFVVDDKGIIRAIVYYPAEVGRDWDEILRLVKALKISTEKGVALPHKWPNNELIGDKVIVPPASTIEEKKQREEAKAKGEIECYDWWFCYKKLE

SEQ ID NO: 34408 - protein, 410 aa, Pyrococcus horikoshii OT3
MFRLEDFNFHNKTVFLRVDLNSPMKDGKIISDARFKAVLPTIRYLIESGAKVVIGTHQGKPYSEDYTTTEEHARVLSELLDQHVEYIEDIFGRYAREKIKELKSGEVAILENLRFSAEEVKNKPIEECEKTFLVKKLSKVIDYVVNDAFATAHRSQPSLVGFARIKPMIMGFLMEKEIEALMRAYYSKDSPKIYVLGGAKVEDSLKVVENVLRRERADLVLTGGLVANVFTLAKGFDLGRKNVEFMKKKGLLDYVKHAEEILDEFYPYIRTPVDFAVDYKGERVEIDLLSENRGLLHQYQIMDIGKRTAEKYREILMKARIIVANGPMGVFEREEFAIGTVEVFKAIADSPAFSVLGGGHSIASIQKYGITGITHISTGGGAMLSFFAGEELPVLRALQISYEKFKEVVK

SEQ ID NO: 34409 - protein, 495 aa, delta proteobacterium MLMS-1
MIPAFHAIRQDWFANLRGDTLAGLVVALALIPEAIAFSIIAGVDPKVGLYASFCIAAVTAFTGGRPGMISGATGAMALLMVVLVKVHGLEYLLAATLLTGVLQILAGSLRLGSLMRFVSRSVVLGFVNALAILIFLAQIPELTNVGWQTYALLAAGLALIYLFPYITRVVPSPLICILALTSITMFFGIDVRIVGDMGALPDSLPIFLFPDIPLNFTTLVIIFPFAVTLAVVGLLESMMTATIVDDLTDSPSNKNRECVGQGVANITSGFLGGMAGCAMIGQSVINIKSGGRGRLSTLLAGVFLLLMVVFLGDWVAQIPMAALVAVMIMVSIGTFNWESIRNLHKTPKSSTIVMTATVVVVVATHNLALGVLVGVLLSALFFTYKISKIMYVGSTLTDDGMTRNYTVIGQIFFTSADNFIASFDMKEAVEKVQIDVSRAHFWDITAIAALDKVVLKFRREGTEVEIIGLNKASETMVDRFAVHNKPDAVEKLMGH

SEQ ID NO: 34410 - protein, 334 aa, Zea mays
MPAVASLWAPPAAARRRRFSPVVSSSLRRVASGGGSSWRSERRLMSELERTVTAGATERVIRSYVGTKSERAALAALSRLLMDSDPLAIPFYEAVTQARWFKWSSIHAAAVAALLEANGRAGESRSLIADSVSQHLQQSTDEVALFYCDLIAAFSSRGLKDRATEFHMELRSMPPLSGRKAYAAMVKSLCLLGMPAEAEAALREMVSRGHRPEAAQFGAVARCYGRAGSPADMERVIASMADAGGIRLGAGAADAVLSCYSACRDHARTLAWLKRMRKLRVAVTAKGYNLVLNSCPSLASVVRELGPELPLSTAGLVGWLRSAIPGIPDRYQPA

SEQ ID NO: 34411 - protein, 405 aa, Neisseria meningitidis MC58
MALIVHKYGGTSVGSPERIKNVAKRVAKARAEGHDIVVVVSAMSGETNRLVALAHEMQEHPDPRELDVVLATGEQVTIGLLAMALKDIGVDAKSYTGWQVALKTDTAHTKARIESIDDEKMRADLTAGKVVIVAGFQGISSEGDISTLGRGGSDTSAVALAAALKADECQIYTDVDGVYTTDPRVVPEARRMDTVTFEEMIELASLGSKVLQIRSVEFAGKYKVRLRVLSSLQDGGNGTLITFEEDDNMERAAVTGIAFDKNQARINVRGVPDKPGVAYQILGAVADANIEVDMIIQNVGSEGTTDFSFTVPRGDYKQTLEILSERQDSIGAASIDGDDTVCKVSAVGLGMRSHVGVAAKIFRTLAEEGINIQMISTSEIKVSVLIDEKYMELATRVLHKAFNLG

SEQ ID NO: 34412 - protein, 213 aa, Mycoplasma pneumoniae M129
MDSKKGILVAIGGGSCSGKTTIADMIYQLLRKKLKVAILPQDNYYKPYKNKSMAQRKAINFDHPDAFDWKLLWSHLDNLLMGKTVAVPMYDYVNYTRKKETIEIGPLNVVILEGLMPWFDERIAKLCKLKIFVEATGEERLIRRIERDWERGRDVASIIKQWREAVSPMYEIFVEKMKQKADLIIPWSERHEVSTNVLDFAIEHLFRKHVDPN

SEQ ID NO: 34413 - protein, 258 aa, Neisseria meningitidis MC58
MSDNALTSSRRFGGIARLYGDSALAHFSQAHVCVVGVGGVGSWAVEALARTGIGRLTLIDLDNVAESNVNRQLHALTGDFGKAKVTALRERITQINPQCEVFEIEDFVTEDNLPEYFGKGFDFVIDAIDQVRVKAAMAAYFVERKQPFVLSGGAGGQKNPALIQTADLSRVTHDPLLANLRYTLRKRYGFSRDTKANMRVPCVYSTENIVPPQSREACSADAAPQGLSCAGYGASMLVTASFGLYCAQAAVEHIADKK

SEQ ID NO: 34414 - protein, 226 aa, Coccidioides immitis RS
MAAFKGPGQTEIYNGANLRIAIVHARWNTPIIEALVGGAKKKMLELGVKERNIVIESVPGSFELPFAVRRVYTASHVQAASVSSGASGSVTTDLLSSSTDFAKLSTTTGTASDTTTPKPTCASAPDATATGPFDAIIAIGALIKGETMHFEYIADAVSHGIMRVQLDAGVPVVFGLLTVLTEEQGLVRAGMVEDKNGKRHNHGEDWGSAAVELGIKRRAWEEGKIG

SEQ ID NO: 34415 - protein, 351 aa, Mycoplasma pneumoniae M129
MKAYAMLKIGATGWIEKPRPVCGPNDAIIRPLAVAPCTSDVHTVWEGGIGERHNMVLGHEGCGVVDEVGSEVKSFKVGDRVLVAAITPEWNSVNAQAGYPMHSGGMLGGWKFSNVKDGMFAEYFHVNDAEGNLALMPEGMDLADACMLSDMIPTGFHANELADIQYGVALSFFCAGPVGLMAIAGAALKGAGRIIVVDSRPDIVEIAKAYGATDYIDFKKVSVVDEILKWTNNEGVEKVLISGGGSTILETAIKVLRPGGKIGNVNYFGAGEFLTIPRVEWGVGMAHKAIHGGLMLGGRLRLEKLARLIMTKKLDPSKMITHRFKGFEHIEEALFLMKDKPKDLIKSVVIF

SEQ ID NO: 34416 - protein, 259 aa, Streptococcus thermophilus LMG 18311
MEDIMPKNVLIIGATSGIGEATARAFAREGANLILTGRRVERLEALKAEFEATYPNQKVWTFALDVTDMEMVKDVCQAILKSVGQVHVLVNNAGLALGLIAYQDYEEWDLLTMLDTNVKGLMMVTRQILPSMVATNEGHIINMGSKAGIYAYAGAAVYSATKAAVKTFSDGLRIDTIATDIKVTTIQPGIVETDFSQVRFHGDKEDKAANVYQGLEALQAQDIAEAVLYVTKQPRRVQISDMTIMANQQATGFTIHRGE

SEQ ID NO: 34417 - protein, 404 aa, Buchnera aphidicola str. APS (Acyrthosiphon pisum)
MKTPIYLDYAATTPVEFEVAKKMMNYLTIDGVFGNSASRSHKFGWKAEEVVDIARNQISELIGADSREIVFTSGATESNNLAIKGIASFHQNKGKHIVTSKTEHKSVLDTCRYLENKGFTVTYLTPKNNGIIDLNNLKKNIKKDTILVSIMHVNNEIGIIQDINSISQICRNHGVFFHVDATQSVGKIPIDLKKIPIDLMSFSAHKIYGPKGIGGLYVRRKPRVRLLSLIHGGGHERGMRSGTLPVHQIVGMGESFVLAKRKIHDDFIHLTKLKNILWNGIKNIEEVYLNSDLQQGAPHILNVSFNYVEGESLIMALKDLAISSGSACTSASLEPSYVLKSLGIRDELAHSSIRFSIGRFTTEKEIIHAIKLVHKSIHRLRELSPLWEMFKSGVDLNSIEWDHV

SEQ ID NO: 34418 - protein, 127 aa, Buchnera aphidicola str. APS (Acyrthosiphon pisum)
MAYSKKVMDHYENPRNVGSFSSTDLNVGSGLVGAPACGDVMKLQIKVNEKGIIEDACFKTYGCGSAIASSSLVTEWVKGKSIEEAESIKNTTIVEELDLPPVKIHCSILAEDAIKAAISDYKRKKIN

SEQ ID NO: 34419 - protein, 128 aa, Brassica napus
SQLKLVIRPMYSNPPLHGASIVATILRDSEMFNEWTLELKAMADRIINMRQQLFNALKSRGTPGDWSHIIKQIGMFTFTGLNSEQVAFMRQEYHIYMTSDGRISMAGLSMRTVPHLADAIHAAVTQLK

SEQ ID NO: 34420 - protein, 104 aa, Arabidopsis thaliana
PSKFIHLLIEKLLLCTESDRALSGIPYHHELFLDRSLTGKCLTTIRGERMNYYKPNSAIGTTSSTRDHASGSNGRKLMSIYRPNGDIFTGPSCSGHGGGRTPAP

SEQ ID NO: 34421 - protein, 833 aa, Chromobacterium violaceum ATCC 12472
MSDALLTPQLIRLGCQPAGKEAAIREAGRMLADAGCIAPDYIDSLLRREAVANTYLGNGIAIPHGMVEDRAMVLRTGVAILQIPAGLEWNPGQRTHLLCAIAARSDDHLVLLRQLTRLLQDEARLLPLFSTRDSADLIAALEQPAETPQADVEAQDLDVRDEWRLDYPNGLHARPAALWVEAARRSPAQLQVRHGGRAADAKNLISLLQLGLRQGDLVAVSARGPQAEEGVRQLLKAMREASLAEQTAAAIAAQRAAGARKTAGWQPAGSLISLPGIAASPGLAIGTVRVLAGERLQVPDRPVSLADGGDRLHEALAATRQQLAELADSTQATLGAGEAGIFRAQAELLNDTDLITLSCQLMVAGHGVEWSWHQAVERLAEKISALGNPLLAARAADLRDVGRRVLFHLDPALQGSAPAEFGPDTLLLAADLSPSDTASLDLSRVKGLATAQGGPTAHTAILARTLGLPALVAAGAALLDVADGSPAILDGDAGRLYLNPGDADLASARAWQQRQLEDQQKQQAERQQPGQTADGKRIEIAANINRPDQAAAALDAGAEGVGLMRTEFLFLEREAAPDEEEQLRTYLAMQQALQGRPLIVRALDIGGDKQVPYLNLPHEDNPFLGMRGARLLLSRRELLEPQLRALYRAAKAGKPLSIMFPMISSLKEITRLKGLCEGVRKELDAPQVPIGIMVEVPAAALLADQFAPYVDFFSIGTNDLTQYALAMDRQHPELAAEADSLHPAVLRLIRQTVQGAAAHRRWVGVCGGIAGDPQGAAVLAGLGVDELSMSPHDIAAVKAMLRRHSHARLRELAEQALACDSAEEVRQLLEALA

SEQ ID NO: 34422 - protein, 71 aa, Populus trichocarpa
MIIPVRCFTCGKVIGNKWDTYLDLLQADYTEGDALDALGLVRYCCRRMLMTHVDLIEKLLNYNTLEKSEGS

SEQ ID NO: 34423 - protein, 293 aa, Gemmata sp. Wa1-1
  misc_feature (278)..(278): Xaa can be any naturally occurring amino acid
MGLKYLEKAANKDLAAAATKDLANPKTSKERAAVADAWYKLARDYRGAEHRRVVDRAWEWYSAALVVAVGDEELKVGERVKEIEKNYPELFNVTFAGHTGATAAIAVTPNGKTLVSVSNDNSVRLWDATTGRLQKVLEGHTSWVGSVVLTPDSTQAVTAGGDNTIRVWDLQSGKEVAQLKGHAVAIRGLALTADGKTLISGASDKTCRAWDLKSGKEVKRYGEGKDSVESVAVTPDGKSVLVGNDAGVVTVYDAKSGDVVSKFDKHDGMMVYTIVTCXTGMTASPGARKLDRP

SEQ ID NO: 34424 - protein, 465 aa, Gemmata sp. Wa1-1
MDSEGHLTRTGILVGTPAYMAPEQADAQRAREVGPACDVYGLGAILYECLTGRPPFRADTLLATVLQVRTEEPVAPRRVQPTVPRDLETICLKCLHKDPRRRYASAEALADDLQRYLDGKPVVARPAGAIERGVKWARRRPTLAALLVTVPVLVALGFSGVFWQWRETVGALRETREEQKKTLRAHEATKAHLYLNQVSLAWNELRSNSGGRAEALLRDTDPALRNWEWHYLQRHAQTDLFTLVGHNNEIQALAWSPDGQLIASGSGHWSSGLESEFKIWDARTGQLLRTITQEIGTVLALAFSPDGTVLASGSHDRVVRLWNPRTGQLVKELPGHSNRVSRVVFSPDGKRLASAALDNTARIWDLETGKTLHVLRGHKDNVFCLEFSPDGKMLVTGDRKHVARVWDPATGKLLRTETGPGDLRATSFSPDGAWLAFGTFQGSIWVWDLTQPNAKPVIHNPVGSI

SEQ ID NO: 34425 - protein, 357 aa, Physcomitrella patens subsp. patens
MAQSGRPLPPQLDKTSTKELNLVVLQRMDQFVEDILATATHVSVYQMNSDTNQWISKDVEGSLFVVKRGRHPRFQFIVMNRRSTDNLVENLSGDLEHTLQSPYFIYRNANQEDLCIQFHNSSEFDDVTSLFQRLLDSLSKHHLKPRSFSPSSEFTELETVPTSFHLESPLERGPLVSSALPEAQDEPHERFFVCICFLCHVSHCESLFDLMQPRTIVSAPHTLPPMPMPSLISPPTTALPPTSLAPAFSLDSPDVISVGRATLIKPSYFAHPPLNSAHGASSAPTGSLAPPTASVQPSHGLPFSQHFPSSPPVSLSQPMQFSGSLSKGAVREALNRLVKNEQFIDIVYREIVNKHSY

SEQ ID NO: 34426 - protein, 467 aa, Rhodopirellula baltica SH 1
MNLPAVPQLHPPRLPNPETIRQSLGSLVLSQIRGRVASVTGDAVTVQGMTAPLGAICELMPPDAKPTLARVIGFDDTRPILAPMEAISALAAGDRVRLVSRSLTLRVGDSLCGRVIDAFGRPIDGKPLSDDLVRVSASRAAPDSLDRPPIDEPLQTGVRAIDAMLTCGVGQRLGIFAGSGVGKSTLLGMLTRGTTADRIVIAMVGERGREVQEFMQRALGAAGLKRSVVVVATSDKPAAQRLSAAWTATAIAEKFRDEGHRVLLLVDSVTRFAMAQRELGLAAGEPPTTRGYPPSVFNMLPQLVERAGRTTKGSITAFYTVLVEGDDNNEPISDTVRGLLDGHIVLNRKLAHRGHYPPIDIPESISRVANHLVTPETYQATLGIREHMVQYQTSEDLISIGAYRSGSDPRVDTAIAMRDPINDLLRQDANEITPIADSQARVQKLHQAASAALAQLNQPQAPAPKPA

SEQ ID NO: 34427 - protein, 122 aa, Gemmata sp. Wa1-1
MASGGSPTCQFVRPRRAVPRGKLIQAAAGDRAAGEFVVGKKLYVGNLSWGVTDSQLQDMFTPYGSVVSAQVIMDRDTGRSKGFGFVEMGTDQEAQAAITGMHGQVIEGRPLTVNEARPKKLI

SEQ ID NO: 34428 - protein, 259 aa, Ralstonia metallidurans CH34
MENASTAHPFSLTGRVALVTGGAQGLGQAIAAGLAAAGAHVLICARNAARVDEAVAQLRANGLGAEALVLDITDEAAVAAAFDDIVACHGRLDILVNNAGARNRNSMAHLDAADLRQMLETNLVAPYALCRHAAQWMQRGGYGRIVNVTSIAGQVARANDVLYPATKGGLDALTRAMAADLGRQGITVNAIAPGYFATEPNQTMVADKTVAEWLRNRTSLGRWGQPEEVAGAVVFLASPAASYVTGQVLAVDGGYLGHF

SEQ ID NO: 34429 - protein, 168 aa, Ashbya gossypii ATCC 10895
MSEIPENSKVSIYSKNEKKARELIQKFSMKPMPGITRVTFRKKNNQIFAIDNPDVYKTQGGNYVVFGEPKVDDFTRRLARAQQQAASAAKDPQSIQADMAAAAAAPAAPAAPAAAPEEDEAGQVDESGLDGQDIELVMQQANVSRNKAVKALREHNSDIVNAIMSLSK

SEQ ID NO: 34430 - protein, 97 aa, Oryza sativa Japonica Group
MSMPGDAQPEGSHQSASSAKPALSSCRRNKSENTSFVSDLRDHIQEFIHASPNEHRTCFTKTIKRMFGMSKVVAERSTEAKEPGAESVLPLQTTVSR

SEQ ID NO: 34431 - protein, 361 aa, Brassica napus
  misc_feature (221)..(221): Xaa can be any naturally occurring amino acid
  misc_feature (302)..(302): Xaa can be any naturally occurring amino acid
  misc_feature (323)..(323): Xaa can be any naturally occurring amino acid
  misc_feature (333)..(333): Xaa can be any naturally occurring amino acid
  misc_feature (346)..(346): Xaa can be any naturally occurring amino acid
  misc_feature (350)..(351): Xaa can be any naturally occurring amino acid
AFSFRVEDMATLEDSFLADLDDLSDNEAELDESDGDDAKKDEEDIDMDMADLETLNYDDLDSVSKLQKSQRYLDIMQKVEEALGKESDGTEKGTVLEDDPEYKLIVDCNQLSVDIENEIAIVHNFIRDKYRLKFQELESLVNHPIDYARVVKKIGNETDLTLVDLEGLLPSAIIMVVSVTALTTKGSPLPEDVLQKTLEACDRALDLDSARKKVLDFVESXMGSIAPNLSAIVGSAVAAKLMGTAGGLSALAKMPACNVQVLGHKRKNLAGFSSATSQLRVGYLEQTEIFQSTPPALKSRAXQDLGCKSTLAARVDATRGDPXGTNGKALREXIRKRLRSARTSSXKQPXXLPVPDPSLKK

SEQ ID NO: 34432 - protein, 657 aa, Vitis vinifera
  misc_feature (261)..(261): Xaa can be any naturally occurring amino acid
  misc_feature (280)..(280): Xaa can be any naturally occurring amino acid
MISLNSSSFLSNSGFSGISRSVSQRKVLPPVVLALGSNGRAGELNVSAVMESTLKELRDGNTVLEVDSKSAVSGGVRDVQGEDAATEDQIVTPWTITVASGYSLLRNPHHNKGLAFTEKERDHHYLRGLLPPAVVSQDLQVKKLMANIRQYTVPLQKYMAMMDLQERNEKLFYKLLMDNVEELLPVVYTPTVGEACQKYGGILRRPQGLFISLNEKGKILEVLKNWPEKNIQVIVVTDGERILGLGDLGYGDTSRETLFIXRTWRSSSFSRNRVSGFPHXKKRFHRFSYLCLPVTIDVGTNNQKLLDDEFYIGLRQKRATGQEYAELIHEFMCAVKQNYGEKVLVQFEDFANHNAFDLLARYGTTHLVFNDDIQGTASVVLAGLISALNLVGGTLAEHTFLFLGAGEAGTGIAELIALEMSKQTQAPLEETRKKIWLVDSKGLIVSSRMDSLQHFKKPWAHEHEPIKNLVDAVKAIKPTVLIGSSGVGRTFTKEVVEAMASFNEKPIILALSNPTSQSECTAEEAYTWSEGRAIFASGSPFDPVEYNGKVFVPGQSNNAYIFPGFGLGLIISGAIRVHDDMLLAASEALAKQATQENFDKGMIYPPFSNIRKISAHIAANVAAKAYELGLATRLPQPENLVEYAENCMYSPVYRSFR

SEQ ID NO: 34433 - protein, 434 aa, Pyrobaculum aerophilum str. IM2
MTEKWYQLSVEIHRKYGGKISITPKVPIRSMDDFAIYYTPGIAEVSRQIHKNPELAFELTSRWNIIGVITDGTRVLGLGNIGPEAAYPVMEGKALIFKYLGGVDAVPIPIRVKTQEEFVFVAKALEPALGGINLEDIESPKCFYLLERLREELRIPVWHDDQQGTATATLAGLINALKLVGKKISDVTIALIGAGASNIYTARILIKYGAKPGNLILVDSRGILHPERDDIDKLMIENPWKYKYAIETNAERRKGGIPEAMRGADVVIAASSPGPGVIKKEWVASMNKDAIVFALANPVPEIWPWEAKEAGAKIVATGRSDFPNQVNNSLIFPAVFRGALDVRATAITDEMLIAAAEEVAKFAEEKGIHEEYIIPKMTEWEVYVREAAAVAATASAQKVARIPRSYKEELEIAGSIIGKSIKMLEVLMMEKIIE

SEQ ID NO: 34434 - protein, 347 aa, Herbaspirillum seropedicae
MTRYDTLCEQLPQHPKRWLITGVAGFIGSNLLARLLTLGQQVTGLDNFSTGRQANLEEVRAEVGAAAWANFRFIEGDICDAATCLRACDGADYVLHQAALGSVSRSIEDPVRTNLNNVNGFLNMLVAARDAGVARFVYAASSSTYGDHPGLPKVEEVIGKPLSPYAVTKYVNELYAEVFARCYGMESIGLRYFNVFGRRQDPHGAYAAVIPQWVTAMIRNGELRINGDGQTSRDFCYIDNVVQANLLAATAGEEAVNQVYNVALNDRTSLNDLYAMMRELLVQRFPHLQEHRPSYVGFRAGDIRDSQADIGKARQRLGYAPTHRLRAGLEQAMSWYIDHLGSTACNT

SEQ ID NO: 34435 - protein, 970 aa, Ustilago maydis 521
MAARTPAREAAAAKMAMPSSLLKRAALTASDETLLVSALKMLATFDNAKNTVFALVVYRYSTRLLRHVRAYGISESLYQLYCLVSAQVFALILKTPAAKRKVKRELDTAMAEVEAKIVPRPSHLGIHHQLPQLGKETEWIKTELAKLQIMEAGVDAKLVEADWENRDGQMVWKGGKVSGAVYHGGDDLSDLLADTIKQFLVSNPLHPDVFPGVRKMEAEVVSMVLKMYNAPAGAVGATSSGGTESILLSCLAMREWARATKGIKEPELIVSVSAHAAFDKAGQYFGIKVHHIPVDTVTRKVQVARVARAINSNTIGLVGSAPNFPDGIIDDIPNLAKLAKRHKILLHVDCCLGSFLVPFLEKAGFESEPFDFRIDGVTSISCDTHKYGFGPKGLSTILYRSADLRRFQYYVKTDWPGGVYATPTLSGSRPGSLIAGTWAAMMKIGESGYTQSCRDIVGAAKEISTRIEREIPELRVLGRPLVSVVAFASAAPNSVSIYDLITDLKAAVKHARSSFTGQKGSMATLYGLGSGVSATAIVGQLASSRLELQQLRLQDLVGLAQPCTLLCQGVQFLLGVHRLGVLLAEEDADFVAQGCALLHLARQLCAQVLVFELYTLQPILDVVQTCLCGLDEVDHLVPLVQELAHLHPLLLVLEHIRIPLDHFGAIALQLRVHLKQLCARLLELPSERNDACRIFLCLRLELSCLGRPRLALLSLGVLRLVRRAQRAHRVVQILSLRFQRCVGDLFAISKLSSLRSSRFSRCSNDTLVAWLPTLPSTAVRIVVSYDGMADNAVSLDASRAAVVGASAAKWLIASACRDVGDRGDVPLTVWLRDCNDDIEPDRERTRASDTCVAGDTGIEQATCEALELPIAVTIAGVAAAAALAAGSSFESVLLAAMPLAALVGIGVASSNLCAAAAMGWMAEPKSISVHVASLAASPAAPVETSGAPERNDAYVSRISSGFTERGSRCH

SEQ ID NO: 34436 - protein, 272 aa, Nocardioides sp. JS614
MGFLDRGIEIKTPEQIAGMRKAGLVVGRTLELLRGHVRAGITTGELDTIAEDHIRSSGATPSFQGYHGFPASICASVNDEVVHGIPGERVIAEGDVVSIDCGAIVDGWHGDAAITVAVGAVSRELTELMRVTEEAMWHGIAAARLGGRVTDISHAVERQVRGQGSYGILEDYTGHGIGSQMHQPPNVPNYGRPGKGPRLVEGLALAVEPMITLGAKDTSVLEDDWTVVTDDGSWAAHFEHTFTLTPRGTWVLTALDGGEAALTALGVRYGGD

SEQ ID NO: 34437 - protein, 224 aa, Bacillus cereus G9241
MTVQKNLTTVNESIKQSCARAGRSLQDIKLVAVTKTVGIEKTNEVIEAGIIDLGENRNEGFLQKYEHFGSKVNWHFIGSLQTRKVKEIINEIDYLHSLDRLSLAKEIQKRADKKVKCFIQVKTSSEESKQGLAIEETVSFIQSLQELDKIEVVGLMTMAPFTEEEEEIRRCFKELRMLQAEVQELELLHAPCKELSMGMSNDYTIAIEEGATYIRLGTILVGKA

SEQ ID NO: 34438 - protein, 228 aa, Kluyveromyces lactis NRRL Y-1140
MTADIPYYESNNDKNVLRLFVIRHGQTEENLKKILQGHMDTELNETGQDQASKLGEYLANDRHLKFDKIYSSDLKRCQQTINTALEHFNTPTKLVTTDKLRERCMGVIEGMYLKDAEEYADSMGKPTFRDFGEPAEEFQQRLSNVLENIVSENKSSKNIGIVSHGGSIRQLLKLLDYKELNVHKIIVFNTSVTIIDYIKNEKAYVVRRVGNTQHLGSGEFIVSDLQLR

SEQ ID NO: 34439 - protein, 183 aa, Brassica napus
MSRNKQEEDPRINGIKTKIRVVPDFPKKGIMFQDITTVLLDPKAFKDTIDLFVERYRDKNISVVAGIEARGFLFGPPIALAIGAKFVPLRKPKKLPGETIFEEYELEYGNDRLEMHVGAVEAGDRALVVDDLIATGGTLCAAINLLERVGAEVVECACVIELPELKGRQRLKGKPLCMLVEYR

SEQ ID NO: 34440 - protein, 223 aa, Neisseria meningitidis MC58
MTTQDELKRIAAEKAVEFVPENEYIGIGTGSTINFFIEALGKSGKKIKGAVSTSKKSGELLAQYDIPVVSLNEVSGLAVYIDGADEVNHALQMIKGGGGAHLNEKIVASASEKFICIADESKYVSRLGKFPLPVEVVESARSLVSRKLLAMGGQPELRIGYTTFYGNQIVDVHGLNIDQPLTMEDEINKITGVLENGIFARDAADVLILGTEEGAKVIYPCQG

SEQ ID NO: 34441 - protein, 525 aa, Erwinia carotovora subsp. atroseptica SCRI1043
MTQNIHQHRILILDFGSQYTQLVARRVRELGVYCELWAWDVTEAQIRGFNPNGIILSGGPESTTEFGSPRAPEYVFNAGVPVLGVCYGMQTMAMQLGGHVEGSNEREFGYAQVEVKTNSALVRDIQDALSATGAPLLDVWMSHGDKVTAIPEGFETVASTDTCPFAIMANEEKRFYGVQFHPEVTHTRQGQRMLERFVLDICQCEALWTPAKIIDDAVNRIREQVGNDSVILGLSGGVDSSVTAMLLHRAIGDRLTCVFVDNGLLRLNEADQVLEMFGDNFGLNIVHVAAEDRFLNELAGEDEPEAKRKIIGRVFVEVFDEEANKQAEVKWLAQGTIYPDVIESAASATGKAHVIKSHHNVGGLPKEMKLGLVEPLKELFKDEVRKIGLELGLPYNMLYRHPFPGPGLGVRVLGEVKKEYCDLLRRADAIFIEELHKADLYNKVSQAFTVFLPVRSVGVMGDGRKYDWVVALRAVETIDFMTAHWAHLPYDFLGRVSNRIINEVDGISRVVYDVSGKPPATIEWE

SEQ ID NO: 34442 - protein, 205 aa, Nocardioides sp. JS614
MSGAQRGQRGGERRGGRDDRRGQGADKTAYIERVVAINRVAKVVKGGRRFSFTALVVVGDGEGLVGVGYGKAKEVPAAIAKGVEEAKKHFFRVPRIQGTIPHPVQGEKAAGVVLLRPAAPGTGVIAGGPVRAVLECAGIHDVLSKSLGSSNQINIVHATVEALRMLEQPEAVAARRGLPVEEVAPAALLKARVEVPAGVSEEVSS

SEQ ID NO: 34443 - protein, 160 aa, Neisseria meningitidis MC58
MTNIRIGQGYDVHQLTEGRKLILGGVEIPFEKGLLGHSDADALLHAVTDALLGAAGLGDIGSHFPDTAAEFKDADSRVLLRAAYQSVQAQGWQAVNVDTTVIAQKPKLAPHIPQMRANIAADLGIDISCVNIKGKTNEKLGYLGRMEGIEAQAAVLLVRI

SEQ ID NO: 34444 - protein, 331 aa, Ustilago maydis 521
MGCGASKVDKEGQARNDAIDAQLKKDRLAQKNEIKMLLLGAGESGKSTILKQMKLINHGSYSAEERESYKEIIFSNTVQSMRVLLDAMERLDIPLADGTNAPRAEIILGLSPSIESSVLPRQVADAIHGLWADAGVQACFARSREYQLNDSAKYYFDSIQRMAEPSYLPTDQDVLRSRVKTTGITETHFKIGELNYKLFDVGGQRSERKKWIHCFENVTAIIFLVAISEYDQLLYEDENVNRMQEALTLFDSICNSRWFVKTSIILDYTGGADYNSACEYIVNRFVSLNQSDAKTIYTHFTCATDTSQIKFVMSAVNDIIIQVNLRDCGLL

SEQ ID NO: 34445 - protein, 225 aa, Brucella suis 1330
MRPIAIAPSILSADFARLGEEVDAVLEAGADWVHIDVMDGHFVPNITFGPQVVKAIRPRTKAFFDAHLMIAPCDPYLEPFAEAGCDLITVHAEAGPHTHRSLQSIRALGKKAGLALNPATPAEALTNVLDDLDLILVMTVNPGFGGQKFIAPMLDKIRRVREMVGDRPIDIEVDGGITPETAGSVVAAGANILVAGSAVYKGNSVESYRANIDAIRAAAEAARNR

SEQ ID NO: 34446 - protein, 534 aa, Physcomitrella patens subsp. patens
MTTNTEPLLRPRNSNGIGNNTSGAFRRNDDDEDRAYEKSEQVKVHFGDELDTDEEGGDLDFLPKFSWRKLWMFAGPGFLMSIAYLDPGNIESDLQSGATAGYALLWLLMWATIMGFLIQKLAARLGVATGCHLAELCREEYPFWARMVLWVLTELAIIGADVQQVIGSAIAFRILSNGVIPLWAGVLITGIDGFLFLFLENYGVRKLELLFCIFIGIMGLSFAWMFGETNPNVKAVATGLIFPTVPSSAVDKAVGIVGAVIMPHNIFLHSALVQSRDIDTSKKSRVREALRYYNIESAFALFVSFLINLCVMAIFAKAFYGKEEAEIIGLANAGEYLQERYGGGMFPILYIWAIGLLAAGQSSTMTGTYTGQFVMAGFLNLRVKKWIRVLVTRSVAIVPTVIVALAFDSSQNELDNLSEWLNVLQSVQLPFALLPLLCLVSNARIMGVFVISKTTKVVAWIIALLVMAINMDLWFAFVFGSTFSSVFSILVFVVISVLYIAFVIYLVLEPSQPDGNWANIKQIFVSSRSDDGLR

SEQ ID NO: 34447 - protein, 472 aa, Yersinia enterocolitica (type 0:9)
MMLLPVIMAGGTGSRLWPMSRELYPKQFLRLHGVNSMLQETVNRLEGISVREPVVICNEEHRFLVAEQLRQINKLSHNIILEPVGRNTAPAIALAALNAVSQGDDPIMLVLAADHIINDCDAFHQAVRDALPFAERGSLVTFGIVPTGPETGYGYIQRGEVTVNELSEAFKVKRFVEKPDTETAEQYISSDEYYWNSGMFMFRAKRYIQELEKFRPDILDACKAAMKDSDSDKDFITIDKDKFSACPDESIDYAVMEQTSNAVVVPLDAGWSDVGSWSALWDVSSKDKSGNSVTGDTFLHDTQNCYINTDEKLVAAVGVDNLVIVSTKDAVLVVDKSKVQDVKKIVEHLKQTKRSEYRRHREIYRPWGRCDIVVNEQRFNVNRITVKAGGAFSMQMHHHRAEHWIVLSGTAKVTIADKTFLITENQSTFIPIGSLHMLENPGQIPLELIEVQSGSYLGDDDIIRIKDHYGRC

SEQ ID NO: 34448 - protein, 241 aa, Triticum aestivum
  misc_feature (41)..(41): Xaa can be any naturally occurring amino acid
  misc_feature (84)..(84): Xaa can be any naturally occurring amino acid
MAAASAPLLLALALAFAASLAAAGDTNRVYDPCTDTKIQRXGDGFTFGLAFAASGAFYSGSTQLSPCDRRLTQLSQLSLFRPKXVDEISLLTVNTTTGFSPASAGGYMVAFAGRKYAARSQPVFVSNSSVTVSSFTLVLEFNKGKLQNLHWKKDGCGACTGKPNFICLGKQTCAIRTNICKSNNQGSMDCSIGIQLAFSGTDKHESVLNSWYEVSNLQQYSLYGLYSNVKGSLSGQFNKFF

SEQ ID NO: 34449 - protein, 401 aa, Coccidioides immitis RS
MQPRLREIFLCREKPLLQHEHTLAAEFLIYPSNCKNVFHESCAKRAGITTVQSDIFKPTKYGGKYTVTLIPGDGIGAEVAESVKTIFKADNVPIEWEQVDVSGVDAGTKHSEELFKESIASLRRNKIGLKGILHTPVERSGHQSFNVALRQELDIYASIVLIKNIPGYKTRHDNVDLCIIRENTEGEYSGLEHQSVSGVVESLKIITRAKSERIAKFAFSFALANNRKKVTCIHKANIMKLADGLFRSTFKKVAESYPTLEINDMIVDNASMQAVSRPQQFDVMVMPNLYGGILSNIGAALVGGPGIVPGCNMGRDVAVFEPGCRHVGLDIKGKDQANPTALILSGSMLLRHLGLDEHANRISKAVYDVIGEGVVRTRDMGGQAATHEFTRAVLDKMEAAL

SEQ ID NO: 34450 - protein, 186 aa, Triticum aestivum
  misc_feature (50)..(50): Xaa can be any naturally occurring amino acid
  misc_feature (78)..(78): Xaa can be any naturally occurring amino acid
  misc_feature (97)..(97): Xaa can be any naturally occurring amino acid
MVRPCMLAMLWLRNLRLSRFGRALFRGIFVQNLQSCNFLLDDNDHAVLGXFGIPSLLFGLPLPNPDLIQRLGTPNYMXPEHWRPDIRGPISYETDSXWGFAWSILEMFSGVQTWCAKSPDEIYQSVVLKKEKPMFLYNLPTEVANVLSGCYEYEFRDHSLMLDILQSFERLEVTHERWQCKIADIK

SEQ ID NO: 34451 - protein, 296 aa, Yersinia enterocolitica (type 0:9)
MKCLKAVIPVAGLGTRMLPATKAIPKEMLPVVDKPLIQYIVNECVAAGVKEIVLVSHSSKNAIENHFDTSFELEAALESRVKRQLLKEIKSICPPDVTIMQVRQGHAKGLGHAVLCAQPMVGDNPFIVLLPDVLLDDSTADLSKENLASMIKRFEETGRSQIMVEPVPQADVSKYGIADCGHVDLAPGESTLMTAVVEKPSVEDAPSNLAVVGRYVLSKDIWPLLKKTPRGAGDEIQLTDAIAMLMEQEPVEAFHMTGKSHDCGDKLGYMKAFVTYGVRHSTEGENFTAWLKQQID

SEQ ID NO: 34452 - protein, 433 aa, Bacteroides fragilis YCH46
MKYYSTNKQAPLASLEEAVVKGLASDKGLFMPMTIKPLPQEFYDEIENLSFREIAYRVADAFFGEDVPAETLKEIVYDTLNFDVPLVPVKENIYSLELFHGPTLAFKDVGGRFMARLLGYFIRKEGRKQVNVLVATSGDTGSAVANGFFGVEGIHVYVLYPKGKVSEIQEKQFTTLGRNITALEVDGTFDDCQALVKAAFMDQELNERLLLTSANSINVARFLPQAFYYFYAYAQLKKAGRAENAVICVPSGNFGNITAGLFGKKMGLPVRRFIAANNKNDIFYQYLQTGQYNPRPSVATIANAMDVGDPSNFARVLDLYGGSHAAIAAEISGTTYTDEQIRESVKACWQQTGYLLDPHGACGYRALEEGLQPGETGVFLETAHPAKFLQTVESIIGTEVEIPAKLRAFMKGEKKSLPMTKEFADFKSYLLGK

SEQ ID NO: 34453 - protein, 297 aa, Yersinia enterocolitica (type 0:9)
MTKLKAVIPVAGLGMRMLPATKAIPKEMLPIVDKPLIQYVVNECVAAGIKEIILITHSSKNAVENHFDTSYELEAMLEARVKRQLLDEVQSICPPGVTIMHIRQGHAEGLGHAVLCAKPLVGNEPFAVLLPDVLIDDAKSDLTKDNLAQLVKRFDETGVSQVLVHSVEPEALSNYSVISCEKSDLAPGESSRIKAMVEKPQSPVDLQSNLSAVGRYVLSADIWPLLEQTKPGAWGRIQLTDAIDALTENAPVDAVALTGQSYNCGEKLGYMQAYVAYGLRHPKQGAEFKAWLKKYIN

SEQ ID NO: 34454 - protein, 311 aa, Novosphingobium aromaticivorans DSM 12444
MSQALKHFLNLTDAGGDAIAAMLNDALDRKSARAGQPKGKADADAPLGGRVLAMVFEKNSTRTRVSFDIAMRQLGGSALILDAGTTQLGRGETIADTARVLSRMADAIMLRTDDHAKVEELARHATVPVINGLTDLSHPCQIMADLLTVIEHGKALPGLEVAWLGDGNNVLNSIVEAAGLMKFNVRIGVPEGYESDAGMIEAAVLAGAGIRVIRDPVEAVRGADVVVTDTWISMGQAHAEAKLAAMAPYQVNDALMAHAKPDAVFLHCLPAHRGEEVTDAVIDGPRSVVWDEAENRIHAQKSVLRWVFGQI

SEQ ID NO: 34455 - protein, 162 aa, Griffithsia japonica
MVKCFFDVSIAGKPSGRIVMELRPDVVPKTAENFRALCTGEKGFGFKGSVFHRVIPGFMLQGGDFTRGDGTGGKSIYGEKFEDENFTLKHTGPGTLSMANAGPNTNGSQFFICTETTSWLDGKHVVFGKVVEGMNVVRAVEAVGTRSGSTSQKVSVTDAGEC

SEQ ID NO: 34456 - protein, 267 aa, Novosphingobium aromaticivorans DSM 12444
MGFDRGRRGRGRDKRDGFGDEGGFDPYGGGGFGGGGYDRGGFGGGDRGGFGGGGRGGFGGGDRGGFGGGDRGGFGGGDRGGFGGGGGGRGGFGGPRGGGGGGGMPAQVVGTGKGVVKFFNGQKGFGFIQREDGGEDVFVHISAVERAGLEGLAEGQQLEFNLVDRGGKISAADLQVVGDVIPVAAKPASPQRELTGEKASGTVKFFNAMKGFGFITRDDGQPDAFVHISAVERSGLRELNEGDKLEFDLEVDRRGKYSAVNLVPRQD

SEQ ID NO: 34457 - protein, 246 aa, Zea mays
  misc_feature (22)..(22): Xaa can be any naturally occurring amino acid
  misc_feature (24)..(24): Xaa can be any naturally occurring amino acid
  misc_feature (28)..(30): Xaa can be any naturally occurring amino acid
  misc_feature (32)..(32): Xaa can be any naturally occurring amino acid
  misc_feature (35)..(36): Xaa can be any naturally occurring amino acid
  misc_feature (38)..(38): Xaa can be any naturally occurring amino acid
  misc_feature (42)..(42): Xaa can be any naturally occurring amino acid
  misc_feature (44)..(44): Xaa can be any naturally occurring amino acid
  misc_feature (46)..(46): Xaa can be any naturally occurring amino acid
  misc_feature (53)..(53): Xaa can be any naturally occurring amino acid
  misc_feature (56)..(58): Xaa can be any naturally occurring amino acid
  misc_feature (63)..(63): Xaa can be any naturally occurring amino acid
  misc_feature (66)..(68): Xaa can be any naturally occurring amino acid
  misc_feature (70)..(72): Xaa can be any naturally occurring amino acid
  misc_feature (76)..(78): Xaa can be any naturally occurring amino acid
  misc_feature (80)..(81): Xaa can be any naturally occurring amino acid
  misc_feature (85)..(85): Xaa can be any naturally occurring amino acid
  misc_feature (87)..(90): Xaa can be any naturally occurring amino acid
  misc_feature (93)..(93): Xaa can be any naturally occurring amino acid
  misc_feature (98)..(101): Xaa can be any naturally occurring amino acid
  misc_feature (111)..(111): Xaa can be any naturally occurring amino acid
  misc_feature (113)..(113): Xaa can be any naturally occurring amino acid
  misc_feature (116)..(116): Xaa can be any naturally occurring amino acid
  misc_feature (119)..(121): Xaa can be any naturally occurring amino acid
  misc_feature (123)..(124): Xaa can be any naturally occurring amino acid
  misc_feature (130)..(130): Xaa can be any naturally occurring amino acid
  misc_feature (132)..(132): Xaa can be any naturally occurring amino acid
  misc_feature (135)..(135): Xaa can be any naturally occurring amino acid
  misc_feature (138)..(140): Xaa can be any naturally occurring amino acid
  misc_feature (143)..(143): Xaa can be any naturally occurring amino acid
  misc_feature (151)..(151): Xaa can be any naturally occurring amino acid
  misc_feature (154)..(154): Xaa can be any naturally occurring amino acid
  misc_feature (156)..(156): Xaa can be any naturally occurring amino acid
  misc_feature (158)..(158): Xaa can be any naturally occurring amino acid
  misc_feature (162)..(162): Xaa can be any naturally occurring amino acid
  misc_feature (166)..(166): Xaa can be any naturally occurring amino acid
  misc_feature (171)..(171): Xaa can be any naturally occurring amino acid
  misc_feature (174)..(174): Xaa can be any naturally occurring amino acid
  misc_feature (214)..(214): Xaa can be any naturally occurring amino acid
RRGGDGEGGGLEPNCCGRNKVXYXIAVXXXGXRVXXGXYDYXVXMXEIEGMNXKIXXXRKLEXFEXXXVXXXSWSXXXDXXLCVXGXXXXKIXERDGXXXXEFVKGDMYIXDXKNXKGXXXGXXGGEWNXKXKEXILXXXEDXFMCFWDVXDFXSXKXVIKXKLVXKMGIXVIXCEWENEGKRIVGGIGDGFIKGWRIKSGWGRRKDIKVEKKXKEDIIGVNFKKRERFFCKKYGILIFKNGVLRR

SEQ ID NO: 34458 - protein, 71 aa, Glycine max
MIIPVRCFTCGKVIGNKWDTYLDLLQADYSEGDALDALGLVRYCCRRMLMTHVDLIEKLFNYNTLDKSDPN

SEQ ID NO: 34459 - protein, 454 aa, Arabidopsis thaliana
MSSSSRNLSQENPIPRPNLAKTRTSLRDVGNRRAPLGDITNQKNGSRNPSPSSTLVNCSNKIGQSKKAPKPALSRNWNLGILDSGLPPKPNAKSNIIVPYEDTELLQSDDSLLCSSPALSLDASPTQSDPSISTHDSLTNHVVDYMVESTTDDGNDDDDDEIVNIDSDLMDPQLCASFACDIYEHLRVSEVNKRPALDYMERTQSSINASMRSILIDWLVEVAEEYRLSPETLYLAVNYVDRYLTGNAINKQNLQLLGVTCMMIAAKYEEVCVPQVEDFCYITDNTYLRNELLEMESSVLNYLKFELTTPTAKCFLRRFLRAAQGRKEVPSLLSECLACYLTELSLLDYAMLRYAPSLVAASAVFLAQYTLHPSRKPWNATLEHYTSYRAKHMEACVKNLLQLCNEKLSSDVVAIRKNTSLQQRSFVPRHYRKSFSSDSVSGYVFFTLVYCTYC

SEQ ID NO: 34460 - protein, 473 aa, Mesorhizobium loti MAFF303099
MLQVRQDVLGERFRLQRAAFEKQPFPDPSVRKDRLKRLLALTEHHEADICAAIDADFGGRSAHETRLAELFVVRAGIRHTLSHLSGWMRERRVATTLPFLPGRNRLLPQPLGVVGIVSPWNYPFQLAVAPVTAALAAGNRVLVKPSELTPAFSALLARLAGEHFAPDELSVITGDAEMGKAFVSKPFDHLLFTGSTAVGRQVAIAAAANLTPVTLELGGKSPAIFDPSCDLDAATASIAYGKLLNAGQTCIAPDYLLVPKGQAGTVAAKLATAVAQLYPTLRDNPDYTAIISERHFQRLRAMIAEARDAGADVVEINPAGEDFGAASRKLLPTLVSNAGPDLRLMREEIFGPVLPIIEYATIDEAISHVNQADRPLALYWFGKDSTNRQRILRETVAGGVTINDCMLHLVQENQPFGGVGASGMGAYHGEWGFRTFSKEKPVFLQSRLSAGALLRPPYGKTFERLFGLLRHIT

SEQ ID NO: 34461 - protein, 481 aa, Pseudomonas syringae pv. phaseolicola 1448A
MKSIRIRAEVLAGLTTSFALVPECIAFALVAHLNPLMGLYGAFIICTLTALFGGRPGMVSGAAGSMAVVIVALVVQHGVQYLLATVLLGGLIMILFGLLRLGKLVRLVPYPVMLGFVNGLAIVIAMAQLEHFKVGESWLSGTPLYVMLGLVALTMAIVYLLPRLTRIAPPALVAILSVGLAVYLLGLPTRTLGDMAHIAGGLPVFAMPDIPWNLDTLRIIAPYAILMALVGLLETLLTLNLTDEITETRGYPDRECVALGAANVVSGAFGGMGGCAMIGQTVINLSSGGRGRVSGVVAGLMILMFVLFLSPLIERIPLAALVGVMFVVAQQTFAWASLRVLRKVPVNDVLAIIAVTVVTVLTDLATAVLFGIIIAAINFAWQQARELYADSHVEADGSKVYHLHGTLFFASTTPFLDQFNPAEDPAQVTLDCRHLSFVDYSAIAALKTLRERYVKAGKHLRVVHLSERCKRLLKRAGVQHA

SEQ ID NO: 34462 - protein, 491 aa, Yersinia pestis KIM
MNTVQVAQACDLVIFGAKGDLARRKLLPSLYQLEKAGHIHPDTRIIGVGRAEWDKDAYTAVVKEALDTFMKEPLDDELWQKLSSRLDFCNLDVNDSKHFTKLGKMLDQKHRTTINYFAMPPSTFGAICKGLGEAGLNKEPSRVVMEKPLGTDLAPSRVINDQVAEYFNECQVYRIDHYLGKETVLNLLALRFANSLFASNWDNRTIDHVQITVAEEVGIEGRWGYFDQAGQMRDMIQNHLLQILTMIAMSPPADLSTDRIRDEKVKVLRSLRRIDHTNVRETTVRGQYTAGFVQGNKVPGYLEEEGANKNSNTETFVSIRVDIDDWRWAGVPFYLRTGKRLPSKCSEVVVYFKNPALNLFRESYQQLPQNKLTIRLQPDEGIEIEVLNKVPGLEHKHRLQTTKLDLSFSKTFNEQHIADAYERLLLETMRGIQALFVRRDEVEEAWKWVDSIMNAWAADNEAPKPYQSGTWGPVASVAMITRDGRSWNEFE

SEQ ID NO: 34463 - protein, 256 aa, Rhizobium leguminosarum bv. viciae 3841
MTPDVRPLVAGNWKMNGMRASLDQIKTIAEGVRPPLADKVEALICPPATLLYVATALCTDSPLAIGAQDCHQNPSGAHTGDISAEMIADCFGTYVIVGHSERRTDHAETDHLVRAKAEAAFAAGLTAIICIGETADERRTGQALDVIKRQLSASVPDCATAESTVIAYEPIWAIGTGVTPTSGDVEKAHAFMRAELAVRFGDEGRKMRLLYGGSVKPANAHELMGIANVDGALIGGASLKAADFLAIYRAYEALLA

SEQ ID NO: 34464 - protein, 498 aa, Physcomitrella patens subsp. patens
MADNLEEFIPVFTSLAEIYGEGPFLEEQFRRYANLKQQFVHHYGRDPELFARAPGRVNLIGEHIDYEGYSVLPMAIRQDTVVAIGRREEDPPTLQIANVNSSEFQACSFSADPSQEVDRANHVWANYFICGYKGVFDYLAAKGDGVQPVVGLNAVVDGIVPIGAGLSSSAAIVCSSAIAILTVLGYSSSKQDVADFACTCERHIGTQSGGMDQAISVMGERGAAKLIDFNPVRASDVVLPKSGSFVVANSLTESKKAETASTNYNNRVVECRLAAMVLAVKLGMRLEEARTSVHTLSDVEGLCAKYASAHGSSSPVVAVERFLHEAPYNAEEIEDILQEKLSSIMKNSPTTLAVLAAATHFKLHQRAKHVYTEAKRVHDFRAVTVQSESEESVMKRLGELMNESHASCSLLYECSCPELESLVGLCRRNGAIGARLTGAGWGGCVVALVKEEEVDSFISALKETYYKPLLERGKIKEEDLDLYVFASKPSAGAAVLKI

SEQ ID NO: 34465 - protein, 356 aa, Physcomitrella patens subsp. patens
MAPYSGKYAEELQATAKYIATPGKGILAADESTGTIGKRLSSIKVENVEANRQALRELLFTTPGVGEFLSGVILFEETLYQKTADGKPFVDVMKENGIIPGIKVDKGTINLWGTNGETTTQGFDDLHKRCAAYYDAGARFAKWRAVLKIGELEPTELAIQQNAQGLARYAIICQENGLVPIVEPEILVDGSHSIDKCAEVTEKVLAACYKALNDQHVLLEGTLLKPNMVTPGSDAEKVAPEVVAKYTVRTLQRTVPPAVPGIVFLSGGQSEEEATQNLNAMNALKTTKPWALSFSFGRALQATVLKTWGGKKENVKAAQDALHVRAKANSEATLGTYGGNASGEGTESLHVKNYVY

SEQ ID NO: 34466 - protein, 477 aa, Mesorhizobium loti MAFF303099
MAAKATGVVGKVRQVIGAVVDVQFGDHLPAILNALETTNVGNRLVLEVAQHLGENTVRCIAMDSTEGLVRGQEVRDTGAPITVPVGPGMLGRIINVIGEPVDEEGPVDAIEMRSIHQPAPTYVEQSTEAQILITGIKVLDLLAPYAKGGKIGLFGGAGVGKTVLIQELINNIAKAHGGYSVFAGVGERTREGNDLYHEFIESGVNKKGGGEGSKAALVYGQMNEPPGARARVGLTGLTVAEYFRDQGQDVLFFVDNIFRFTQAGSEVSALLGRIPSAVGYQPTLATDMGALQERITTTTKGSITSVQAIYVPADDLTDPAPATSFAHLDATTTLNRAIAEKGIYPAVDPLDSTSRMLDPMVVGEEHYAVARQVQSILQRYKSLQDIIAILGMDELSEEDKQTVARARKIERFLSQPFFVAEVFTGAPGKLVDLADTIKGFKGLCNGDYDHLPEAAFYMVGGIEEAVEKAQRLAAEAA

SEQ ID NO: 34467 - protein, 305 aa, Ashbya gossypii ATCC 10895
MSDNKQSNFLINFMMGGVSAAVSKTAAAPIERVKLLIQNQDEMLKQGSLDRRYNGIVDCFKRTAASEGVISFWRGNTANVIRYFPTQALNFAFKDKIKAMFGFRKEVDGYAKWFAGNLASGGAAGGLSLLFVYSLDYARTRLAADSKSAKKGGERQFNGLVDVYKKTLASDGIAGLYRGFLPSVVGIVVYRGLYFGMYDSLKPLLLTGNLESSFIASFLLGWAVTTGASTASYPLDTVRRRMMMTSGQAVKYDGAFDAFRKIVAAEGVKSLFKGCGANILRGVAGAGVISLYDQLQLVLFGKKFK

SEQ ID NO: 34468 - protein, 133 aa, Vibrio campbellii AND4
MNQNKADYPCFFRELSNLDVKSPQAVTDLFIDREAANAWLDLYLARCELEIDEQGKPVTVQQRCERMRQVNPKYILRNYLAQLAIDKAEEGDFSEVNRLAELLKRPFDEQPEQDDYAKLPPEWGKKMEISCSS

SEQ ID NO: 34469 - protein, 745 aa, Saccharum hybrid cultivar
MSGAALVAIVASIGNLLQGWDNATISAALLYIKKEFKLESEPTVEGLIVAMSLIGATIITTFSGPVSDWIGRLPMLILSSVLYFVSSLIMLWSPNVYVLLLARLINGFGVGLAVTLVPLYISETAPPEIRGLLNTLPQFSGSGGMFLSYCMVFGMSLLPSPDWRIMLGVLALPSLFFFGLTIFYLPESPRWLVSKGRMAEAKKVLQRLRGKDDVTGEMALLVEGLEVGGDTFIEEYIIGPAIEPADDHVADGDRERIILFGPEEGQSWIARPSKGSSMLGSVLSIGSRHGSMVNQNLPLTDPIVTLFGSVHENISLAGGSMRRIVPSKFDSMISITDQHPKTEQWDEENLHRDNEEYATDGAASDYENNVHSPLLSRQNTSAEGKGIAHHGHRGSALGLRRRSLSDEGGEAATSTGIGGGWQLAWKWSEREGEDGKKEGSFKRIYLHQEGVAGSRRGSVVSLPGGGDASEGGKFIHAAALVSQSALYPRDITEQRMAGPATMHPSEAAAKVPSWRDLFEPGVRRALLVGIGIQILQQFAGINGVLYYTPQIMEQAGVAVLISNLGLSSASASILISSVTALLMLPSIGLAMRLMDVSGRRFLLLSTIPVLIASLIVLVVSNVIELGTVVHAVLSTISVITYLCCFKMGFGPIPNILCAEFFPTRVRGICIAICALIFWVGDIIVTYSLPVMLNAIGLEGVFGIYAVACAIAFVFVYLKVPETKGMPLEVITEFFAVGAKQAVAKA

SEQ ID NO: 34470 - protein, 246 aa, Glycine max
EDYLNVKVRRVDVLSAWSGIRPLALDPTAKNTESISRDHVVWEDYPGLVTITGGKWTTYRSMPEDAVNAAIKSGKLTPTSICVTNNLRLVGGEGWEPSSFTVLAQQYKRMKSTYSGKVVPGVMDSAVAKHLSQAYGTLAERVATIAQNENLGKRLAHGYPYLEAEVAYCARNEYCESAIDFIARRTRLAFLETNAARKALPRVIEILANEHKWDNSKQKEELEKATEFLKTFKSSKNAQFHDGKHS

SEQ ID NO: 34471 - protein, 326 aa, Archaeoglobus fulgidus DSM 4304
MKKIVVIPGDGIGKEVMEAAMLILEKLDLPFEYSYYDAGDEALEKYGKALPDETLEACRKSDAVLFGAAGETAADVIVRLRRELGTFANVRPAKAIEGIECLYPGLDIVVVRENTECLYMGFEFGFGDVTEAIRVITREASERIARYAFELAKREGRKKVTALHKANVMKKTCGLFRDVCREVAKDYPEIQYNDYYIDAACMYLVMDPFRFDVIVTTNMFGDIVSDLAAGLVGGLGLAPSANVGERTAIFEPVHGAAFDIAGKGIANPTAMILTACMMLRHFGYVEEAKKVEEAVEKTIKEGKKTPDLGGNLKTMEFANEVASLLD

SEQ ID NO: 34472 - protein, 320 aa, Solanum virginianum
  misc_feature (135)..(135): Xaa can be any naturally occurring amino acid
MGSKNSKAKTSVDDTSNSSYQIRVESFRVPFVALQEATNNFDENWVIGMGGFGKVYRGVLCDGTKVALKRCTPGSSQGIKEFLIEIEMLSRHRHPYLVSLIGYCDERNEKILVYEYMENGNLRRHLYGSDLPTLXWEQRLEICIGAARGLQYLHNSAVIHGDVKSTNILLDDHFVAKITDFGLSKTQTELDQTHFTTVVKGTFGYLDPEYIMRGKLAEKSDVYSFGVVLFEVLCARPALDRSLSSEMFSLVRWAMESHKNGQLERIIDPNLVGKIRLDSLRKFGETAVKCLAESGLDRPSMSEVLWNLEYALHLQEPVIQ

SEQ ID NO: 34473 - protein, 305 aa, Brucella suis 1330
MGGFASIGECMIELSGNEGDQWRMGFAGDTLNTAWYMRALTDKSYPVEYVTAFGEDSFSQKQRVFLTSNGIGIAHSPVISGLHPGLYAITLDGAERSFTYWRSNAAARRLACDRDALEKSLAGRDMIYLSGITLAIILPEHRATFFDILHQCRAAGSRIAFDPNFRQQLWPDRKAAREIISNAMGIADIALPTFPDEQALFGDRDAAACAKRIAALGVGEIVVKDGTEPALVAAGGECTLVPSAAAQAIDTTGAGDSFNGAYLAARLNGLAPVEAARKAHLVAARVVEIRGALAPMETARATFAG

SEQ ID NO: 34474 - protein, 225 aa, Brassica napus
MDGGDHSASGTKRSFEDDESDTSVSKKRCTCTKVDEEAAMIVSLTESLQSCKDELASCQSELESAKAEVDKWNTAFKQESFVPSRKSPEPQFVIDYIQTLKSSEKSLKEELEIAQMKLAIRDLKSQLKPESMKLQTDEDPEVDGEEQGSTPAGTSRMAYLEDELRAANTVIAEMREIQAVRVDALEKAQATHAKEFEYLKNNLLTLQQSPRLVLTAAPENADAQK

SEQ ID NO: 34475 - protein, 340 aa, Brucella suis 1330
MTVRYGKDSSSVKASRPRFAVAPMIDWSDRHCRYFHRLFSKRALLYTEMVVADAAIFGPRDRLLGFDPAENPVALQLGGSDPAKLRQAAQIGADFGYDEINLNVGCPSDRVQSGTFGACLMLTPDVVARCVAAMKETISIPVTVKCRIGVDDQDTETALDALADQVLEAGADALWVHARKAWLKGLSPKENREIPPLDYERVYRLKQRLGETFVGINGGIATLEEAQVHLQKVDAVMLGRAAYHNPALLADVDARLYGEGQEPLAMPEIIDAMCDYIDRHIASGGRLSHVSRHMVGLFTGQPGARRWRQILSTDATKPGATSDVVRQAYATVVEACAEAA

SEQ ID NO: 34476 - protein, 390 aa, Yersinia enterocolitica (type 0:9)
MSKQQIGVVGMAVMGRNLALNIESRGYSVSIFNRSSDKTDEVVAENPGKNLVPSYTVEEFVDSLEKPRRILLMVKAGEATDKTIASLTPHLDKGDILIDGGNTYYKDTIRRNRELSAQGFNFIGTGVSGGEEGALKGPSIMPGGQKEAYELVAPILEKIAARADDGDACVAYIGADGAGHYVKMVHNGIEYGDMQLIAEAYSLLKQSLGLSNEELASTFAEWNKGELNSYLIDITKDIFTKKDEAGKYLVDVILDEAANKGTGKWTSQSSLDLGEPLTLITESVFARYLSSLKDQRVAASKVLTGPTVKPFEGDKAEFIEKIRRALYLGKIVSYAQGFSQLKAASEENNWDLHYGEIAKIFRAGCIIRAQFLQKITDAYAENADIANLLV

SEQ ID NO: 34477 - protein, 429 aa, Oryza sativa Japonica Group
MAGAVSALFLLDIKGRVLVWRDYRGDVSALQAERFFTKLLDKEGDSEAHSPVVYDDAGVTYMFIQHNNVFLLTASRQNCNAASILLFLHRVVDVFKHYFEELEEESLRDNFVVVYELLDEMMDFGYPQYTEAKILSEFIKTDAYRMEVSQRPPMAVTNAVSWRSEGIRYKKNEVFLDVVESVNILVNSNGQIVRSDVVGALKMRTYLSGMPECKLGLNDRVLLEAQGRATKGKAIDLDDIKFHQCVRLARFENDRTISFIPPDGSFDLMTYRLSTQVKPLIWVEAQIEKHSRSRIELMVKARSQFKERSTATNVEIEVPVPSDATNPNIRTSMGSAAYAPERDAMVWKVKSFPGGKDYMCRAEFSLPSITAEEAAPEKKAPIRVKFEIPYFTVSGIQVRYLKIIEKSGYQALPWVRYITMAGEYELRLI

SEQ ID NO: 34478 - protein, 438 aa, Coccidioides posadasii
MAITKIHARSVYDSRGNPTVEVDVVTETGLHRAIVPSGASTGQHEACELRDGDKTHWLGKGVLKAVKNVNEVIGPAVIKENIDVKDQSKVDEFLNKLDGTANKSNLGANAILGVSLAIAKAGAAEKGVPLYAHVSDLAGTKKPYVLPVPFQNVLNGGSHAGGRLAFQEFMIVPSAAPSFSEALRQGSEVYHKLKALAKSKYGQSAGNVGDEGGVAPDIQTPEEALDLIAEAIEQAGYTGKVKIALDVASSEFYKPEEKKYDLDFKNPNSDKSKWVTYEELSDLYKKLASKYDIVSIEDPFAEDDWEAWSYFFKTSNMQIVADDLTVTNPIRIKKAIDLKACNALLLKVNQIGTLTESIQAAKDSYADGWGVMVSHRSGETEDVTIADIVVGLRSGQIKTGAPARSERLAKLNQILRIEEELGSSAVYAGENFRTAVNL

SEQ ID NO: 34479 - protein, 434 aa, Novosphingobium aromaticivorans DSM 12444
MMGDVKPDVCVVGLGYIGLPTAAIIARAGCRVLGLDVSQKVVDTINRGEIHIEEVDLDGLVHGVVQRGLLRASTEIAPADVFVIAVPTPFEKDGHHTPDISYVLAAATQVAAVLKAGDTVILESTSPVGTTEQMRDLMAGLRPDLKFPGKTRETPDVSIAYCPERVLPGRILEELTNNDRSIGGITPRCARKALAFYKRFVRGTCVTTDARSAEMTKLVENAYRDVNIAFANELSMVADRMGLDVWEVIRLANRHPRVNILQPGPGVGGHCIAVDPWFIVAGAPDETPLIRTARNVNDGKMHHVVKKATELVEAHPGEKVACLGLAFKANIDDFRESPARYVAASLARRFGSRVHIVEPYAGTLPREFEGTGAVQIDVDTALEDCGVLIVLVDHDVFKVIPLAERAGKVVYDTRGIWPDQPGAESAGAGLRLAS

SEQ ID NO: 34480 - protein, 571 aa, Oryza sativa Japonica Group
MPLATLLGHLAAGRFGLVQALTGAATAAAAHRLLHLLLRTAPPPPLPDLVSLARWSRAHFRAPLPLRLHGLLLARLASKGLYPLLRSELHVLAAARLHSPASILRALPSPSASASASTPLIADMLVLALARASQPLRAYDAFLLAGESHPRHRPSTSSVNALLAGLVGAKRVDLAEKAFRSALRRRVSPDIYTFNTVISGLCRIGQLRKAGDVAKDIKAWGLAPSVATYNSLIDGYCKKGGAGNMYHVDMLLKEMVEAGISPTAVTFGVLINGYCKNSNTAAAVRVFEEMKQQGIAASVVTYNSLISGLCSEGKVEEGVKLMEEMEDLGLSPNEITFGCVLKGFCKKGMMADANDWIDGMTERNVEPDVVIYNILIDVYRRLGKMEDAMAVKEAMAKKGISPNVTTYNCLITGFSRSGDWRSASGLLDEMKEKGIEADVVTYNVLIGALCCKGEVRKAVKLLDEMSEVGLEPNHLTYNTIIQGFCDKGNIKSAYEIRTRMEKCRKRANVVTYNVFIKYFCQIGKMDEANDLLNEMLDKCLVPNGITYETIKEGMMEKGYTPDIRGCTVSQA

SEQ ID NO: 34481 - protein, 142 aa, Erwinia carotovora subsp. atroseptica SCRI1043
MTIERTFSIVKPNAVAKNAIGAIYARFESAGFTIVASKMLRLSREQAEGFYAEHKGKPFFDGLVEFMMSGPIMVQALEGENAVQRNRDIMGATNPANALAGTLRADYADSFTANAVHGSDSIESAQREIAYFFSDDEICPRA

SEQ ID NO: 34482 - protein, 491 aa, Burkholderia sp. 383
MAVSAESSSSFDPAVLLARQRNAFVSEGPPSVQQRKARLARLRAVVLAYRREVEEAISADFGHRSRHETAIMELVGVVQAIDYLTRNLCRFTKPQRRHVGLLYRAGQAHIEYQPLGVIGVMAPWNYPFALTFIPLATALAAGNRAMLKPSELTPRTSEVMRRMLAETFPSEEVAVVLGGPEVGAAFSGLPFDHLLFTGSTQVGRKVMKAASDNLVPVTLELGGKSPAIVARGHVDGRTMSSIVFGKLSNAGQTCVAPDYALVHEDDLDAFVAQYDEAVARFYPDGPTSPDYTSIVSDRHFDRLKGLVDEARSKGARVIEAGVNPQQAATRKRTLAPTLIVGAGDDTTVMQEEIFGPILPVRTYRTIDEVVDYVNARPRPLALYYFGAQDSDCESLLRRTTSGNVGINNTLLHVAQEDLPFGGVGPSGMGAYHGIEGFRAMSHAKGVFVLGRWNLPSLLRAPFGKLADLSLAALLGRSREPEGVRAGLSAKR

SEQ ID NO: 34483 - protein, 148 aa, Brassica napus
IRHVLSGYFSQKTGLLVHIEDSHLTRIQSNGGDTVFWETTYNSSLDDYRQVEGIMIAHSGHSVVTLFRFGEEAMSHTRTKMEESWTIEEVAFNVPGLSLDCFIPPADLKTGSVTEYPQEEIGKNNNAVVLSAAHRAKVAALENGSFDA

SEQ ID NO: 34484 - protein, 332 aa, Novosphingobium aromaticivorans DSM 12444
MKVLVTGAAGFIGYSLATRLLARGDEVIGVDIVNDYYDPRLKEARLARLAQQGGGRFTFLRTDFADYPALTAALEGAHFDRIVHLGAQAGVRYSIENPHAYVQSNLVGHVNLLEVARHRGVEHMVYASSSSVYGGNTKLPFSVDDRVDHPLSLYAATKKADELMSETYAHLYRLPLTGLRFFTVYGPWGRPDMMMWLFTRAILAGEPIQVFNHGDMYRDFTYVDDIVSGVVACLDNPPLDDGAPKAGGSLKPHRLYNIGNHKSEHLMKVIAILEAELGRKAEMRMLPMQPGDVRQSFADIDAISGDLGYRPTTGIETGVPNFVRWYKDYHGL

SEQ ID NO: 34485 - protein, 330 aa, Novosphingobium aromaticivorans DSM 12444
MTSQFRMPPEWHPQDWLWIGFPHLAEEWSGVIDEAQVQIAAFANAVADSGQEVRLVVRDAANEMRAKSLVSGAVTLERRTYGDVWLRDTGPLVVLDGAGRREARLFGFNGWGEKYLMPGDQEIGADLAKSAGLATHGKADWILEGGALDGDGTGLVATTEQCLLNPNRNPHLSRGDLEARLLRDLGYDRVLWLGDGLINDHTDGHVDNLARFVGPNRLALPRATGPNDPNAAIYADARARALDAGVEVVEVPSPGRIEWGDMVQPASYMNFVITSDLVVVPVFGSPHDDDGVAAIAELFPDRATVGVMGDAVLAGGGGFHCASQQMPKPF

SEQ ID NO: 34486 - protein, 397 aa, Zea mays
  misc_feature (211)..(211): Xaa can be any naturally occurring amino acid
MAMATAKLSSPATSLLAGGRARRSAPARRATVIRAAAGSYSDELVSTAKSVASPGRGILAIDESNATCGKRLSSIGLDNTEPNRQAYRQLLLTTAGLGEYISGAILFEETLYQSTTDGRKFVDCLKDQNIMPGIKVDKGLVPLPGSNNESWCQGLDGLASRCAEYYKQGARFAKWRTVVSIPCGPSALAVKEAAWGLARYNVIFVYHVSIXNNLQDNGLVPIVEPEILLDGDHGIERTLEVAEKVWSEVFFYLAQNNVLFEGILLKPSMVTPGADHKEKASPEAIAKYTLTMLRRRVPPAVPGIMFLSGGQSEVEATLNLNAMNQSPNPWHVSFSYARALQNSVLKTWQGRPENVEAAQKALLVRAKANSLAQLGRYTGEGESDEAKKGMFQKGYTY

SEQ ID NO: 34487 - protein, 117 aa, Zea mays
TASYEASEKKRKLGILEKQFLDELKKEIEGVAFFCLSNQGAGKSPNAKDDSPSDRGGGARYPGGGEEDDFGTAFKSRKQGGLFKALKMGQEKKKGEVGLLQKGKKNAGFGAFSQKRP

SEQ ID NO: 34488 - protein, 457 aa, Zea mays
MATWCDEYTRIACEIFADEVLIGNRSSTHLNKAGYQNVIQKFKERTGVVYTRKQFKNKWDRLKIDYGIWKQLTRQTGLGWDGSGKNIDMPEDWWKKMAKAIKGSTRFKTRGLQNEDHLATMFEDLRNTGDDHWSASSGIPPTQQNVDQSPINIDVEFEPTNEDDSEPEEITPSSGKVKRPRIPANNKDDGQFTSSSDTTDSDSDDDNIIGQVIPLDYIRPIDPKFSTVHSRIAGDRRMMPHFKDCIGALDGTHINATPPVEDVIRYIGRTGQPGSMHDTNVLFHALRNDTENFPHPPAGKYYCVDAGYPNRPGYLAPYKGQRYHVPDWRRGPAPNGEQEHFNHLHSSIRNVVERAFGVWKMKWRVLLKMPSYKMGVQKMIVAATMCLHNYIRENHALDLDFVKCDRNPDYVPTIPDRYARFQPSQNASDTSTTQSNDRTMDRFRDDIARAVFLSRSA

SEQ ID NO: 34489 - protein, 297 aa, Oryza sativa Indica Group
MAQNMSSKGVKMPIDSADWNDYNTRVVCEIFVDQVAAGNRPNTHLSNPGYDEVIEQFAARTGLRYSRLQIKNKWDKLRVEYNCWKKLKSQTGLGWDSTKQTVTATVERWKQLKADIPGCTKFIKAGLQNEELLEKMFEDIRNTGADHWSLGQGTIPTATNDAIHIADDNEIDDETEDDEPSAKRKRGGSSKVDKSKKSKSGSQKMVEEMSKSNELSAQTLSSIQSFTKTREDPPGCSIKDVMALVEECGAVEGTNEHFIATEIFIKKDQREMFVNSLRTPAGRFAWLKKKYEVKYGN

SEQ ID NO: 34490 - protein, 412 aa, Oryza sativa Indica Group
MEAKLSAASRRVAPSPIQQLSHLAQRAGAVNLAEGFPDFPAPAHVKAAAAAAIAADLNQYRHVQGICDALAETMKRDHGLRVDPLTDFAVCCGQSEAFAAAIFAIIDQGDEVLLFDPAFETYQTCIELARGVPVYVPLDPPSWTLNEDKILKSFTNRTKAVVLNSPHNPTGKVFSREELLIIAQACQKMDCFAITDEVYEYITYDENKHISLASLPGMQERTIITSSLSKTYSVTGWRIGWACAPANIASAIRNIHVKLTDSAPAPFQEAALVALTSPPDFYSSLKQDYTARRDFILQVLTDFGFRISFKPQGSIFVFVELPRSWQLSDMDFVTNLIKNAGVAAVPGRGFFHSSTDDPSYHHRYVRFAFCKSNDTLNAAAEKMRKLAVSHDARLLRPTDDGEAGQTASATSP

SEQ ID NO: 34491 - protein, 220 aa, Mesorhizobium loti MAFF303099
MGDTVQQFFAVKAKIAAAEREARREAGAVTLVAVSKTFDAADIRPVIEAGQRVFGENRVQEAQGKWPDLKQAFADIELHLIGPLQSNKAKEAVALFDVIETVDREKIAAELAKEIARQGRAPKLYVQVNTGSEPQKAGIEPRAAIAFVTRCRDVHGLAIEGLMCIPPADENPGPHFALLEKLAREAGVEKLSMGMSGDYETAIAFGATSVRVGSAIFGSR

SEQ ID NO: 34492 - protein, 159 aa, Escherichia coli
LEMRIGHGFDVHAFGGEGPIIIGGVRIPYEKGLLAHSDGDVALHALTDALLGAAALGDIGKLFPDTDPAFKGADSRELLREAWRRIQAKGYTLGNVDVTIIAQAPKMLPHIPQMRVFIAEDLGCHMDDVNVKATTTEKLGFTGRGEGIACEAVALLIKA

SEQ ID NO: 34493 - protein, 317 aa, Glycine max
MVTLLNPVLSKVALYLLIPNLPLSELWHKKASTLALSRSSSRMSKEVSQQRKDYVDPPPAPLIDLAEIKLWSFYRALIAEFIATLLFLYVTVATVIGHKKQTGPCDGVGLLGIAWAFGGMIFVLVYCTAGISGGHINPAVTFGLFLARKVSLIRALFYMVAQCLGAICGVGLVKAFMKHSYNSLGGGANSVSAGYNKGSALGAEIIGTFVLVYTVFSATDPKRSARDSHIPVLAPLPIGFAVFMVHLATIPITGTGINPARSFGAAVIYNNGKVWDDHWIFWVGPFVGALAAAAYHQYILRAAAIKALGSFRSNPTN

SEQ ID NO: 34494 - protein, 453 aa, Mesoplasma florum L1
MSRIEKIIAREVLDSRGTPTVEVELWTEFGGYGIAKAPSGASTGENEALELRDGDKARYNGKGVLKAVANVNDKIAPALIGHDVQDQLGLDRVMIKLDGTEFKKKLGANGMLAVSLAAAHAAASELEVPLYRYIGGVQAKRLPVPMLNVINGGEHADSAIDFQEFMIMPVGAPTFKEALRWSSETFQALKSLLHDKGDITAVGDEGGFAPHFSWAYAKQDLASFKAKTPAEIALDLLVEAITKAGYKVGKDGIMIAMDCASSELYFEDKKYHFKKIEKVTGQEWAFTTEEMIAYLEKLVNNYPIISIEDGLSEKDWDGFVQLTEKIGDRVQIVGDDLFTTNPRFIKEGISKDAANSTLIKLNQIGTLSETVEAITMTQKAGWTAVVSHRSGETEDATIADLAVAFNAGQIKTGSMSRSDRIAKYNRLLQIEDQLGEDAIYDGYATFYNLKINK

SEQ ID NO: 34495 - protein, 356 aa, Vitis vinifera
MEIDLTPKSAKEAYGSNGGSYLAWSPSELPMLGEGNIGAAKIILHQHGFALPSYSDSSKVAYVLQGNGVAGIVLPESEEKVVPIKKGDALALPFGVVTWWYNKEDTDLEVLFLGDTSKAHKAGEFTDFFLTGSNGIFTGFSTEFVSRAWDLEEDVVKSLVGKQSGKGIVKLEGTFEMPEPKKEHRNGLVLNCLEAPLDVDIKNGGRVVVLNTQNLPLVGEVGLGADLVRLDGSAMCSPGFSCDSALQVTYIVRGSGRVQVVGVDGHRVLETTLKAGSLFIVPRFFVVSKIGDPEGMDWFSIITTPNPIFTHLAGRTSAWKALSSKVLEASFSVGSDMEKLFRSKRNADAIFFPPPN

SEQ ID NO: 34496 - protein, 339 aa, Triticum aestivum
  misc_feature (236)..(236): Xaa can be any naturally occurring amino acid
MSAKAGKPLVQTDAGAYIAWSGADQPELATEGLGCGLLVLRPLGFALPHYADSNKFGYVLSGSGVAGVLPVEAKERVVRLKAGDVIAVRTGDVSWWYNDNDNEGSADDLSILFIGDTARAVSPGDISYFFLAGGNSVLSGFDAGLLTMAWPGVTEEQAATAFRSQPAVLLTRLSAKLPGVCPREHDRKGLVVNAGHVAAGTLKMLTASDLDALGGFGFSAVLGRLEPGAARAPWVXLREGAAQAVYVARGSARVQVSSAVGGDTLLLDEDVAAGSLFVVPRFAVALVAAGADGVEWVSLIKSARPAVEHLIGEGSIFGGLTPQVVQASLKVAPELVKLL

SEQ ID NO: 34497 - protein, 480 aa, Vitis vinifera
MDSVLFPHPLFPHIFISSSFPRSLAAPQSIGVGIGVGLSRHRWCSTCWAVGVSGVGAGNVFDKIPLKANENGSVLGALEEPTSAPFGTLDAEITPETIDFFVSDAEGDPDSPSEGFSSIEQALNTLRQGKFVIVVDDEIGKAEGNLVMAASLTSPRDMAFMVKHGSGIVSVGMKEEHLERLKLPLMSPDSEDKDSSAPTFTITVDAKAGTSTGVSASDRAKTVLALSSPISTPQDFRRPGHVFPLKYREGGVLRRAGHTEASVDLVMLAGLQPISVLSAIVDGDDGSIATLPSLRKLALEHSIPMVSITDLIRYRRKREKLVERTAISRLPTKWGLFQAYCYRSKLDGTEHVAIVKLVEQAGRGVVVYLRGHEGRGIGLGHKLRAYNLQDEGHDTVEANLELGLAVDAREYGIGAQILRDIGVRTMQLMTNNPAKFTGLKGYGLAVVGRVPVLTPITEENKKYLETKRTKMGHIYGSDIE

SEQ ID NO: 34498 - protein, 547 aa, Ustilago maydis 521
MSSTTPTSQTVESKPAPAALQASSIDQPPAFSSATPTCDIANPLPKPALATPRESSASSNNLAHRPKRAVIADSEPDMLEKGQAGSSNEASSALSRTLSSSDPASSITARKRGVTRDASSGGEGLGGPFAGPPRRATMESRATTRRSFNDLFTPEHRLAKPPATLVSLKNLLFGSILNLLLVFIPISWALHFALDQSVTRNGIAVFVTSFLAIMPLATILSQATEELSLRVGETIGGLINASLGNAVELIVAIVSLFNCELIVTQTSLLGSILSNLLLVLGTCFFVGGLRVKEQVFLEAPAQLNTSLLMMAVISLVIPSAFHAVLGGIPDNTERGDILKFSRGVSVLLLLIYIGFLYFSLSSHKEFFEDDNEDEEEQPQMNMTAVIITLVIVTVLIGVTSEWLVTAIDVVTSSGAITRTWIGLILLPIASNATEHLAAVIFAWKNKIQMASSIAIGSSIQIALFVIPLLVIIAWIGDRPLTLLFDPFATILLFLTVLIVNFAIADNRSNYLEGFVLIMVYLIVALTVWFVPDDLADTLFSDAYCHNR

SEQ ID NO: 34499 - protein, 305 aa, Xanthomonas campestris pv. vesicatoria str. 85-10
MSTVPMAQRSYYEADARERIEGLLDAGSFREFVGPRRRLISPHLAQLETPGAFDDGIVVGEGTLRGRNVLIAAQQGAFMGGGVGEVHGAKLTGLLERAANTQPAAVLLLLDTGGVRLHEANAGLIAISEIMRATLGARAAGVPVLALIGSGNGAFGGMGIVARCCSAVIMSEEGRLSLSGPDVIETVRGVEEFDARDRALVWRVTGGKHRYLLGEAHTLVADRIDAFADAALATFDALTEATGEAALQALEHAQQQLTARIDAYGDCRDGLEIWKRQGIVDAQRLPLLDTEAFLAATADRSLPWT

SEQ ID NO: 34500 - protein, 472 aa, Vigna radiata
MKFLSTKATCNSHGQDSSYFLGWQEYEKNPYDEVLNPQGIIQMGLAENQLSFDLLESWLAKNPDVAGFKSDGKSIFRELALFQDYHGLPSFKKALVDFMAEIRGNKVTFDPNHIVLTAGSTSANETLMFCLAELGDAFLLPTPYYPGFDRDLKWRTGVEIVPIQCTSSNNFQITEAALKQAYQEAKKRNLRVKGVLVTNPSNPLGTTMSRSELNLLVDFIKDKNMHLISDEIYSGTVYNSPGFVSIMEILKDRNDLKDCGANVWDRVHIVYSLSKDLGLPGFRVGAIYSENEVVVAAATKMSSFGLVSSQTQYLLSAMLGDKKFTKNYISENLKRLKRRQRNLVSGLQKAGISCLKTNNAGLFCWVDMRHLLHSNTFEAEMELWKKILYQERLNISPGSSCHCTEPGWFRMCFANMSEETLNLAMNGLKTFVQESNHDNGCTTKRVQSSRRKSLSNWVFRLSSREHREQEQR

SEQ ID NO: 34501 - protein, 321 aa, Coccidioides posadasii
MFRTAATKSLTAGIPSIGARAFSTSPATQAAAEVHKVAVIGAGQMGLGIALVAAQKAGVPVTLVDNSQASLDKGLKFADKLLEKDVAKQRITKDAAVKIRSMLTPTTKLEDVSDVDFVIEAVPEIPDLKASIFSKLAQVAPKHAILATNTSSISITKIAAATTTDPKDLSNSSRVISTHFMNPVPVQKGVEIITGLQTSQDTIDTALEFVKRMGKIPARSTDSPGFLANRILMPYINEAISCLENGIGTREDIDSIMKYGTNVPMGPLTLADFIGIDTCLAIMNVLHQETGDSKYRPAGLLKKMVDAGWLGKKTGKGFYDY

SEQ ID NO: 34502 - protein, 467 aa, Vigna radiata
MRLLSTIATCNSHGQDSSYFLGWQEYEKNPYDELHNPKGIIQMGLAENQLSFDLLESWLAKNPDVAGFKRDGKSIFRELALFQDYHGLPSFKKALVDFMSEIRGNKVTFDPNHIVLTAGSTSANETLMFCLAEQGDAFLLPTPYYPGFDRDLKWRTGAEIVPIQCTSSNNFQITEPALKQAYEEARKRNLRVKGLLVTNPSNPLGTTMSRSELNLLVDFIKEKKDTHLISDEIYSGTVFSSPGFVSVMEILKERNDTEEIWNRVHVVYSLSKDLGLPGFRVGAIYSENDTVVAAATKMSSFGLVSSQTQYLLSAMLGDKKFARNYIVENQKRLKRRQRMMVSGLQKAGISCLESNAGLFCWVDMRHLLHSNTFEAEMELWKKIVYQVGLNISPGSSCHCTEPGWFRVCFANMSEETLTLAMKRLKNFVVESTCTQRSALFNGTSKRKSLTKWVFRLSSRDHREQEER

SEQ ID NO: 34503 - protein, 475 aa, Mycoplasma pneumoniae M129
MKKENITYGKVHQVIGPVVDVIFTESSQLPRIYDCLSVKLAGEELFLEAAQLIGDDIVRCIALGPTEGLARNEKVTNYNHPIEVPVGKNVLGRMFNVLGKPIDGKEELPKKPQLPIHRKPPSFDDQSNTLEIFETGIKVIDLLTPYARGGKIGLFGGAGVGKTVLVQELIHNIAKEHSGLSVFAGVGERTREGNDLYYEMIQGGVIDKTALVFGQMNEPPGARMRVALTALTMAEYFRDHDNQDVLLFIDNIFRFTQAGSEVSALLGRMPSAVGYQPTLATEMGQLQERIASTKTGSITSVQAIYVPADDLTDPAPATTFTHLDAKTVLDRNIAALGIFPAINPLESTSRLLDPNIVGINHYKVALGVQNILQRFAELQDIIAILGIDELADEDKIIVERARRIRNFLSQPFFVAEKFSGIAGKYVPLSDTIQSFKEILDGKHDDLPEQAFFFVGTIQEAVEKAKRLKKATVEEK

SEQ ID NO: 34504 - protein, 392 aa, Bacillus sp. SG-1
MKKFNYSKTLEDLPQQFFAKLVKDVSKVTSEGHDVINLAQGNPDQPTPEHIVRSAQAAVENPLFHKYSPFRGYTFFKEAAAEFYKREYNVDIDPETEVAVLFGGKAGLIEVSQCLLDEGDIALVPDPGYPDYWSGVSLARAEMAPMPLLEENQYLPDYPKIDEATLSGAKLMFLNYPNNPTGAIATSEFFEETVRLAKENDVCVVHDLAYGAIGFDGEKPLSYLQTQGAKDVGIEIYTLSKTYNMAGWRVGFAVGNPSVIAALNLLQDHLHVSLFGGVQEAAATALTSSQECVDELVSLYESRRNFLIDHLKEIGWDVDPPKGSFFAWLPVPEGFTSQSFFNKLLEEAHVAVAPGIGFGEYGEGYVRVGLLREEEELAEAVRRIGKLGLFKK

SEQ ID NO: 34505 - protein, 128 aa, Erwinia carotovora subsp. atroseptica SCRI1043
MAYSEKVIDHYENPRNVGSFDNADPSIGSGMVGAPACGDVMKLQIKVNNEGIIEDARFKTYGCGSAIASSSLVTEWVKGKSLNEAEAIKNTQIAEELELPPVKIHCSILAEDAIKAAIADYKSKRDAQ

SEQ ID NO: 34506 - protein, 126 aa, Chlamydomonas reinhardtii
MAMAMRSTFAARVGAKPAVRGARPASRMSCMAYKVTLKTPSGDKTIECPADTYILDAAEEAGLDLPYSCRAGACSSCAGKVAAGTVDQSDQSFLDDAQMGNGFVLTCVAYPTSDCTIQTHQEEALY

SEQ ID NO: 34507 - protein, 149 aa, Acidovorax sp. JS42
MGNKLYVGNLPYSVRDQDLEQAFSQFGAVTSAKVMMERDTGRSKGFGFVEMGSDAEAQEAINGMNGQSLGGRSIVVNEARPMEARPPRSGGGGFGGGGGYGGGRSGGGGGYGGGGGGRSEGGFRSPYGSGPRGGGGGRGGYGGGGNNGY

SEQ ID NO: 34508 - protein, 468 aa, Novosphingobium aromaticivorans DSM 12444
MSQQPQPGGNLGFIGLIVAVATIGGFMFGYDSGAINGTQDGLKHAFGLGEAELGLTVSALLPGCALGAFLAGRFADIWGRRAVMMMAAALFILSALGSGAAPSAIVLAVARFFAGAAVGAASVLSPAYISEVTPAHVRGRLSSAQQVMIISGLTGAFLANYWLAGAAGSSLGAFWCGYPAWRWMFWVQAAPAILFLVTLLLIPESPRFLVAKGRTEEARSVLARLFGDATADAKLGEIRASLAADHQPSLADIRKPGGGWRPIVWVGIGLAVFQQLVGINVVFYYGAVLWQAVGFSEADALKINILSGVVSIAACLVSIGLVDKLGRKPLLLIGSAGMTATLGALAWCFAQASTGPDGALVLPEGVGTIALYAANIYVVFFNMSWGPVMWVMLGEMFPNQMRGSALAVAGAAQWLANFAVSSSFPWLAGNIGLPVTYAAYTLFAAISLVFVWTSVKETKGKELEAMEG

SEQ ID NO: 34509 - protein, 516 aa, Zea mays
MFSHGADSAHDAGAVGVSSGGATVPTRFVWPYGGKRVFVSGSFTSPLPVNHRYSGAPNSYTFCRRWSEHLPMSPIEGCPTVFQAICSLSPGIHEYKFFVDGEWRHDERQPTISGEFGIVNTLYLTREYNQINTLSSPSTPGSRMNMDVDNENFQRTVTLSDGTVSEGTLRVSEAAIQISRCRVSEYLSLHTCYDLLPDSGKVIALDINLPVKQSFHILHEQGIPVAPLWDSFRGQFVGLLSPLDFILILRELETHGSNLTEEQLETHTISAWKEAKRQTNGRNDGQWRPQQHLVHATPYESLRDIAVKLLQNGISTVPVIYSSSSDGSFPQLLHLASLSGILKCICRYFKNSTGNLPILNQPVCSIPLGSWVPKIGDLNSRPLAMLRPNASLSSALNMLVQAGVSSIPIVDDNDSLLDTYSRSDITALAKDKVYTHVRLDEMTIHQALQLGQDANTPFGFFNGQRCQMCLRSDPLLKVMERLANPGVRRVFIVEAGSKRVEGIISLSDIFKFLLSL

SEQ ID NO: 34510 - protein, 272 aa, Rhodobacter capsulatus
MSKTRAKVAAIDPVWMRICEEAHDAVGQEPLLGALIHAGLLHHATMEKALAYRFSLKLASGEMSEQLLREIADDAYGSDPDLGQAARADLVAVFDRDPACHRFLQPILFFKGYQALQSYRVAHWLWRQGRKDMAYFVQMRTSEAFGVDIHPAARIGRGVMIDHAHSIVIGETAVVGDNVSMLHSVTLGGTGKEEQDRHPKIGNGVLIGAGAKVLGNIHVGDNSRIAAGSVVLADVPRCKTVAGVPAKIVGEAGCAQPSVNMDQQLRGCDCEG

SEQ ID NO: 34511 - protein, 112 aa, Petunia x hybrida
MAGKLSIVLFVLLVVLLAQNQVSMAKKVLDSKVQRRGNDQIYGVSQGSLHPQDCQPKCTYRCSKTSFKKPCMFFCQKCCAKCLCVPAGTYGNKQTCPCYNNWKTKEGGPKCP

SEQ ID NO: 34512 - protein, 139 aa, Vibrio campbellii AND4
TDIESTFTALEIGKGRVVRKGEKVAILNFGTFLGNALEAAENLNATVADMRFVKPLDEALIRQLAAEHDVLVTLEENAITGGAGAGVIEFMMQDKIIKPVLNLGLPDRFIPQGTQDELHEELGLDAKGIEKSICDYMAK

SEQ ID NO: 34513 - protein, 613 aa, Phanerochaete chrysosporium
MAAAEDIAPEEKVALLEPHSNHDTQSASPRRRRPHAAHAALLAVFLLGVALLALGVWGTYASSPRGPSLPRELQRTPHTHFALDGLRGQPPQTRSHAFVVSEVEGAPDGVRKPMLVVNGMYPGPTIEANQGDRVVVKVTNMLENRTTIHWHGLFQNGTNYYDGTAAITECGIPPGQTLVYNFTLGEFSGTTWWHAHYSTQYTDGITGALVVHPTDPLPASIPPWDGDLVVQVSDLYHTFSPVLLERFLSPWGIDGVPGDEPVPDAGTLNGLGQWAGHGDYFNFTLEANKTYRLRVVNTGSFASVRFSVDRHVLRVVEADGTLVEPHDVSGVTLAVGQRYSVLLRTDNATGGPFWMRATLQKHMFRYDLPGQNRDIRGVIRYGPAADTTALPAETDDPGVRSHPGLADADDRQLVPALFNTAPERTRSYPLRVSLQLHDSLVMLGFLNTTSWEPLRGTTTLLRVREAFRAGGVYGGGDGGSLQDGEQFVLTEDSIQVVDLVIDNIDDGDHPFHLHGHRPWIVGSGVGRYIGQPLNATNPLRRDTVLVRAYSWMVLRFVTDNPGLWAFHCHLAWHMAAGMLMQVNSLPTRAAQLDIPQTIVDQCQVDVGGAGARR

SEQ ID NO: 34514 - protein, 149 aa, Oryza sativa
SAAAALRDQLTALLSSMFSQGLVDEQFQQLQMLQDEGGTPGFVSEVVTLFCDDADRIINEIATLLEQPVVNFDKVDAYVHQLKGSSASVGAQKVKFTCMQFRQFCQDKSRDGCLMALAVVRNDFYDLRNKFQTMLQLEQQIQAYDPKQQ

SEQ ID NO: 34515 - protein, 321 aa, Candida glabrata CBS 138
MPTNSIKLLAPDVHRGLAKLVAKRLGIELTDCKLKRDPSNEVSFSIGESVRDQDIFIITQIGSGTVNDRVLELLIMINASKTASARRITAIIPNFPYARQDRKDKSRAPITAKLMADMLTTAGCDHVITMDLHASQIQGFFDIPVDNLYAEPSVVRYIKENVKYEDAIIISPDAGGAKRAATLADRLDLNFALIHKERARANEVSRMVLVGDVTDKICIIVDDMADTCGTLAKAAEVLLDNGHAKSVIAIVTHGVLSGNAIANINNSRLDRVVCTNTVPFEDKMPQCPKLDVIDISSVLAEAIRRLHNGESISYLFKNYPL

SEQ ID NO: 34516 - protein, 332 aa, Leptospira interrogans serovar Lai str. 56601
MAPMMDWTDRHFRYFLRLISKHTFLYTEMVHTGAVLHGDRRKLLSYSPEELPLAIQLGGSDPKALAESCKIGEDYGYTEINLNVGCPSDRVREGNFGACLMETPEKVAELTFAMDTSVSIPITVKCRIGIPGKETFEDLCKFIECVRQTGVQRFIVHARIAILGGLTPAQNRQVPPLHYTYVESLKKEFPDLLIEINGGIRTITSIRERLEKNDGVMIGRAAYETPYLFSEVDSLFFGENLPPLSRREILLRMKDYIEEVILKEKNGKPHHALRHMLGLFHGEKGARSFRKILTEGMYSGYSKDLLSKAIQEISNDSLDIVSSNAYLYKSGS

SEQ ID NO: 34517 - protein, 412 aa, Archaeoglobus fulgidus DSM 4304
MQYEKVKPPENGEKIRYENGKLIVPDNPIIPYFEGDGIGKDVVPAAIRVLDAAADKIGKEVVWFQVYAGEDAYKLYGNYLPDDTLNAIKEFRVALKGPLTTPVGGGYRSLNVTIRQVLDLYANVRPVYYLKGVPSPIKHPEKVNFVIFRENTEDVYAGIEWPRGSEEALKLIRFLKNEFGVTIREDSGIGIKPISEFATKRLVRMAIRYAIENNRKSVTLVHKGNIMKYTEGAFRDWGYEVAKQEFGEYCITEDELWDKYGGKQPEGKIVVKDRIADNMFQQILTRTDEYDVIALPNLNGDYLSDAAAALIGGLGIAPGSNIGDGIGVFEPVHGSAPKYAGQNKVNPTAEILTGALMFEYIGWKDASEMIKKAVEMTISSGIVTYDIHRHMGGTKVGTREFAEAVVENLQSL

SEQ ID NO: 34518 - protein, 523 aa, Zea mays
  misc_feature (42)..(42): Xaa can be any naturally occurring amino acid
  misc_feature (412)..(412): Xaa can be any naturally occurring amino acid
  misc_feature (433)..(433): Xaa can be any naturally occurring amino acid
MEADAAAASGGLALLPAVLLLVALSTLVFSTWSNRNSRLPPXPMALPLIGHLHLIRPPPHRAFDRILARYGPLVYLRLGPSTHCVVAGTADAARDLLKHEASIPERPLTAVTRHLAYDDAGFAFAPYGPHWRFMKRLCMSELLGPRTVDQLRPVREAELAAVLEAARQAAAAREPIDVSRHLISMSNNAIMRMVASALPGHMTEAARDCAKHVAELVGAFNVEDYVGLCRGWDLQGLTRRTREVRDKFDALLEIMITGKEESRRRRHATTDTGGGTKDLLDILMDAAEDANAEVRLTRENIKAFVLDIFTAGSDTTATSVEWMLALLINHPACMDKLRAELDAVVGASRLVGEQDVPRLPYLQAVFKETLRLQPPAVFAQRETIEPVHVRGYVIPPKTSVFFNIFSIGRDPXCWEDPLQFRPERFMPGGAGAXVDPKGQHMQLMPFGSGRRACPGMGLAMQAVPAFLAALVQCFHWEVPIPPGQSTAPPLYMEEAAGLVTARKNHLLLIPTPRLNPLPARAAT

SEQ ID NO: 34519 - protein, 513 aa, Coccidioides posadasii
MFRPIVPRLAGRSLPKATPQTAFQHSFPVSTVYILGRSKRGYATQSDEHDLVIIGGGVAGYVAAIKAGQEGLKTACIEKRGALGGTCLNVGCIPSKSLLNNSHLYHQVLHDTKKRGIEVGDVKLNLKQMMKAKDTSVESLTKGIEFLFKKNKVEYVKGTGSFIDQHSVKVDLLEGGERTLRAKNIIIATGSEATPFPGLTIDEKRIITSTGALSLEEVPKKMVVIGGGIIGLEMASVWSRLGSEVTVVEFLGQIGGPGMDAEIAKQIQKILSRQGLKFMVGTKVTKGDASGESIKLEVEAAKGGKEQTLDADVVLVAIGRRPYTQGLGLEKVGLDVDEKGRVIIDQQYRTKEQHIRVIGDCTFGPMLAHKAEEEAVAAIEYIKKGHGHVNYSAIPSVMYTHPEVAWVGQNEADLKAAGIKYRVGTFPFSANSRAKTNLDSEGQVKFLADEQTDRVLGVHIVGPNAGEMIAEATLAVEYGASCEDIARTCHAHPTLAEAFKEAAMATYAKAIHF

SEQ ID NO: 34520 - protein, 416 aa, Leptospira interrogans serovar Lai str. 56601
MTDMSFSAERIRTDFPILGTKMNGKALVFLDSAASSQKPFTVIDTIEKYYREENANIHRGIYYLSQKATEKYELSRIRLSKFIGAQCAKVCIFTRNATESINLVAQTWGRTQIKEGDEIVLNELEHHSNIVPWQMLAQEKKAVLKFIPLNEDSTLDFSNLQEIITTKTKLVAISQMSNVTGTIHDILPVQKRAKEVGAKLLVDGAQGVCHLPVNMKEMEYDFYVFSAHKMLGPTGVGVLYAKEEILEEMPPWMGGGDMIAQVYKEKSTYAELPSKLEAGTPNIAGVIGFGSAIEYLENIGMQEIRNHEIELLSYALNRLDDFGGLELYGTRDLSKRGGVISFNFPGVHPHDVGTILDEEGIAIRVGHHCAQPFMAFQNIPGTCRASLYLYNTKDDIDRLIQGLIKVKEIFSRVLKR

SEQ ID NO: 34521 - protein, 521 aa, Coccidioides posadasii
MFKSGVARTFGRSAFARPASTILSSTRSAVGNNALRALSARYASTEAGKTGKIHQVIGAVVDVKFDTEQLPPILNALETENGGQRLVLEVAQHLGENVVRTIAMDGTEGLVRGAKAVDTGAPIQIPVGPGTLGRIMNVTGDPIDERGPIKGVKMAPIHAEAPEFVEQSTTAEILVTGIKVVDLLAPYARGGKIGLFGGAGVGKTVFIQELINNIAKAHGGYSVFTGVGERTREGNDLYHEMQETRVIQLDGESKVALVFGQMNEPPGARARVALTGLTIAEYFRDEEGQDVLLFIDNIFRFTQAGSEVSALLGRIPSAVGYQPTLAVDMGVMQERITTTTKGSITSVQAVYVPADDLTDPAPATTFAHLDATTVLSRGISELGIYPAVDPLDSKSRMLDPRIVGDEHYQVATRVQQMIQEYKSLQDIIAILGMDELSEADKLTVERARKLQRFLSQPFAVAQVFTGIEGKLVDLKDTIRSFKAIINGEGDDLPEAAFYMVGDFESARAKGEKILAELEKSS

SEQ ID NO: 34522 - protein, 398 aa, Streptomyces viridochromogenes
MTITSVRLRGILDSRARVTLEAEVTLDSGHTGTGSAPRAIAPGRLERRRGPEPVLGPVTAPPLAAALTDGAVDGQRQCDARLADVYEAGEAGSDLTLAVSLAHARAAAAARHLPLHAHLAEQYGLGHPGLPRLMVNVFSGGIHRDGPPRGFQQVMVLPATGRIHTDIEVADQVFTAAHRAVERRFGPVPLSASSGLLVPLESEEQLALLQAAVAEAGHTEVCTLGVDVAAEHLHTGSGRYRFGDREFTSGEFAEHLAGLAHRFRLTFLEDPFDPADDAGWDKLRGALPSATSVVGDDLFATDARRIAPGLADGILLKLSQAGTVSATLAAAAAARRAGMLLAVSHRSGETEDTAMCDLAVAVAAELIKVGGPRRGDRLAKYNQLLRLDESLAGLVTAP

SEQ ID NO: 34523 - protein, 267 aa, Erwinia carotovora subsp. atroseptica SCRI1043
MHPMLNIAIRAARKAGNLIAKNYETPDAVEASQKGSNDFVTNVDRDAERLIIEVIRKSYPQHTIIGEECGELAGEDPAVQWVIDPLDGTTNFIKRLPHFAVSIAVRIKGRTEVAVVYDPMRNELFSATRGQGAQLNGYRLRSSTARDLEGTVLATGFPFKLKQHSKSYINVVSALFTQCADFRRTGSAALDLAYVAAGRVDGFFEIGLKPWDFAGGELLVREAGGIVTDFVGGHNYLASGNLVAGNPRVVKSILGTIREELSDALKR

SEQ ID NO: 34524 - protein, 456 aa, Mycoplasma pneumoniae M129 [sequence omitted]

SEQ ID NO: 34525 - protein, 661 aa, Acidovorax sp. JS42
MSSLALTLLYLLAAVLGVVACRSLRLPPMMGYLAAGILIGPHALALTQNSEGVRHLGEFGVVFLMFTIGLEFNLPKLRAMRRHVFGLGLLQVLACMAAFSAWLLLLARLTGGVWDMGWQTALALGGTLAMSSTAIVVKLMSERGELESEHGRRVLGILLFQDLAVVPMLVLVPALGSEPEQLLTALAVALLKATVLVAVLLVGGQRVMRWWLTQVARRKSDELFMLNLLLVTLGLAWLTELAGLSLALGAFIAGVLVSETEYRHQVGTDIRPFHDVLLGLFFITVGMMLDWHVLVERWSLVLVLLAAPLLIKTAIIVALARGLGTTTGVSLRTALYVAQAGEFSFVLLSLMQVHGLLQPALMNPVLAAMVLSMLATPFLIQYSNRIVMKLVASDWLQQSLQVTTIARQAINTSGHVLICGYGRSGQNLARMLEREGIAYMALDLDPDRVRQAAAAGNSVVFGDATRLQALKAAGLARAAALVVTYLDTPAALKVIHHARTHAPQLPVVVRTQDDSQLEKLQEAGATEVVPEAIEGSLMLASHALALVGVPMRRVLRLVQDQRDARYGLLRGYFHGADDDTPSERDQERLYSLSLPAGAAVVGKPLADLPLHGIGVRLVNVRRASGAMSPPDDRTPLAEGDTLVLSGHPTALGLAEEKLLRG

SEQ ID NO: 34526 - protein, 184 aa, Acidovorax sp. JS42
MTALSVNDYLRQHIRTVPDWPAPGVQFRDITPLLQNPKVFRVLIDAFVHRYMDRALRPDVVAGLDARGFILGAVVAYELNVGFVPIRKKGKLPFTTVEETYELEYGSATVELHADAVQPGDRVLLIDDLIATGGTMMAGKKLLEKLGATVMEGAAIVDLPELGGSERLRASGLPLYTLVDFSGH

SEQ ID NO: 34527 - protein, 479 aa, Coccidioides posadasii
MASRRLASSLNGALRSRAALQAVRPAKRGFATPVSTAATTQSTTLSNGLTIATEYSPWAQTSTVGVWIDAGSRAETDKTNGTAHFLEHLAFKGTNRRTQHQLELEIENMGGHLNAYTSRENTVYYAKSFNADVPKAVDILSDILQNSKLEPAAIERERDVILREQEEVDKQLEEVVFDHLHATAFQNQPLGRTILGPKENIQSIQRQDLVDYIKTNYTADRMVLVGAGGIPHEQLVKLAEQHFGSIPSQPPTSAASAIAAEQKRLPDFIGSDVRIRDDTVPTAHIALAVEGVSWKDDDYFPALVTQAIVGNWDRAMGNSPYLGSKLSTFISHNNLANSFMSFSTSYSDTGLWGIYLVSENKTALDDLVHFTLREWSRLSFSVTPAEVERAKAQLKASILLSLDGTTAIAEDIGRQIVTTGRRMSPQDIERAVDKVTEKDVMDFAQRKLWDQDVAVSAYGSVEGMLDYQRIRNDMSRNAA

SEQ ID NO: 34528 - protein, 399 aa, Novosphingobium aromaticivorans DSM 12444
MNVHEYQAKELLAKYGVGIPAGIAALTVEEAVAAAKQLPGPLYVVKAQIHAGGRGKGKFKELPADAKGGVRLAKSIEEVEAFAKEMLGNTLVTVQTGEAGKQVNRLYVTDGVDIDKEYYLSMVVDRATGRVAIIVSTEGGMDIEEVAHSTPEKIATIVIDPAEGFMPHHGRAVGFALKLSGDLLKQAAKIAEQLYTAFVALDCSMLEINPLVQTKDGNLLVLDTKMSFDSNALYRHPDVVALRDETEEDPAEIEASKYDLAYIKLDGNIGCMVNGAGLAMATMDIIKLNGEFPANFLDVGGGANKEKVTAAFKIILKDPAVKGILVNIFGGIMKCDIIAEGIVAAAKEVNLSVPLVVRLEGTNVQQGKDILANSGLPIVPANDLGDAAKKIVAEVRAVA

SEQ ID NO: 34529 - protein, 184 aa, Oryza sativa
MVRGWPMGGGIGPAQGPGSRAMVVPLSRVSGSRAGPTSRLLEKPIQRSFLVSADMAHALHPNYMDKHEENHQPKLHGGLVIKHNANQRYATNAVTAFIFREIAERHHLPIQDFVVRNDMGCGSTIGPILASGVGIRTVDIGAPQLSMHSIREMCAVDDIKHSYEHFKAYFEEFTELDSKVKVDC

SEQ ID NO: 34530 - protein, 509 aa, Chromobacterium violaceum ATCC 12472
MSNKQDYLERILTSRVYDVAVETPLELAPNLSRRYRNHILLKREDLQPVFSFKLRGAYNKMAKLTPEQRARGVITASAGNHAQGVALSASKLGCEAVIVMPVTTPQIKIDAVKQRGGQVVLSGDSFNEAYLHAVKLAEESGRTYIPPFDDPDVIAGQGTVGMEILRQHPDDLDAVFVAIGGGGLAAGVASFIKRLKPEIKIIGVQPVDSDAMRQSIEKGERVELKDVGLFADGVAVKLVGEETFRICRELLDEIILVDSDAICAAIKDIFEDTRSIVEPAGALAVAGAKAYIEREGCEGQSLVAISCGANMNFDRLRHVSERSELGERREAIIAVTIPEKPGSFKRFCSVIGGRNITEFNYRFADPSVAHVFVGVQIAGKEDVEKLLRDLRAAELDGIDLTDNELAKLHIRHLVGGHAPQLKDERVLRFEFPDRPGALMRFLEAMRTDWNISLFHYRNHGADYGRVLVGIQVPSGDAQAFQQFLDTLGYPYIEETENPAYRLFLGKTIR

SEQ ID NO: 34531 - protein, 352 aa, Arabidopsis thaliana
MDTEMETEQIYQVDVGNLLAFNPNHRFPSAPSSRGELVKEILTEGTKLVQEIANKLFNFPSTETNDGPIVQLPPPTTKLPREKHIPRPKPPTKWEEFALKKGIQKRKKEKVVWDEQTNQFKRRHGYDRVNDDNDVPIIEAKESDETMLKSNLFEFEDKDMELHYIIFSTIYESFWLIAEPGVDPFAKRLDDKKKRVGKQEKNRLQNLKAAEKAGALPSHVQLAATSLPISGTKAQPKKIGKDELGDVAGLAATSTASGGKFDKKLPGEKPPKKQGKHHKYLPVVSGRGDVNAEKEQTNNVLSKIFSKHSHEILNVGKAINMYNVKKEKKKSGRSDKLKPKKDITKKPANKAK

SEQ ID NO: 34532 - protein, 477 aa, Novosphingobium aromaticivorans DSM 12444
MGKATGFLEIDRKDRTYDAPAERLKHYREFVVPHDEAGLKGQAARCMNCGIPYCHNGCPVNNQIPDWNHLVYENDWRDALTNLHSTNNFPEFTGRICPAPCEAACTLNIIDQPVTIKSIECAIVDRGWKEGWIEPQVPVKKTGKSVAVVGSGPAGLAAAQQLARAGHSVTVFEKNDRVGGLLRYGIPDFKMEKTHINRRAMQMEAEGVQFRTGVEVGVTVSFASLQENFDAVVLSGGAEDPRGLQIPGAELPSVRMAMEFLTQQNKRNAGDDELRAAPRGSLFATGKHVVVIGGGDTGSDCVGTSNRQGALSVTQLEIMPKPPEKEDKALSWPNWPLKLRTSSSHEEGCEREFAVLTKRVVGENDVTGLECVRVEWVNGQMQEVPGSEFVLKADLILLAMGFVGPRKQGLLEQAGVELDARGNVKGNVVDYKTSVENVFACGDMRRGQSLVVWAIREGRQCARAVDEALMGVSELPR

SEQ ID NO: 34533 - protein, 144 aa, Rhizobium leguminosarum bv. viciae 3841
MTSSVKAILDLKGRDVVTAGPNTTVAEAAAILSKKKIGAIVVVGMENRISGMFTERDLVHAIAKHGKEGLDHSLAQVMTAKVYRCHEETTVNELMELMTSRRFRHVPVESNGKLAGIISIGDVVKSRIAEVEREAEEIKAYIAG

SEQ ID NO: 34534 - protein, 297 aa, Phanerochaete chrysosporium
MAAAEDIAPEEKVALLEPHSNHDTQSASPRRRRPHAAHAALLAVFLLGVALLALGVWGTYASSPRGPSLPRELQRTPHTHFALDGLRGQPPQTRSHAFVVSEVEGAPDGVRKPMLVVNGMYPGPTIEANQGDRVVVKVTNMLENRTTIHWHGLFQNGTNYYDGTAAITECGIPPGQTLVYNFTLGEFSGTTWWHAHYSTQYTDGITGALVVHPTDPLPASIPPWDGDLVVQVSDLYHTFSPVLLERFLSVSPPALRPTRHTAVLREPPAAAAWWRTIVALRSTDDTAFFGNDVTPFC

SEQ ID NO: 34535 - protein, 462 aa, Phanerochaete chrysosporium
MAAAEDIAPEEKVALLEPHSNHDTQSASPRRRRPHAAHAALLAVFLLGVALLALGVWGTYASSPRGPSLPRELQRTPHTHFALDGLRGQPPQTRSHAFVVSEVEGAPDGVRKPMLVVNGMYPGPTIEANQGDRVVVKVTNMLENRTTIHWHGLFQNGTNYYDGTAAITECGIPPGQTLVYNFTLGEFSGTTWWHAHYSTQYTDGITGALVVHPTDPLPASIPPWDGDLVVQVSDLYHTFSPVLLERFLSPWGIDGVPGDEPVPDAGTLNGLGQWAGHGDYFNFTLEANKTYRLRVVNTGSFASVRFSVDRHVLRVVEADGTLVEPHDVSGVTLAVGQRYSVLLRTDNATGGPFWMRATLQKHMFRYDLPGQNRDIRGVIRYGPAADTTALPAETDDPGVRSHPGLADADDRQLVPALFNTAPERTRSYPLRVSLQLHDSLVMLGFLNTTVRPVSRPGVRCSR

SEQ ID NO: 34536 - protein, 286 aa, Phanerochaete chrysosporium
MAAAEDIAPEEKVALLEPHSNHDTQSASPRRRRPHAAHAALLAVFLLGVALLALGVWGTYASSPRGPSLPRELQRTPHTHFALDGLRGQPPQTRSHAFVVSEVEGAPDGVRKPMLVVNGMYPGPTIEANQGDRVVVKVTNMLENRTTIHWHGLFQNGTNYYDGTAAITECGIPPGQTLVYNFTLGEFSGTTWWHAHYSTQYTDGITGALVVHPTDPLPASIPPWDGDLVVQVSDLYHTFSLCSRRIRYRSSTWSLTTSTTGTIRSICTDTGHGSWALASGGTLASR

SEQ ID NO: 34537 - protein, 408 aa, Pyrobaculum aerophilum str. IM2
MLLNEIIDLIPNINKCLKKGKTLIIRIDINSPIVNGKIIDDFRIRAHSYTLRLASDAGARAVVLAHQGRPGQDDFTSLEIHKPYIEKYLERPIKFVDDIIGPEARRQIKELKDGEILLLENVRILSEEVIEKVPEAQAETLLVRKLAPLADYYVFDGFAVAHRSQPSVVGFPIVLPSCAGPVFERELRALGAVFEKRGRGVTLIAGGAKMPDTLKAVEQLLKNGFVEKVAVGGLVGFVFALGKYGVLNSALKQEVEKGGFLPYIERARQLLAKYGAQIYTPVDFAVNQNGRLDVDIYSLAQPPLDIGRSTTIAFKEVIEQSEIVIFSGPMGYIEDERFATGTIELLKAASNRRLILGGGHTIMAAEKAGVLDKAYHVSTGGRAFIQTIGGEEMPAVKALLTSAKKFSL

SEQ ID NO: 34538 - protein, 192 aa, Oryza sativa
  misc_feature (19)..(19): Xaa can be any naturally occurring amino acid
MESNGKAVTRSGDYVKYTXGAVFWGEPGTNSQHSFFQLLHQGTKLIPADFIRAVETHNPVQGGLHQRMLASNFLAQTEALMVGKTPEQVKAEGAPEELIPHKTFLGNRPTTSILADKISPATLGALIAYYEHMVFTEGAIWNINSFDQWGVELGKALAKKVQKDLETEGAGSGHDSSTSGLIAAFKAKSGLK

SEQ ID NO: 34539 - protein, 257 aa, Arabidopsis thaliana
MKLIEKTMSMNQFRTMEEEKQDGGELFHTIEVAKVDRNNVSQPPPAATAALLEVPGDELNLIPPLNFSMVDNGIFRSGFPDSANFSFIKTLGLRSIISLCPEPYPENNMQFLKSNGISLFQFGIEGSKSKCLPGLENEVWLHIWSSKHQKEDFYTNGNSKTSEPFVDILDQKIREALKVLLDEKNHPLLIHCKRGKHRTGCLVGCMRKLQKWCITSILDEYKRFAAAKARVSDQRFLESFDVSGLKHTPMSFSCSNR

SEQ ID NO: 34540 - protein, 591 aa, Phanerochaete chrysosporium
MDQSAYSRFGRANHARRRLNLCLRPAPVYLPLLLALLAIAFVTSVDARAVSYASRDTPELASHEATVAVPRADNFVVGSIRGQPPTTRHFNFVVSQMNGSPDGFSKPMLVVNGLFPGPTIEANQGDRIVVHVTNTLSTRTTIHWHGLYQNSTNYYDGTAGVTECGIPPGQSLTYNFTVDDFSGTTWWHAHYDTQYTDGVTGALIVHPRKYPRGFPTWDEDIVVELTDIYHAFSETILSEYLGGGGGPLTGLQLETPDSGAINGIGQYNGSTKYTNLNLKPNKTYRLRLIHTGSAAAIRFSVDYHALTVIEADSTLTQPYTVSSVTLAVAQRYSVLLTTNQHAEPARNYWMRAALKSAVAVPGANADIRGILRYGSGHAAPTAGADPGVPGSGLADLDVAKLVPAAPRTPPPATKAYTVDFSIGGKPDGGAFATMNGTSWQPLQGTTTLLQIVDAARNGSMYAPEGASIQPGGQFLITEDNIEVVDVLLVNTGPGDHPFHLHGHTPYIMGFGTGAYTGTGLNTVNPFMRDTFAVPGSGWLLMRIVTDNPGIWTLHCHIAWHMAAGLMMQISSLPSKAAQLDIPRDIVRQCSA

SEQ ID NO: 34541 - protein, 316 aa, Bifidobacterium longum DJO10A
MAEDVAEQLGIDVLETTAYDFANGEMYVRYTESVRGADVFVLQSHYKPINKAIMEQLIMIDALKRASARSITAVCPLLGYSRQDKKHRGREPISCRLVFDLLKTAGADRIMSVDLHAAQSQGFFDGPVDHLVAMPVLVDYIRDRFQGHLDNVAVVSPDAGRIRVAEQWAQRLGGGPLAFVHKTRDITRPNQAVANRVVGDVAGKDCVLVDDLIDTAGTIAGACHVLQDAGAKSVTVVATHGVLSGPAVERLKNCGAREVVLTDTVPIPEEKRWDGLTVLSIAPLLASAIRAVFEDGSVAELFDTYPEHHGQGFLFA

SEQ ID NO: 34542 - protein, 459 aa, Triticum aestivum
  misc_feature (184)..(184): Xaa can be any naturally occurring amino acid
  misc_feature (196)..(196): Xaa can be any naturally occurring amino acid
  misc_feature (351)..(351): Xaa can be any naturally occurring amino acid
  misc_feature (367)..(367): Xaa can be any naturally occurring amino acid
MPTANVRAAQPGADRRLSTLVRHLLPSSPRTSAATATSADSSLQPFPTMASPSVFAGIAQGPEDPILGVTVAYNKDPSPVKVNLGVGAYRTEEGKPLVLNVVRRAEQMLIQNESRVKEYLPITGLADFNKLSAKLIFGADSPAIQENRVATVQCLSGTGSLRVGGEFLARHYHERTIYIPQPNXGGNHPKVFTLAXGLTARSYRYYDPATRGLDFQGLLEDISSAPSGAIVLLHACAHNPTGVDPTLEQWEQIRQLMRSKALLPFFDSAYQGFASGSLDKDAQSVRMFVADGGELLMAQSYAKNMGLYGERVGALSIVCGSADIAVKVESQLKLVIRPMYSNPPLHGASIXVATILKDSAMFDEWTXWELKAMADRIISMREQLFNALKIRETPGDWSHIIKQIGMFTFTGLNSDQVAFMRQEYHIYMTSDGRISMAGLSSRTVPHLADAIHAAVTKLK

SEQ ID NO: 34543 - protein, 601 aa, Physcomitrella patens subsp. patens
MAVAKTTTRIAHKNTVAQNVDPEYRLYQHPVCERNVPFVLIILSGWGEGREDEFNAIHKSDCVAIKTLRNIHPYRWRTLKAHGEWVGLPKNTDMGNGEVGNNAMGCGKIVAQRATLVDKAIADGSMSKGQGWLYAKEAWVYGGTLHLLGLLSDGGVHSRYDQLRYIFKTAADQQCKKIRFHVLLDGRDVNEGTSIHFVEQLEKDLDELRKWGCDARIASGGGRMFVTMDHWNTDWRIVRRGWYAHVLGDSPNKYESAVEAITDLKKKDPHCNDQYLPPFVIIKKSDGKPWGTIEEGDVVINFNFRADRMIQISQAFVDENFDKFDRIYWPNVRYVALMQYDLKAKIPIHYLVKPPQFHKLAGKYLSANGVRTFAITESQKMGHITFNWNGNNSGKTHEVNDTWHEVQSENVRYEYEPEMRAATIGNVANDALLSGKYDFVRVMFANGDFVGHTNDFEATKRACVAVDEGIKLICSAVELCGGIYMIVGDHGNCEDMVQRDVEGNPQLDGCGNPFRKPCHSLHEVPCGIGGPGLHPNARFRDNLRNAGLANVTATYMNLLGFEAPHCYEPSLLTFDYNPWAFTGVHEDHKPHMDDQRALIKR

SEQ ID NO: 34544 - protein, 169 aa, Physcomitrella patens subsp. patens
MATISVGDKLPEANLSYFDTEGNVQSVSVSELTRGKKVVLFAVPGAFTPTCSSKHLPGFVANAEELRKAGVDTLACVSVNDAFVMQAWAKSVGAGDKVLMLSDGLAKFTQALGTTVDLTDKVEGLGIRSRRYSMLVDDGVVKVLNLEEGGAFTSSSAEEILSSLQKANA

SEQ ID NO: 34545 - protein, 513 aa, Stevia rebaudiana
MDAVTGLLTVPATAITIGGTAVALAVALIFWYLKSYTSARRSQSNHLPRVPEVPGVPLLGNLLQLKEKKPYMTFTRWAATYGPIYSIKTGATSMVVVSSNEIAKEALVTRFQSISTRNLSKALKVLTADKTMVAMSDYDDYHKTVKRHILTAVLGPNAQKKHRIHRDIMMDNISTQLHEFVKNNPEQEEVDLRKIFQSELFGLAMRQALGKDVESLYVEDLKITMNRDEIFQVLVVDPMMGAIDVDWRDFFPYLKWVPNKKFENTIQQMYIRREAVMKSLIKEHKKRIASGEKLNSYIDYLLSEAQTLTDQQLLMSLWEPIIESSDTTMVTTEWAMYELAKNPKLQDRLYRDIKSVCGSEKITEEHLSQLPYITAIFHETLRRHSPVPIIPLRHVHEDTVLGGYHVPAGTELAVNIYGCNMDKNVWENPEEWNPERFMKENETIDFQKTMAFGGGKRVCAGSLQALLTASIGIGRMVQEFEWKLKDMTQEEVNTIGLTTQMLRPLRAIIKPRI

SEQ ID NO: 34546 - protein, 520 aa, Bifidobacterium longum DJO10A
MANGPVLVVDFGAQYAQLIARRVREAGVYSELVPHSMPVDEILAKDPKAIILSGGPASVFEPGAPTIDTKVFESGVPVLGICYGFQVMAYELGGKVDKAALGEYGKTSATIDDAAGILADSPAEQTTWMSHGVAVEQAPAGFEVLAHTEGAPVAAMADESRKLYGVQWHPEVKHSPLGQKLIENFLHRCAALPNDWDASSIIEDQVKKIREQVGDAEVICGLSGGVDSAVAAALVHKAIGDQLTCVFVDHGLLRKGEVEQVKHDFVAATGIRLITVDAADDFLDALAGVSEPERKRKIIGEKFIRTFEKAQRQVLEEAGARGKEVKFLVQGTLYPDVVESGGGDGAANIKSHHNVGGLPEDIKFQLIEPLRTLFKDEVRAIGTELGLPDEIVWRQPFPGPGLGIRIIGEITKERLDLLREADAIAREELSKAGLDRDIWQCPVVLLADVHSVGVQGDERTYGSPIVLRPVSSEDAMTADWSRVPYDVLATISTRITNECRQINRVVLDCTSKPPATIEWE

SEQ ID NO: 34547 - protein, 396 aa, Physcomitrella patens subsp. patens
MTIHLLSAVMHLQSVLQGSSKCGYTQQSSRHGFFSTKATTTNPLSVSNARASAAVQLKLVVNRAPPLLAFRIIWGLNALTFAFHINQATRSNTMAATAIAIRTFTNAAALSRGGTNLWSTYSRSLATLVPSHIRGVAAVRTLPTFGSRAATTIAEGSKLPDAELSYFDKEGNVNIVKVSDLMRAKKVVLFAVPGAFTPTCSTQHLPGFVAKADKLRKAGADLLACVSVNDAFVMRAWGENQNVGESVLLLSDGLGKFTHAMGASVDLSDKPVGLGVRSRRYAMLVDDGVVKTLHMEEGGAFTSSGADDILKALLKRKTSAATAPECANQNTTDLRLILDAMLLQPQLKETAHEFVFKFGTTTITIIVTIPTQHTNTCDRLKGSTQWSRTCSRCRLK

SEQ ID NO: 34548 - protein, 458 aa, Coccidioides posadasii
MMLSRTSFGRQAVRAFRKQCLSTSQRGMASAAAPKGYDYETTEAAGVKLACRDFPAPTTTLTVVAKAGSRYQPLPGYSDALANFAFKSTTKRSALRITRESELLGGQFSAYHSRENVVLTTKFLSADLPYYAELLAEVLSNAKYSAYELSEVVVDHVKLSQQELVANPSLQALDAVHNVAFHRGLGNPLIPSPSAPLNVDADGVAAFSKNVYTKATTAVISNGANASEVSKWVGQFFSGVPASPASGAVASEASKYYGGEQRIASQAGNAMVIAFPGSSSFGTNGYKPEFNVLAALLGGQSTIKWSTGSSLLSKSVEGVSGVSVSAKQATYSDAGLFHITISGQAESVAQASKSVVETIKKVASGNIASEDIKKAIALAKFRALECGQNLTSGVELTGSALVHGSQPFQIAGVGQSIEKVTEQQVKEAAKSLLAGKASVASVGDLFRIPYASELGLTV

SEQ ID NO: 34549 - protein, 681 aa, Mycoplasma pneumoniae M129
MRKVLYQKYRPTKFSDTVGQDSIKRIIVNAITQDQLPHGYIFAGERGTGKTTFAKIIAKAINCLNWNGDVCNQCEACQAINSNSAIDVFEIDAASKNGINDIRELAENVFNLPFKFKKKVYILDEAHMLTPQSWSGLLKTLEEAPDYVLFIFATTEFNKIPITILSRCQSFFFKQITNDLIQQRLAEVAAKESIKITTDALVKLADLAQGSLRDGLSLLDQISNFSESKTISLADVEKTFNLLDKEQKFGFIEAVLSGDLKQSFHLIDNFESQGINFVHFLRELFALTVDLYGYVKTGQIAVVKPSDQTMAAKLRFHPKQYALLVQAIEANTGYGPSQLSLSDQIKAIVIHYNNAVSKEPHIPAYTPVVQTQSPAKEHVPSKTVEEAKPQLPAKEPVLYKVIEEPKVSSFVKDPVASKLIEQPQTIVQPEAQQEITEVEQPTETSPAPATDLFGLAIKPEVVRKRGRRPLSVENTDFFQPAVKKLIQPVSKPAPIKLIEPSDNNPVSIPIKLNRAVIAVSVYGHNDPKLVAHFQQLLDSFKREFTQAEKTKDSSYLKQFSDKFTASDLSKVIKVLAASPFGLVLIFEDKEIATRLWKEALTEATAQATLLEIFQQNLFLSSFTLSEYETKVLAKVEQLTHKPQVLQLQQLEQLSSTVVKKAQKTAAQEIADTFFKGLYEEK

SEQ ID NO: 34550 - protein, 695 aa, Oryza sativa Indica Group
MESAHGGSDRPGLAMCDFVGWVRCRFQMEIASRVHGLYRQQPALKFRRASIPEKDADATNASSVSPVSSSSSWRRDSSCTKGEGSMDSQEPRVDAEQKPVLSDNPEEQTIPSKDEKVLEPTISHDSNGINLPSEGQAQAGTSNIGGGHNAAYPQTMYSSQAQPFYYQGPGYDNPSNEWDGYPPYVSVEGLEAGPAVVYNDDPQLMYHGGYGYDPYAHYSPISTPVPAAVSGDGQLYSQQFSFSAPYYQQSVPPGMPYLSSPTPISQGEAMVPIDPTQGAFIAETLSPNSFLFGPRPEWFRSSEGNGSFPSPAASPQPAGGVSGPFGQSNFPMASGMQSPQHRPFYGFGTPSDSYGRVFSHGGYFPQATNYGGPFPSFGLNGRSSIPMEKGRRRGRGNALLCSCNGSLDFLNEQSRGPRATRPKKQPEDGGKDEKPSAGVDCELYNRPDFVTEYKNARFFIIKSYSEDNVHKSIKYGVWASTTNGNKKLDSAYREAKEKEEHCPIFLLFSVNASAQFCGVAEMIGPVDFEKSVDYWQQDKWTGQFPVKWHIVKDVPNNLFRHIILENNDNKPVTNSRDTQEVKLEQGMEMLKIFKDHEEDASILDDFDFYEERERALLENKARLHQQHQLPSSTVVEPKKPLTVATDLVGHITKSFAQAVRLGEAKNVSPNSADKGASGDSSVAAKPLEVKEAGLA

SEQ ID NO: 34551 - protein, 341 aa, Zea mays
MAATFTVAARLPLRGPARAPSRPAVAAVTRLRSRQERRGLAATGGRGPARVRAETFSGGGGVGRRDPMAPPYNVLITGSTKGIGYALARKFLEAGDNVIICSRSAQKVESVVGDLKEEYGEQHVWGTVCDVRNGKDVKALVEFARDKLKHIDIWINNAGSNAYTYKPLVETSDEALMEIITTNTLGLMICCREAINMMRNQPRGGHIFNLDGAGSDGRPTPRFAAYGATKRSVVHLTKSLQAELQMNEVNNVMVHNLSPGMVTTDLLMSGATTKQAKFFINILAEPPDVVADYLVPNVREIPTKQSMKPTYIRFLTGLKAYSRIFSRLAFGARRNKYVTED

SEQ ID NO: 34552 - protein, 149 aa, Arabidopsis thaliana
  misc_feature (59)..(59): Xaa can be any naturally occurring amino acid
  misc_feature (63)..(63): Xaa can be any naturally occurring amino acid
  misc_feature (80)..(80): Xaa can be any naturally occurring amino acid
  misc_feature (82)..(82): Xaa can be any naturally occurring amino acid
  misc_feature (102)..(102): Xaa can be any naturally occurring amino acid
  misc_feature (138)..(138): Xaa can be any naturally occurring amino acid
MASSMLSSAAVATYPAQANMGAPFTAMKPCASLPDTRKANNDITYITCNGGRASRMKGXPPIXKKTLETLSYLPDLTDYXIXKEVDYLLHNKWITRGEFQMXHGLEYREHGNTPGYYDGRDWTIAKLPLFGCTDSAQXLNEGEECKNEY

SEQ ID NO: 34553 - protein, 433 aa, Nostoc punctiforme PCC 73102
MKISIFGLGYVGAVTAACLARDGHEVIGVDVNPEKVDLIAKGESPIVEPGLSQLLVDGVAANLITATTDTEAAVLASDVSLISVGTPPIERGEPDLTYVWNVCKQIAKASIHKTESHVVVLRSTVPPGTLEKCQNLIDSITGNNSIHLAFNPEFLREGSAIKDYDQPPYTIIGTESPVAEAAVRQMYATVDAPFTVVKPSVAEMVKYVANCWHAAKVGFANEIGRVAKAFGVDGREVMNIIVQDTKLNISPVYMRPGFAYGGSCLPKDLSALLYYARNMDVPVPLLNALPTTNSLQVDLAAQQVLRLGARKIAILGLAFKPGTDDLRESPAVLLVKRLIGEGCQIKIYDQAVYEARLMGTNLTYIQNNLPHFEELLVAEAEQALKDAELVIVTHANPEFRQILQEALKEIQVLDLASVFTEPIEELNYCGIAW

SEQ ID NO: 34554 - protein, 271 aa, Streptococcus pneumoniae R6
MTNTSFSIEQFSLKGKIALITGASYGIGFAIAKSYAEAGATIVFNDINQDLVNKGIEAYREVGIEAHGYVCDVTDEDGIQAMVKQIEQEVGVIDILVNNAGIIRRVPMCEMSAADFRKVIDIDLNAPFIVSKAVIPSMIKKGHGKIINICSMMSELGRETVSAYAAAKGGLKMLTRNIASEYGGANIQCNGIGPGYIATPQTAPLRELQEDGSRHPFDQFIIAKTPAARWGNPEDLMGPAVFLASDASNFVNGHILYVDGGILAYIGKQPE

SEQ ID NO: 34555 - protein, 338 aa, Picea sitchensis
MACVVAGNSPSVFGSGSSPFIGGKCPSPLLQRKRPQRLDVPFHSLELNAPCAAMEQPMEVNVEGLHYAVSSKKGRREFMEDTHQAMVNVLGDSKQAFFGVFDGHSGRTAAAFAAENIGQNIVDAMLGMEDETGDILEQAVRAGYLTTDAEFLKLEVGSGTCCVTALIINGNLVVSNAGDCRAVISRDGVSEALTCDHRAGREDERQRIENLSGIVDLHHGVWRVQGSLAVSRAIGDLHMKEWITAEPDTRKIEITSDCEFLILASDGLWDKVTNQEAVDIARPFCVQKQPNLTPFGGGPKAACKKLVEVAVTRKSQDDVSVMIVQLRHFCLKENKTVR

SEQ ID NO: 34556 - protein, 591 aa, Phanerochaete chrysosporium
MDQSAYSRFGRANHARRRLNLCLRPTPVYLPLLLALLAIAFVTSVDARAVSYDSRDTRDLASDEATVAVPRADNFVVGSIRGQPPTTRHFNFVVSQMNGSPDGFSKPMLVVNGLFPGPTIEANQGDRIVVHVTNTLSTRTTIHWHGLYQNGTNYYDGTAGVTECGIPPGQSLTYNFTVDDFSGTTWWHAHYDTQYTDGVTGALIVHPRKYPRGFPTWDEDIVVELTDIYHAFSATILSEYLGGGGGPLTGLQLETPDSGAINGIGQYNGSTKYTNLNLKPNKTYRLRLIHTGSAAAIRFSVDYHALTVIEADSTLTQPYTVSSVTLAVAQRYSVLLTTNQPAEPARNYWMRAALKSAVAVPGANADIRGILRYGSGHAAPTAGADPGVPGSGLADLDVAKLVPAAPRTPPPATKAYTVDFSIGGKPDGGAFATMNGTSWQPLQGTTTLLQIVDAARNGSMYAPEGSSIQPGSQFLITEDSVEVVDILLVNTGPGDHPFHLHGHTPYIMGFGTGTYTGTGLNTVNPFMRDTFAVPGSGWLLMRIVTDNPGIWTLHCHIAWHMAAGLMMQISSLPSKAAQLDIPRDIVRQCSA

SEQ ID NO: 34557 - protein, 349 aa, Porphyromonas gingivalis W83
  misc_feature (30)..(30): Xaa can be any naturally occurring amino acid
  misc_feature (100)..(100): Xaa can be any naturally occurring amino acid
  misc_feature (111)..(111): Xaa can be any naturally occurring amino acid
  misc_feature (240)..(240): Xaa can be any naturally occurring amino acid
  misc_feature (262)..(262): Xaa can be any naturally occurring amino acid
  misc_feature (304)..(304): Xaa can be any naturally occurring amino acid
  misc_feature (333)..(333): Xaa can be any naturally occurring amino acid
MTKRLFLPEWAPQEAVQLTWPHDRTDWAYXLDEVETCFVRIATAILRHERLIVVCPDRKRVFGLLPPELHHRLYCFELPSNDTWARDHGGISLLADGRPXIADFAFNGWGXKFAAHHDNLITRRLHALGLFAEGVTLDNRLAFVLEGGALETDGEGTLLTTDSCLFEPNRNAGLSRTAIIDTLKESLGVSRVLSLRHGALAGDDTDGHIDTLARFVDTRTIVYVRSEDPSDEHYSDLTAXEQELKELRRPDGQPYRLVPLPXAEALYDGADRLPATYANFLIINGAVLVPTYDSHLDAVALSVXQGLFPDREVIGIDCRPLVKQHGSLHCVTXQYPQGFIRLEHHHHHH

SEQ ID NO: 34558 - protein, 208 aa, Brassica napus
MEFTLATSSFMGTKVIPATLFCRRARAASLIVTASSTKIYTRLDSCLVIPPPPIFKKPRAIIKFLGGAFVGAVPELTYSYLKELLAKEGYLIVSVPYNVTFDHEQAAKQVYQRFNSCLDAIVLSGVPNANLNPQDLANLPVFSVGHSNGALLQVLTGSYFSDKIPKVNAIISFNNKSATEAVPYFEQLGPLIQQMMPVVEASPLYEIA

SEQ ID NO: 34559 - protein, 431 aa, Candida glabrata CBS 138
MKDTYAEKGESPALNRRQNLTVKTRDRRSSSVGRIDLGDTVPSISTMNETKYSKLEAKRRKRALMGSDENDLDLMRKLWYSYREVNYRHSWVTPLLILFSVYSAYLTSGNRTETNPLHMFVAISYRIGDTDRYGKGIKDLAFIFYHMIFFTFLREFLMDVVIRPITRILNITSRHKVKRMMEQMYALFYCGCSGPFGLYIMYHSDLWLFKTKEMYNSYPDFTNPFLYKVFYLGQAAFWSQQACVLVLQLERPRKDYKELVFHHIVTLLLIWSSYVFHFTKMGLSIYITMDISDFFLSLSKILNYLDSIFTPPVFLVFVGSWIYLRHVVNIRILWSVLTEFKTEGNYVLNFATSQYKCWISQPIVFVLIFALQLVNLYWLFLIFKILLRLIFKGEQKDERSDSESDESTMPGTPADDNITICINESSKEKDE

SEQ ID NO: 34560 - protein, 439 aa, Pyrococcus horikoshii OT3
MIREKALEFHKNNFPGNGKIEVIPKVSLESREELTLAYTPGVAEPCKEIARDPGKVYEYTSKGNLVAVVSDGSRILGLGNIGPLAGLPVMEGKALLFKRFGGVDAFPIMIKEQEPNKFIDIVKAIAPTFGGINLEDIASPKCFYILERLREELDIPVFHDDQQGTAAVVLAGLLNALKVVGKKISEITLALFGAGAAGFATLRILTEAGVKPENVRVVELVNGKPRILTSDLDLEKLFPYRGWLLKKTNGENIEGGPQEALKDADVLISFTRPGPGVIKPQWIEKMNEDAIVFPLANPVPEILPEEAKKAGARIVATGRSDYPNQINNLLGFPGIFRGALDVRARTITDSMIIAAAKAIASIVEEPSEENIIPSPLNPIVYAREARAVAEEAMKEGVARTKVKGEWVEEHTIRLIEFYENVIAPINKKRREYSKAITRA

SEQ ID NO: 34561 - protein, 444 aa, Phanerochaete chrysosporium
MDQSAYSRFGRANHARRRLNLCLRPTPVYLPLLLALLAIAFVTSVDARAVSYDSRDTRDLASDEATVAVPRADNFVVGSIRGQPPTTRHFNFVVSQMNGSPDGFSKPMLVVNGLFPGPTIEANQGDRIVVHVTNTLSTRTTIHWHGLYQNGTNYYDGTAGVTECGIPPGQSLTYNFTVDDFSGTTWWHAHYDTQYTDGVTGALIVHPRKYPRGFPTWDEDIVVELTDIYHAFSATILSEYLGGGGGPLTGLQLETPDSGAINGIGQYNGSTKYTNLNLKPNKTYRLRLIHTGSAAAIRFSVDYHALTVIEADSTLTQPYTVSSVTLAVAQRYSVLLTTNQPAEPARNYWMRAALKSAVAVPGANADIRGILRYGSGHAAPTAGADPGVPGSGLADLDVAKLVPAAPRTPPPATKAYTVDFSIGGKPDGGAFATMNGTVRSALCS

SEQ ID NO: 34562 - protein, 174 aa, Brassica napus
MDGFPTDEERLTRRDSVGKKRVRDELDELVINSPDVKRLRDDLFDDSGHDPATQDLDSLMKSFEDELTNTTAQQSGETQPDLGYLFEASDDELGLPPPPPQPSTLLPPSSGETKETELVRASSDSSGVGELRGIEEPVTGFGSFELDDGLFEYSDVSLDSGDLFSWRPETLPAE

SEQ ID NO: 34563 - protein, 161 aa, Aspergillus oryzae
MATDVAFDTSMGSFTVELYNSHAPKTCKNFATLAQRGYYNNVIFHRIIPNFMVQTGDPTGTGRGGSSIYGEKFEDEIRADLKHTGAGILSMANSGPNTNGSQFFVTLAPTPWLDGKHTIFGRVKSGMRVIQRMGLVKTNGEDRPVDEVKIIRARVVEEGEE

SEQ ID NO: 34564 - protein, 437 aa, Mycobacterium tuberculosis H37Rv
MAAATGGLTPEQIIAVDGAHLWHPYSSIGREAVSPVVAVAAHGAWLTLIRDGQPIEVLDAMSSWWTAIHGHGHPALDQALTTQLRVMNHVMFGGLTHEPAARLAKLLVDITPAGLDTVFFSDSGSVSVEVAAKMALQYWRGRGLPGKRRLMTWRGGYHGDTFLAMSICDPHGGMHSLWTDVLAAQVFAPQVPRDYDPAYSAAFEAQLAQHAGELAAVVVEPVVQGAGGMRFHDPRYLHDLRDICRRYEVLLIFDEIATGFGRTGALFAADHAGVSPDIMCVGKALTGGYLSLAATLCTADVAHTISAGAAGALMHGPTFMANPLACAVSVASVELLLGQDWRTRITELAAGLTAGLDTARALPAVTDVRVCGAIGVIECDRPVDLAVATPAALDRGVWLRPFRNLVYAMPPYICTPAEITQITSAMVEVARLVGSLP

SEQ ID NO: 34565 - protein, 513 aa, Haemophilus influenzae Rd KW20
MKNLLTNPQPSQSDYINAIVKLGSRVYEAAQVTPLQKMGKLSERLHNNIWIKREDRQPVNSFKLRGAYAMISSLSAEQKAAGVIAASAGNHAQGVALSAKQLGLKALIVMPQNTPSIKVDAVRGFGGEVLLHGANFDEAKAKAIELSKEKNMTFIPPFDHPLVIAGQGTLAMEMLQQVADLDYVFVQVGGGGLAAGVAILLKQFMPEIKIIGVESKDSACLKAALDKGEPTDLTHIGLFADGVAVKRIGDETFRLCQQYLDDMVLVDSDEVCAAMKDLFENVRAVAEPSGALGLAGLKKYVKQNHIEGKNMAAILSGANLNFHTLRYVSERCEIGENREALLAVTMPEQPGSFLKFAYVLGNRAVTEFSYRYADDKRACVFVGVRTTNEQEKADIIADLTKNGFDVEDMSDDDIAKTHVRYLMGGRAANDNERLYTFEFPEQKGALLKFLETLQNRWNISLFHYRAHGADYGNILAGFQIEQREQAEFEQGLAQLNYVFEDVTKSKSYRYFLR

SEQ ID NO: 34566 - protein, 522 aa, Pyrococcus horikoshii OT3
MGMIEKVEELHERKKKILQMGGEEAIKKQHEKGKLTARERLELLLDPGSFVEIGMFVKHRATEFGMDKRELPADGVITGYGTINGRLVFVYAQDFTVMGGSLGEMHAMKIKRIMELALEAGAPVIGLNDSGGARIQEGVDSLKGYGEIFKMNTILSGVVPQITAIMGPCAGGAVYSPAIGDFILMVDNPSTFMFITGPQVVKAVTGVEVTPVQLGGAMVHAQRSGQAHLIGKSDEEVIMLIKKLLSYLPSNNMEKPPRVKPKDEPFRRTPELYDIVPDDPNKGYDVRQVIYTIVDRDENGNPDFLELQPYFAPNAVIGFGRINGQPVGIVANNPIHLAGVLDIDSSDKIARFVRFCDAFNIPIVTFVDVPGYLPGVDQESRGIIRHGAKVLYAYAEATVPMVTIILRKAYGGAYLAMGSKHLGADFVFAWPTAEIAVMGPEGAANIIFRKEIAKAENPEEFRRQKIQEYREKFANPYVAAARGYIDDVIDPAETRAKIVMALEALENKRVKLPPKKHGNIPL

SEQ ID NO: 34567 - protein, 133 aa, Bacillus sp. SG-1
MTANVEACSAQDNFQSAASKMSSLGVGALPVVQNGQVVGMVTDRDLVVRGLSHNNAAGTIQGVMSNHVVTVSPNASVEEAAALMSQHQVRRLPVVENGNLVGMLALGDLAVQQQSDQKAGAALSEISEKDHLH

SEQ ID NO: 34568 - protein, 349 aa, Haemophilus influenzae Rd KW20
MKLTKLALCTLFGLGVSIANAADLPNITILATGGTIAGSGQSSVNSAYKAGQLSIDTLIEAVPEMKNIANIKGEQIVKIGSQDMNDEVWLKLAKAINAQCKSTDGFVITHGTDTMEETAYFLDLTVKCEKPVVLVGAMRPATEKSADGPLNLYNAVVVAADKKSSGRGVLVAMNNEVLGARDVTKTSTTAVQTFHSPNYGSLGYIHNSKVDYERSPESKHTINTPFNVEKLDSLPKVGIIYAYSNAPVEPLNALLNAGYQGIVSAGVGNGNVNAAHLDRLEKAAKDSVVVVRSSRVPTGYTTRDAEVDDSKYGFVASGTLNPQKARVLLQLALTQTKDPKVIQQYFEDF

SEQ ID NO: 34569 - protein, 472 aa, Dechloromonas aromatica RCB
MHRNRNAKIVATLGPASSDRDTIQKLYLNGADIFRLNFSHGTHEDHKRSLETIRDVEREAGRPIGVLLDLQGPKLRLGKFANGPITLAEGDKFRLDLDCDRPGDQTRAPMPHPEIFKALSVQSSLLIDDGRIRLFVEKCGPDFAETRVVAGGTLSDRKGVNVPGSLIPMSAMTDKDRADLDFGLTLGVDWVALSFVQRAEDILEIKKIIDGRAGVIAKLEKPAAIERLEAIVNVSDAIMVARGDLGVEMPPEQVPAIQKRIIRACRSAGKPVIVATQMLDSMVAAPVPTRAEASDVATAIYDGADAVMLSAESASGKYPVAAVKMMDSIISRTESDPYYRVAIDASQPPARANKADAIGSAVRHVADLLHIAVTVAYTSSGTSALSMARERPKAPIIALTPRLATARRLSLAWGLHAVMCHDVVDVTEMTDLACETARRQHFASRGQSVVISAGMPFGRSGTTNLLRIAELS

SEQ ID NO: 34570 - protein, 155 aa, Physcomitrella patens subsp. patens
MPPQVVHGGAQQVQGQHPLGQWTTGLCDCGDDPTNFCIAFCCTCITFGQIAEVIDQGATSCLLAGAGWLGMLMFTGCPCAISCLWRGKLRAKYNIQDDAFTDFCIHCWCEPCAVAQEFRELKNRGLDPALGWSLLSQQGYGAQPMGIPMQAPMQR

SEQ ID NO: 34571 - protein, 365 aa, Ralstonia eutropha JMP134
MNAAMLPPMLDVLAALAAGQRVVVLEDETDEALGCVLVAAERATEGDVNFMAAEARGLVCMAITEARRQRLQLPPMAANHRQRERYTVSIEAASGVSTGISAADRALTLRVAAARLAQPADLVQPGHIFPVVAQPDGVLRRAGFAEACSDLPSLAGCVASGAYAMLLDDAGDLLRGPALLAFAQRHGLPAVSISGLIHHRLLTEGALRRTRTSELNTPYGRFAVHAYHDVPVDALHLALVLGQPDPAKAVLTRVQTVEMQRDVLGFGTPALPAWNLERSLARIGAEGCGVLVLLDERESPQQRLERLAAPAAATPAPAFAQRALGVGAQILRDVGARKLRLLSHPVPYRTVAGFELEVTEFVPPA

SEQ ID NO: 34572 - protein, 421 aa, Shigella flexneri 2a str. 301
MSNNEFHQRRLSATPRGVGVMCNFFAQSAENATLKDVEGNEYIDFAAGIAVLNTGHRHPDLVAAVEQQLQQFTHTAYQIVPYESYVTLAEKINTLAPVSGQAKTAFFTTGAEAVENAVKIARAHTGRPSVIAFSGGFHGRTYMTMALTGKVAPYKIGFGPFPGSVYHVPYPSDLHGISTQDSLDAIERLFKSDIEAKQVAAIIFEPVQGECGFNVAPKELVAAIRRLCDEHGIVMIADEVQSGFARTGKLFAMDHYADKPDLMTMAKSLAGGMPLSGVVGNANIMDAPAPGGLGGTYAGNPLAVAAAHAVLNIIDKESLCERANQLGQRLKNTLIDAKESVPAIAAVRGLGSMIAAEFNDPQTGEPSAAIAQKIQQRALAQGLLLLTCGAYGNVIRFLYPLTIPDAQFDAAMKILQDALSD

SEQ ID NO: 34573 - protein, 563 aa, Anaplasma marginale str. St. Maries
MSHASYLLDVILLLSAAVVVVVVFGKLRISPVLGYFVAGAAIGPHGLQLVESSAIISSLGEFGVVFLLFLIGIELTFERLAAMRLHVFGFGTMQVIVTATLIWCVARALGVDYESSVVIGGALALSSTAIVLQVLQEKGQQSTQIGRLSVAILLLQDFAVVPLIVLLPLLAGESNSLVMSLMHALLKAVAALALIFISGRLLLRPLFGTIATMKSNEAFIATTLLVVLGAAFVTENFNLSMALGAFVSGLLVAETEYRYDVEQVVLPFKKLLMGLFFMVVGMSIDGGLLISKLPIILALSIALILLKAIVVCALCRFFRFQLAVGVHAGLLLCQGGEFAFILFGLAAEKGVMSHGLAQILMMTTTVTMAFTPLLAALGHWIAGLLTKNKIAFSSQELVLDTRDLDQHVIVVGFGRVGRIVAKVLTAEHVNYIASDIQPVVVTEGRKEGFPVYLGDLTRLETLTSMGIARAKAVIIAINNSVTTKKIISLVANNFRDTIVAVRIPDLTNAEAYRKLGAHYLIPETYETGLQLGGVALSISGFSTDAIASLQDALRAEDYGHIEE

SEQ ID NO: 34574 - protein, 572 aa, Mycoplasma pneumoniae M129
MKKLSGIGVSDGMALAKAFLVKTPEFAVNKYLKHQLTKAQAKRLLDSAFKKAVKDLEEIKEITVNNINTEAGMIFDAHIQMLNDPTITEQLEQQLAQNVHPVIAVDTVFSQTATMFSQMQDKYFQERAADILDLRQRLLAYLTGQKPHDLVKIKSDVIIVAHDLTPSQTATLNKKYVKGFLTEIGGRTSHAAIMARSLEIPAVVGIKGITTKVKDGQIVGVDGRKGIAGLDLNSKDTTEWKKQKALEEKYQQELKQYTNKETVTLDGHAVVVAANIGNVKDMELACQYNTNGVGLFRTEFLYMNSQEWPDEETQYQAYKAVLEQAHGDLVIIRTLDIGGDKKLNYYEFPHEDNPFLGYRALRLTLDKQDIFKTQLRALLRAADHGQLGIMFPMVATLDELLQAKQLLNQVHQELGGNKQFKLGIMIEIPAAVLAANTLSHHVDFFSIGTNDLIQYSFAADRMNKNVSYLYQPLNPALLKLIYLTIEGGKVNDIWTGMCGEMAGEPLAIPLLLGLGLKEFSMSASSMFKARMIIAKLNYTECQTLAQKALTLANAKEVEKLVEKFFKKKDIFI

SEQ ID NO: 34575 - protein, 508 aa, Mycoplasma pneumoniae M129
MHKKVLLAILDGYGISNKQHGNAVYHAKTPALDSLIKDYPCVMLEASGEAVGLPQGQIGNSEVGHLNIGAGRIVYTGLSLINQNIKTGAFHHNQVLLEAIARAKANNAKLHLIGLFSHGGVHSHMDHLYALIKLAAPQVKMVLHLFGDGRDVAPCTMKSDLEAFMVFLKDYHNVIIGTLGGRYYGMDRDQRWDREEIAYNAILGNSKASFTDPVAYVQSAYDQKVTDEFLYPAVNGNVDKEQFALKDHDSVIFFNFRPDRARQMSHMLFQTDYYDYTPKAGRKYNLFFVTMMNYEGIKPSAVVFPPETIPNTFGEVIAHNKLKQLRIAETEKYAHVTFFFDGGVEVDLPNETKCMVPSLKVATYDLAPEMACKGITDQLLNQINQFDLTVLNFANPDMVGHTGNYAACVQGLEALDVQIQRIIDFCKANHITLFLTADHGNAEEMIDSNNNPVTKHTVNKVPFVCTDTNIDLQQDSASLANIAPTILAYLGLKQPAEMTANSLLISKK

SEQ ID NO: 34576 - protein, 306 aa, Oryza sativa Indica Group
MAMATTSVTSLAMAMAAAASADATQAPHKLSALPFHHLLFSRAPPLLRASRRLPLAPLVASSDAAAAAEAGVEWSETEEADEGSQEEEEEEEVVEEQAEAEEEVVASVEEEEEEAVEEEFAAEPPEEAKVYVGNLPYDVDSEGLAQLFEQAGVVEVAEVIYNRETGQSRGFGFVTMSTIEEADKAIEMLNRYDINGRLLNVNRAAPRGSRVERPPRQFAPAFRAYVGNLPWQVDDSRLLQLFSEHGEVVNASVVYDRESGRSRGFGFVSMASKEELDDAISALDGQELDGRPLRVNVAAERPQRGF

SEQ ID NO: 34577 - protein, 531 aa, Acidovorax sp. JS42
MTWQLPYPSGRQPVLARNVVSTSQPLAAQAGAAAFARGGNAIDAALAAAITLTVVEPVMNGIGGDAFALVWDGAALHGLNASGRAPRAWSAERFAHLPQMPRIGWDTVTTPGGVAGWVALSERFGALPFEDLFTDAIRHARDGFPVSPVIARQWAQAAIDLKGQPGFEAFTPGGRAPQAGEIWRFADQADTLADIARTRGASFYRGRLAQAMADYARQHGAGLALEDLAAHAVEWVQPISVPFGDRTVHEIPPNGQGIAALMALGLLEHLPYRSTAAGSAARMHLEIEAMRVAFADLYAHVADPAHMRLTPAQLLDPAYLRQRAALIDPQRAGQYPAGQPGSGGTVYLCTADSEGRMVSFIQSNFKGFGSGVVVPGTGIALHNRGMGFVTTPGHPNQVAGGKRPMHSIIPAFVTRGGQPHMAFGVMGGNMQAQGHVQMVLREAVEGLNPQACSDAPRWRINDAGALTLEHTVPAAVVDGLRALGHDPQVAAPGSLEFGSAQIIRRLEATPGTGFAYAAGSDHRRDGQAVGC

SEQ ID NO: 34578 - protein, 389 aa, Streptococcus equinus
MSTKDVKELAIEQAKKFGGKLEVCPKVPIETKADLGIAYTPGVAAVSSAIYEKKERAYELTTKKNTVAVISDGSAVLGLGNIGPEAAMPVMEGKAALFKRFAGVDSIPLVLDTQDTEEIIQTVKFLAPTFGGINLEDISAPRCFEIEQRLIDELDIPVFHDDQHGTAIVVLAALYNSLKLINKKIEDIHVVINGGGSAGLSITRKFLAAGVKHIIIVDRTGILSETDTALPPHHAEIAKLTNREHRTGDLATALEGADVFVGVSAPGVLKPEWIQQMNEQPVIFAMANPVPEIFPDEALAAGAYIVGTGRSDFPNQINNVLAFPGIFRGALDARAKKITIEMQIAAAKGIAKLIPDNELTPTNIIPDPFQEGVAKVVAESVRNAVKETN

SEQ ID NO: 34579 - protein, 244 aa, Mycoplasma pneumoniae M129
MRTKYLIGNWKTNKDLHQALAFVEQFKQHPAKTKAVLGIAPVHVHLTEVNKVLPNNLLLLAQDANFIASGSYTGTVSYTQLQDIKVNSVIIGHSERRKYFNETAQVINQKLKACLQAGMLVVLCIGETEGQPISFLKEDLTQVLQGIDLSLLKQLVIAYEPIWAIGTGKTATPEIANNTIAQIRVYLSELYNKEIAQQTSILYGGSVAKDNIKELAQTEQIDGFLVGKASLDVNDFLVMAQVYA

SEQ ID NO: 34580 - protein, 382 aa, Oryza sativa Indica Group
MASGQPKSAGLVDVTGQWSQLAGEEDKLVVVAGRLAIIRQRRPMLVQPPNAVAVRATAAGKEPLFSFGVIADVQYADIPDGRSFLGVPRYYRHSLTVLQRAVRSWNAHNHKHPVAGGGVRFCVNFGDIVDGFCPKDRSLAAVQAVVAEFDRFHGPAYHMLGNHCLYNLPRSKLVSLLRMPSGRAYYDFSPFPGYRFVVLDAYDFSAVGWPRGHPVAAAARRFLDERNPNADKNSPSGLAGVDRRFVMFNGAVGEAQLRWLDGVLRGAARRREAAVVCSHLPLHPGAASPSGLMWNYEEVMRVVHRHGCVAACLAGHDHRGGYGVDARGVHHRTLEAALECPPGTDAFGRVDVYPDGLTLVGAGRMGSTDMRLQLHSPVTELS

SEQ ID NO: 34581 - protein, 257 aa, Brassica napus
  misc_feature (230)..(230): Xaa can be any naturally occurring amino acid
  misc_feature (248)..(248): Xaa can be any naturally occurring amino acid
MAAKQGAATSTYSPKIIARTRPPIFKNSDLDWTRPDGRGFHQCRPALLQTGAVSSASGSAYAEFGNTKVIVSVFGPRESKKAITYSDVGRLNCNVSYTTFASPALGSQGTDHKEYSSMLHKALEGVIMMETFPKTTVDVFALVLESGGSDLPVVISCAGLALADAGIMMYDLITAVSVSCIGKSLMIDPVTEEEGCEDGSFMMTCMPSRSEITQLTITGEWTTPNINEAXQLCLDACSKLGEIMRDCXKQAASASDE

SEQ ID NO: 34582 - protein, 364 aa, Anaplasma marginale str. St. Maries
MGLNCGIVGLPNVGKSTLFNALTKTMAAEMANYPFCTIEPNKGMSVVRDARLKTLASIAGSQNVVFSQVEFVDIAGLVKGASSGEGLGNKFLGHIREVDAIMHVLRCFEDGDVSHVHQVVDPIGDAEVVEMELIMADIDSIKRRLPNLEKAVKSGKEDKSRLVVLEEILKTLESGQPARSAIGSVDPEELKQLQLLSSKPVMYVCNVEDTNVVGGNALSALVSKMAEARGSKCCYLSAKLETDVLSIDDEDERRTFLAEIGMEESGIDVAVRNMYALLDLITFFTVGPKEARAWPIKRNTKADKAAGVIHTDFEKGFIKAETTSFQDYVQYGGESGCREAGKIRFEGRDYIVQDGDVIHFRVNK

SEQ ID NO: 34583 - protein, 242 aa, Chlamydomonas reinhardtii
MHRTLVCERAVLDRADGSAKWTQEGSSVLAAVYGPRQAKLQKEDAERAVVEVVFKPRAGLQGHEDRSLELEIRGILEGVIPLGMFPRTSVMVVLQVLQDDGGALSCALNAAAAALVDAGVPLNSMFSSVSCVLTSDRRLVLDPDALEEQAAAARFCFTYPHHFDLTTAVPAAATGATTASPGADDASATAVVGESVLGSRCVGAFSGDELLDAAALCRRGCERVATFARLSLAKSLQAAGGA

SEQ ID NO: 34584 - protein, 196 aa, Anaplasma marginale str. St. Maries
MRVVHYCCRLPSLITAVRAVPFRVGIGYDVHGFADSPPENGHIVLCGVEIAFHRKIKAHSDGDVGTHALVDALLGCVGEGSIGEHFPNTDPRWENMSSTHFLLEAQSKALAKGYAVLNFDLTIVCELPKIIPHVPKMKLFMSKLLGMDASAINIKAVTTEKLGFIGRGEGIAAHAVVLCRKVTAAAPNPGSENPRG

SEQ ID NO: 34585 - protein, 815 aa, Physcomitrella patens subsp. patens
MATPAAAHPGEPSDPKPSSKKDFSTAILERKKAPNRLIVDEAVNDDNSVVALNMETMEKLQLFRGDTVLIKGKKRKDTVCIVLADDTCDEPKIRMNKVVRANLRVRLGDVVSVHQCADVKYGKRIHVLPFDDSIEGVTGNLFDAYLKPYFLEAYRPVRKGDLFLVRGGMRSVEFKVVETDPAEYCIVAPDTEIFCEGEPLRREDEERLDEVGYDDVGGVRKQMAQIRELVELPLRHPQLFKSIGVKPPKGILLFGPPGSGKTLIARAVANETGAFFFLINGPEIMSKLAGESESNLRKAFEEAEKNAPSIIFIDEIDSIAPKREKTQGEVERRIVSQLLTLMDGLKSRAHVIVMGATNRPNSIDPALRRFGRFDREIDIGVPDEVGRLEVVRIHTKNMKLAEDVNLERIAHDTHGFVGADLAALCTEAALQCIREKMDVIDLEDETIDAEVLNSMAVTNEHFQTALGISNPSALRETVVEVPNTTWEDIGGLENVKRELQETVQYPVEHPEKFEKFGMSPSKGVLFYGPPGCGKTLLAKAIANECQANFISVKGPELLTMWFGESEANVRDVFDKARQSAPCVLFFDELDSIANQRGSSQGDAGGAADRVLNQLLTEMDGMNAKKTVFIIGATNRPDIIDSALLRPGRLDQLIYIPLPDEASRLRIFQAALRKSPIAKEVDLQALAKFTQGFSGADITEICQRASKYAIREDIEKDIEREKRRAENPEAMEEDEVEEVAQIKARHFEEAMKFARRSVSDADIRKYQAFAQTLQQSRGFGSEFRFADRPAAATGAPYAAETTPAFGGAADDDDLYN

SEQ ID NO: 34586 - protein, 153 aa, Candida glabrata CBS 138
MKAQLQAISLRIQAVRSSDQMTRSMREATGLLAGMNRSMNLPQLQKISMEFEKQSDLMDQRQEFMDEAIDNVMGDELEENEDADEIVNKVLDEIGIDLNSQLQNTPQHELKLPGEAESQNGVAETVGASGSGGDTKMSPDDDLQARLDSLKRQ

SEQ ID NO: 34587 - protein, 721 aa, Pyrobaculum aerophilum str. IM2
MNMISYALLGVILGISGVIYAVYLAVWVLRQDPGNEKMRFISQAIATGARAYLFRQYRTLAVLLVILAVLILVAIDMPRRTFGLTALAFIVGALGSMLAGYLGMYVTTRSASRVAQAAATGGMGKALLVSWRAGAVMGLSLASIALLLISGFYLVFRSVLPDDWAVPLVALGFGASLVTLFMRVGGGIYTKAADLGADLVGKVEAGIPEDDPRNPGVIADNVGDNVGDVAGMAADVYESYIVTVTAAIFLAAILGLPTQFIEAIILFAALALVATFAGVNLLKTTGVKHPLSSISLAIYATIGLSVVLFFIGAFTLGLDSTKALALAATTSLGAVIAPLIVKITDYYTSYNYGPVRKIAEQAKISPATVIITGYGVGLMSAIPVIAVIVAVLGISYMIGYYTVPVSGFGELSKYLAGIFGTAMASVGLLVVAGIIITADSYGPVSDNAGGVVEMAGLPDEVREITDVLDSVGNTTKATTKGYAIASAALAALVLFIALIFEIVYSASKILGKGIVDMISESLSGLQLINANVLIGAFLGVALVYFFSSRTLEAVGRTAMEIVEEIRRQFREKPGILEWKEQPDYARVVDIATRRALGEFLIPGLAAIVLPLITGLLLGWNALAGLIMGAIVAGVPRALLMANAGGAWDNAKKYIEIQGLKKTEMHKAAVIGDTVGDPMKDTVGPSLNPLIKVLNTLSVVFTYVIVSTNIALGIWPSGLLPF

SEQ ID NO: 34588 - protein, 438 aa, Candida glabrata CBS 138
MGKDHWKLVAVTAAVTITLTKIAEVAWKKYVEQKDAITQQVSVKKMLKREYDDNLFREQLARNYAFLGEDGMEKLKNQYIVVVGAGGVGSWVVTMLIRSGCKKIRVIDFDQVSLSSLNRHSCATLEDVGASKVDCLKAHMEKIAPWCQIEAINSLWNKENGEELLLGGGKPTMVVDCIDNIDTKVDLLEFTYSNKIEVISSMGASTKSDPTRINVGDITITEEDPLARAVRRRLKIKGITTGINVVFSAEKPDPRKAKLLPLPDDEYSKGKVGELSALKDFRVRILPVLGTMPGIFGLTIATWILTKVSGYPMNPIEGKNRIKVYDGIYQSLAGQMTRIGMPDQRVPIALKEVGYIVEEVFRGKSPVSGFSTRLTLSKWDPKKPVSLQNVVVLTKEEQKEHEQRILNGKEALSDVYSQDVIDLVNQRFEEELYYSRYR

SEQ ID NO: 34589 - protein, 516 aa, Bifidobacterium longum DJO10A
MTTTASPVSKQTASAAQETGATGAAATAIETIETGVAGVADAATNAAANAIEDLEAAESRGFSTRFPLNSAFIFTFGALGGMLFGFDTGIISGASPLIESDFGLSVSQTGFITSSVLIGSCAGALSIGALSDRFGRKKLLIVSALLFLLGSGLCASSTGFAMMVCARIILGLAVGAASALTPAYLAELAPKERRGSLSTLFQLMVTFGILLAYASNLGFLNHNLFGIRDWRWMLGSALVPAALLLLGGLLLPESPRYLVNKGDTRNAFKVLTLIRKDVDQTQVQIELDEIKAVAAQDTKGGVRELFRIARPALVAAIGIMLFQQLVGINSVIYFLPQVFIKGFGFPEGDAIWVSVGIGVVNFVSTIVATLIMDRFPRKGMLIFGSIVMTVSLAVLAVMNFVGDVAVLAVPTMILIAFYILGFAVSWGPIAWVLIGEIFPLSVRGIGSSFGSAANWLGNFIVSQFFLVLLDAFGNNVGGPFAIFGVFSALSIPFVLRLVPETKGKSLEEIEKEMTKR

SEQ ID NO: 34590 - protein, 324 aa, Xanthomonas campestris pv. vesicatoria str. 85-10
MGLLVDGKWQDRWYDTSKSEGRFERSQSQFRNWVTRDGSAGPHGQGGFKAASGRYHLYVSLACPWAHRTLIFRRLKGLESMIDVSIVHWLMRENGWTFADGPGVVGDTESHAQYLYEVYLKADPHYSGRVTVPVLWDRERKTVVSNESADIIRMFNSAFDAIGAADGDFYPQPLREQIDAVNARVYDTVNNGVYKAGFATTQAAYDEAVVPLFESLDWLEARLSAQRYLCGDRLTEADWRLFTTLVRFDAVYVGHFKCNLRRIADYPQLSGFLRELYQMPGIADTVNFQHIKGHYYQSHDTINPNGIVPMGPLLDLDAPHGRGG

SEQ ID NO: 34591 - protein, 387 aa, Brucella suis 1330
MTTLSNRSAVEPFHAMDVLAEANRRRAAGHPIISMAVGQPADSAPVVVRQAAERALKDGRIGYTDALGLIELREAIAAHYADHYGVSVSPERIAVTTGSSAAFNLAFIVYFDPGDRVAITRPGYPAYRNILTALGLEVVEIPTGHGTFSSLTAQALAAAHAEKPLKGVLFASPANPTGAVIDKPELTAIIETARNLGIRVISDEIYHRLSYEADDVTALEVADDVTIINSFSKYYCMTGWRIGWMVLPDNDIRAIERLSQSLYISAPELSQRGAIEAFRATAELERIKDRYRRNRLILLNHLPRMGLDLAAPMDGAFYAYCDVSRFTNDSMEFVRGMISEINIAATPGRDFDPLDGHRTVRFSYAGKVEEMEEAVRRLDDWLPQQKA

SEQ ID NO: 34592 - protein, 227 aa, Haemophilus influenzae Rd KW20
MELVFIRHGFSEWNAKNLFTGWRDVNLTERGVEEAKTAGKKLLDKGYEFDIAFTSVLTRAIKTCNIVLEESHQLWIPQVKNWRLNERHYGALQGLDKKATAEQYGDEQVHIWRRSYDISPPDLDPQDPNSAHNDRRYANIPSDVVPNAENLKLTLERALPFWEDQIAPAMLSGKRVLVVAHGNSLRALAKHIIGISDAEIMDFEIPTGQPLVLKLDDKLNYVEHYYL

SEQ ID NO: 34593 - protein, 339 aa, Physcomitrella patens subsp. patens
MDHAADAMRTDLMTITRHVLNEQSRFPEARGDLTILLNNIVLGCKFVCSSVSKAGLAKLIGLAGETNVQGEEQKKLDVLSNHVFINALVSSGRTNVLVSEENEEAIFVESSKRGRYCVVFDPLDGSSNIDCGVSIGTIFGIYMLKEGASGTVEDVLQPGTAMLAAGYCMYGSSCTLVLSTGAGVNGFTLDPSLGEFILTHPNIKIPKKGKIYSVNEGNAKHWDGPTTKYVENAKFPKDGSSPKSLRYIGSMVADVHRTLLYGGIFMYPGDKKSPKGKLRVLYEVFPMSFLVEQAGGQSFTGKQRALELVPAHIHDRSPIFLGSSDDVEEIKALYAAESA

SEQ ID NO: 34594 - protein, 395 aa, Mycoplasma pneumoniae M129
MDLKDNSFAKKRSTVFVVLLIVFCFFLMFSAFADGFNFWSPWSTDFNSRVIHIKSDGNIETTSIVSHELHPDFKAVRFAFGLVIVLFISVIAVLMNWELSNSIFKNYEKLNLSLSLLSGIMVSGGMIPTFFVIYFREWNATVNWIWTASFAGMIVFLWAVYMISTSFIKIRPSLQVIYSLGAVICFIACIGTIYFSVIRGWTTIFLLIAIGVCTDTFAYLFGKRFGKNPLIKISPSKTWEGAFFGVTGTVLTISIICVLYSIPNYVRQPSIKDASKTALQTPQNYDVHNLITNVFLISFISGGSTFYIYWWVSTLALIFTASIFAIGGDLFFSYIKRLTKIKDFSKLLGKHGGILDRFDSSSFLISFFFIYHVIAGISSNQRLLMEPNTYFSAVS

SEQ ID NO: 34595 - protein, 252 aa, Oryza sativa Indica Group
MAAAALTSQLNALVNNMFAMGLLDDQFQQLQMLQDSTAPDFVSEVVTLFCDDGERIICELARQLEKPNVDFDRVDSYVHQLKGSSASVGAQKVKNTCIQFREFCQQRSRDGCLKTLDLVRTEFYDLRNKFQAMLQVKLNYFWIDMHQNSQEHIYNPAFPSSGSRYSTLKVEQLYVDLPLFVGRWLRFDHFVATTYIQHCKLQQQQEEARLQCSCECGPLAAFMVSSYCKTVIFLTNQKFTTNRKKIHTNNIF

SEQ ID NO: 34596 - protein, 564 aa, Alteromonadales bacterium TW-7
MTTNTDPNYLYIHHSGPGLIETPLLNKGSAFSKKERENFNLAGLLPPRFETIEEQVERCYQQYSSFTDNLNKHIYLRAIQDNNETLYYRLVRDHLEEMMPIIYTPTVGDACEKFSDIYRSARGLFISYEDRYQIDDILRNATKGKVKVIVVTDGERILGLGDQGIGGMGIPIGKLSLYTACGGISPAYTLPVMLDVGTNNEKLLNDPMYMGARHKRIAQDEYDEFLDLFIKAVKRRWPNVLLQFEDFAQPNAMPLLKRYREEICSFNDDIQGTASVTVGSLLAACRVKGSTLSQQKVVFVGAGSAGCGIAEQIISQMVFEGITEEQARSQVFMVDRFGLLTNGMEGLRDFQQALAQPTDALNDWTYSGEYASLLDVMHCAKPDILIGVSGQPGLFTEQVIRAMHSTCEQPIIFPLSNPSKQVEAHPEDVIKWTDGKALVATGSPFDPVEYNGETFPIPQCNNSYIFPGIGLGVIAAKATRITDAMLSVSSEMLAESSPRANSGKGSLLPALTEIETLSKRIAFAIAKKAIEEGVALEISDDALWAAIDKNYWLPKYRNYKRCSV

SEQ ID NO: 34597 - protein, 380 aa, Myxococcus xanthus DK 1622
MAHRSMDNGRDETHREADVAPPGSRERAESDLTGWNPARDEEASIRQGRYHRAATMRMAQPRTQVDDEPGEDVYGAPPEDSGPYGRDDRDSHYATGRGPRHDTGEQDVELSRQRADYRPWDRSGYGGEPSRPQPPQGESYRDVRFHGRERGAHGEERHGDARPRYRMDRSASLGPGRDEASTHRWAGTGAPSSTGARRDGASTPIYTAVAGRSETSTSRRDDRARNGRWRHEALLAREVMTRNVRTARPESPLRDIARIMKDESCGVVPIVDERDRLVGIVTDRDLVVRAFTGGRSPEQLRASDVMTDDVEAVTPDDTLHDVIGLMGRRQLRRIPVVERDDGIVGIISLGDIALRADHDEELQQALERISSKRSFWSRLG

SEQ ID NO: 34598 - protein, 454 aa, Sorghum bicolor
IGHVCQVVGAVVDVRFDEGLPPILTALEVLDNNIRLVLEVAQHLGENMVRTIAMDGTEGLVRGQRVLNTGSPITVPVGRATLGRIINVIGEPIDERGDITTNHFLPIHREAPAFVEQATEQQILVTGIKVVDLLAPYQRGGKIGLFGGAGVGKTVLIMELINNVAKAHGGFSVFAGVGERTREGNDLYREMIESGVIKLGDKQSESKCALVYGQMNEPPGARARVGLTGLTVAEHFRDAEGQDVLLFIDNIFRFTQANSEVSALLGRIPSAVGYQPTLATDLGGLQERITTTKKGSITSVQAIYVPADDLTDPAPATTFAHLDATTVLSRQISELGIYPAVDPLDSTSRMLSPHVLGEDHYNTARGVQKVLQNYKNLQDIIAILGMDELSEDDKLTVARARKIQRFLSQPFHVAEVFTGAPGKYVELKESVKSFQGVLDGKYDDLPEQSFYMVG

SEQ ID NO: 34599 - protein, 592 aa, Alteromonadales bacterium TW-7
MHFKLNSLFAIGLGVLSLPVLSKEPTKVEVREPEATTSISSKQIVVGDKYMVAAANPYASQAGQQILAKGGNAVDAAIATQLVLTLVEPQSSGIGGGTFMMYYNKANNKLTSFDGRETAPKNANENLFLNKHGKAVKWIEAVVGGRSVGVPGVLHAFANAHKHYGLLPWEQLFKPAIELAEQGFVVSPRLHGLLARQLNPGVMSMPVINEYFYPNGKLIEAGTVKKNQPLADLYKAIANEGIDAFYKGENAKKMVSAVQNSKIAPGKLSQQDLAQYKSKERDAVCIKYRVYNVCSMAPPSSGGVAVLQILGLLELTNISALKPNSEQAIHYFSQASRIAFADRNVYMGDPDFTEVPTQALLNKSYIKSRATLITEKDQHAVAGDPVNYLSYAQDDSYELPSTSHVSIVDSFGNAVSMTSSIEMAFGSTVMVNGYILNNQLTDFSLSPRKNGKLVANRVEPGKRPRSSMSPVMVFNEDGSLRLVVGSPGGSRIIDYVAQVVVGVLDWNLSVQEAINLPRTTNRNDYTSLEKGTVIESLAPALTSRGHKVRVLDLNSGLHGVEVKNNKLYGAADPRREGVALSDLTNNNATFKF

SEQ ID NO: 34600 - protein, 555 aa, Bacteroides fragilis YCH46
MGLFIKKPFEALLAEANASGSKSLKRVLGPWSLVALGVGVIIGAGLFSITGTVAAGYTGPAITLSFAIAALGCCFAGLCYAEFASMIPVAGSAYTYSYATMGELIAWIIGWDLVLEYTVAATTVSISWSRYLVVFLEGLDIHLPQALTACPWDGGIVNIPAFLIVVLMSIFLIRGTEGSSIFNGIVVFLKVSVIAIFVVLGWKYINADNYTPYIPANTGTLGEYGLSGVLRGAAIVFFAFLGFDAVSTAAQETKNPKRNMPIGILVSLLVCTVLYMLFAHVMTGVAHYTEFSGQQGIAPVAIAIEHMGHADATGIIHPDYPWLNRAIVLAILFGYCSVIMVTLLGQSRVFLSMSHDGLLPPFFSHINEKFRTPARSNLLFMLIVGLLAAFVPARLAGEMTSIGTLMAFTLVCAAVLVVRKTMPNVPRSFKTPFVPLVPILGILTCLCMMLFLPADTWIRLVLWMLIGLDIYVGYGMKHSKLEHGVKNRRGQSALNMIGIALSLLCVITGLWHQQTVGWNESKVLLIISFVFAFTHCAYYMMRIWKGTTKQTNDNG

SEQ ID NO: 34601 - protein, 454 aa, Sorghum bicolor
IGQVCQVIGAVVDVRFDEGLPPILTALEVLDNNIRLVLEVAQHLGENMVRTIAMDGTEGLVRGQRVLNTGSPITVPVGRATLGRIINVIGEPIDERGDITTNHFLPIHREAPAFVEQATEQQILVTGIKVVDLLAPYQRGGKIGLFGGAGVGKTVLIMELINNVAKAHGGFSVFAGVGERTREGNDLYREMIESGVIKLGDKQSESKCALVYGQMNEPPGARARVGLTGLTVAEHFRDAEGQDVLLFIDNIFRFTQANSEVSALLGRIPSAVGYQPTLATDLGGLQERITTTKKGSITSVQAIYVPADDLTDPAPATTYAHLDATTVLSRQISERGIYPAVDPLDSTSRMLSPHVLGEDHYNTARGVQKVLQKYKNLQDIIAILGMDELSEDDKLTVARARKIQRFLSQPFHVAEVFTGAPGKYVELKESVKSFQGVLDGKYDDLPAQSFYMVG

SEQ ID NO: 34602 - protein, 936 aa, Myxococcus xanthus DK 1622
MSSILVINAAGRETRVALVEGGHIAEFYLERKKDKGVVGNIYKGRVVRVLPGMQAAFVDIGLEKAAFLYVSDVVYDPDFARAQFELTEGEHEDAPDVPDESEAEAAEAAARHAPPRHLEPEPEDAHFEPVAAPTESLPRDTALELAANAPTVTPPGAETPVAPAEEAPAAGSELVVAAEVAVQPVTPEQIVAVEPSTAAPVEAAPAPAGGEAEAAPSSEPQMAEAAVEPDANVESPEAALAVAAASEPDAAGVAVPAESAMEAAEGEATGLPVEPPPPSAAALGDIIPSPAEEGAQAAKPSEVSGERRTPREAREAREPRNREKERGEKDKGRRPQEEKRRGDKHEDKEKAKPRRTDKIEDLLKVGQEVVVQISKDPIGTKGARLTSHISIPGRHLVFMPTVDHVGISRRISNEKERRRLRDIVDRLRPPGTGFIVRTVAENVPQEKLESDIRFLIEVWNQVVRKNEKRGGPGLLHPDLDLILRATRDLFAHDVEKLVVDDREEYERILGFVTAQDPALRDRVALHEGDDTVFDAYGIEQELQRATQRKVWLKSGGYLIIDQAEALTAIDVNSGRYVGKKSLEETITKINVEAAKEIVYQLRLRNIGGIIICDFIDMEKAQNRDKVFKALQEALGRDKAKTNVLRISELGLVEMTRKRVRESIGRMLHEDCPYCDGNGFVKTATTVAYEIFREIRREAPGYKDSTLVINCNAEVARLLQGEERNELRHLMDRYNKSIQVKAQQNYHREQYDIYGRSASGPEHKVASSPGSGDGELAMQQRKPDSNGGGYGRQEQGRRGGGGGGGGGRDRGGERGNERSERGERGGDRREGRREGRSGGDRPRGDRGGERGDRSERGGERGERGGERGERSERGGERSERGERSERGERGDRRGDRGERGERGGSQNTSGGGENAGGSTPPPPPASGGGSEPSGGTT

SEQ ID NO: 34603 - protein, 305 aa, Burkholderia xenovorans LB400
MSNPGVNSEFPLFVSAGDILTDLVRTGPSQWLSRPGGAGWNVARCVARLGLPTACAGSLGVDNFSDELWNASVAAGLDMRFMQRVERPPLLAIVHQTHPPAYFFMGENGADLAFDPARLPAGWASHVKWAHFGCISLVRQPLGNTLAALAAQLRSQGVKISFDPNYRNLMEHGYEPTLRKMAALADLIKVSDEDLRLLFKTDDEASALAQLRAMNPAATVLVTRGPETAVLIDGAVVTEARPPRVEVVDTVGAGDASIGGLLFSLMTAPQRAWPEHLAFALAAGAAACRHAGAHAPSLDEVVALL

SEQ ID NO: 34604 - protein, 433 aa, Burkholderia cepacia
MSLNDDATFWRNARHHLVRYGGTFEPMIIERAKGSFVYDADGRAILDFTSGQMSAVLGHCHPEIVSVIGEYAGKLDHLFSEMLSRPVVDLATRLANITPPGLDRALLLSTGAESNEAAIRMAKLVTGKYEIVGFAQSWHGMTGAAASATYSAGRKGVGPAAVGSFAIPAPFTYRPRFERNGAYDYLAELDYAFDLIDRQSSGNLAAFIAEPILSSGGIIELPDGYMAALKRKCEARGMLLILDEAQTGVGRTGTMFACQRDGVTPDILTLSKTLGAGLPLAAIVTSAAIEERAHELGYLFYTTHVSDPLPAAVGLRVLDVVQRDGLVARANVMGDRLRRGLLDLMERFDCIGDVRGRGLLLGVEIVKDRRTKEPADGLGAKITRECMNLGLSMNIVQLPGMGGVFRIAPPLTVSEDEIDLGLSLLGQAIERAL

SEQ ID NO: 34605 - protein, 161 aa, Leptospira interrogans serovar Lai str. 56601
MYRIGNGIDFHKLEINLNRPLILGGIECESEFALVGHSDADIILHAISDAILGALALGDIGQYFPDTDPSLKNIDSKIILVKCLELMKEKNFDLVNIDCTVIGERPKITPLKDRITKSLSNLLNLPLDCISVKATTTEKMGALGRQEGIGTFCSILLEKRS

SEQ ID NO: 34606 - protein, 324 aa, Thermoanaerobacter tengcongensis
  misc_feature (1)..(1): Xaa can be any naturally occurring amino acid
  misc_feature (21)..(21): Xaa can be any naturally occurring amino acid
  misc_feature (53)..(53): Xaa can be any naturally occurring amino acid
  misc_feature (75)..(75): Xaa can be any naturally occurring amino acid
  misc_feature (98)..(98): Xaa can be any naturally occurring amino acid
  misc_feature (102)..(102): Xaa can be any naturally occurring amino acid
  misc_feature (140)..(140): Xaa can be any naturally occurring amino acid
  misc_feature (143)..(143): Xaa can be any naturally occurring amino acid
  misc_feature (180)..(180): Xaa can be any naturally occurring amino acid
  misc_feature (217)..(217): Xaa can be any naturally occurring amino acid
  misc_feature (238)..(238): Xaa can be any naturally occurring amino acid
  misc_feature (252)..(252): Xaa can be any naturally occurring amino acid
  misc_feature (256)..(256): Xaa can be any naturally occurring amino acid
  misc_feature (276)..(276): Xaa can be any naturally occurring amino acid
  misc_feature (306)..(306): Xaa can be any naturally occurring amino acid
  misc_feature (315)..(316): Xaa can be any naturally occurring amino acid
XEGLKQLKDLPAETPDGKKVXLAANIGTPKDVASALANGAEGVGLFRTEFLYXDRNSLPSEEEQFEAYKEVVEKXGGRPVTIRTLDIGGDKELPYLDXPKEXNPFLGYRAIRLCLDRPDIFKTQLRAILRASAYGNVQIXYPXISSVEEVRKANSILEEVKAELDREGVKYDKEIKVGIXVEIPSAAVTADILAKEVDFFSIGTNDLTQYTLAVDRXNEHVKEYYQPFHPAILRLVKXVIDAAHKEGKFAAXCGEXAGDPLAAVILLGLGLDEFSXSATSIPEIKNIIRNVEYEKAKEIAEKALNXSEAREIEKXXKDVIKDIG

SEQ ID NO: 34607 - protein, 154 aa, Bacillus sp. SG-1
MFKNFKAEWFGNVRGDILSGIVVALALIPEAIAFSIIAGVDPMVGLYASFCIAVVIAFVGGRPAMISAATGAMALLMVTLVADHGLQYLFAATILTGVLQILFGVFKLGRFMKFIPRSVMIGFVNALAILIFMAQVPHFLGEGMLVYALIAGAL

SEQ ID NO: 34608 - protein, 311 aa, Nicotiana sylvestris
MAKIVSLLATLVVALLSLSFPLECKANYYYSSPPPPTKKYVYSSPPPPVYKYKSPPPPLPIYRSPPPPVYKYKSPPPPVYKYKSPPPPPPVYKSPPPPVYKYKSPPPPVYKYKSPPPPPPVYKSPPPPVYKYKSPPPPVYKYKSPPPPPPVYKSPPPPVYKYKSPPPPPPVHKSPPPPIYKYKSPPPPVYKYKSPPPPPPMYKSPPPPVYKHKSPPPPPPVYKYKSPPPPVYKYKSPPPPPPVYKSPPPPIYKYKSPPPPPPVYKSPPPPVYKYKSPPPPPPVYKSPPPPVYKSPPPPYHYYYTSPPPPHY

SEQ ID NO: 34609 - protein, 215 aa, Dechloromonas aromatica RCB
MPNCIRHEIAGVQRSSGVWNSRCANFRPAKRSIGPTGIGVVYGKKALLEQMPPWQGGGNMIADVTFEKTLFQPAPNKFEAGTGNIADAVGLGAALDYVDRIGIENIARYEHDLLVYATRGLSLIPGVRLIGTAADKASVASFVLAGYTTEEVGRALNEEGIAVRSGHHCAQPILRRFGVEATVRPSLAFYNTCEEIDRMLAVVRRLARGKGKVAA

SEQ ID NO: 34610 - protein, 324 aa, Dechloromonas aromatica RCB
MSKWFADNSQSIGRTPLIKLNRVIDGAKATVLAKIEGRNPAYSVKCRIGAALINDAEKRGLLGPGKELVEPTSGNTGIALAFVAAAKGIPLTLTMPETMSIERRKLLTAFGAKLVLTEGAKGMSGAIAKAEEIAASDAKYVLLQQFKNPANPAIHELTTGPEIWDDTDGAIDILVSGVGTGGTITGVSRYIKNTKGKAIQSVAVEPTASPVLTQARAGEPIKPGPHKIQGIGAGFVPAVLDLSLLDAVEQVSNEDAVLYARRLAKEEGIISGISSGAAVAAAARLARIPENAGKTIVAILPDSGERYLSSILFEGLFNEAGLAA

SEQ ID NO: 34611 - protein, 264 aa, Mesorhizobium huakuii
PIGILADLQGPKLRVGKFANGKEVLTPGQTFTLDDNPEPGTSTRVYLPHPEILSSVEPGHRLLIDDGKLELKAVKSDGKSIVCTVVAGTTISDKKGVSLPDTDLPVGALTEKDRKDLDAVLATGVDWIALSFVQRPEDLAEARKIARGRALIMAKIEKPQAVARLAEIIELSDALMVARGDLGVEMPLEAVPGIQKQITRAARRAGKPVVVATQMLESMITAPVPTRAEVSDVSIAVFEGADAIMLSAESAAGAYPVEAVAMMN

SEQ ID NO: 34612 - protein, 224 aa, Pseudomonas putida GB-1
MTQDQLKQAVAQAAVDFILPKLDEKSVVGVGTGSTANFFIDALAQHKTAFDGAVASSEATAQRLKGHGIPVYELNSVSELEFYVDGADESDAHLNLIKGGGAALTREKIVAAVAKTFICIADGSKLVPVLGAFPLPVEVIPMARSHVARQLVKLGGDPVYREGVVTDNGNVILDVHNLQITNPVELEAQINAIVGVVTNGLFAARPADLLLLGTSEGVKSLKAE

SEQ ID NO: 34613 - protein, 291 aa, Oryza sativa Indica Group
MGSNEQIHRDKLIIDTDPGIENTSEFQPSRKLLLANSFPYKLVPDDSMTILMAFRAPTVEIIGLTTIFGNTTTKNATQNALLLCERAGHPEVPVAEGSAEPLKGGEPRVADFVHGSDGLGNLFLPAPTSKKVDENAAEFMVNKAIKRDPSFASKVKKIVVLGGAFFAAGNVSPAAEANIYGDPEAADIVFTSGADVDVVGINITTQVCFTGIFLHDPVSFTALVHPEYFTFKKGVVRVETQGICTGHTLMDQGLKKWNSENPWSGYKPISVAWTVDVPNVLAFVKELLMAP

SEQ ID NO: 34614 - protein, 264 aa, Mesorhizobium loti
PIGILADLQGPKLRVGKFANGKEVLTPGQTFTLDDNPEPGTSTRVYLPHPEILSSVEAGHRLLIDDGKLELKAVKSDGRSITCTVVAGTTISDKKGVSLPDTDLPVGALTEKDRKDLDAVLATGVDWIALSFVQRPEDLAEARKIARGRALIMAKIEKPQAVARLAEIIELSDALMVARGDLGVEMPLEAVPGIQKQITRAARRAGKPVVVATQMLESMITAPVPTRAEVSDVSIAVFEGADAIMLSAESAAGAYPVEAVAMMN

SEQ ID NO: 34615 - protein, 504 aa, Pseudomonas putida GB-1
MLEQYVKKILTSRVYDVAVETPLQSAGQLSKRLGNQILLKREDLQPVFSFKIRGAYNKLAQLSPEELARGVVTASAGNHAQGLALAAREMGIKATIVMPKTTPEIKVEGVRSRGGKVVLHGDSFPEALAYSLKLVDEKGFVYVHPYDDPHTIAGQGTVAMEILRQHPGQLDAIFVPVGGGGLIAGIAAYVKYLRPEIKVIGVEPDDSNCLQAAMAAGERVVLPQVGLFADGVAVAQIGQHTFDICRHHVDEVVTVSTDEICAAIKDIYDDTRSITEPAGALGVAGIKKYVELYGVTGQTLVAIDSGANVNFDRLRHVAERAELGEKREAIIAVTIPERPGSFKAFCEAIGKRQITEFNYRKHTSDEAHIFVGVQTHPENDPRAALVQQLTEQGFPVTDLTDNELAKLHIRHMVGGHSAGASDEMVLRFEFPERPGALFNFLNKLGGRWNISMFHYRNHGAADGRVVAGLQVPEDERHLVPAALAKIGYPYWDETENPAYKLFLG

SEQ ID NO: 34616 - protein, 626 aa, Vitis vinifera
MQAKPFHAVPVKFPSPTKLPLLQKPPAMPEKVLSRAISISTPDTRVSDVSTPNLDDSMAAFWDYQFLFMSQRSETDGSIALRVVDGAIPVDFPSGTYFLAGPGLFSDDHGSTVHPLDGHGYLRAFAINGPGKEVKFSARYVKTEAQLEEHDPMTRGWRFTYRGPFSVLKGGKKVGNRKVMKNVANTSVLKWGGRLMCLWEGGDPYEIESGTLDTIGRLDMMEGCDSLHEGGSPGSDAWDLAAAALKPILHGVFKMPEKRPLSHYKIDAKRNRLLMMWCNAEDINFTIYGKLILYLIKAMYGMVRIHYDAEFDSKMKVVQRKEFKIPDHLMIHDWAFTDSHYVLFSNRIKLDILGSMGALSGLSPMISALSANPSKPTSPIYLLPRFSDDVTGNRDWRVPIEVPSQLWLIHVGNAYEERDERGNFNIQIHASACSYQWFNFHKMFGYDWQSRKLDPCVMNVQQGQEESLPHLIQVSINLDANGTSKNCSVEPLNQWNKPSDFPSINPSSSGIKNTYMYAAAASGSRSTLPHFPFDTIVKVNVPNKSTHRWSTGTRRFIGEPIFVPKGIEEDDGYLLVVEYAVSIQRCYLVILDAKRIGEIDALVARLEVPKHLTFPIGFHGFWAPKE

SEQ ID NO: 34617 - protein, 280 aa, Triticum aestivum
MDQYEKVEKIGEGTYGVVYKAKDRYTNETIALKKIRLEQEDEGVPSTAIREISLLKEMQHRNIVRLQDVVHNEKCIYLVFEYLDLDLKKHMDSSADFKNHHIVKSFLYQILHGIAYCHSHRVLHRDLKPQNLLIDRRTNSLKLADFGLARAFGIPVRTFTHEVVTLWYRAPEILLGARQYSTPVDVWSVGCIFAEMVNQKPLFPGDSEIDELFKIFRIMGTPNEETWPGVSSLPDYKSAFPKWPSVDLATVVPTLEPLGLDLLSKMLCLDPTRRINARTA

SEQ ID NO: 34618 - protein, 759 aa, Pseudomonas putida GB-1
MLNTLRKIVQEVNSAKDLKSALGIIVLRVKEAMGSQVCSVYLLDPETNRFVLMATEGLNKRSIGKVSMAPNEGLVGLVGTREEPLNLENAADHPRYRYFAETGEEKFASFLGAPIIHHRRVVGVLVIQQKERRQFDEGEEAFLVTMSAQLAGVIAHAEATGSIRGLGRQGKGIQEARFVGVPGSPGAAVGRAVVMLPPADLEVVPDKTVDDIDAELKLFQNALEGVRDDMRKLSAKLATQLRPEERALFDVYLMMLEDAALGGEVTEVIKTGQWAQGALRQVVGEHVNRFELMDDDYLRERASDVKDLGRRLLAYLQEARSQSLVYADNTILVSEELTPAMLGEVPEGKLVGLVSVLGSGNSHVAILARAMGIPTVMGLVDLPYSKVDGIELIVDGYKGEVFTNPSEVLRKQYSEVVEEERQLAQGLDALRELPCVTPDGHRMPLWVNTGLLADVARAQQRGAEGVGLYRTEVPFMINQRFPSEKEQLAIYREQLAAFHPLPVTMRTLDIGGDKALSYFPIKEENPFLGWRGIRVTLDHPEIFLVQTRAMLKASEGLNNLRILLPMISGIHELEEALHLIHRAWGEVRDEGTDVPMPPVGVMVEIPAAVYQTKELARQVDFLSVGSNDLTQYLLAVDRNNPRVADLYDYLHPAVLQALNTVVRDAHGEGKPVSICGEMAGDPAAAILLMAMGFDSLSMNATNLPKVKWMLRQVNMSKATELLAEALSHDNPQVIHSSLQLALKNLGLARMIGPGANKTL

SEQ ID NO: 34619 - protein, 379 aa, Triticum aestivum
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGARMAGASRIIGVDLNPAKYEQAKKFGCTDFVNPKDHSKPVQEVLVEMTNGGVDRAVECTGHIDAMIAAFECVHDGWGVAVLVGVPHKEAVFKTYPMNFLNERTLKGTFFGNYKPRTDLPEVVEMYMRKELELEKFITHSVPFSQINTAFDLMLKGEGLRCIMRMDQ

SEQ ID NO: 34620 - protein, 412 aa, Streptococcus pneumoniae R6
MKIAVAGTGYVGLSIAVLLSQQHQVMAVDIIPEKVELINQRKSPIQDDYIEKYLAKKDLNLVATLDAKEAYQDADFVVIAAPTNYDPKKNFFDTSAVESVIETALKYNPDAIMVIKSTVPVGYTESARKKFQTENILFSPEFLRESKALYDNLYPSRIILGTDKNNERLVSAAETFARLLQEGALKENIDTLYMGFTEAEAVKLFANTYLALRVSYFNELDTYSEMKGLDTQAIIDGVGLDPRIGSHYNNPSFGYGGYCLPKDTKQLLANYEDIPEELIGAIVRSNSTRKDFIADQVLKMVDYYDYSAHNIFDERVEKDIIIGIYRLTMKSNSDNFRQSSIQGIMKRIKAKGVRVVIYEPTLESGSTFFGSSVINDLEEFKRLSNAIVANRYDNSLEDVKEKVYTRDIFERD

SEQ ID NO: 34621 - protein, 466 aa, Chromobacterium violaceum ATCC 12472
MSGSLLERQRGWLAACGAAAEAASLWQPCGRLVRVTGMVMEAVGIKLPVGSACRVMLADAHSVEAEVVGFSGDKVFLMPLTNVHGLLPGTPVLPLPSFNPPRYGSEPGAAQAASNGAAGRQVPVGASLLGRVLDSLGRPLDGLGPIHPDAWFPLYSQPMNPLHRTPVHDVLDVGVRAINGLLTVGRGQRLGLFAGSGVGKSVLLGMMARFTKADVVVVGLIGERGREVKDFIENILGEEGRARSVVVAAPADMPPLMRLHGAAYATALAEYFRSQGLDVLLLMDSVTRFAMAQREIALAIGEPPVTRGYPPSVFARLPQLIERAGNGEEGGGSITGFYTVLSEGDDQQDPIADSARAILDGHFVLSRDLAEAGHYPAIDIEQSISRVMVDVVPQQQMDLARHFKQLYSRYQRNRDLISVGAYVSGSDPVLDDAMRRQLPMVSFLTQPMHESHDYASCCEQLAGVMA

SEQ ID NO: 34622 - protein, 1753 aa, Arabidopsis thaliana
MAKQPLRNKLQYWLKWDGTPNPNVALDELVKIKELVDKGQLVTIPISYKLETSDVRLLKQEFGTNFKVLADENRIAVRFRRRRELLAMLRSRRSRSRHGAQACAVMSAVLLLASVSLLYTRLSLFSSHSPNHLRSGSSEDTVLFPDSVLVSDSDVETTGGGGRGSTTSTEDRIDEHDDAIEDDGVSNEEDENQDAEQEQEVDLNRNKAASSSGFYFDHVNGVIRRAFNKRSIDEWDYDYTGFSIDSDSSGDKSSRAAFGSDDVPLDESIRRKIVEVTSVEDALLLKSGKKVSPLRQGWGDWFDKKGDFLRRDRMFKSNIETLNPLNNPMLQDPDSVGNTGLTRGDKVVQKWRLNQIKRNPFMAKKPLSVVSEKKEPNEFRLLSSVGEIKRGERKTLDNDEKIEREEQKNVESERKHDEVTEHMYADGTKWGYYPGIEPSLSFSDFMDSFFRKEKCSMRVFMVWNSPGWMFSVRHQRGLESLLSQHRDACVVVFSETVELDFFRNSFVKDSYKVAVAMPNLDELLQDTPTHVFASVWFDWRKTKFYPTHYSELVRLAALYKYGGVYLDSDVIVLGSLSSLRNTIGMEDQVAGESLNGAVMSFEKKSPFLLECLNEYYLTYDDKCLRCNGADLLTRVAKRFLNGKNRRMNQQELNIRPSSVFFPINSQQITNYFAYPAIEDERSQQDESFKKILNESLTFHFWNSVTSSLIPEPESLVAKLISSDHESSDLSLPSSPSSSPSQCLVKSVCSLVCTSYLRQNHVVSSPHRVNLDFDANSLTHEQAITVVASLASESGSMVALCFFYWAVGFEKFRHFMRLYLVTADSLLANGNLQKAHEVMRCMLRNFSEIGRLNEAVGMVMDMQNQGLTPSSITMNCVLEIAVELGLIEYAENVFDEMSVRGVVPDSSSYKLMVIGCFRDGKIQEADRWLTGMIQRGFIPDNATCTLILTALCENGLVNRAIWYFRKMIDLGFKPNLINFTSLIDGLCKKGSIKQAFEMLEEMVRNGWKPNVYTHTALIDGLCKRGWTEKAFRLFLKLVRSDTYKPNVHTYTSMIGGYCKEDKLNRAEMLFSRMKEQGLFPNVNTYTTLINGHCKAGSFGRAYELMNLMGDEGFMPNIYTYNAAIDSLCKKSRAPEAYELLNKAFSCGLEADGVTYTILIQEQCKQNDINQALAFFCRMNKTGFEADMRLNNILIAAFCRQKKMKESERLFQLVVSLGLIPTKETYTSMISCYCKEGDIDLALKYFHNMKRHGCVPDSFTYGSLISGLCKKSMVDEACKLYEAMIDRGLSPPEVTRVTLAYEYCKRNDSANAMILLEPLDKKLWIRTVRTLVRKLCSEKKVGVAALFFQKLLEKDSSADRVTLAAFTTACSESGKNNLVTDLTERISRGQIHIVVDQETVECSRVEAMTWYAFAAFFVACSVDSKDWRVGFRLLSPSEGSWLMSYSTIISNTSFLSLASKFTTRGSRLQCTVSMARSAVDETSDSGAFQRTASTFRNFVSKDSNSQFPAESGRYHLYISYACPWASRCLSYLKIKGLDDAISFSSVKPIWGRTKETDEHMGWVFPGSDTEVPGADPDHLNGAKSVRELYEIASPNYTGKYTVPVLWDKKLKTVVNNESAEIIRMFNTEFNHIAGNPDLDLYPSHLQAKIDETNEWIYNGINNGVYRCGFAKKQGPYEEAVEQVYEALDRCEEILGKHRYICGNTLTETDIRLFVTLIRFDEVSLCSPLQMQQETHKGVSEFVQLHERHFPDPRYE

SEQ ID NO: 34623 - protein, 510 aa, Paracoccidioides brasiliensis
MVSAGVALGVSLLLSSSLLASSQSLSSCHTHGSTLFCVGPDGTEVPVSTSMTSMTPQTSQSNITTTTGAPQTTAITSCHTHGPKTFCVEGNGDEVEVSALGTPTSPVPSQYTNCHTHGPDRFCVGASGDEVKVLMPSQTSGAGQHGGHGQGMQQSCHFHGGVEHCNGDADSSAPVSCERRDRNYNVPLRIGSLFAILATSGIAVFGPILWARFFNSSLNGVVFTIIKQFGTGIMVATAFVHLLTHAQLLFQNRCLRGSLRSTTAAIVMAGIFLSFLVEYIGNRIILARTPDSKPHAHGDAELEPNSEVQSKIPQAKSPNGSDSEPPSTTLTNPFGQPPAYPCSQNQMTNLKKRRLMVKWRPASSFFHSIIIGLTLVLAGGSGYISLFIVIIFHQMFEGLALGARIANLKTTVTASKLTMALMFALITPVGMAIGLGVLHRFNGNDRSTIIAIGTLDALSAGILAWVALIDMWSHDWLYGDLRNSGFVKSAVGFFGLIAGMVLMGLLGKWA

SEQ ID NO: 34624 - protein, 333 aa, Methanocaldococcus jannaschii DSM 2661
MHKICVIEGDGIGKEVVPATIQVLEATGLPFEFVYAEAGDEVYKRTGKALPEETIETALDCDAVLFGAAGETAADVIVKLRHILDTYANIRPVKAYKGVKCLRPDIDYVIVRENTEGLYKGIEAEIDEGITIATRVITEKACERIFRFAFNLARERKKMGKEGKVTCAHKANVLKLTDGLFKKIFYKVAEEYDDIKAEDYYIDAMNMYIITKPQVFDVVVTSNLFGDILSDGAAGTVGGLGLAPSANIGDEHGLFEPVHGSAPDIAGKKIANPTATILSAVLMLRYLGEYEAADKVEKALEEVLALGLTTPDLGGNLNTFEMAEEVAKRVREE

SEQ ID NO: 34625 - protein, 398 aa, Methanocaldococcus jannaschii DSM 2661
MSQENWIDLEKKYHLQIYGRLPVVLVEGKGMEVYDIDGKKYLDFLAGIGVNNVGHCHPKVVEAIKKQAETLIHTSNIYYTIPQIKLAKKLVELSGLDRAFFCNSGAEANEGAIKFARKYVSKVLGREGGEIISMYNAFHGRTLTTLAATPKPKYQDGFYPLPPGFKYVPFNDIEALKEAITDKTAAIMIEPVQGEGGIHVADKDYLKAVRDLCDDKNIVLIFDEVQCGMGRTGRMFAFEHYGVEPDILTLAKALGGGVPIGAVVLKEEIAKALSYGDHGTTFGGNPLACSAALASVEVIEELIKDDKVIEKGKYFIRKLENLIEKYNFIKEVRGLGLMIGAELEFNGADIVKKMLEKGFLINCTSDTVLRFLPPLIVEKEHIDALINALDEVFTEIKK

SEQ ID NO: 34626 - protein, 972 aa, Ustilago maydis 521
MDWDHNVTFSAVRSLQATTAVAQATDNVVDLDRNRVDSRPGVLPTKNESSPHSSASLPPPSPHPPPPPAFTPSPSPSPSPSPQTATARSSVTDAAPAPKRSPRSPLHSNGSFPPVSDPISSIDSRDALDIDHESTAMLASSSSARKSKPKLQPQLINHLPLAQQAAMATFHEITFNDYHDKKLGRPPGKFDDYMICDCTPNSGNLDMACTDYSGCINRMTQIECSASKCRWGKQCRNQRFHRRQYVDVDIVQTEKKGFGLRACQDIPKETFIYEYVGEVMNQTTFLQRMQQYRIEGIRHFYFMMLQPNEYLDATKKGGKGRFINHSCNPNCAVSKWQVGKHLRMGIFAKRNIQKGEELTFNYNVDRYGNDAQECFCGEPNCVGTLGGKTQTDLSGMDDLFLDALGISDEVEQTEAKGSRRKRGKRLDLDFIPQMRAIQEHEATRVMTAARQAGPKREILEKLLRRMEMTTDVNVQKSLVKLHGFILMQFLLEQWWNDRDIVILIINVLARWPLIARNKVIDCGVEDQVRILAQTYRPRSPEDQKPSLDALRQVKQDDSAADRNDYTQVQPTLAPVRIGAPPAPDAEVSARAEHLLEAWKKLDMTYRIARKDALKPDADDHKDATAVTTWIDRRRMQDLDDPLDLEHAQAPNAVSSELGNALSGDQELREIKPSWQPPPAPPSMPNAPAKRMGGAVHHRSPPGSFTPTRLQSSGQSPLTPDQVTSVLSSSLVKSLSGLVSSLKQQGIQLQQQQQQQPPAQQQPSAQPAAPSAKSIEDIIREANEQEERARKEAEAAAKAARELEVNGGQTSGSSRKRPSSASRHSDKRAKHSSLSSSSQAASKLISSNGSAADSTSKAGSVESVAANERRLRKLVGELVVRQMSKYKDDLERESFKRHAKELTNAIVGKEMRNPKSWPPARGALTELSLDKRAKIKAFAKEYIDKLLARKGKGKGSSTPSNNEGAGSSNNGIV

SEQ ID NO: 34627 - protein, 431 aa, Picea sitchensis
MDSVRIADGFVSRIIKFFFRSTLLLGVAFVFVLSILIVLFTTGGIAPYILPINGSLLVYFLAWKLARRWKRLRKKRSVPEKIESDNKFSGEYLKNLTGLPAIFTYETIEIATGGFSKEIGKGGFGTVYEGILEDDTLVAVKCLVNESRQGQAEFCAEIGTTSSINHSNLVRLHGICVEGQHRILVYEFMANGSLDRWLFDSDKWLDWKTRYSIALDTARGLAYLHEESRLCILHLDVKPQNILVDEYFKAKVSDFGMARCLKRDIESHLVTGVRGTPGYMAPEWLLGAGITSKSDVFSYGMVLLEIISGRRNVDNTRDSDNWYFPSIAINKARQDKMEEIIETGLEMKRPEDLEEAYRLIKTALWCVQSNSGLRPSMGTVVRILEGDLEILDPPSEWTLPFAPSVVYLKPSSDITLSVAEDTERSSLSFST

SEQ ID NO: 34628 - protein, 153 aa, Oryza sativa Indica Group
MAAIGSSNVGFQVREALHPTWASVRSNPMAMGVGGWVGLGFDALFDLVFCISLLKKSGWKEGTGLGAQEQGRLEPVETRVKNNKRGLGSKEPKLKPKVDEDGEKDPKKPKLEAPKKKAKLAAKRIRKMQEEEKRLQEREFEMAFFREFWPDNV

SEQ ID NO: 34629 - protein, 424 aa, Zea mays
MESLEALVAHIQGLSGSPEELAHLHSLLKQADGEPLRAHAAALVPFLAHLSPETHSLGYLYLLEACATSSSNLSDFGGGDFLVTIGGFLTACSADQIRLAPDKFLNVCRVLKDQVMQLNMPIRGIAPLRAAVPKIQSSPEQLTPVHADYLLLCLLAKQYKAGLSVLEGDIFEVDQPKDLFLYCYYGGMIYVGLKKFPKALELLHNAVTAPMSSLNAIAVEAYKKYILVSLIVNGQVPPFPKYTSISAQRSMRNHAQIYAELSTSYSNGSKTDLETFIQSNSAAFQSDNNLGLVKQVLSSMYKRNIQRLTQTYLTLSLEDIARSVQLETPRDAEMHVLRMIEDGEIHASINQKDGMVSFHEDPEQYKSVEMVEHIDTSIHRLTALSKKLASIDQNMSCDTAYLMTGRDRGRFDYDDFDSVPHKYF

SEQ ID NO: 34630 - protein, 448 aa, Pyrobaculum aerophilum str. IM2
MPKWHWPISPDDVPKIVVEPPGPKALEIVKRDEELIMQSFARWYPLVIARGYGPVVEDVDGNLYVDFNSGIAVTNVGHAHPKVVEAIKRQAELFLHYSLTDFYYEIAVKLAERLVSIAPISGRKKVFFTNSGTESVEGVLKIARGYFKGQRPYVIAFLGAFHGRTYGSMSLTASKPVHRRHFSPLVPNVIHAPYPHPVRCPFKASDPEECGEYALAFIEDWIFKRLVDPSEVSLVIIEPIQGEGGYVVPPKNFIQGLRKLTQKHGILFAVDEVQTGFGRTGKWFAVEHFGVEPDLIATAKAIAAGLPLGAIIGRAEVMSLPRGAHANTFGGNPVAAAAALASIEVIEEEGLLHHAQTLGEELKKFFKDEVGEKHDVRGLGLMIGIELLDERKKPAGYLDEVLLKAFKRGVAVIGAGISTVRVAPPLVIPRDMALRAAALITEILRRYR

SEQ ID NO: 34631 - protein, 269 aa, Rhizomucor miehei
SIDGGIRAATSQEINELTYYTTLSANSYCRTVIPGATWDCIHCDATEDLKIIKTWSTLIYDTNAMVARGDSEKTIYIVFRGSSSIRNWIADLTFVPVSYPPVSGTKVHKGFLDSYGEVQNELVATVLDQFKQYPSYKVAVTGHSLGGATALLCALDLYQREEGLSSSNLFLYTQGQPRVGNPAFANYVVSTGIPYRRTVNERDIVPHLPPAAFGFLHAGSEYWITDNSPETVQVCTSDLETSDCSNSIVPFTSVLDHLSYFGINTGLCT

SEQ ID NO: 34632 - protein, 264 aa, Mesorhizobium ciceri
PIGILADLQGPKLRVGKFANGKEVLTQGQTFTLDDNPEPGTSTRVYLPHPEILSSVEAGHRLLIDDGKLELKAVKSDGKSIVCTVVAGTTISDKKGVSLPDTDLPVGALTEKDRKDLDAVLATGVDWVALSFVQRPEDLAEARKIARGRALIMAKIEKPQAVARLAEIIELSDALMVARGDLGVEMPLEAVPGIQKQITRAARRAGKPVVVATQMLESMITAPVPTRAEVSDVSIAVFEGADAIMLSAESAAGAYPVEAVAMMN

SEQ ID NO: 34633 - protein, 512 aa, Triticum aestivum
MVSFWSFLLSYPEVFLAIACFFCLSLFRLVRHCHKSDLPVNWPVIGMLPFLVRNLYQIHDSVTDMLREAGCTFRIIGPWFLNMSFLATCDPATVNHCFNTNFNNYPKGSEFAEMFDILGDGLLVADSESWEYQRRVAMQVFASRAFRSFSMSTITRKAGTVLLPFLDHMAKHGSQVELEGIFMRFSLDVSYSTVFATDLDCLSVSHPIPAFGQATKEVEEGMLFRHVVPPSLWKLLRMLKVGSEKKMADARVVIDKFIYEEIAKWKAQANKECQGDVLSMYMNWPMDPSMSEQQKTLFLRDTVVGFIFAGKDLIAVTLTWFFYMMCKHPHVEAKILEEIKALQSTTWPGNLSVFECDKLRPAIYLQAALLETLRLFPATPFEEKEALNDDVLPDGTMVSKGTRIVFSLYAMGRIKGIWGKDCMEFRPERWISKSGRLRHEPSYKFLSFNSGPRSCLGKDLGLSNMKMAAASIIYNFKVELVEGHAVMPESAVILHTRNGMMVRLKRRELVAA

SEQ ID NO: 34634 - protein, 239 aa, Mesorhizobium tianshanense
PIGILADLQGPKLRVGKFANGKEALTLGQTFTLDDNPEPGNSTRVYLPHPEILRSVEVGHRLLIDDGKLELKAVKSDGKAIVCTVVAGTTISDRKGVSLPDTDLPVGALTEKDRRDLDAVLATGVDWVALSFVQRPEDLAEARKIARGRALIMAKIEKPQAVARLAEIIELSDALMVARGDLGVEMPLEAVPGIQKQITRAARRAGKPVVIATQMLESMIAAPVPTRAEVSDVSIAVFE

SEQ ID NO: 34635 - protein, 474 aa, Bacillus cereus E33L
MKKHLYINGDWKSVNTYKPLYAPYSEETLAEIAQGTEEDVKEAVAAAKNAMKEMNTLSAYDRATILEKVAQKMDERREEFAEIIAKEAAKPIRAARGEVDRTVQTYKFAAEEAKRIYGETLPLDAAPGADGRIAYTIRKPIGVIGAITPFNFPLNLVAHKVGPAIAAGNTVVLKPADQTPLSSYALIELFEEAGLPKGALNIISGPGSTVGEAIVTNDDVASITFTGSPKVGIGIKAKAGLKRVTLELGSNAAVIIDEDVELTDELIERVKWGAFVNNGQVCISVQRVFVHEERMNEFLSKLRKAMETVVVGDPLIEETDVSALISKKDVERIDNWVQEAVKEGANVLYGGNKRDERVFEPTVLTNVPEHVSVQCQEVFGPLMTVNTFKEFNEAIEQVNNSRYGLQAGVFTNNLFKAMRAIDELEVGGVMINDIPTFRVDHMPYGGVKESGTGREGIKYAIEEMTEMKLVCIKK

SEQ ID NO: 34636 - protein, 264 aa, Mesorhizobium mediterraneum
PIGILADLQGPKLRVGKFANGKEALTLGQTFTLDDNPEPGNSTRVYLPHPEILRSVEAGHRLLIDDGKLELKAVRSDGKAIVCTVVAGTTISDKKGVSLPDTDLPVGALTEKDRRDLDAVLATGVDWVALSFVQRPEDLAEARKIARGRALIMAKIEKPQAVARLAEIIELSDALMVARGDLGVEMPLEAVPGIQKQITRAARRAGKPVVIATQMLESMITAPVPTRAEVSDVSIAVFEGADAIMLSAESAAGSYPVEAVAMMN

SEQ ID NO: 34637 - protein, 264 aa, Mesorhizobium plurifarium
PIGILADLQGPKLRVGKFANVKEALTVGQTFTLDDNPEPGTSKRVYLPHPEILSSVEAGHRLLIDDGKLELKAVKADGKSITCTVVAGSGISDKKGVSLPDTDLPVGALTEKDRADLDAVLATGVDWVALSFVQRPEDLAEARKIARGRALIMAKIEKPQAVARLPEIIELSDALMVARGDLGVEMPVEAVPGIQKQITRAARRAGKPVVIATQMLESMITAPVPTRAEVSDVSIAVFEGADAIMLSAESAAGAYPVEAVAMMN

SEQ ID NO: 34638 - protein, 662 aa, Medicago truncatula
MPSVAPSSEPTIEAASLLQNLSLDSQPKTIVGDAEPVKKNGPVFANGAAKGTGKPFNPNPSYVPNGYPSTYYYGGYDGQGDWSGYSNYVNLDGGMTQGVYGDNCSYMYHQGYGYTPYGAYASPNSSSPVVQHDGQMYGLQQYQYPCSYYNSPTSADGSFAPNKTSVPQREMSTAVNADRITSNVMNKGNSVSMVNGDCTNQNGLKAFMKSSQHTSLNTKDSYQGSSLPACAPLSGYQGPRLSTHGAQSAIPTDVSLVSDRQSKHGGKVGLSSQVANIKDFSSQRNQRHSQSLPQFMNLNGSRHPSGMELLPGFMNGMYPSNNLFSQYGSSFRANSRYGSSAYGSRTGSFDNKYRATGNGYVANDSRRNGDGFSELNKGPRAAKSSDNKSVKSPEPVTLLLKGQNLPVKSDDEVVPLVLNKEQYNGEDLSENYSDAKFFIIKSYSEDDVHKSIKYSVWASTPNGNKKLDAAYQEAGGCPIFLLFSVNTSGQFVGLAEMTGPVDFDKTVEYWQQDRWTGCFNVKWHIIKDIPNGVLRHITLENNENKPVTNSRDTQEVKFEKGVQIVKIFKEHASKTSILDDFGFYESREKTTQERKFKEQQLPKQVNKASDITFGSVTLPKSLDTTLMKESATADAAQGNVNSEVLLERNGSTPAFEDSSKSS

SEQ ID NO: 34639 - protein, 264 aa, Mesorhizobium amorphae
PIGILADLQGPKLRVGKFANGKEVLAVGQTFTLDDNPEPGTSSRVYLPHPEILSSVEAGHRLLIDDGKLELRAVKSDGKSIVCTVVAGTTISDKKGVSLPDTDLPVGALTEKDRKDLDAVLGAGVDWVALSFVQRPEDLAEARKIARGRALILAKIEKPQAVARLSEIIELSDALMVARGDLGVEMPLEAVPGIQKQITRAARRAGKPVVVATQMLESMITAPVPTRAEVSDVSIAVFEGADAIMLSAESAAGAYPVEAVAMMD

SEQ ID NO: 34640 - protein, 455 aa, Kluyveromyces lactis
MMMKWTHHRPNTGVSMSQPKIFRKKRQESRYHGGSQSRYQPNRPNNHHNTAGNVNVNRSLGKRNPRGKFNRPSNGPETSGSRFEGHGSIPRGPRAMGSSAESAGDSHSRNIFGKKPLALISFQDVKSSFQPLAQVGEGTYGKVYKAENVHTGKLIALKRLRLEQERDGFPITSIREIKLLQQLNHPNISLIHEIIVSDKNTISMGFQYMENDLSGMLMDKSIQFSDSNIKHLMKQLFVGLQYLHQQQIVHRDIKGSNLLIDNRGNLKITDFGLAKKLTDVSSPASNTNRVITHWYRPPELLLGATDYKYEVDCWGCGCLLVELFAGAAIFPGSNEVDQFQRILSIMGSPTLEQWPKMLDMPWWFMLVPQISKTYKNVFFDEFSKVPQDALDLASKLLRYDQDTRFTTTEALQHHYFTNEPKPQPLLLGPEFKGSHEYEVKKIRRKERERQKETTV

SEQ ID NO: 34641 - protein, 291 aa, Blumeria graminis f. sp. hordei
MPTDGIPPMLGQSSPLKLRKYEGRLSDDNFRNHVIAAIGEFLGTTLFLFYGFLAAQIINSKPDNLSDAPSLLQLIFVASAFGVSGAVNVWLFYRVSGGHLNPAITIGLTLIGAVPVTRALLLVSVQLLGGILAASLVLAVTPGSLNVQTALGNATSVKQGFFLKMILTATLVLTVFMLAVEKHRTTPLAPLGIGLILFLDVLLAAQFSGGSLNPARSFGPAVVELNFATYHWIYWFGPIAGAVLAAAIFKVLKFLAYETAVAGQDHDGLDVYRLIDDAGGHEVDREIQLEV

SEQ ID NO: 34642 - protein, 508 aa, Azoarcus sp. EbN1
MTSEANFAGLGLAEPLLRAISESGYTTPTPIQAQAIPLVLAGGDLLAAAQTGTGKTAGFTLPVLHRLSAAPAANPKAGRPRCLILTPTRELAAQVEESVRTYGKHLPTTSMVMFGGVGINPQIQALKKRVDILVATPGRLLDHVGQKTLDLSGVEILILDEADRMLDMGFIRDIRKILALLPKQRQNLLFSATFSDEIRSLANGLLHNPGCVEVARRNTASELVQQSVYSVAQKQKRDLLVHLVKQNDWHQVLVFTRTKHGANKLAEYLAKHGIPSAAIHGNKSQSARTRALAEFKDGSLPVLVATDIAARGLDIDQLPHVVNFELPNVPEDYVHRIGRTGRAGSSGAAVSFVDSEERQHLTAIERLIKRTIDREALPAFAIAPVDPNESDARPPRQPRQPSRHNNANAPRQARTDRPAGRQATPPSPSRAPVRSRDADNFGNRAPRSEVEAKRGHPDADGNRALRNAGPNGAPRSSDSARAAPRPDGNRRPQSRPALFNAKTDDRNR

SEQ ID NO: 34643 - protein, 244 aa, Brassica napus
  misc_feature (119)..(119): Xaa can be any naturally occurring amino acid
VRDQEQQQEAVYRRKSEDGLIFSPPYAPPPPPQTAVPQNSTQAPPMNFWQGNHCNPGGVYPTTAPGMRLPEQPVYMVPAPAPTPTPHPGTVYHAQPQQQPQSVMRPVAPGQGNQAGYYXQAYREQHQPAYNVAQPQVGARAPPQQQQQPPPPFTSGPPPQPQYSAVPPPRQVLGLPDTTAYTQVNYAGGMGKQVYYTEAPPPQYHGGVGLPVNGMSEVRTGPDGKPVVMNMSPKVSSQSSDSAV

SEQ ID NO: 34644 - protein, 137 aa, Botryotinia fuckeliana
MTGGKSAGGKAGTTKNAQSRFHPKAGLAFPVGRVHRLLRKGNYAQRVGAGAPVYLAAVLEYLAAEILELAGNAARDNKKTRIIPRHLQLAIRNDEELNKLLGHVTIAQGGVLPNIHQSLLPKKTAKTAGGKPASQEL

SEQ ID NO: 34645 - protein, 648 aa, Oryza sativa Japonica Group
MAKRGSKKKTTASTRALPLLRRSAGETGTAESKEETGAASPIKNAIKNAAAGEMAEEEKLAGAASPLLRLRSARGETGTAIKNAAAAGEMGEEETAAMGITRTRGDQETPRKKKGRSWKESKAMDDGAAALRRKAREITKEEEDDERLRGEMVSRVRARIRKQQPDETNDEEIQAHETYLLHDAGRGAGDTSDHPAAIARPQDVTTFHIVGVVDTDGARVRLLFRDSDLYFVAFKTGSCWFRFNDEHIPTFLTPTVPIAYTSGYMNIAQVRVGYHCLYDIFNVISRYTPESAQEKTNERQRILQCAALMLSESQRFGHVQLLAIRSGGHRVRLPPPLQAEDETNKQKMMIKKKNTHHPAVPSSSDNVEDLPTVSAPPVTPMVVTQQKNHKKTQAEEVDEKKNQENPNTDATIGAPSGGENHQNRSLISCDGINLYESDLDSLRGPHWVTDAILGYALAKFSRAYSDDGLLLVQPTNAALLNNKHYVAAEADHLLLASRRLVLIPVNDNLDFNQAGDGKHWSLLVIHKTSNDGVIQFIHHDSVRSGDNSYNLHAAQKLANVLRGVLPTAGDVINAETPQQTNGNDCAIHVLAAVQVICRWWRANANKSGPADWIRKLDKRISEGNITQMRASLLQDIERDCQKKKSKDQ

SEQ ID NO: 34646 - protein, 361 aa, Zea mays
SLRSSMAHAKAGASLPVPNVQALAQTWHGSGEPVPFRYVRTEEIVAGEVVAGCAIPVVDLSRLLDPRSSEEELANLGSACQHWGFFQLINHGVPDEVIQDTKKDMVEFFKLPVEAKKVHAQVPGGIEGYGQAFVFSETQKLDWADMIYLMISPKESRDLRFWPTRPPSFRDSIERYSAETAKVTACLLRFMAKDLGVEPERLLEEFRGLPQSMRTTYYPPCRLAADVLGLSPHTDATGLTLLLHVNDVQGLQIRRDGKWLAVDPLDGALVVSIGDILEILSNGRYRSIEHRAIVHPDKERISAAMFHQTCPNTTVGPLQELVERDSGGARYRSMDYMDFMKGFFAAKLDGRRSHMDALRIY

SEQ ID NO: 34647 - protein, 190 aa, Treponema pallidum subsp. pallidum str. Nichols
MRGIGRYHAPVDGHAALDRAIRKRIDFPKKGILYYDITGVLMNAAVFRYCLDQMVEFYRDEHVTAVAAIESRGFIFAAPFADRMGIPLILVRKAGKLPGDTYSCSYSLEYGKATVEVHKSDVVAGARVLLTDDLIATGGTLNAARTMLRAGGAEVVGFFAVVGLPFLRYHELIGDLPVRTLIEYNQETSN

SEQ ID NO: 34648 - protein, 239 aa, Triticum aestivum
  misc_feature (179)..(179): Xaa can be any naturally occurring amino acid
  misc_feature (204)..(204): Xaa can be any naturally occurring amino acid
  misc_feature (215)..(215): Xaa can be any naturally occurring amino acid
AYLGDTIEQVCTKKQAGTGPEFPGYRRPTRPGGAMELLSTDQICNGDGNIDMIGERYSSENALQQLEGRKFSVSSGSQLSSSQNLLKQILHSDKTSPSNITSDCYSDRNCQFSPSISFAQRNLMVQKQVANLQPGQLINDEGQLGQQTLTRRASYPCENYEVEKKGFGKQSKDTLGTSXVVDGSFVSSLSSDNSVEESSFQQLXDAVSQVDVKTXLCIRDGLYRLARNAQNKPVSQCDD

SEQ ID NO: 34649 - protein, 457 aa, Saccharomyces cerevisiae
MTSEPEFQQAYDEIVSSVEDSKIFEKFPQYKKVLPIVSVPERIIQFRVTWENDNGEQEVAQGYRVQFNSAKGPYKGGLRFHPSVNLSILKFLGFEQIFKNALTGLDMGGGKGGLCVDLKGKSDNEIRRICYAFMRELSRHIGKDTDVPAGDIGVGGREIGYLFGAYRSYKNSWEGVLTGKGLNWGGSLIRPEATGFGLVYYTQAMIDYATNGKESFEGKRVTISGSGNVAQYAALKVIELGGIVVSLSDSKGCIISETGITSEQIHDIASAKIRFKSLEEIVDEYSTFSESKMKYVAGARPWTHVSNVDIALPCATQNEVSGDEAKALVASGVKFVAEGANMGSTPEAISVFETARSTATNAKDAVWFGPPKAANLGGVAVSGLEMAQNSQKVTWTAERVDQELKKIMINCFNDCIQAAQEYSTEKNTNTLPSLVKGANIASFVMVADAMLDQGDVF

SEQ ID NO: 34650 - protein, 203 aa, Orpinomyces sp. PC-2
MNLSIKSVIFLAIVALATLVSASTNPKVTNKVYFDIRQGDKDLGRIVLGLYGEVVPKTVENFRALATGEKGYGYKNSKFHRVIKDFMIQGGDFTRGDGTGGKSIYGERFADENFKLRHTGPGILSMANAGRDTNGSQFFITTVTTSWLDGRHVVFGKVIEGMDVVTAIETTKTLPGDRPATPVIIADCGELPVSNNNDAKAEL

SEQ ID NO: 34651 - protein, 270 aa, Mycobacterium tuberculosis H37Rv
MHLDSLVAPLVEQASAILDAATALFLVGHRADSAVRKKGNDFATEVDLAIERQVVAALVAATGIEVHGEEFGGPAVDSRWVWVLDPIDGTINYAAGSPLAAILLGLLHDGVPVAGLTWMPFTDPRYTAVAGGPLIKNGVPQPPLADAELANVLVGVGTFSADSRGQFPGRYRLAVLEKLSRVSSRLRMHGSTGIDLVFVADGILGGAISFGGHVWDHAAGVALVRAAGGVVTDLAGQPWTPASRSALAGPPRVHAQILEILGSIGEPEDY

SEQ ID NO: 34652 - protein, 174 aa, Glycine max
  misc_feature (94)..(94): Xaa can be any naturally occurring amino acid
RHFVPNLTIGAPVIESLRKHTKAYLDCHLMVTNPLDYVEPLAKAGASGFTFHVETSKDNWKELIQRIKSHGMIPGVALKPGTPVGEVYPRVRTXEAENPVEMVLVMTVEPGFGGQKFMAETMDKVSSLFLMLCLMWLTTLINYESCIYFFIFFPLILNFQTRYVYLGRSIHHLT

SEQ ID NO: 34653 - protein, 499 aa, Glycine max
  misc_feature (443)..(443): Xaa can be any naturally occurring amino acid
MWSPIVLLLCLIPPVFLLFFFQYRRTFKNSNLPPGPRGLPIIGNLHQLDSSNLHLQLWKLSKKYGPIFSLQLGLRPAIVISSSKVAKEALKTHDVEFSGRPKLLGQQKLSYNGKDISFSPNGSYWREMRKLCVVHVLSSRRVSSFSSIINCEVKQMIKKISRHASSLKVTNLNEVLISLTCAIICRIAFGRRYEDEGTERSRFQELLNECEAMLSIFFVSDYVPFLGWIDKLSGLQARLEKSFKELDKFSQEVIEEHMDPNRRTSKEEDIIDVLLQLKKKRSFSTDLTIDHIKAVFMDLLIAATDPTAATTVWAMTELVRHPRVMKKVQEEIRNLGGKKDFLEENDIQKFPYFKAVIKETLRLYPPVPLLLPKETNENCIIDGYEIAAKTLVYVNALAIQRDPEIWEDPEEFLPERFLYSTIDFRGQDFELIPFGAGRRSCPXMLMATASLDLILANLLYLFDWELPAGMKKEDIDTEVLPGLVQYKKNPLCILAKCHM

SEQ ID NO: 34654 - protein, 264 aa, Aminobacter aminovorans
PIGILADLQGPKLRVGKFANGKEELSVGQTFTLDDNPDLGTSSRVHLPHPEILKSVQTGHRLLIDDGKLELRATKTDGKSIVCTVVAGTKISDKKGVSLPDTDLPVGALTEKDRKDLDAVLETGVDWVALSFIQRPEDLAEARKIAQGRALLLSKIEKPQAVARLAEIIELSDALMVARGDLGVEMPIESVPGIQKQITRAARRAGKPVVVATQMLESMITAPVPTRAEVSDVATAVFEGADAVMLSAESAAGQYPVESVATMD

SEQ ID NO: 34655 - protein, 350 aa, Gloeobacter violaceus PCC 7421
MFGLIGHLTNLSHAQRVARDLGYDEYASHDLEFWCMAPPQAVDEITITSVTGQVIHGQYVESCFLPEMLAQGRFKTAMRKILNAMALVQKRGIDITALGGFSSIIFENFSLDKLLNVRDITLDIQRFTTGNTHTAYILCQQVEQGAVRYGIDPAKATVAVVGATGDIGSAVCRWLTDRAGIHELLLVARDAERLDRLQQELGTGRILPVEEALPKADIVVWVASMNQGMAIDPAGLRTPCLLIDGGYPKNMAGTLQRPGIHILDGGMVEHSLDIDWQIMSFLNVPNPARQFFACFAESMLLEFEGLHFNFSWGRNHITVEKMAQIGSLSKKHGFRPLLEPSQRSGELVHG

SEQ ID NO: 34656 - protein, 391 aa, Triticum aestivum
MSDNLMEKVNALGERLKITGSEVGKQMQAGMSSMSFKMKELFQAQTPADKIVEDATAETLEGPDWAANLEICDLINTEKVNSVDLIRGIKKRIMLKEARVQFLALFLLETIVKNCEKAFSEVAAERILDEMVRLIDDPQTVVNNRNKALTLIEAWGESGDELRYLPVYEQTYKSLKSRGIRFPGRDNESLAPIFTPPRSVAEAEVAANFSQQIFEDVHVHTYTAEETKEAFDVARNSMELLSTVLSSSPQQDALQDDLTTTLVQQCYQSQHTIQRFIETAGDNEALLFEALSVNDEVLKVLSKYEEMKKPMASARTEQPVVIPIATEHEDSVTVGNEDALVRKPAAARAMSGGDDDILDDLDEMIFGKKGGSSSQDVSKRQDPKKDDLINF

SEQ ID NO: 34657 - protein, 524 aa, Triticum aestivum
MVALQLAALLALLLALWRLVWRPRAVGRSFVRQGIRGPPYTFLAGSLPEAKRLLIAGRRGVPPLDAGCHDIMPILLPQFHRWVADYGKTFLFWIGPIPAIFSIDLQLIKQVLTDRTGLYQKDFMIPVLKSLFGNGVILINGDDWKRHRKVVLPAFNYEKIKSMSAVTAEVTRQMIQQWGEQIHQSNSDKKAAEIDMIHAFNDLTANINGRVAFGTTHRDVEEVIVLMREMQKIATAAMLDAPILWYLPTRRNLHVRRLNKQLRSKIMSIMQARLAADGAKYGRGDTGGCGDDLLGLLLEAWTPHRQVRGGDTLTTDEVIDECKTFFAAGQETTATLLVWAMFLLAVHPQWQDKVREEVLREFPGGDGDDVIPNADILAKLKLLHMVLLETSRLYPPVVYIQRKAASDTVLGGIKVPQGTIISIPIGMLHRDKEVWGPDANEFNPMRFEQGVTKAAKDSKALLTFSLGPRVCTGQNFGIVQVQVVMAMILSKFSFSLSPEYVHKPKYLLSLTPRLGMPLILRNLL

SEQ ID NO: 34658 - protein, 353 aa, Zea mays
ISGAFVQQYYHILHEQPDQVHKFYQDSSILGRPDSNGIMAYVTTMRDINEKIMSMDFRNCLTEIETADAQLSHKDGVLIVVTGSLTSDEGVFRRFTQSFFLAPQESGGYFVLTDVFRFISERKPAEINQVATQENEISQNVRPASETCSALPEPIPADGSVISDHVTADSNVTEKQISDLSANGTAIESNDNTQPPVQVPKEDPKKALLVAPPPPTQMDVTKKSYASIVKVMKEGPPTPVVKTTSSVSKQKPAPKPVSTAVEGLEKPSEKPTQAIGTGDGIVAQNNSSRNEQGYSIFIKNLPFHANIEMVEEEFKKFGTIKPGGVQVRHNKVDRFGFGFVEYESQQSMQAAIE

SEQ ID NO: 34659 - protein, 504 aa, Oryza sativa Japonica Group
MSKPQQQSPPSTTTTSPPPPPPSTPPPASSSRSLLSALRRSPVTTLVAAFFLLALFMYGEDVRTLAELSIDDYLYPDADFYNVSALPPLLLPPPTCDLSRGRWVFDNTSLPAYREKECTFLTKQVSCLANGRPDDLWQYWRWQPNNCSLPTFDARRFMEKMRGKRMMFVGDSLNRNQWESLVCLVQPILSKGRKKIVKRGSFNIFYAKEYRATLEFYWAPFLVESNSDNPNFHHIDQRIISPERIESHANNWKDVDYLIFNTYIWWMNNEDIKVRRPNSTSWSDHDEVPRIETYGRVFKTWSTWLEQNVDPARTSVFFMTISPLHNSSKIGIGGRWFNTDAVITFCQFNIDEPCISATGSLELWNILKYRHRVRWFPAQWGNPNGIKCVKETLPVLNYTKPLDLNHDMRMYDLVAKVAKNMKNVPVSLIDITRMSDYRKDAHTSLYSIRQGKLLTPEQKADPQKYADCIHWCLPGVPDVWNQILYTRILSKSSPPSPHPPLPPQ

SEQ ID NO: 34660 - protein, 208 aa, Lyophyllum shimeji
KQMKLIHHGGYNESERDSYKEIIFSNTIQSMRAILEALPQLDIALAPANDARRNTILALPPQIEADVFPRDVADAIRTLWRDNAIKEAVRRSREFQLNDSAVYYFNVIDRMAAPNYLPTDQDILRSRVKTTGITETTFKVGDLTYKLFDVGGQRSERKKWIHCFENVTALVFLVSLSEYDQMLYEDESVNRMQEALTLFDSICNSRWF

SEQ ID NO: 34661 - protein, 344 aa, Streptococcus pneumoniae R6
MYHSLGNQFDTRTRTSRKIRRERSCSDMDREPVTVRSYANIAIIKYWGKKKEKEMVPATSSISLTLENMYTETTLSPLPANVTADEFYINGQLQNEVEHAKMSKIIDRYRPAGEGFVRIDTQNNMPTAAGLSSSSSGLSALVKACNAYFKLGLDRSQLAQEAKFASGSSSRSFYGPLGAWDKDSGEIYPVETDLKLAMIMLVLEDKKKPISSRDGMKLCVETSTTFDDWVRQSEKDYQDMLIYLKENDFAKIGELTEKNALAMHATTKTASPAFSYLTDASYEAMDFVRQLREKGEACYFTMDAGPNVKVFCQEKDLEHLSEIFGQRYRLIVSKTKDLSQDDCC

SEQ ID NO: 34662 - protein, 452 aa, Burkholderia xenovorans LB400
MEKSAPPPAPEDWIARSLRAVWHPCTQMKHHERLPLVPVARGQGAWLYDRAGHRYLDAISSWWVNLFGHANPRINAALKDQLDTLEHAMLAGCTHEPAIELAERLSALTGNTLGHAFFASDGASAVEIALKMSFHSWRNRGFADKQEFVCIANSYHGETIGALGVTDVALFKDAYDPLIRHAHVVASPDARLAQAGETAADVARRALDHVRSLFEARATKIAALIVEPLVQCAAGMAMHDASYIAGLRTLCDQYGVHLIADEIAVGCGRTGTFFACEQAGIWPDFICLSKGISGGYLPLSIVLSRDEIFEAFYHDDTARGFLHSHSYTGNPLACRAALATLDLFAADNVIAVNAQKSAKLKAALAPLAEHEQVRNLRQCGTIFAFDALIDDAQQARTFSRRFFENALRRELLLRPIGTTVYLMPPYILDDEELALLASRTRETFDATLAETR

SEQ ID NO: 34663 - protein, 617 aa, Myxococcus xanthus DK 1622
MSSQATPTLRLLGIGASPGVAVGHAFILDRKRIRTPKLRLAEAEVEPERMRMKTAIDLSDRQLAELKEQITRTEGSDHALILEAHRLMLHDPMLVDEVNRLIIEDRINAEWAVRRVARKIKHLFDNIPDEYFRERRSDVDYVADRIIRNLMGQVVDEEVEVPAEAIVVAHDLSPADAALMARSGRVGGFVTDLGGQTSHTAIVARARETPAVVGAGRASEQISPGDLVAMDGIRGVVLVNPSDEQLAVFREEQRRYQESERLALATKDLPAVSTDGFQIRLNGNIEFLEEIPSLLAHGAEGIGLYRTEFMFLDRKTAPTEEEHYRAYRQVLEAMGGRPVTIRTLDLGGDKVPGKTKHEKEPNPAMGLRAIRYCLSNRELFRTQLRALLRASVHGNLRLMFPLICGVSELREARSELEACRTELGRAGVPVGKRFPVGIMVETPSAATIADRLAQEADFFSVGTNDLIQYSLAIDRQNREVAYLYRPLHLSVLRQLRGIIDAGRAANIPVSMCGEMAGDPLYTLVLLALGFDELSMTSGQIPVVKRFLRRVSRVDAMELLQNAMELTTAEEIERYVRTEMDRRFSETMEPGAPGVGNAEPADHEPSEHGASPSGRNTA

SEQ ID NO: 34664 - protein, 184 aa, Oryza sativa
MDTMRGALERARMLVGMEVDEESAPEEQSFFDDVTRNCALTTTQASSIPTPPTQPGSIRVPRSDLRLYGFAICLAAGLTCTFLSMLVFFNPVKFGVTFTLGNLMALGRWGFNLLNYVYINVNLYFNFAMVHSKLLTLLAIILEFGALVWLLLDFPASQVLPECNFGIYLVWLSSTRQTLSVGDN

SEQ ID NO: 34665 - protein, 363 aa, Triticum aestivum
  misc_feature (231)..(231): Xaa can be any naturally occurring amino acid
KYLGRMRSGKNQMDCSAIAPEIFPEIEKWKPSWRSFDYDELCAATDRFSSDNLIGKGGHAEVYKGQLADGQFVAVKRLTKGGNKEDRISDFLSELGIIAHVNHPNAAQLLGFSVEGGLHLVLQFSPHGSLASLLHGAKGGLRWKARFNIALGIAEGLFYLHEGCHRHIIHRDIKASNILLTEDYQPQISDFGLAKWLPDKCTHQVVFPIEGTFGYMAPEYFMHGIINEKTXDVFAYGVLLLELVTGRKAVDSSRQSLVIWAKPLLESNNMKGLVDPSLDVGYDPEEMALTLAVASMCIHHSANLRPSMKSVVRFMKGDRESLELMGKPKPTKPPMFDSCDSEDYTRTSYLNDLDKHKQLALEQ

SEQ ID NO: 34666 - protein, 543 aa, Synechococcus sp. WH 7803
MNAVDRQAGHPKQRSSVAPVVLAILDGWGDREGSDFNAIRSAETPVMDALRHAYPNTLIQASGSHVGLPDGQMGNSEVGHLTIGAGRIIRQELVRIGDTVRANQLAAVPALSKLAARLRESGRTLHLLGLCSDGGVHSHVDHICGLLRWAAEEGIESVAIHAITDGRDTPTQSAPRYVHTIEDTIQSCGVGEIASLCGRYWAMDRDQRWERTARAYALLTDPAHPCSNNDASAVLEASYAAGTTDEFLEPTRLSSSHLQDGDALLMFNFRPDRARQIIQSLTLDAFEGFERPHHPKLDVVTFTQYESGLPVEVAFPPESLDNLLGQVVAAEGLKQYRTAETEKYPHVTYFMNGGIEQPLDGEDRHLVPSPRVATYDQAPAMAADTLTDSCIAAIEQGIYSLVVINYANPDMVGHTGVMQAATEAIQTVDQCIGRLLDAVGRMGGTLMITADHGNAECMRGADGEAWTAHTTNPVPVILVEGERRKLVGMGNALRLRDEGGLADIAPTLLQLLGLDKPAAMTGQSLIEAIDTPAPSSAKLPQPV

SEQ ID NO: 34667 - protein, 978 aa, Candida glabrata CBS 138
MTRFNFAIGHDEDGTTDLGKVATDTTTTTGSSIPVRSSMDSDSFSHDEDAELSRSMDDSQDAREVKSMNSEYSSDDGSKDRTKKEINSAEYSADIQPLQFKMSRRRTTQFDGTESSKASRKANASGNGSDPIKTLRFDEGSLSSSPTAIASDATRASLQRDTFAKVREHIQRGSVGNSGLTRSDFNPFAFIDREQFETYLKEPRYIRIFKKRSRSSKQFRRLFLAQELKTTDEFDDIEAMSASLLSQPDGLKPNTSITNATLNGNNFHDNINDPNHDMHSDKTFSGTACPVLPTSGHLEPAKNTKAIWSTKFSIDGKYMATGSRDGVLRLWKVLSTPVERWGLDSSIDSAHLTSAKSLRLQQNQHGSSHGGPLGSPAMRRDTFDNIDAKENSSNLYAPVFQPTPVRTYKEHLHDVLDMDWSKNNFLISASMDKTAKLWHPSKMRSLKSFQHPDFVTCVKFHPTDDRFFISGCLDQKCRLWSILDDEVSFEFNCRDLVTSLTLTPGDGTYTIVGTFNGYIHVLQTKGLEHITSFHVTAKKTHENTHEVLCPSNDSKVRHGPRVTGLQCFNSLIDNSLRLVVTSSDSRIRVFDLTRRKLIEILRGFQCGSSQHKAQISVYRNQPIVINSSDDHWVYGWRLKSSDPVEINKKAKKHGMSRSGSIRGLFSKSISRSSSQGSEDRQSLRNTLKLSSLLPIPHSSHSDGVMKNSDYFSFHAHNAPVTTVTMAPEETSKTLSLSNDPICELSLEFFEPSDEVDIIKLKDTQKGGHDNIPATKTPVTTSLAKPTPVEVIGSILISTDSNGLIRVFRADMSKSIRARVLQKLQKYNREMGKQYGSTDSLVSENDKSRPNLGTVGHQPSTNSTSFLSSTGSTNTTTVGSGSKASITRNHSFRSLKAFKSPTANFSNTALGATMNRAPRESISSVRSDSTSNTMTPMSFPGLKCHVCDGTKFEPLTRSSGSQDKSYFCVDCKTLLNNFR

SEQ ID NO: 34668 - protein, 487 aa, Synechococcus sp. WH 7803
MAAAAPASAGTKGVVRQVIGPVLDVEFPAGKLPKILNALRIEGTNTAGQPVALTAEVQQLLGDHRVRAVAMSGTDGLVRGMEALDTGAPISVPVGEATLGRIFNVLGEPVDEQGPVNASATAPIHRSAPKLTELETKPKVFETGIKVIDLLAPYRQGGKVGLFGGAGVGKTVLIQELINNIAKEHGGVSVFGGVGERTREGNDLYEEFKDSGVINAEDLSKSKVALCYGQMNEPPGARMRVGLSALTMAEHFRDVNKQDVLLFVDNIFRFVQAGSEVSALLGRMPSAVGYQPTLGTDVGELQERITSTLEGSITSIQAVYVPADDLTDPAPATTFAHLDATTVLSRGLASKGIYPAVDPLDSTSTMLQPAVVGEEHYKTARAVQSTLQRYKELQDIIAILGLDELSEDDRRTVDRARKIEKFLSQPFFVAEIFTGMPGVYVKLEETIAGFNQILAGELDHLPEQAFYLVGNIDQVKAKAEKIAAEAK

SEQ ID NO: 34669 - protein, 472 aa, Mycobacterium tuberculosis H37Rv
MTRRGKIVCTLGPATQRDDLVRALVEAGMDVARMNFSHGDYDDHKVAYERVRVASDATGRAVGVLADLQGPKIRLGRFASGATHWAEGETVRITVGACEGSHDRVSTTYKRLAQDAVAGDRVLVDDGKVALVVDAVEGDDVVCTVVEGGPVSDNKGISLPGMNVTAPALSEKDIEDLTFALNLGVDMVALSFVRSPADVELVHEVMDRIGRRVPVIAKLEKPEAIDNLEAIVLAFDAVMVARGDLGVELPLEEVPLVQKRAIQMARENAKPVIVATQMLDSMIENSRPTRAEASDVANAVLDGADALMLSGETSVGKYPLAAVRTMSRIICAVEENSTAAPPLTHIPRTKRGVISYAARDIGERLDAKALVAFTQSGDTVRRLARLHTPLPLLAFTAWPEVRSQLAMTWGTETFIVPKMQSTDGMIRQVDKSLLELARYKRGDLVVIVAGAPPGTVGSTNLIHVHRIGEDDV

SEQ ID NO: 34670 - protein, 192 aa, Gloeobacter violaceus PCC 7421
MRHGQTVLSEKRQFCGRTDPDLSAGGAQNVRALASWLAGESLPVQVFTSPLLRARRTARLLEAAWPSPVVEPRLRESDFGDWEGLDGDTLQASDPAGFAAWMADPVGFRPPGGESVGELCERVAEFFQEALERFADQTIAAVCHGGPIRAMVLAGLGLPLECFWHFNPPWASVSRLEVRGPVRQLRYFGQRG

SEQ ID NO: 34671 - protein, 128 aa, Glycine max
MAAAALRPAILRHIRLSPATAAPLAAAAAAGRPLALAPWLARPMSSHDAHLTRDEVVGRVLDVLKCHPKVDPSKVTPEAHFEKDLGLDSLDTVEVVMAIEEEFKLEIPDLEADKINSLPLAIEYVANH

SEQ ID NO: 34672 - protein, 434 aa, Ralstonia eutropha JMP134
MDESETGSPVADTSTDTDANVPWYKLMGPGLITGAADDDPSGIVTYAQAGAQFGNGLLWSVLLTLPLMIAIQLVCARLGRISGRGIVANIRRHQSRPLAYAFVVLLVVANTLNVGADLAAMGDALALVLGGARWIYTLALAAGSLLLQLFMPYRRYAAYLKWLSLSLLVYIAAMFLLKIDWHAAALAMVWPRIEFSSAYLLMVVAVLGTTISPYLFVWQAAAEVEELDIDRTALPLHAAPEQARMNFRRINVDTVTGMVVSAVIALCIMLTTSYALHNSGILDIDSSAAAAKALEPVAGKWALLLFSAGIIGTGLMAVPVLAGSVGYAVAEAMRWRRSLEEKPLSARNFYAVIGITMVIGTALCWLPIEPAKMLVWSAVLNGIAAAPAMVMLQLMSRHKAVVGEFRTPGWVHSLAWLATATMWISLLVTIVFAL

SEQ ID NO: 34673 - protein, 184 aa, Gloeobacter violaceus PCC 7421
MTASVGLPAPSFTLKSTKGATSPKNLGEPIALTDYRGKWLIFFFYPLDFTFVCPTEILALSDRYEEFQDLDTEVLGCSCDSVFSHWAWISTPREKNGIAGLKFPLVADFTKDVAEAYGVLNEKEGYSQRGLFIIDPDGILKYATITDDNVGRSVEETIRVLQALQNGGLCPGDWKPGQKVLEVV

SEQ ID NO: 34674 - protein, 473 aa, Vitis vinifera
MPFSAETRSKRRVSCPEVNWFNDQAPFSHVVFKMQLQSLSPENDIVPRKSLTITTDPFSLLSDQLLLHILSKLPYSHHTTTSLVCKRWMHLHGRLVQSVKLVDWDFLESGRLICRFPNLTDIDLVRACVRLPNNSAIWLSHKFLSIQLDSRFLSGGFVSGDDLLPPDVIDEGLRIVAEGCPNLRKLVLIGASEKGLSSVATECLTLQELELHYCTDLSLRGISGCQNLQILKLIGSVRELYNSVISDIGLTILAQGCRRLVKLELCGCEGSYDGIKAIGQCCQMLEELTLCDHRMDGGWLSALSFCGNLKTLKLQSCKSIDASPGSDQHLGSCPTLETLHLQRCQMRDKQSTRALFLVCEAVREIVLQDCWGLEDETFGIATICRRLKSLSLEGCSLLTVEGLDSVVHSWKELQRLRVVSCNNIKDSEVTPALATLFSVLKELKWRPDSRSLLSSSLGETGMGKKGGKFFKRA

SEQ ID NO: 34675 - protein, 254 aa, Mycobacterium sp. JLS
MSTVVTTRESELAASLAALRERLARAADAAGRDVAEIALLPVTKFFPASDIRILYGLGCREFAESREQEASKKAAELAGEFAGDPVRWHMVGRIQRNKARAVARWAYAAHSVDSAKLIAALDRGAGDALGDGVRTAPLRVYLQLSLDGDVERGGVDVDQPELIDQLCAAVDSAEALEFVGLMGIPPLGADAGSAFARLQSEWRRVRQRRKEIGRGQRFELSAGMSGDLEMAVRHGSTCVRVGTALMGPRPLTSP

SEQ ID NO: 34676 - protein, 266 aa, Glycine max
MAIPYPHFIATEKAAMDAGLLHPSSPSVILTQDDLKKIAAYKAVEYVESGMILGLGTGSTAKHAVDRIGELLRQGKLKDIVGIPTSTKTHEQALSLGIPLSDLDAHPAIDLAIDGADEVDPFLNLVKGRGGSLLREKMVEGACKKFIVIVDESKLVNYLGGSGLAMPVEVIKFCWRFTAARLQKLFEEAGCVARLRTFGEKEKEEPYVTDNGNFIVDLYFERSIGDLKAASDAILQLAGVVEHGMFLDMATTVIVAGELGLTVKNK

SEQ ID NO: 34677 - protein, 377 aa, Oryza sativa
  misc_feature (273)..(273): Xaa can be any naturally occurring amino acid
MVQRTSSDSAASAEAMVMDLSPKRPAKSYGGEGGSYFDWSPSELPMLRAASIGAAKLSLAAGGLALPFYSDSAKVAYVLQGKGTCAVLLPETPSEKILPIKEGDALALPFGVVTWWHNLHAATTELVVLFLGDTSKGHTAGRFTNMQLTGSTGIFTGFSTEFVARAWDLPQDAAASLVSTQPGAGIVKLKDGFRMPEGCDKDREGMVLNCLEAPLDVDIKNGGRVVVLNTQNLPLVKEVGLGADLVRIDGHSMCSPGFSCDSAYQVTYIVRGXGRVQVVGIDGTRVLETRAEGGCLFIVPRFFVVSKIADDTGMEWFSIITTPNPIFSHLAGRTSVWKAISPAVLQASFNTTPEMENLFRSKRLDSEIFFAPNSNSI

SEQ ID NO: 34678 - protein, 476 aa, Pseudomonas putida GB-1
MTSPIALPAVYSDTNLDATFAAQRKAFAGNPMPPAAQRRQWLKSLCEALLADQQQLIKAIDADFGGRSADETLLAELLPSVQGIRHAERHLRRWMRPAKRAVGLAFQPASARVLYQPLGVVGIIVPWNYPLFLAIGPLTCALAAGNRVMLKLSEATPATGLALKALLQRVFPEDLVSVVLGEVEVGQAFARLPFDHLLFTGATSIGRQVMLAAAQNLTPVTLELGGKSPAIVSANVPLEVAAERIAFGKTLNAGQTCVAPDYVLVPRERLNDFVDAYRNVVRRMYPRIADNPDYSAIINPRQLQRLEHLLDDARSKGAQVVDLYPDEPRQGRRLPPHLLTKVNDSMQVMQDEIFGPLLPLVPYSTLDDALAYINQRPRPLALYYFGYDRSEQQHVLQYSHSGGVCLNDTLLHVAQDDLPFGGIGPSGMGHYHGHEGFLTFSKAKAVLAKQRINAARLIYPPYGKALQRLVYKLFIR

SEQ ID NO: 34679 - protein, 572 aa, Triticum aestivum
  misc_feature (169)..(169): Xaa can be any naturally occurring amino acid
  misc_feature (203)..(203): Xaa can be any naturally occurring amino acid
MAGGGVEDVYGEDRATEEQLITPWSFSVASGHQLLRDPRHNKGLAFTEAERDEYYIRGLLPPAIVSQEHQEKKIMHNLRSYTVPLHRYVAMMDLQERNERLFYKLLIDNVEELLPVVYTPVVGEACQKYGSIYRRPQGLYISLKDKGKVLEVLKNWPERSIQVIVVTDXGERILGLGDLGCQGMGIPVGKLSLYTALGGVRPXSACLPITIDVGTNNETLLNDEYYIGLRQRRATGEEYHELLQEFMNAVKQNYGEKVLVQFEDFANHNAFDLLAKYSKSHLVFNDDIQGTASVVLAGLLAALKMIGGGLVDQTYLFLGAGEAGTGIAELIALEMSKHTELPVDDCRKKIWLVDSKGLLVESRKESLQHFKKPFAHEHEELKTLLEAVQSIKPTVLIGTSGVGKTFTQEVIEAMASFNEKPVIFSLSNPTSHSECTAEEAYTWSKGTAVFASGSPFDPVEYEGKTYVPGQSNNAYVFPGFGLGVVISGAIRVHDDMLLAASEALAEEATQENFDKGLIFPPFTNIRKISASIAAKVAAKAYDLGLASRLPRPDDLFKYAESCMYTPLYRSYR

SEQ ID NO: 34680 - protein, 432 aa, Alteromonadales bacterium TW-7
MNNKHPIDLNFDREHIWHPYTSMTQPIPVYPVTHANHNLIHLETGEQLIDGMASWWSAIHGYNHPTLNAAMVEQINSMSHIMFGGITHNSAVELCKKLVAITPESLTKVFLADSGSVSVEVAIKMALQYWLSQGITTKQKLMTPYKGYHGDTFAAMSVCDPVNSMHSLYSGFLPEHIFVPAPVSQFGSKFNQAEAQTLEQYFKAHHNQVAAFIIEPIVQNAGGMNFYHPDYLAYVRKLCSRYNVLLICDEIATGFGRTGKLFAVEHADIEPDILCIGKALTGGSMTLSATLTSEKIATGISEGEAGVLMHGPTFMGNPLACAVACASIDLLLNQNWKQRISDINTQLQQLHKCSELNAVANVRTLGAIGVVELNEAAGNVDVAKIQAYFVEQGVWIRPFGKLIYLMPPYISDDTSIKTLCDAIYNAINNKHY

SEQ ID NO: 34681 - protein, 417 aa, Acinetobacter lwoffii
MSSSFKHICVIGLGYIGLPTAATFAAHGVKVTGVDVNQHAVDMINQGKVHIVEPDLDALVRDVVAQGKLSAQLAPTEADAYIVAVPTPFKDDYQPDLKYIEAASKALAPFLKSGNLVILESTSPVEATEQMSAWLSEARPDLSFPQQKGEEADILVAHCPERVLPGKVLQELISNDRIIGGMTPRCSKAACDLYKIFVKGACIETNARTAEMCKLTENSFRDVNIAFANELSVICDKLDINVWELISLANRHPRVNILQPGPGVGGHCIAVDPWFIVAKTPEQARLIRTAREVNDAKPEWVIDQVKIKIADFLQANPTKTIQDVTIACYGLAFKPDIDDLRESPALEITKKLAEQGFNILAIEPNIHELPAKLPSNIKLIALKEHQQADIHLILVDHRQFKNMNFSFSYVVDTKGIL

SEQ ID NO: 34682 - protein, 575 aa, Trichodesmium erythraeum IMS101
MCQQKNFSHNYLLVWLITQKIIVTNTRKLIIKVQHNKILIVTLTTQTQKNSDSLTQFNRQMIVILDFGSQYSELIARRIRETQVYSEVISYRTTAAKLADINPKGIILSGGPNSVYDEGAPHCDPEIWNLGIPILGVCYGMQLMVKQLGGEVERTQLAEYGKASVSIDDPTDLLTNIEEGTTMWMSHGDSVTKMPSGFEVLAHTDNTPCGAIADHNKKLYGTQFHPEVVHSIGGQVLIRNFVYHICKCEPTWTTEAFVEEAIREIRAKVGDKRVLLALSGGVDSSTLAFLLHQAIGDKLTCMFIDQGFMRKYEPENLVKIFHESFHISVKYVNARDRFLSILKGVSDPEEKRKLIGHEFIQVFEEESKRLGPFDYLAQGTLYPDVIESANTNVDPKTGERVAVKIKSHHNVGGLPKDLRFKLVEPLRKLFKDEVRNVGRSIGLPEEIVRRHPFPGPGLAIRILGEVTDKRLKILRDADFIVRDEIRQQGMYHDFWQAFAVLLPIQSVGVMGDQRTYAYPIVLRFVKSEDGMTADWSRVPYDLLETISNRIVNEVKGVNRVVYDITSKPPGTIEWE

SEQ ID NO: 34683 - protein, 513 aa, Glycine max
MSTLEIEARDVIKIVLQFCKENSLHQTFQMLQNECQVSLNTVDSIETFVADINSGRWDAILPQVSQLKLPRNKLEDLYEQIVLEMIELRELDTARAILRQTQVMGVMKQEQPERYLRLDHLLVRTYFDPNEAYQDSTKEKRRAQIAQAIAAEVTVVPPSRLMALIGQALKWQQHQGLLPPGTQFDLFRGTAAMKQDVDDMYPTTLSHTIKFGTKSHAECACFSPDGQFLVSCSVDGFIEVWDYISGKLKKDLQYQADEVFMMHDDAVLCVDFSRDSEMLASGSQDGKIKVWRIRTGQCLRRLERAHSQGVTSVSFSRDGSQLLSTSFDSTARIHGLKSGKMLKEFRGHTSYVNDAIFTNDGSRVITASSDCTIKVWDVKTTDCIQTFKPPPPLRGGDASVNSVHIFPKNTDHIVVCNKTSSIYIMTLQGQVVKSFSSGKREGGDFVAACVSPKGEWIYCVGEDRNMYCFSYQSGKLEHLMKVHEKEVIGVTHHPHRNLVATFSEDCTMKSWKP

SEQ ID NO: 34684 - protein, 114 aa, Oryza sativa
MASRTRIEKMSAEVVDSNPYSRLMALQRMGIVQDYERIRQFSVMIVGVGGVGSVAAEMLTRCGIGKLLLYDYDKVELANMNRLFYQPHQAGLTKVEAAADTLRFINPDVIIEPY

SEQ ID NO: 34685 - protein, 75 aa, Brassica napus
  misc_feature (43)..(43): Xaa can be any naturally occurring amino acid
NIIKPAYAYTVVYVRDVAKSVEFYSRAFGYNVRRLDESHRWGXELESGQTTIAFTPLHQHETDDLTGKVQSSYPR

SEQ ID NO: 34686 - protein, 500 aa, Saccharomyces cerevisiae
MSRLERLTSLNVVAGSDLRRTSIIGTIGPKTNNPETLVALRKAGLNIVRMNFSHGSYEYHKSVIDNARKSEELYPGRPLAIALDTKGPEIRTGTTTNDVDYPIPPNHEMIFTTDDKYAKACDDKIMYVDYKNITKVISAGRIIYVDDGVLSFQVLEVVDDKTLKVKALNAGKICSHKGVNLPGTDVDLPALSEKDKEDLRFGVKNGVHMVFASFIRTANDVLTIREVLGEQGKDVKIIVKIENQQGVNNFDEILKVTDGVMVARGDLGIEIPAPEVLAVQKKLIAKSNLAGKPVICATQMLESMTYNPRPTRAEVSDVGNAILDGADCVMLSGETAKGNYPINAVTTMAETAVIAEQAIAYLPNYDDMRNCTPKPTSTTETVAASAVAAVFEQKAKAIIVLSTSGTTPRLVSKYRPNCPIILVTRCPRAARFSHLYRGVFPFVFEKEPVSDWTDDVEARINFGIEKAKEFGILKKGDTYVSIQGFKAGAGHSNTLQVSTV

SEQ ID NO: 34687 - protein, 301 aa, Glycine max
MVIRRNHVVGGITYRPYASQRFGEIAFCAITADEQVKGYGTRLMNHLKQFARDMDGLTHFLTYADNNAVGYFIKQGFTKEIHLEKDRWQGYIKDYDGGILMECKIDPKLPYTDLSTMIRRQRQAIDEKIRELSNCHIVYAGIDFQKKEAGIPKKIIDDIPGLREAGWTPDQWGHSRFRTLNVSSDNATNQKHLNGFMRSLLKSMFDHADAWPFKEPVDARDVPDYYDIIKDPMDLKTMSKRVDSEQYYVTFEMFVADARRMFANARTYNSPETIYYKCSTRLEAHFQSKVQAGLQPGTKIQ

SEQ ID NO: 34688 - protein, 527 aa, Candida glabrata CBS 138
MAEILNYTELSEIDAKISISRNYFQQNRKELANQKNVRSADNKQRQFWLKKLYWSVKDHEEQILEALEKDFHRSRQESISLEYVKLLGDILHLIEGIPKWNKPKKVRDNSAPFMFGNINIEKISRGNVLVISPFNFPVLLALAPVACALSAGNTVILKPSEMTPHCALVLEDIVKSCQLPEGVLQIVQGGVEQTTKLINSESLDMIFYTGSPRVGSIVAQAAAKNLVPCVLELGGKSPTFITGSLQKKNLETALKRIFFGAFGNAGQICVSPDYLLVHESIYDDVVKESGKVMKELYPDLNEHTEYTHMIHKASYDKTLEKLQKTKGRKVSAADVKIDNTSGKLMIPPTIVFDSDWDDALMEEENFAPVLPVIKYTDIDATIDKILSKHDTPLVQYIFSEKQKEIDHILARLRSGDCIICDTTIHVGIKDAPFGGIGQSGYGNYGGVYGFDAFSHERIVLKQPFWVDFLLKLRYPPFTAKKVKLLKLATERQPWFDREGNDHRSYKLIAMFSVTCALLAVGVKSFFV

SEQ ID NO: 34689 - protein, 451 aa, Oryza sativa Indica Group
MVLRRFAWPYGGQRASFCGSFTGWRECPMGLVGAEFQVVFDLPPGVYQYRFLVDGVWRCDETKPCVRDEYGLISNEVLVDNTHPVVQPETSIRVVSMDEGTILTTMPPDQLSQNSGVQIAIFRHRVSEILLHNTIYDVVPVSSKIAVLDARLPVKQAFKIMHDEGLSLVPLWDDQQQTVTGMLTASDFVLILRKLQRNIRTLGHEELEMHSVSAWKEAKLQFYGGPDVAAIQRRPLIHVKDSDNLRDVALAIIRNEISSVPIFKSSTDSSGMPLLGLATLPGIVKFICSKLQEQPEGYSFLQNQIVSMPIGTWSPHTGKASNRQLRTSRPSTPLNSCLDLLLEDRVSSIPIVDDNGALLDVYSLSDIMALGKNDVYTRIELEQVTVEHALELQYQVNGRRHCHTCLSTSTFLEVLEQLSAPGVRRVVVIEPRSRFVQGIISLRDAFTFLIG

SEQ ID NO: 34690 - protein, 204 aa, Oryza sativa Japonica Group
MTSVWKTKVLTGLNKLFDKDGKKAAAAEFLKSFNKEEIGKEIDDKKTELEPKVVEVVESSPPEIKALLKDKKTASKIKKNGPAVTKFLEELAKIDFPGAKPVSDAVAKSGTTPLSPAIAFILEKVAPFVPKEEPKPEPEAEAAAETTSREVAVEEEKKEEEAAPAEPAAAAAEAAAPSTEVVEEKKEEEKPAEAAAPAAEPEKQ

SEQ ID NO: 34691 - protein, 681 aa, Oryza sativa Japonica Group
MALVCAECRLVDIVRVHANLMVPEMEIQLGEEVGVAKFIKQFVENQNGKHVLGSHRVEGSVVHVEAPWLVDQQNRRREWRRVGADGELVSALFLQFVVLKLWVAIRSNHYRGLAGLEVDVMIDGSGRWEAGWSAKRSSNSASKDGRRSSACSAAQLRSRAKQSTSNTSVATYRRSPCTTPAPRMRSLSATTTRRPWRTGWRGRPMRWASLVVMKLCVEAGVNKGHHLLGRDTRHEAHRASAIDTENRVERDVWFIGVVCVVPFAEISRGVVVLKRPCLQRSGNSAGERQRNWCPGTSQGHGLLEILGLLELDIDADVVGEPRCEELNLLAVGEEVGRAATQRQKALLVRRHRANLSEMLEFTQGIVADRRSILTVTELLERIPIRRTHVLLIMEVPFLCSSSEMTRKRPSTDFMETIQKDVNPSMRAILIDWLVEVAEEYRLVPDTLYLTVNYIDRYLSGNEINRQRLQLLGVACMLIAAKYEEICAPQVEEFCYITDNTYFRDECWNESNSNNSLIAYNRRFVRVAQVSDELFIVQDPALHLEFLANYVAELSLLEYNLLSYPPSLVAASAIFLAKFILQPTKHPWNSTLAHYTQYKSSELSDCVKALHRLFSVGPGSNLPAIREKYTQHKILHAADVIDLNMANAFKNVKILCQCPCQCNLLEEVMLKLFPYWKLSTAV

SEQ ID NO: 34692 - protein, 321 aa, Thermobifida fusca YX
MITVVGEALIDLISSESGTYRSVPGGAPANTAVALARLGVPSSLLARMSTDRFGQQLRAYVGSRGVSTRDIVVSDEPTTLAIATLDETGRATYDFYVKGTVDWQWRPEELPDPLADDVTAIHVGSLAMAMPPGAAVVEEWVARQRGRAVISYDPNIRPALAGTPASARERVERQVALADLVKVSDEDVYWLYEQDPATGSADLLVEVGRSWLRRGPSLITITCGGDQTLVLVRGREDRPLSVAPEPVDVVDSIGAGDAFCAGLLDALGQAGALGADGRERLAALTDAQLTVCVAHAHRVAAHTCRRVGADPGELDFPPLEF

SEQ ID NO: 34693 - protein, 326 aa, Ralstonia eutropha JMP134
MAKVVRIHETGGPEVLRFEDTTVGEPGPGEVRVRHVAVGLNFADTYFRSGMYQVPLPNGIGNEAAGLIEAVGPGVTHLSVGDRVTYTGFTNTLGAYSTERLIAAAPLIKLPPEISCEVAAAMTMRGLSASYLMRRIWPFKAGDTILLHAAAGGAGLIISQWAKLLGLNVIGTVSTDAKAEVARAHGCDHTINYSHEDVAKRVRELTDGVGVSVVFDSVGKDTFMASLDSLKRRGLLVCVGFASGPVTGFDPAILARKGSAYLTRPGLADYIADPAEKAELVNELFGHVAAGRIRIEINQRYALEDAVQAHRDLEARKTTGSSIFVI

SEQ ID NO: 34694 - protein, 678 aa, Zea mays
  misc_feature (460)..(460): Xaa can be any naturally occurring amino acid
MQPPTLLPLGAVVVAILLLATAPSPAVSRHRHSSAADTETLDVAASLSRARAALSTDAVSLHQSAAAAAAGAKRSPRAREGGLTLRLHSRDFLPEEQGRHETYRSLVLSRLRRDSARAAAVSARATLAADGVTRLDLRPANGSAVFAASAAIQGPVVSGVGQGSGEYFSRVGIGSPARQLYMVLDTGSDVTWVQCQPCADCYQQSDPVFDPSLSASYAAVSCDSQRCRDLDTAACRNATGACLYEVAYGDGSYTVGDFATETLTLGDSTPVGNVAIGCGHDNEGLFVGAAGLLALGGGPLSFPSQISASTFSYCLVDRDSPAASTLQFGDGAAEAGTVTAPLVRSPRTSTFYYVALSGISVGGQPLSIPASAFAMDATSGSGGVIVDSGTAVTRLQSAAYAALRDAFVQGAPSLPRTSGVSLFDTCYDLSDRTSVEVPAVSLRFEGGGALRLPAKNYLIXVDGAGTYCLAFAPTNAAVSIIGNVQQQGTRVSFDTARGAVGFTPNKTAIGRAKRCRRRRLFSWDPEVTARTSREEVDEIEGGPALPLLAAASASQMPWGWGGAGLSTPQRIKETRRLVENSRHAVYLAKDDGAGESEKHSGGTPALPPPPLATLHARTQLAWPGLSTSSEAPSPAAEDAGAGGVEEKEEGVAHAPSLPNREQAQADVSSRADWPDLLS

SEQ ID NO: 34695 - protein, 601 aa, Torenia fournieri
MSAKHTYRICFCIRRRFKHKEAEAPEEIKLLFENYSENGSMSVENLHRFLQEVQGEENITAEETENLMESFLHEEHRHLLIFHRKHLNLEEFFAFLRSETNSPLPFPPKVRHDMDSPMSHYFIYTGHNSYLTGNQISSDASEKPIVEALKRGVRVIELDMWPNSTKDDIDIMHGGTLTSPVKLIKCLKAIKEHAFIASEYPVILTLEDHLTPDLQAKVAEMVTETFEDVLVCSTTEDELKFPSPESFKGKIIISTKHPKEFLETKSSSVAEGDDQASVKAPKSSEEAAWGTEIADFMDKTEHDDDNNNNNNGLENQDEDDQHENDAATLLNAAPEYKKLIGIRAEKMKGGIKAWLKVGSEKAHRVSLNEEKLEKAVVTHGTDIVRFTQKNLMRVYPKGTRIDSSNFNPMIGWVHGAQMVAFNMQTHGRSLWLMQGIFRANGGCGYVKKPDFLLRVGPHNEVFDPKAHLPVKKTLKVKVHMGEGWNLDFSRTHFDLYSPPDFYVKIGIAGVPSDTVMKKTKVVEDNWAPVWNEEFEFPLTVPELALLRIEVHESDMSDKDDFGGQTCLPVSELRKGIRSVPLYDHKGEKYKSVKLLMRFHFT

SEQ ID NO: 34696 - protein, 508 aa, Oryza sativa Japonica Group
MSSNLAASRRSSSSSSVAAAAAAKRPAVGEGGGGGGGKAAAGAAAAKKRVALSNISNVAAGGGAPGKAGNAKLNLAASAAPVKKGSLASGRNVGTNRASAVKSASAKPAPAISRHESATQKESVLPPKVPSIVPTAALAPVTVPCSSFVSPMHSGDSVSVDETMSTCDSMKSPEFEYIDNGDSSSVLGSLQRRANENLRISEDRDVEETKWKKDAPSPMEIDQICDVDNNYEDPQLCATLASDIYMHLREAETRKRPSTDFMETIQKDVNPSMRAILIDWLVEVAEEYRLVPDTLYLTVNYIDRYLSGNEINRQRLQLLGVACMLIAAKYEEICAPQVEEFCYITDNTYFRDEVLEMEASVLNYLKFEVTAPTAKCFLRRFVRVAQVSDEDPALHLEFLANYVAELSLLEYNLLSYPPSLVAASAIFLAKFILQPTKHPWNSTLAHYTQYKSSELSDCVKALHRLFSVGPGSNLPAIREKYTQHKYKFVAKKPCPPSIPTEFFRDATC

SEQ ID NO: 34697 - protein, 489 aa, Pseudomonas putida
MAAISVDPCTFALFGALGDLALRKLFPALYQLDRANLLHPDTRLLALAREAGSAQEHLNSIEAHLRRHVPEADIEPAALGRFLARLSYQHLDFLQPEGYRALAEQLPGDLPLIAYFATAAAVYGAICENLDNAGLAPRTRVVLEKPIGHDLESSRRVNDAVARFFPENRVYRIDHYLGKETVQNLIALRFANSLFETQWNQNSISHVEITVAEKVGIEGRWGYFDKAGQLRDMIQNHLLQLLCLIAMDPPSELSADAIRDEKVKVLKALAPITGEGLSTQVVRGQYIAGYSEGKPVPGYLEEDNANARSDTETFVALRADIRNWRWSGVPFYLRTGKRMPQKLSQIVIHFKETPHYIFAPEQRLQIGNKLIIRLQPDEGISLRVMTKEQGLDKGMQLRSGPLQLNFSDTWRSTRIPDAYERLLLEVMRGNQNLFVRKDEIEYAWKWCDQLIAGWRNAGDAPKPYAAGSWGPMSSIALITRDGRAWYGDI

SEQ ID NO: 34698 - protein, 510 aa, Azoarcus sp. EbN1
MHDIIRQLQEKREAARLGGGQRRIDAQHAKGKLTARERIELLLDEDSFEEWDMYKEHRCTDFDMAEERVPGDGVVTGYGTVNGRLVFVFSQDFTVFGGSLSETHAQKICKIMDHAMKVGAPVIGLNDSGGARIQEGVDSLGGYADVFQRNVMASGVVPQISLIMGPCAGGAVYSPSMTDFIFMVKDSSYMFVTGPEVVKTVTHEEVTAEELGGAVTHTTKSGVADLAFEDDVEALAGLRRFIDFLPLSNREQPPVKPALDLADRVDESLDTLVPANANQPYDMKELIAKVVDEGDFFELQPDYAKNILIGFGRMEGQTVGIVANQPLVLAGCLDIKSSIKAARFVRFCDAFNIPVVTFVDVPGFMPGTSQEYGGIIKHGAKLLYAYAECTVPKITVITRKAYGGAYDVMSSKHLRGDVNLAWPTAEIAVMGPKGAVEIIFREEKNDPAKISAREAEYKKKFANPFVAARRGFIDDVIMPHNTRKRICRSLAMLRDKQLDNPWRKHGNIPL

SEQ ID NO: 34699 - protein, 533 aa, Glycine max
MLAIQLSLQCPCILLFCPCSLDAFYNLWDTQISIFCNFTQTRKLTMAQPASLTRIGLAGLAVMGQNLALNIAEKGFPISVYNRTASKVDETVERAKQEGNLPVYGYHNPKFFVQSIQKPRVIIMLVKAGAPVDQTIKTLSAHLEKGDCIIDGGNEWYENTERREKAMSELGLLYLGMGVSGGEEGARHGPSLMPGGSFEAYKYIEDILLKVAAQVPDSGPCVTYIGKGGSGNFVKMIHNGIEYGDMQLIAEAYDVLKSVGKLSNEELQSAFSEWNKGELLSFLIEITADIFGIKDDKGEGHLVDKVLDKTGMKGTGKWTVQQAAELSIAAPTIEASLDARFLSGLKEERVEASKVFKSSGFDEILSDQHVDKKQLIDDVRKALYAAKICSYAQGMNLIRAKSIEKGWDLKLGELARIWKGGCIIRAIFLDRIKKAYDRNPNLANLLVDPEFAKEIVDRQSAWRRVVCLAINYGTSTPGMAASLAYFDTYRRERVPANLVQAQRDYFGAHTYERIDMEGSFHTEWFKLAKQSRT

SEQ ID NO: 34700 - protein, 334 aa, Zea mays
  misc_feature (213)..(213): Xaa can be any naturally occurring amino acid
MPLPPQPVRRSCPILLAVNDTCGVTRMTSTCAARVPSLRWAPQRGWVGSWVSVRPAKCRTSGGHAVVCAAVSFRPCIDIHKGKVKQIVGSTLRDLANDSMELVTNFESDKSPAEFAKFYKADELLGGHVIMLGANPSSQAAALEALRAYPGGLQVGGGINLENAMSYLNEGASHVIVTSYVFSDGKMNTERLRKLVELVGKQRLVPDHQSFLXKDGRYTIVTDRWQKFSDVFVDEPTLEYLAAFADEFLGHGVDVEGKRLGIDEELVELLGHYSPIPVTYAGGVSTMDDLERIKKAGKSRVDVTIGSALDIFGGDLPYKDVVLWHRKQSMVGQV

SEQ ID NO: 34701 - protein, 476 aa, Arabidopsis thaliana
MVFFKILFISLMAGLAMKGSKINVEDLQKFSLHHTQNNLQTISLLLFLVVFVWILYMLTRPKPVYLVDFSCYLPPSHLKVSIQTLMGHARRAREAGMCWKNKESDHLVDFQEKILERSGLGQETYIPEGLQCFPLQQGMGASRKETEEVIFGALDNLFRNTGVKPDDIGILVVNSSTFNPTPSLASMIVNKYKLRDNIKSLNLGGMGCSAGVIAVDVAKGLLQVHRNTYAIVVSTENITQNLYLGKNKSMLVTNCLFRVGGAAVLLSNRSRDRNRAKYELVHTVRIHTGSDDRSFECATQEEDEDGIIGVTLTKNLPMVAARTLKINIATLGPLVLPLKEKLAFFITFVKKKYFKPELRNYTPDFKLAFEHFCIHAGGRALIDELEKNLKLSPLHVEASRMTLHRFGNTSSSSIWYELAYTEAKGRMKEGDRIWQIALGSGFKCNSSVWVALRDVKPSANSPWEDCMDRYPVEIDI

SEQ ID NO: 34702 - protein, 538 aa, Oryza sativa Indica Group
MELLTSNNTVDNKIESLSLTFHGHDLIVDSELELNYGRRYGLLGLNGCGKSTLLTAIGCRELPIPEHMDIYHLSSEIEASDMSALQAVICCDEERMKLEKEAEILSAQDDGGGDALDRIYERLEALDASTAEKRAAEILFGLGFNKQMQAKKTQDFSGGWRMRIALARALFMNPTILLLDEPTNHLDLEACVWLEETLKKFDRILVVISHSQDFLNGVCTNIIHMQSKKLKLYSGNYDQYVQTRSELEENQMKQYKWEQEQIASMKEYIARFGHGSAKLARQAQSKEKTLAKMERGGLTEKVVRDKVLVFRFTDVGKLPPPVLQFVEVSFGYTPDNLIYKNLDFGVDLDSRIALVGPNGAGKSTLLKLMTGDLAPLDGMVRRHNHLRIAQYHQHLAEKLDLDMPALQYMMREYPGNEEEKMRAAIGKFGLSGKAQVMPMRNLSDGQRSRVIFAWLAYRQPQLLLLDEPTNHLDIETIDSLAEALNEWDGGLVLVSHDFRLINQVAQEIWVCEKQAVTRWEGDIMDFKEHLRSRAGLSD

SEQ ID NO: 34703 - protein, 590 aa, Trichodesmium erythraeum IMS101
MPQIRFPQTKNQIVILSCVAVFLWLFSCTPNSPKSLPLAELKRSKESIVVSAHPLASEAGKLMLEKGGNAVDAAVATAFAISVVEPFSAGIGGGGFLLLGTPPENSETQQYKIRALDFRERAPKAATRNMYLNEKGEVEKRASLDGHLAVGVPGTVAGLYNIHKSLGKLPWKELLKPAIRYARDGFELRDDFVSKLEKRLEVINKNPAARDIFTKNGQAYEPGDLLIQTDQAQTLETIAENPQSFYTGKIAQAIATDMAKAGGLITLEDLQNYTPIWREPICGKFRQAKVCAMPPPSSGGVHLLQILNIVGETNLQQWGRENADTIHLLTEAMRVAYADRSLHLGDPDFLEVPVKELTSLSYAQQRRQEISLTKVRRSTEVQPVSPEVLRSNILESPDTTHLTVVDQERNVISMTYTINGSFGAGVVAAGTGILLNNEMDDFAAAPEAPNLYGLVGDEANAIAPRKTPLSSMTPTIVTDNGRLIMATGSPGGSTIITTVLQVILNVLEYKMNVAEAVSAPRFHHQWLPDKLILETGGFGEATVNELKQRGHNVVMQRGWGNANVVFQDESGMLEAAADPRGEGEAMGTGQ

SEQ ID NO: 34704 - protein, 542 aa, Cucumis sativus
MAAAVGGLTTCFARPTPEFIAPSTSYSAPVRVFFKPFKVRDLCCAGEVVGVLSARSIPISPRFELIRLVRMQPGLSALELLKTSSVNRYTKERISIVVIGLNVHTAPVELREKLAIPEAQWPPGIGELCALNHIEEAAVLSTCNRIEIYVVALSQHRGVKEVTEWMSKRSGIPISELCKHRVLLYNTDATQHLFEVSAGLDSLVLGEGQILAQVKHVVKTGQGVAGFDRKISGLFKHAITVGKRVRTETNISSGSFSVSSAAVELAQKKLPESSYATAKVMVVGAGKMGKLVIKHLVAKGCRKMVVVNRTQDSVDAVEELKDVEIIYKPLSKILACASEADVIFTCTASKTPLFTKEHVAMLPPAGTETGRRLFVDISVPRNVEQRVSDLETVSVFNVDDLKEVVAANKEDRLKKVQEAQSIIGEEINKFEAWRDSLETVPTIKKFRAYVERIRAAELDKCLSKMGEDIPKKKKVAINDLSLGIANKLLHGPIQHLRCDGNDSRTLDEILQNMHAINRMFDLETDLSVLEEKIRAKVERGQK

SEQ ID NO: 34705 - protein, 256 aa, Trichodesmium erythraeum IMS101
MEWQENSGNWVLIPSRPKAIIHFLGGAFVATAPHVTYRCLLEILANQGYAVIATPFINTLDHLAIANNVLSSFENCLNHLYTSEILRKKSLPIYGIGHSMGCKLHLLMGSLNSIARAGNILISFNNFGARNAIPMVEQISSVVKVEFTPSPKITNSIIQKRYQIRRNLLIKFNNDNIDQTLRLSDILRLRFPSMVTVQRLNGNHLTPLGQDLSWSVGQVYTPVDAIGQWLKQEIYKDFNKLQREILLWLNPLAPIS

SEQ ID NO: 34706 - protein, 380 aa, Streptococcus pyogenes str. Manfredo
MIYFDNAATTIPYGEALKTYQEVATKIYGNPSSLHQLGTNASRILEASRKQIAGLLGVKSEEIFFTSGGTESANWAIKGIAFEKTAFGKHIIISAIEHPAVSESVKWLLTQGFEVSYAPVTTQGVVDVNALAELIRPDTILISIMAVNNEMGAIQPIRAISNLLANQPTITFHVDAVQAIGKIPLCDYMTNRVDLASFSGHKFHSVRGVGFLYKKAGKRLNPLLSGGGQEQELRSTTENVAGIASMAKALRIVTEKQVSVLPKLTAMRDVIYKALSAYPDVTVFSAQEGFAPNILTFGIRGVRGEVIVHAFEKYEIYISTTSACSSKAGKPSGSLVAMGIPVKTAQTAVRISLDDDNDMGQVEQFLTIFKQIYDKTQKVR

SEQ ID NO: 34707 - protein, 96 aa, Trichodesmium erythraeum IMS101
MATYKVTLKTPDGDQVIDCPEDEIILDIAEDQGFDLPYSCRAGACSSCAGKVESGTVDQDDQSFLDDDQVKEGWVLTCVAKPTSDCTINTHQEDNL

SEQ ID NO: 34708 - protein, 100 aa, Trichodesmium erythraeum IMS101
MATYKVTLINEEEGINQTFDCPDDEYILDAAEEQGLDLPYSCRAGACSSCTGKIESGTIDQADQSFLDDDQMTAGYILTCVAYPTSDCTIRTHQEEGIAS

SEQ ID NO: 34709 - protein, 450 aa, Streptococcus pyogenes str. Manfredo
MVIPYDYIVIGGGSAGIASANRAAMHGAKVLLAEGKEIGGTCVNLGCVPKKVMWYGAQVADILGTYAKDYGFDFKDKAFDFKQLKANRQAYIDRIHASYERGFDQNGVDRIYDYAVFKDAHTVEIAGQLYTAPHILIATGGHPVFPDIEGAQYGISSDGFFALDEVPKRTAVVGAGYIAVELAGVLHALGSKTDLFIRHDRPLRSFDKAIVDVLVEEMAVGGPCLHPHSEVAKVVKNTDESLTLYLKDGQEVEVDQLIWAIGRKPNLEGFGLDKTGVTLNDKGYIETDAYENTSVKGIYAVGDVNGKLALTPVAVAAGRRLSERLFNGKTDEKLDYQNVATVIFSHPVIGSVGLSEEAAVKQYGQEAVKTYQSRFTSMFTAITNHRQPCLMKLVTVGDTEKIVGLHGIGYGVDEMIQGFAVAIKMGTTKADFDNTVAIHPTGSEEFVTMR

SEQ ID NO: 34710 - protein, 98 aa, Trichodesmium erythraeum IMS101
MPNYKVTLKTPDGNSTIIEVPDDQYILEEAEEQGLDLPFSCRAGACSTCAGKVVSGKVDQSDQSFLDDDQMAAGYVLTCVAYPTSDCIIETHKEEALY

SEQ ID NO: 34711 - protein, 323 aa, Caulobacter crescentus CB15
MSGRITSAFGAKSTAREVVAGHDLSGRVAIVTGAATGIGVETARALALAGAEVIIAARKPELGEEVANAINEEAGSKRVSFGMLDLSSLEAIRHFVNVWGDRRIDILINNAAVMASPLMRTADGFEMQFGTNHLGHFLLSVLLAPNLIAGAKASGKPSRLVSLSSIGHRRSGIHFDDPNYTTRPYEKWEAYGQAKTANSLFAVGFDKRFKDQGVHANAVMPGGILTPLQRHLPIEEQRALGWLDENDQPREGFKTTEQGAATSVWAAVGSELEGVGGLYLEDCNQALPWSKENPWTGVMPHALDPEAADRLWDLSVDIVGAGA

SEQ ID NO: 34712 - protein, 308 aa, Listeria monocytogenes str. 4b F2365
MTIANSITDLIGKTPIVKLNRLPEAGSADVYVKLEFQNPGGSVKDRIANAMIESAEKSGALKPGDTIIEPTSGNTGIGLAMVAAAKGYQAIFVMPETMSLERRKLLQAYGAKLVLTPGPDGMKGAIAKAEELAKENNYFVPQQFHNPANPAVHEETTGPEIVEAFGKDGLDAFIAGVGTGGTVTGVGHVLKKNYPDVKIYALEPEESPVLSGGSPSPHKIQGIGAGFVPDTLDTKVYDGILKVSSEDALETAREVAKKEGILVGISSGATVKAALDLAKELGAGKKVLAIVASNGERYLSTPLYNFED

SEQ ID NO: 34713 - protein, 124 aa, Listeria monocytogenes str. 4b F2365
MDKIYLNELVFYGYHGVLAEETKLGQTFRVSLILGLSTKKAGISDSVDDTVSYAEVYETVKEIVEGTPFKLIEALAEKIATEVLTGYPLLEEVTVKLIKPNPPIPGHYDSVAVEIERKRSDLNG

SEQ ID NO: 34714 - protein, 510 aa, Vibrio cholerae O1 biovar eltor str. N16961
MGLTNQTGAEYLRQILRSPVYEVANVTPLQTMPRLSARIGNQVQIKREDRQPVHSFKLRGAYNMVSHLTEAQKAAGVIAASAGNHAQGMALSGTKLGIKTTIVMPRTTPDIKVEAVRGFGGEVLLHGSNFDEAKAEAERLSKEQGYTFVPPFDHPLVIAGQGTIGMEMLQQNGHLDYIFVPVGGGGLAAGVAVLVKQLMPEIQVIAVEPEDSACLKAALDAGKPVVLDQVSMFADGVAVKRIGDETFRLCQQYIDGHVTVSSDEICAAVKDIFEDTRAIAEPSGALALAGLKKFAEQQQLKGKQLGTVLSGANTNFHGLRYVSERCELGEKREGLLAVTIPERKGAFFDFCQIIGNRAVTEFNYRYNDDQLANIFVGVRLVGGPDELKSIIHELRQSGYPVQDLSDDEMAKLHIRYMIGGRPSKPLTERLYSFEFPEYPGALLKFLSMLGTHWNISLFNYRNHGADYGRVLCGFELDTPDLVRFSEHLVELGYRYKDETDNPAYRFFLAK

SEQ ID NO: 34715 - protein, 319 aa, Populus x canadensis
MEFPVISMEKLNGEERAATMEKIKDACENWGFFELLNHGISHEFLDTVERMTKEHYKKCMEQRFKELVASKALDGVQTEIKDLDWESTFQLRHLPKSNIAEIPDLDDEYRKVMKEFALKLEKLAEELLDLLCENLGLEKGYLKRAFYGSNGSPTFGTKVSNYPPCPKPDLVKGLRAHTDAGGIILLFQDDKVSGLQLLKDGQWIDVPPMRHSIVVNLGDQLEVITNGKYKSVEHRVIAQTDGTRMSVASFYNPGSEAVIYPAPALVEKEAEEKKKVYPKFVFDDYMKLYAGLKFQAKEPRFEAMKAVETTVNLGPIATA

SEQ ID NO: 34716 - protein, 175 aa, Arabidopsis thaliana; identical to SEQ ID NO: 1336

SEQ ID NO: 34717 - protein, 288 aa, Gloeobacter violaceus PCC 7421
MWTAIARHIAQSTGEAFAAEGRSAVGGGSINRTCVLSGSGRRYFVKLNTPDTLAMFEAEADGLEALHRAGALRVPRPICSGVAADSAYLVIEWLPLGGRGDWEQLGEQLARLHRTISSKGFGWRRDNTIGSTPQPNPWTADWAAFFARHRIGHQLALARGSAIDRATAQELVERIPNLLAGHCPEPSLLHGDLWLGNADFTAAGEPVIFDPATYYGDRETDLAMSELFDGFPESFYRGYRRAWPLAPGYERRKVLYNLYHVLNHYNLFGGGYASQANRMIRQLLIQSD

SEQ ID NO: 34718 - protein, 282 aa, Bifidobacterium longum DJO10A
MLEPPVTPIRKANDGLELPATGFGTYKVNGLAGVDAIKSAIHQGYRLIDSAFNYENEGVVGRAIRESGVPREDIIVTSKLPGRHHAHDEALLTIEESVCRMGLDYIDLYLIHWPNPSQGQFVEAWEALVEARERGLVKHIGVSNFLPGHIDLLIRDTGVTPAVNQVELHPYFQQREQLAYDNAHGIITEAWSPLGRANQMLRDPDLKRIAAKHGISVVQAILRWHLQYGDVAIPKSLNPERQRQNLDLTAFELDDQDMADIAAMDNPEGHTFGQNPHWHEEA

SEQ ID NO: 34719 - protein, 532 aa, Oryza sativa Japonica Group
MLRAALLRSGSGLRRPPMAAPLSTAAAASWLSDSASSPPRVRLLIGGEFVESRADEHVDVTNPATQEVVSRIPLTTADEFRAAVDAARTAFPGWRNTPVTTRQRIMLKFQELIRANMDKLAENITTEQGKTEGCLGRCFRGLEVVEHACGMGTLQMGEYVSNVSNGIDTFSIREPLGVCAGICPFNFPAMIPLWMFPIAVTCGNTFVLKPSEKDPGAAMMLAELAMEAGLPKGVLNIVHGTHDVVNNICDDEDIQAVSFVGSNIAGMHIYSRASAKGKRVQSNMGAKNHAIILPDADRDATLNALIAAGFGAAGQRCMALSTAVFVGGSEPWEDELVKRASSLVVNSGMASDADLGPVISKQAKERICKLIQSGADNGARVLLDGRDIVVPNFENGNFVGPTLLADVKSEMECYKEEIFGPVLLMKAESLNDAIQIVNRNKYGNGASIFTTSGVSARKFQTDIEAGQVGINVPIPEPLPFFSFTGSKASFAGDLNFYGKAGVQFFTQIKTVTQQWKESPAQRVSLSMPTSQK

SEQ ID NO: 34720 - protein, 512 aa, Gloeobacter violaceus PCC 7421
MTASLTGGLSANPLRQGLRLERTPKPAILTIFGASGDLTVRKLIPALYDLARDRRLPPEFTVVGYARRPYSHEEFREMMKEGVAKYSRSKLGNLWESFSKGIYYFQGDLDNLQNFKDLGEFLQTLDSERGTLGNRAFYMATAPSFFAPIIENLGGAGLAGDVRNTRLVIEKPFGHDLESAQNLNKVVQQVFHEKQVYRIDHYLGKETVQNILVFRFANSIWEPLWNNRYVDHVQITVAETVGVENRGPYYDEAGGALRDMIQNHLVQLLALTAMEPPSAFEADTVRDEKVKVLRATQVGQGPNGLAAVRAQYANGWISGEPVHAYRDEPRVNPDVQTASYIAAKFMINNWRWKGVPFLLRTGKRLAKRVTEIALQFREVPHLLFPSSSAGQLSPNMLVLRIQPDEGISLRFEAKRPVADIAMRSVNMDFHYGGTFEVASPEAYERLLLDFLLGDQTLFTRADEVEAAWKIVTPLIERWEIQKAGDLNYYDAGSWGPSAASKLMDNGRRWRRL

SEQ ID NO: 34721 - protein, 447 aa, Bradyrhizobium sp. BTAi1
MASTSDGHARGGWRGERGDPSLGNMFASVRTSAKGSLWRKLVAFLGPGYLVAVGYMDPGNWATSLAGGSKFGYVLLSVALLSNIMAIVLQSLCTRLGVGTGRDLAQACRDSTPRWVSVPLWLSAEIAITATDLAEVIGTAIGLSLLFGLPLSIGVCVTALDVFLILALQAFGFRWIEAFVVALLGIIALCFAIQIAMAQPDWAQVIKGFVPSGQLLANPEMLYLALGILGATVMPHNLYLHSGLVQTRGYGDSLKEKREAITLSTIDSTIALCLALTINASILILAAATFHRTGQHDVAELDQAHSFLAPLLGSTLAPTLFAIALLCCGLNSTITATLSGQIVMEGFLHWRIAPWLRRLITRMIAIVPAVVVTIWAGEKATGQLLILSQVVLSLQLPFAVVPLVLITASRAKMGPFVAPRWLTAIATVIAIAIIGLNAKLVWDLATG

SEQ ID NO: 34722 - protein, 387 aa, Streptococcus pyogenes str. Manfredo
MNKLYIDSFVEKKLTAGVQLLDEKDFSNIKEKNQLVQLVTKSNRPIGTAYISKQNKGIGWYLGPEKIDLSISYFVSLFSVAKAKRQDFAQSDETNAYRLFNQEGDGFGGVTIDLYKDFAVFSWYNAFVYDKKEMIMEAFQQVFPEVKGAYEKCRFKGPDTETAHLYGELAQETFSILENGIAYQVFLNEGLMTGIFLDQHDVRRALVDGLAMGKSLLNLFSYTAAFSVAAAMGGAIETTSVDLAKRSRELSLAHFEHNQLNLASHHFVVMDVFEYFKYAKRKKLIFDVIVIDPPSFARNKKQTFSVSRDYHKLITEALDILSPRGTIIASTNAANMTVSQFKKQIIKGFGSRRPESMTLQQLPSDFTINKADERSNYLKVFTIKVRE

SEQ ID NO: 34723 - protein, 496 aa, Burkholderia sp. 383
MNKLTLADWQDKAASLKIEGRAFIDGASRDAHGGKTFDCVSPIDGRVLAKVADCGEADVNAAVAAARRAFDAGVWAGLNPRARKAVLLRWAALMREHLDELSLLETLDAGKPIGDTTTVDVPGAAYCVEWFAEAIDKVGGEVAPADHHLVGLVTREPVGVVAAVVPWNFPILMAAWKFGPALAAGNSVVLKPSEKSPLTAIRVAQLAYEAGIPAGVFNVVPGAGEPGKLLALHRDVDCIAFTGSTAVGKLIMQYAAQSNLKRAWLELGGKSPNIVLADCPDLDRAAQTAAGAIFYNMGEMCTAGSRLLVHRDIKDAFIEKLVAAARAYVPGNPLDPSVSMGAIVDGIQLERVLGYIEAGRSEGKLVTGGARVKEETGGFYVEPTVFEVKPDAKIAREEIFGPVLSVIVFDDVDEAVRIANDTEYGLAAAVWTSNLTTAHDVSRRLRAGTVWVNCYDEGGDMNFPFGGYKQSGNGRDKSLHALEKYTELKSTLIRLR

SEQ ID NO: 34724 - protein, 163 aa, Bordetella petrii
MKHVISVLMENEPGALSRVVGLFSARGYNIETLTVAPTEDATLSRLTVVTVGSDEVIEQITKHLNRLVDVVKVVDLTEGAHIERELMLIKVRAVGKEREEMKRMADIFRGRIIDVTDKSYTIELTGVQEKVQAFIDALDRSAILETVRTGVSGIGRGERILKL

SEQ ID NO: 34725 - protein, 381 aa, Arabidopsis thaliana
MTTMSDLSPDLVGEILTRVPMTSLISVRCTCKMWNALSKEGIFFKAARKQFMGFTMMDSRVCSMKFDLQGIRNNEHDFVDPCIKQIAKLDQIEVSKVLQCDGLLLCVGKDNSRLLVWNPYLGQTRFIKPRKRFNKLEWYALGYDNNHNYKILMNYDTGHLFGYEIYDFSSDSWRVLDVSPDCHIPFHQQSVSLNGNTYFLAQEKIIVEGEEEEVVDEIEKFLLCFDFTTERFGPRLPLPFHSDVLETVAISCVRDDQLAVLYQRFETWEIWVTTKIDPTAVSWSMFLSVDMEPPTGCQFDDEAGSFFIDEENKVAVFFNSDLFNPRVENRNRRYPTAYIIGQDGYFKSATLREAPDLVKPDPYVYCCPLVWSSYAPSLVQL

SEQ ID NO: 34726 - protein, 582 aa, Oryza sativa Japonica Group
MGGRARSILRWLRHHRSRRVSSSSFHLTTTGDDTVKDLHDPRREDAEGDGWEEVHEGPESDPEEYIALVSEDAGTHLPVRTEPRRMDPSKKEPDFFTEYGEANRYKVSEVIGKGSYGVVAAAVDTQTGERVAIKKINDVFDHVSDATRILREIKLLRLLRHPDIVEIKHIMLPPSRREFRDIYVIFELMESDLHQVIKANDDLTPEHHQFFLYQLLRGMKYIHAASVFHRDLKPKNILANADCKLKVCDFGLARVSFNDTPSAIFWTDYVATRWYRAPELCGSFFSKYTPAIDIWSVGCIFAELLTGKPLFPGKNVVHQLDLMTDLLGTPSAESLAKIRNEKARRYLSNMRKKPRVPFTKKFPGVDPMALHLLERLLAFDPKDRPSAEEALTDPYFNGLANSEREPIAQPISKLEFEFEKRKLAKDDVRELIYREILEYHPHMLQEYLRGGDQMSFMYPSGVDRFKRQFAHLEEGVSKGEKSSPQLRQNASLPRERAIGNKHGDDEYHAKLNVGEKPCHASVTDGISKPLMSARSLLKSESISASKCIGEKPKQDRDQEDSLTESMDETADEVSEKVAQLKT

SEQ ID NO: 34727 - protein, 157 aa, Listeria monocytogenes str. 4b F2365
MIRIGQGYDVHKLAYDRELIVGGIKIPYEKGLLGHSDADVLLHAITDAIIGAIGAGDIGHFFPDTDMAFKDADSAELLEEIWQKVEADGFRLGNLDATIIAEKPKMAPYVEQMKLRIAELLHADSAQVNVKATTTEKLGFTGREEGIASLAVVLLEK

SEQ ID NO: 34728 - protein, 590 aa, Magnaporthe grisea 70-15
MSTLVDELLQDFESGSEAAESPDHDDGLMGDEEGASLMGGGGGDVDMDGDMDSSDDEMGGVDRTDPEEMKAKVDKMQMAGIGDIRTVATLMKTLEPVLESQPPESQTGAIGNVEDHPEYHLLTQSNSLSTQIDSEIVLVHKFIKDHYSVRFPELETLITNPLEYAKVVAVLGNGPLDAENIKTLQLATDNPLGVSLKSVLDGPSLMIVTVEATTSKGQDMSPEALERVVRACKMVISLDKAKKTLTDYVQSRMNLFAPNLTAMVGSLTAAQLLNTAGGLTGLAKTPACNIAAWGSKKGAGAASFATNVGVRQRGYLYNSPILRQVPTDLKKQGLRIVSAKLILAARIDCSHEAPDGSKGEEYRENCLSRIEKLQEKPLNKGARALPAPDDKPARKRGGRRARMAKAATAMTDLRKAQNRMAFGKEENEVGYGTGDSTAGMGMIGQQSDGRVRAMQIDNRTRAKLSAKNKGWGGIATSTGSGGAASSLKGFGQTAGNLDLRGKGLRASGVGTTLGSGGTMSSLAFTPMQGLELVDPKVQAELGRKRKAEEDRWFKGGTFTQVGGSGGGDDGVFKKPALPPAKRVDTGATKK

SEQ ID NO: 34729 - protein, 412 aa, Zea mays
MAALSVPLHAAAGSRAAAADPVKVPCVRSTGSAHFGRAFPSVAVSSLAARHIEPMRAIATQAPPAVPQYLSGEKTKIGINGFGRIGRLVLRIATSRDDIEVVAVNDPFVDAKYMAYMFKYDSTHGPFKGSICVVDDSTLEINGKKVTITSKRDPAEIPWGNFGAEYVVESSGVFTTTDKASAHLKGGAKKVVISAPSADAPMFVVGVNENSYDSKMNVVSNASCTTNCLAPLAKVVHEEFGIVEGLMTTVHATTATQKTVDGPSMKDWRGGRGAGQNIIPSSTGAAKAVGKVLPELNGKLTGMAFRVPTPNVSVVDLTCRIEKNASYDDVKAAIKAASEGALKGILGYTDEDVVSNDFVGDSRSSIFDAKAGIGLSSSFMKLVSWYDNEWGYSNRVLDLIAHMALVSAAAKL

SEQ ID NO: 34730 - protein, 460 aa, Yarrowia lipolytica
MCVDSCVQRSSLPHLSRPPGNLHKIINSDIYIYIKPHAPTPLLVAFAPTPHPSTTTSPFGQGLHQAHRQRVASLPTYGKTTTFNLPDNRPIKTVHCPSCEHVCRPQTQDAEAQKLQEAVTQRRRRSGAPGNSFPSAITALHPRQTHAPRERPSARQPDKPNGNRWELGVEFKIDIRAQDLRTIQELGAGNGGSVSRVEHIPTGAVMAKKVIHIGGKEAVRRQILRELHIMHECDSPYIVSFYGAFINESSGDVVMCMEFMDCGHLDRIYKKAGPLTEEIVGHITVAVVEGLTYLYNEHRIVHRDVKPSNILVNSHGQIKLCDFGVSGELINSIADTFVGTSTYMSPERIQGGNYTVKSDVWSLGISLLELLLGKFPFDMANGAVGPMGILDLLQRIVNEPPPTLPAEDTRFSPVCRRFVDRCLVKEPERPSPQQLHPTMPFIITSRAKQVDMKAWAMSVQ

SEQ ID NO: 34731 - protein, 272 aa, Pseudomonas putida GB-1
MSKTRIAFIGAGNMAASLIGGLRAQGLDASQIRASDPGAETRGRIQAEHGIETFEDNAQAIEGADVIVLAVKPQVMKAVCQALQPNLRDGQLIVSIAAGITCASLQSWVGDRPVVRCMPNTPALLRQGVSGLYATAEVSGEQRQQAEQLLSAVGTALWLQQEQQLDAVTAVSGSGPAYFFLLIEAMTAAGEKLGLPRETASQLTLQTALGAARMAVASDVDAAELRRRVTSPAGTTEAAIKSFQASGFEAIVEQALQAAATRSAELAEQLGK

SEQ ID NO: 34732 - protein, 228 aa, Pseudomonas putida GB-1
MSTLADNLSAISARIASAAQAAGRDPASVQLLAVSKTKPASAIREIHTAGVRDFGENYLQEALTKQQELSDLPLIWHFIGPIQSNKTKAIAEHFDWVHSVDRLKIAQRLSEQRPAGLAPLNLCLQVNVSGEDSKSGCAPADLPALAKAVAGLPNLRLRGLMAIPEPTDDRAAQEAAFAHLRQLQENLGLDLDTLSMGMSHDLEAAIAQGATWVRIGTALFGARDYGNT

SEQ ID NO: 34733 - protein, 388 aa, Vitis vinifera
MSQEAAGYHLSGGPAHMRGAVFWEVNRPLTIEDFHMPRPKAGEVLIKTKACGVCHSDLHVIKGELPFASPCVVGHEITGEVVEHGPLTDTKITKRFPIGSRVVGAFIMPCGSCFFCNRGQDDLCEDFFAYNRAKGTLYDGETRLFLRNNGKPVFMYSMGGLAEYCVVPAHGLTNLPDSLPYTESAILGCAVFTAYGAMAHAAEVRPGNSVAVIGIGGVGSSCLQIARAFGASDIIAVDVNDEKLENAKVFGASHTVNALKEDVADKIREITGGRGVDVAVEALGKPLTFAQCTQSVRDGGKAVMIGLTKSGAVGEIDINRLVRRQIKVIGSYGARARQDLPKLVKLAETGIFNLKAAVSRKCEFEEVGKAYQDLDQGKIVSRAVVEIM

SEQ ID NO: 34734 - protein, 541 aa, Thermobifida fusca YX
MSGTATLTSAIDPTSPAFHANAETNRALAAELRRRLADAARGGPPHARERHKARGKLLARERIDALLDPGTPFLELSPLAAHGMYGPDGNDAPAAGIITGIGRVSGRETVIVANDATVKGGSYYPMTVKKHLRAQEVALHNHLPCIYLVDSGGAFLPMQDEVFPDRDHFGRIFYNQATMSQRGIPQIAAVLGSCTAGGAYVPAMSDEAVIVRNQGTIFLGGPPLVKAATGEVVTAEELGGGDVHARVSGVVDHIADDDAHALAIVRRIVATLGPRPAPAWDVREPRPPAADPAELYGIIPTDTRTPYDVREVIARLVDASEFTEFKADYGPTLVTGFAHLHGHPVGIIANNGILFSESALKGAHFIELCDRRAIPLVFLQNISGFMVGRDYEAGGIAKHGAKMVTAVACARVPKFTVIIGGSFGAGNYSMCGRAYSPRFLWMWPNARISVMGGEQAASVLATVRRDQKAARGEDWSAEEEEAFKAPIRARYEEQGNPYYSTARLWDDGVIDPVDTRTVLALALSAARHAPLDPVGYGVFRM

SEQ ID NO: 34735 - protein, 459 aa, Pseudomonas fluorescens PfO-1
MDTGNFSAADRLERLPVSGYHRIIFIIIALAFFFDSMDLAMMTFLLGSIKAEFGLSSAQAGLLASSSFFGMVLGASLSGLLADRFGRKPVFQWSIVLWGLASYLCSTAQTVESLTLFRILLGIGMGMEFPIAQSMLSELIPAQRRGRYIALMDGFWPLGFVAAGVLSYFLLPLIGWRDIFLVLAVPAVFVLAIRFFIPESPRWLEQAGKHDEADKVLRGIEARVQASLGGAALPEPVRLPRSVTPPGHFLSALKQIWSPLYRQRTTMIWSLWFFALLGFYGLTSWLSALLQQSGFAVTQSVYYTVLISLGGIPGFLMAAWLVERWGRKPVCIVTLLGGGVMAFLYGQSAVFGGNVALLIGTGLLMQFFLFGMWAVLYTYTPELYPTSARATGSGFASAIGRVGSLLGPLVTGLVFPITGQGGVFALGALCFTIAAGVVWLFGMETRGKTLEELTEAVVR

SEQ ID NO: 34736 - protein, 480 aa, Burkholderia sp. 383
MTYRNESAWIQPAAPSATAAAPRATQARTTAEYRALDAAHHIHPFSDMGALNRAGSRVIVKADGVYLWDSDGNKVIDGMAGLWCVNVGYGRKELADAAYRQIQELPFYNTFFKTTHPPVIELSAMLAEVTPKGFNHFFYCNSGSEGNDTVLRLVHQYWRVQGQPQKKFVISRKNGYHGSTIAGGTLGGMGYMHEQMPSKVENIVHIDQPYFFGEAAAGETPEAFGLARAQQLEAKILELGAENVAAFIGEPFQGAGGVIFPPSTYWPEIQRICRKYDILLVADEVIGGFGRTGEWFAHQHFGFEPDLITMAKGLTSGYVPMGAVGIHERVARPIIDNGEFNHGLTYSGHPVAAAVAVANLKLLRDEGIVERVKNDTGPYFQALMRETFARHPIVGEVHGHGLVASLQLAESPAERRRFANGGDVGTICRDFCFNGNLIMRATGDRMLLSPPLVISRPEIDELVSKAKKAVDATAQQLGIS

SEQ ID NO: 34737 - protein, 118 aa, Glycine max
  misc_feature (94)..(94): Xaa can be any naturally occurring amino acid
MAGNQDQFEIKFRLTDGSDIGPKSFPAATSIATLKESVLAQWPKDKENGPKTIKDVKLINAGKILENNRTVGECQSPLCDTPDTVTTMHVVVQXHPATEKEKKAANKATQNKCMCVIL

SEQ ID NO: 34738 - protein, 84 aa, Triticum aestivum
MIPPGALVMLTPNVFIGLLVGAMLPYWFSAMTMKSVGSAALKMVEEVRRQFNTIPGLMEGTAKPDYATCVKISTDASSSSIFRA

SEQ ID NO: 34739 - protein, 232 aa, Triticum aestivum
MASSSDPWMKEYTEASKLVDDISSMIADRSSLPQSGPEIMRHTSAIRRKITILGTRLDSLVTLLSRIPPKSLTDKEMHKRQDALSNLKSKAKQMGTSFNVSNFANREDLLGQSKKAADDMSRVAGLDNQGIVGLQRQVMREQDEGLERLEETVLSTKHIALAVNEELTLHTRLIDDLEDHVDVTNSRLQRVQKRLAILNKRAKGGCSCMCLMLSVAAIVLLAVIVWLLIKYL

SEQ ID NO: 34740 - protein, 340 aa, Ostreococcus tauri
MVNERFGTNEWRANASAEDKDFDESTKEKVVKQIEFYFCDSNLPRDSFLLEEVARATRDGHGGAVDLALIAGFSRMRDILAPYGGKENVKNIERIAAALEGSALVEATDGKRVKRKSLTVGDHVPDLTTDEGVEAYRKLMVEDLDKRFVYAAPFSREASMDSMMEYFNTVGKVQSIRLRRHAQSKDFRGSIFVEFSSEEEARVVAARDDLEFDGAKLTTQHKSDYMAQKKKEKAEKVEKERQAAIARGEDPDAPKPEMEPVFVGQARERPGGGDRDAGRGGGRVGRGGGRGGGRGGGRGGGRGGGRGGGRGGGRGGGRGRGGPDRGGDRGGDKPRFGRPY

SEQ ID NO: 34741 - protein, 1565 aa, Oryza sativa Japonica Group
MGEFRGTGNKDDAKCGKDCSTDSYMDNSSNTNDDDYAECSLTEDECYNFYNSYAKRKGFSVRKDIVRREKRVGAIEYRHFVCSKEGIRDPSLVKPEDCVRRERALTQMECAASLSIKLDKKHGIWFVDNFIDEHNHPLTSHDETPFLRSHRKIKDFQKSEIHSLESIGIRKNVIMKVMKCKYGGYDKVGFVKKDLYNYSSRYKRSRILEGDASATLELMKKRRDKDPGFFYEYQVDDEGRLKNLFWCDAQSRMDYQSFGDVVVFDSTQRMNKYNMPFIPFVGLNHHRQTTIFACGIVSDECVESYTWFLQVFLRAMCQQKPRSIITDSDNAMMKAICQVLPDTDHRVCSWHIERVEHYEVCVSELREKVAEFDSKASQSWPATITDSPEIEESAGHIFTSANFDLVQKELQKLDGLHVDVVQDGKGERYMVTSKQKSARKCYVDYTRIGGNHDIRCSCRKMEREGIPCKHILSVLKHLEVKEIPKCCVLQRLSKNAKAGLPSVRKSDLHVWTEKQKNYYELNARGSELFDLASNSRELFREVKEYMESQLSKISSSNAATKKHTHVDEVGETSHRPEGSVLDPICVATKGAPRRMKGWDEHRPRLCSRCHQPGHDIRRCPEAKREEQDLALIESLKIAVILYDINLHCLETLRVKDEELQNLANNIRARDATIKKIADKLTQTAEAAEAAASVAHTLDGHRILLCSEIERLRHYKQWKDKWNNPCSRYNFQNPNTIISVKQEIGFTVIQPFRLGGSVHIIDHIPEDHTSMADGLPVFLRCTDLMAVASRLAVARVAPDGGAAGRRRRRGRPVVAVPTAGRGRGGAVAASPPTEEAVQMTEPLTKEDLVAYLVSGCKPKENWRIGTEHEKFGFEVDTLRPIKYDQIRDILNGLAERFDWDKIVEENNVIGLKQGKQSISLEPGGQFELSGAPLETLHQTCAEVNSHLYQVKAVGEEMGIGFLGIGFQPKWALSDIPIMPKGRYEIMRNYMPKVGSLGLDMMFRTCTVQIATAIFANSPFKEGKPNGYLSLRSHIWTDTDNNRSGMLPFVFDDSFGFERYVDYALDIPMYFVYRNKKYIDCTGMSFRDFMVGKLPQAPGELPTLNDWENHLTTIFPEVRLKRYLEMRGADGGPWRRLCALPVFWVGLLYDEESLQSISDMTSDWTNEEREMLRRKVPVTGLKTPFRDGYVRDLAEEILQLSKNGLERRGYKEVGFLREVDAVISSGEDFNIPASLFIDEDINIFMVALAKRLVEASFADRVFFANTGTEANEAAIKFARKFQRVARPDGDAPTEFMSFTNCFHGRTMGSLALTSKVQYREPFAPVMPGATFAEYGNLEEAKKVIQSGKIAAVFVEPVQGEGGIHSATKEFLQGLRDACDEAGALLVFDEVQCGLGRTGYLWAYEAYGVLPDIMTLAKPLAGGLPIGVVLVTEKVASAINFGDHGTTFGGGPLVCQAALTTLDKIQKPGFLAEVAKKGENFKQLLSTKLSGNAHVKEIRGIGLIVGIELDVPAGPLVDACLDRGVIVLTAGKGNVVRLVPPLIISEKELEQAAEVIRDCLPALDASTS

SEQ ID NO: 34742 - protein, 390 aa, Trichodesmium erythraeum IMS101
MHLSKRLKPLSFNVFADMDRAKGRAKAAGQDLIDLSLGSSDLPAPRHALEAISQSLQDSNTHGYSLFSSTQAFREAVARWYSNKFDISLNPETEVLALIGSQEGTAHLPLAILDPGDFALLQDPGYPSHSGGVYLAGGQVYPMPLLAENKFLPVLGDIPQHVLAQAKMMILSYPHNPTTAIAPISFLQEAVAFCQKHNLVLVHDAPYLDFVFNSSSEAPSIFQADVEKSVSIEFFTMSKSYSMGGFRVGYAIGNAQLIQALRQVKACIDFNQYRGIFNGAIAALTGPQEVVRKTVDIFRQRRDIFIEALDNIGWTVPMPSATMYVWTKLPKLWSNDSVDFCVDLVENTGVAVAPGAGFGKAGEGYVRFALVHRPEVLSRAVEKISVFLQR

SEQ ID NO: 34743 - protein, 381 aa, Oryza sativa Japonica Group
MKEGGGDGGFVRADQIDLKSLDEQLERHLSRAWTMEKRKEEAAADQRGSKPPALAAAHYSQNRRQRREEWEIDPAKLVVRGVIARGTFGTVHRGVYDGHDVAVKLLDWGEDGHRSEQDIAALRAAFSQEVSVWHKLDHPNVTKFIGAIMGARDLDIQTESGHLAMPSNICCVVVEYLAGGSLKGFLIKNRRKKLAFKVVVQIALDLARGLSYLHSKKIVHRDVKTENMLLDKTRTVKIADFGVARLEASNPSDMTGETGTLGYMAPEVLNGSPYNRKCDVYSFGICLWEIYCCDMPYPDLSFSEVTSAVVRQNLRPEMPRCCPSSLANVMKRCWDANPDKRPEMAEVVSMLEAIDTSKGGGMIPVDQRQGCLSCFRQYRGP

SEQ ID NO: 34744 - protein, 294 aa, Mycobacterium tuberculosis H37Rv
MSRIEALPTHIKAQVLAEALPWLKQLHGKVVVVKYGGNAMTDDTLRRAFAADMAFLRNCGIHPVVVHGGGPQITAMLRRLGIEGDFKGGFRVTTPEVLDVARMVLFGQVGRELVNLINAHGPYAVGITGEDAQLFTAVRRSVTVDGVATDIGLVGDVDQVNTAAMLDLVAAGRIPVVSTLAPDADGVVHNINADTAAAAVAEALGAEKLLMLTDIDGLYTRWPDRDSLVSEIDTGTLAQLLPTLESGMVPKVEACLRAVIGGVPSAHIIDGRVTHCVLVELFTDAGTGTKVVRG

SEQ ID NO: 34745 - protein, 400 aa, Mycobacterium tuberculosis H37Rv
MTGASTTTATMRQRWQAVMMNNYGTPPIALASGDGAVVTDVDGRTYIDLLGGIAVNVLGHRHPAVIEAVTRQMSTLGHTSNLYATEPGIALAEELVALLGADQRTRVFFCNSGAEANEAAFKLSRLTGRTKLVAAHDAFHGRTMGSLALTGQPAKQTPFAPLPGDVTHVGYGDVDALAAAVDDHTAAVFLEPIMGESGVVVPPAGYLAAARDITARRGALLVLDEVQTGMGRTGAFFAHQHDGITPDVVTLAKGLGGGLPIGACLAVGPAAELLTPGLHGSTFGGNPVCAAAALAVLRVLASDGLVRRAEVLGKSLRHGIEALGHPLIDHVRGRGLLLGIALTAPHAKDAEATARDAGYLVNAAAPDVIRLAPPLIIAEAQLDGFVAALPAILDRAVGAP

SEQ ID NO: 34746 - protein, 307 aa, Mycobacterium tuberculosis H37Rv
MIRHFLRDDDLSPAEQAEVLELAAELKKDPVSRRPLQGPRGVAVIFDKNSTRTRFSFELGIAQLGGHAVVVDSGSTQLGRDETLQDTAKVLSRYVDAIVWRTFGQERLDAMASVATVPVINALSDEFHPCQVLADLQTIAERKGALRGLRLSYFGDGANNMAHSLLLGGVTAGIHVTVAAPEGFLPDPSVRAAAERRAQDTGASVTVTADAHAAAAGADVLVTDTWTSMGQENDGLDRVKPFRPFQLNSRLLALADSDAIVLHCLPAHRGDEITDAVMDGPASAVWDEAENRLHAQKALLVWLLERS

SEQ ID NO: 34747 - protein, 318 aa, Synechococcus sp. WH 7803
MKGSLSPLHWEAVQGLERFTLLFPLWTLLAALLSLLQPGLFSWVAGPVIVWSLALIMLGMGLGLSPADFRRAMLPPRAALIGVGAQFLVMPSLAALLAWTLQLEPPLAVGLILVGCCPGGTASNVVALIARADVALSVVMTSLSTLLAVVVTPLLASALAGRYVPVNGWTLLVNVLQVVLIPVTVGVVIKQGLPRLAARVQPVMPPLAVVAIALIVAGIVGSQREVLLRQGAVLVLATALLHGGGFLLGFLLPALMGEPRAVRRTISIEVGMQNSGLAVVLARSGGFASPLTALPGAISAVMHSLLGSLLAALWRRRP

SEQ ID NO: 34748 - protein, 481 aa, Arabidopsis thaliana
MASAAASSAFSLLKSTGAVASSAGTRARASLLPIPSTSVSARPLGFSATLDSRRFSLHVASKVESVRGKGSRGVVSMAKKSVGDLTSADLKGKKVFVRADLNVPLDDNQTITDDTRIRAAIPTIKYLIENGAKVILSTHLGRPKGVTPKFSLAPLVPRLSELLGIEVTKADDCIGPEVESLVASLPEGGVLLLENVRFYKEEEKNDPEFAKKLASLADLYVNDAFGTAHRAHASTEGVTKFLKPSVAGFLLQKELDYLVGAVSNPKRPFAAIVGGSKVSSKIGVIESLLEKCDILLLGGGMIFTFYKAQGLSVGSSLVEEDKLELATELLAKAKAKGVSLLLPTDVVVADKFAPDANSKIVPASGIEDGWMGLDIGPDSIKTFNEALDTTQTVIWNGPMGVFEMEKFAAGTEAIANKLAELSEKGVTTIIGGGDSVAAVEKVGVAGVMSHISTGGGASLELLEGKVLPGVIALDEAIPVTV

SEQ ID NO: 34749 - protein, 253 aa, Triticum aestivum
  misc_feature (48)..(48): Xaa can be any naturally occurring amino acid
  misc_feature (57)..(57): Xaa can be any naturally occurring amino acid
  misc_feature (77)..(77): Xaa can be any naturally occurring amino acid
  misc_feature (94)..(94): Xaa can be any naturally occurring amino acid
  misc_feature (235)..(235): Xaa can be any naturally occurring amino acid
RAAPAPFLGGRLPPAFSRRGSQFLAPSFSLNLGVTAKGGVGKPSGSKXGTVGIQGIXWEFGGIFLWSLMNAGIFGGXINPGVTLGFFLARKLSXLTRAVFYMVIQCLGAICGAGVVKGFQTTLYQGNGGGANSVAPGYTKGDGLGAEIVGTFVLVYTVFSATDAKRSARDSHVPILAPLPIGFAVFLVHLATIPITGTGINPARSLGAAIIYNKKQAWDDHWIFWVGPFIGAALXAAIYHVVVIRAIPFKSRD

SEQ ID NO: 34750 - protein, 660 aa, Vitis vinifera
MIDDQFNVENPLSPRPLHSPKIKFIIPTLDEATPIPFFLYFFLSSPFPSIFLSLIGPLCDVEEGLPCGGGGGGRGGGHRPGVRRGRGFEVEVLQEEQGLIVIDDDKCRDLALPGGFLIRNIPKSINCDKGERIRFSSDVLSFQQMSEQFNQELSLSGKIPSGHFNAAFDFSSCWKKDAANTKALAFDGVSITTYNIALEKSQIVLRNHVKQAVPSTWDPAALTRFIEKFGTHVIVGVKMGGKDTVYVKQLYSSTLQPTEVQKQLKDIADKRFSDAPGSYGKVSREKVCRIHFYIKEHGMPFMDTSTSSAYSNKEDITFISKRRGGSSKTNLPHSAWIPTVSFEPDVISMSLVPITSLLSGIDGSGFLTHAINLYLRYKPPIEELHQFLEFQLPKQWAPVFGDLAVGPETKQQSNSSLRFSLMGPKLYVNTTPVDVGKRPVTGLRLYLEGKRSNCLAIHLQHLSSQPKTFELQEEVTSNASRLSSDRRYHEKVQWKSFSHVCTAPVESQHETAIVTGAHFEVGDSGLKNVLFLRLHFAKVIGATVVRQAQWDGSPSLSQKSGIISTLISTRFTTGQKPPPQPADVHINSALYPGGPPVPTQAPKLQRFVDTTEMIRGPQDPPGYWAVSGAKLSVDNGKISLRVKYSLLAVISPDEDVPMEF

SEQ ID NO: 34751 - protein, 425 aa, Pseudomonas putida GB-1
MPTMSDLKTAALEYHAQPRPGKLSVELSKPTATARDLALAYSPGVAEPVREIGRDPELAYKYTGKGNLVAVISDGTAILGLGDLGPLASKPVMEGKGVLFKRFAGIDVFDIEVESESPQAFIDTVRRISITFGGINLEDIKAPECFEIERTLIEQCDIPVFHDDQHGTAIVTAAGMINALEIAGKKLEDAKIVCLGAGAAAISCMKLLVSMGAKVENIYMIDRSGVIHAGRDDLNQYKAQFAHATDKRTLADALDGADVFVGLSGPNLLSPEGLKSMAANPIVFACSNPDPEISPELAHATRSDVIMATGRSDYPNQVNNVLGFPFIFRGALDVRAKRINEEMKIAAAIALKDLAKLPVPKEVCEAYGVEGLEFGREYIIPKPLDARLITVVSDAVAKAAIESGVATLPYPKHYPLTSVDEVFNG

SEQ ID NO: 34752 - protein, 452 aa, Burkholderia sp. 383
MDFDYDLFVIGAGSGGVRLARMSASYGARVGIAEEEQIGGTCVLRGCIPKKLLVYASHYPHEVEDAKGFGWRFGAGTLDWPALIAAKDREINRLSDIYINLLRQSGVEMHAGRATLVDAHTVAIGDRTIRARHIAIATGSRPSMPARPGIEHAITSREALSLAALPKRIAVVGGGYIAVEFAGIFNGFGSHVDLFYRGEKILRGFDDDVRQFLTDEMTKQGVTIHARSVVESIERADDGTLSVRVGDARHGPYDQVLYATGRVPNVDGLGLEQAGVALDARGAIAVDAYSATSVPSIHAIGDVTSRPQLTPVATRDGALLARTLFGGSRVAADHEWVPSAVFSQPEVATVGLTESTARDLYDGDVDIYRTSFKALRHTLSGRDERTLMKLVVARDSQRVVGAHMVGRDAGEIIQGIAIAIRAGATKAQFDDTIGIHPTAAEEFVTMRQKVAD

SEQ ID NO: 34753 - protein, 383 aa, Vibrio parahaemolyticus RIMD 2210633
MAYPKHKTASTRSKLNKVTIMGFKCGIVGLPNVGKSTLFNALTKAGIEAANFPFCTIEPNTGVVPVPDLRLDALAKIVNPQKVLPTTMEFVDIAGLVAGASRGEGLGNKFLANIRETDAIGHVVRCFENENIVHVAGKVSPIEDIEVINLELAMADLDSCERAIQRNAKKAKGGDKDAKFELTVLEKLLPVLTEGGSARTVELSKEELAAVGYLNFLTLKPTMYIANVNEDGFEDNPYLDAVREFAAKENNVVVPVCAAIESEMAELEDDEREEFLADLGIEEPGLNRVIRAGYELLSLQTYFTAGVKEVRAWTIPVGATAPKAAAKIHTDFEKGFIRAEVVGYEDFIQYNGENGAKDAGKWRLEGKDYIVKDGDVVHFRFNV

SEQ ID NO: 34754 - protein, 328 aa, Bradyrhizobium sp. BTAi1
MGLLVDGQWHDVWYDTAASGGRFVRKDSSFRSFVTADGSPGPTGSGGFKAEPGRYHLYVSLACPWAHRTLIMRALKGLTEMISVSVVHWLMREQGWTFADGPAVVRDSINHAELLHQVYTAADPHYSGRVTVPVLWDKAQRTIVNNESSEIIRMLNTAFDGVGAAPGDYYPEPSRSEIDAINQRVYDTLNNGVYKCGFATTQAAYEEAIGPLFATLDWLEERLATRRFLLGDAMTEADIRLFTTLIRFDAVYVGHFKCNIRRIADYPHLSAYTRDLYQWPGVAATVNFEHIKRHYYESHRTINPTGIVPVGPLQDFTAAHGRERLSAS

SEQ ID NO: 34755 - protein, 202 aa, uncultured marine group II euryarchaeote DeepAnt-JyKC7
MVADGKILSYEEALATGLPIREVEIVDALLPGLDDDVLAVNMIQRMTDSGRRVRFNVLCVVGNSDGYVGLAICKGKEVASTIRKAIDKAKLNMIPVMRGNGSWESGGGPGTSVPLKITGRSGSTRVTLMPAPAGKGLVVSDYGRRVLTLAGVTDVWSRSAGQTRTTINYAQATFNALVALNKVRISDADKRRLYITSGRREL

SEQ ID NO: 34756 - protein, 431 aa, Trichodesmium erythraeum IMS101
MNIAVIGLSHKTAPVEVREKLSLPETEIQNAISELCSGTYTQEVGILSTCNRLEIYVVTNEMQPGIREVTQFLSESSKIPLNQLRPHLFMLLHEDSIMHLMRVASGLDSLVLGEGQILAQVKQTHKLGQKYKGIGRILNRLFKQAVTAGKRVRTETSIGTGAVSVSSAAVELAQMKLEDLSNYQVAIVGAGKMSKLLVQHLLAKGANKISIINRSVGRAQDLANSFKDANIKVYSMLEMVQVIGESDLVFTSTAATELILDKAKLETILDPLKPLMLVDISVPRNIGNDVSELPNVRCFNVDDLKAVVAQNRESRRQMAMEAEVLLEEEVEAFDVWWKSLETVPTINSLRQKIETIREQELEKALSRLGSEFAEKHQEVIEALTRGIVNKILHDPMVQLRAQQDIEARRHAMETLQLLFNLESEMSSGKVI

SEQ ID NO: 34757 - protein, 248 aa, Bordetella petrii
MTSVENRARLVLGNWKMHGSLAENAALLDALRAADPASHCEIGVCVPFPYLAQAASALGGSSVSWGAQDVSAHAKGAYTGEVSGAMLSEFGCRWTLAGHSERRSLHGETDQAVADKARAALDAGLTPVVCVGESLAEREGGNTLGVIERQLEPILALGADALARMVLAYEPVWAIGTGRTATPEQAQEVHGAIRVALRGLGAGQVRVLYGGSVKAANAATLFAMPDIDGALVGGASLVADEFLRIAAA

SEQ ID NO: 34758 - protein, 231 aa, Triticum aestivum
IGSIHHVNVVRLVGFCSEEMRRALVYEYMPRGSLEKYIFSPEKSFSWDKLNQIALGIARGIDYLHRGCDMQILHFDIKPHNILLDSDFTPKIADFGLAKLYPRDNSFLPVSAARGTVGYIAPEMVSRSFGAISSKSDVYSFGMLLLEMAGGRRNVDPRASRSQTYYPSWVYNQLSQQEVGGISEAVGIHQVERKLCIVALWCIQMKPDDRPAMSEVLDMLEAGIDGLEMPP

SEQ ID NO: 34759 - protein, 526 aa, Vibrio vulnificus CMCP6
MSPKCRKLLKFDEVITMSAKKPLALVILDGYGYREDTASNAIANAKTPVMDALIANQPNTLISASGMDVGLPDGQMGNSEVGHTNIGAGRVVYQDLTRITKSILDGEFQQTAALVEAIDTAVKAEKAVHIMGLMSPGGVHSHEDHILAAVEMAAERGAEKIYLHCFLDGRDTPPRSAEGSLQRFQDLFAKLGKGRVASLVGRYYAMDRDNNWDRVQVAYDLLTQAKADFTYDSAVAGLAAAYERGENDEFVKATEIKAEGQESAAMQDGDAVIFMNYRADRARQITRTFVADFAGFERAVFPAVNFVMLTQYAADIPLAIAFPPASLENTYGEWLSKQGQTQLRISETEKYAHVTFFFNGGVETEFAGEERQLVASPKVATYDLQPEMSSTELTEKMVAAIKSGKYDTIICNYPNADMVGHTGVYEAAEKAIEALDASVGQVVEAIKEVGGQLLITADHGNAEMMVDPETGGIHTAHTSLPVPLIYVGDKAVEFKEGGKLSDLAPTMLSLAGLEIPAEMTGQVLVK

SEQ ID NO: 34760 - protein, 245 aa, Zea mays
MAGSEELKLLGWWAPGVSPFVLRAQMALAVKGLSYEYLPEDRGCKSDLLIASNPVYKKVPVLIHDGRPVCESLLILEYLDDAPGLAGNGTSILPTDPYSRAVARFWAAYVNGKLFPSCIGILKTAKQEERAGKVEETLSGLRHLEGVLAECSKGEAEAEAPFFGGDTIGFLDIALGCYLPWFEAVGRLAGLGPLIDPARTPKLAAWAERFRVAEPVKALLPGVDELEEYITTVLYPKWNIAVTGN

SEQ ID NO: 34761 - protein, 500 aa, Caulobacter crescentus CB15
MQSMADAETADTFGCHALVGGTPKVSFWTRRKAIDTITAGHADSHQLKKTLSWPHLVALGVGAIVGTGIYTLTGVGAGLAGPGVILSFLIAGAVCACAALCYAELSTMIPASGSAYTYSYAAMGEPVAWFVGWSLILEYTLVCAAVAVGWSAHAHGLFKMIGFPDALLAGPHQGGLINMPAVFISMAVAGLLALGTRESATVNMVLVFVKIIALIVFVVLCLPAFNLAHFTPFMPNGFQAHVPEGAAADAAKVGVMAAASLIFFAFYGFDAVSTAAEETKNPKRDLTIGIVGSMAVCTAIYMIVAAVSIGASRTEVFSKSEAPLVFILESLNHGKIAQLVALAAVIALPTVILAFMYGQSRIFFVMARDGLLPRALSKVNAKTGTPVMMTLLTGVLAAVISGLLSLKDIAELANAGTLWAFIAVGASVILLRLREPNRPRVFSTPLWPIVAPAGILGCLYLFLSLPGKTQLYFLYAHLIGAVVYLAYGMRKSVLAQQERA

SEQ ID NO: 34762 - protein, 246 aa, Triticum aestivum
MDMGLEVSSSSPSSSSASSSPEHAAGRASLAKRPAGRTKFRETRHPVYRGVRRRGNAERWVCEVRVPGKRGARLWLGTYATAEIAARANDAAMLALGGRSAACLNFADSAWLLAVPPALADLSDVRRAAVEAVADSQRREAANGSLTVTATVTEEASCGAPEESSSESDSVGSSETSEPSADGEFEVPVAVDTDMFRLDLFPELDLCSYYASLAEALLLDPPAPVTTTYAYWDNGDGGADVALWSY

SEQ ID NO: 34763 - protein, 141 aa, Triticum aestivum
  misc_feature (127)..(127): Xaa can be any naturally occurring amino acid
HASESPSKNDKEPVSREDFKEYFAKFGTVRYVDFSKGDDSGYLRFEESTAAEKARAFAALADEGGLVMKGHLVTLEPVSGQAEKDYWSGIKGGQGRFNNNNRSNRGGRDWKNNRGGGGRHHGGGKRXGRHSDNTKGYKSKA

SEQ ID NO: 34764 - protein, 170 aa, Triticum aestivum
  misc_feature (79)..(79): Xaa can be any naturally occurring amino acid
  misc_feature (89)..(89): Xaa can be any naturally occurring amino acid
  misc_feature (99)..(99): Xaa can be any naturally occurring amino acid
  misc_feature (104)..(104): Xaa can be any naturally occurring amino acid
  misc_feature (126)..(127): Xaa can be any naturally occurring amino acid
  misc_feature (135)..(135): Xaa can be any naturally occurring amino acid
  misc_feature (150)..(150): Xaa can be any naturally occurring amino acid
HAFGGVPRESWNSGILSCLGRNDEFCSSDVEVCLLGTVAPCVLYGSNVERLAAGQGTFANSCLPYTGLYLLGNSLFGWXNCLAPWVSHXLRTAIPTTLXLEGSXEVSTSNVGCCGDLVRRTKEKRXXPKKPPGDXSTNYFCQPCALWQEXPNCPQVPNLDQQRGLLSRSP

SEQ ID NO: 34765 - protein, 1813 aa, Ostreococcus tauri
MSRCSSSAWALVALVFSLVTLTRAVPSVPSSSSATATAYSRTTLSFPGTADGSGDALETIIVGSTDPDYGTLYTDEGLTTTVSTLGVTTACANAGNVTGRRLTSQTAYYVAPNATATCDTTETRRTIVTSLTYRLIDGAGNCSDESSINITVKVFDASLSRFVRACKAMWVTRSEDMNTIDAVDWWNPNLTLPLTGTDAENNGQFMKQANSSSVVYGWGDNGMKQLSLGDDISRTFPETNTNFAQVKQFTYIAATLSGETVFGIEHESGYVWGWGYDARRVLGLETVTPSASTIAAQPVRIGSLALITKLAAGAFHVVAMTESGKVYTWGADDLGQLGRGWMPGMLQSIKSEAFKKSKSLPARVVNNGFRGVVTVDIASGEFHTLALTSSGDIWAWGSNIEGQLGLKPCEISKYGNGLGECRESAPEMPYTDSPQIVAVGANVKFAAIAAGARYSMALTAADETGAGGGRVFAWGYGENGQLGLVLDGRNVERALVPQPLTTLGDEVIVFIAAGESHVAAIASTGELYTWGSNTFGQLGHGDRVDRGKPTKVQILSDANIKIHSVSCGRSHTVAVSDYGEVFTWGSNEYGQLGTEPRPADDTERNMTLTLRGWSRSSSVSSRRRLLAVYGSSTTSKTIFSAFSDFQDASGRSGSSNAELSALVMGAARPFKGGYVSKTELGLYGDIEYVATPVIVAALQQVTAVVAAGGSSFALRLSCNVGYERDTTTGRCTACSAGSYTNDFTSFACQACPVGQYQDGRASSSCKLCEAGQYAQTTGSSACSFCAAGKFVPFEGSFSSIFCEDCPRGTKSVANGSQTCTPCAKGEYQDSIGQSTCKVCPAGTFNDRMGSQQEADCVKCPPGTFAANNGSATCTPCPAGFDADVAGASACQQCALGKYSPGGRPQCTPCPAGTSGNVTAVMTSVDECVPCALGFYMNAPGAEACLSCEVGTYSDTQGATKCTPCPVGYEAKIDVRNGTSLGQACQVCGTGKYNAIAGGSCTVCNEGTYQDQTGQSECKKCPIGKEGSSAGAQSIDDCVNCAAGYESKYEGMVKCTPCAMGFYGTGDRDDTSACQQCPAGTYSQQISSTTIEDCEECPAGFFSQGDKPCEQCPAGQYQANTAQSSCDLCPAGTYLESTGAKSEGECLPCNPGTFSATAGSVTCTQCAAGSYAATERLEACVQCPVGTISTVVGSQTEDDCLPCPAGSTSDGEGKTTCTPCAAGSYRTAESAECVPCPAGTYSNVPGASSEAACLPCPAGSFSNLVGQTVCTQCAAGTYQAVLGSTECVGCPAGTSSGVDGAETSSTCQPCAPGTFSDVVGSIVCDNCLAGTFMPTAGNSSCINCPAGTYSTVEGSSTASNCLLCTAGQYSLEAATTCADCDPGSYAPNPGTALCDACPAGTYGEEQGGTNIDVCLPCPIGRYSSIEGAQECLPCPAGKFGNETGLSECYSCRPGTFSTVTGAVTGDETVCTPCATGTSSFLGGKSSCTPCDPGTYADVTGSINCTKCGPGTYGIAVGATKLSACKRCPLYRFNSTLGSSSIEDCVYYHSATSRSSVIPFSSLVPTRGDETARSASASDPLAHPLDYFTPPNVTPPIPHTRSPHRRHACSPRARTSFTRRPSHLASPRVGVFARTFSRWRRTASTSCAWRNLHRILRQKGTEPARTGEYDKFYPTEGHFVCRGCGTPLYSAKAKFDSGCGWPAFDKCYTGAVKTEVDNSFGMRRVEIMCAGCDGHLGHVFENEGFSATMERHCVNSISVRYVKEQKEAEEGKVVDESVASSAFGFVQTPIMALIGAYALSDLLGRVMNFWAARQG

SEQ ID NO: 34766 - protein, 352 aa, Oryza sativa
MGKPGKLALPSHESTIGKFLTQSGTFKDGDLLVNKDGLRIVSQSEEGEAPPIEPLDHNQLSLDDLDAIKVIGKGSSGIVQLVRHKWTGQFFALKVIQLNIQENIRRQIAQELKISLSTQCQYVVACCQCFYVNGVISIVLEYMDGGSLSDFLKTVKTIPEPYLAAICKQVLKGLMYLHHEKRIIHRDLKPSNILINHMGEVKISDFGVSAIIASSSAQRDTFTGTYNYMAPERISGQKHGYMSDIWSLGLVMLELATGEFPYPPRESFYELLEAVVDHPPPSAPSDQFSEEFCSFVSACIQKNASDRSSAQILLNHPFLSMYDDLNIDLASYFTTDGSPLATFNTSNRYDDR

SEQ ID NO: 34767 - protein, 202 aa, Oryza sativa Japonica Group
MAISRSSSRRRRWVGSARGRCAEESASAAGRRRSRSRPVGVIWSGVDGGGVGGGCGWAAATSPAGASGRDASAMSGIKTTTTDFLSSRDKTEKVIGNKWDLYLDLLQADYTEGGSGRQRGEERYWGLMAATEMVCYGGGGRRLADGDADLSVHMWDALDALGLVRYCCRRMLMTHVDLIEKLLNYNNDGSDITSGQSTSGCV

SEQ ID NO: 34768 - protein, 428 aa, Synechococcus sp. WH 7803
MSRNHHPNLWPPFTSITTTPPLEQVVRGEGALLHRAEGGPLIDGISSWWVTLHGHAHPVVAAAIAEQAATLEQVIFAEFTHPQAERLAQRLAQHTHLDRVFFSDNGSTAVEVALKTAVQWWHNRGEPRQQLIAFDGAYHGDTFGAMAVGARSLFSEPFDPLLFPVARVPWPHTHWDDATVDQREQEALSALEQALKTPTAAVILEPLVQGAGGMRMVRPAFLQAVEQQVRQAGSLLIADEVLAGFGRCGTLLASQRAGIHPDLVALSKGLTAGFLPMGITMARESIFAEFLGSDPTRTLWHGHSFTANPLGCAAANASLDLLEAEPENYQRFEERHQPRLERLARHPKVQRPRLCGTIAAFDLVTDSAEGYLNPAGKILRSLVREHGVLIRPLGDVVYLLPPLCISDAQLDQCYDAIETGLDALRDQA

SEQ ID NO: 34769 - protein, 350 aa, Debaryomyces hansenii CBS767
MNTSIPQTMKAIVLSGPYEVSTVTKQSPTIQDPTDVILKVKYSGLCGTDLHTYRGHIKLGSKDQIIGHEFLGTIVSRGSAITDSDFKIGDDVLSTFTIQCGECWYCKHGYSGQCDKTNTFGKVGLDGGQAEYVRVPYAMSTLIRKPESKSTEDDAVYVMMADIFITGYYGVKKILNHLKNESADGYTKSDIKDITILQLGVGPVGLCALRILKHFGFEKVVCVDSVTSRLEEARRFGAFKAINFETEKNGVADFIKESTNNVGFDVVLEVVGASSALRTAYDSVRGNGFICSIGMAHDPLPFTGLDCYLKNVNISFGRCHAWSLFPEALDLFEVLKPDFTIFIDFNLFLY

SEQ ID NO: 34770 - protein, 924 aa, Lathyrus sativus
MMELQVIWIIRLVVACVLCLCIFIISASSATEGFESIACCADSNYTDPKTNLNYTTDYRWYSDKSSCRQIPKILLSHRSNVNFRLFDIDEGKRCYNLPTIKDQVYLIRGIFPFDSVNSSFYVSIGATELGEVTSSRLEDLEIEGIFRAPKDNIDFCLLKEDVNPFISQLELRPLPEEYLHDFSTNVLKLISRNNLCGIEEDIRFPVDQNDRIWKATSTPLNALPLSFNVSIVDLNGKVTPPLKVLQTALTHPERLEFVHNGLETEDYEYSVLLYFLELNNTLKAGERVFDIYLNSEIKKESFDVLEGGSKYSYTVLNISANGSLNITLVKASGSKFGPLSPALKILQARPWIDETNQTDLEVIQKMRKELLLQNQDNEALESWSGDPCMLFPWKGVACDSSNGSSVITKLDLSSSNLKGTIPSSVTEMTKLQILNLSHNHFDGYIPSFPPSSLLISVDLSYNDLTGQLPESIISLPHLNSLYFGCNQHMSNDDEAKLNSSLINTDYGRCNAKKPKFGQVFMIGAITSGSILITLAVVILFFCRYRHKSITLEGFGGKTYPMATNIIFSLPSKDDFFIKSVSVKPFTLEYIELATEKYKTLIGEGGFGSVYRGTLDDGQEVAVKVRSATSTQGTREFDNELNLLSAIQHENLVPLLGYCNEYDQQILVYPFMSNGSLLDRLYGEPAKRKILDWPTRLSIALGAARGLAYLHTFPGRSVIHRDVKSSNILLDHSMCAKVADFGFSKYAPQEGDSYVSLEVRGTAGYLDPEYYKTQQLSEKSDVFSFGVVLLEIVSGREPLNIKRPRVEWSLVEWAKPYIRASKVDEIVDPGIKGGYHAEALWRVVEVALQCLEPYSTYRPCMVDIVRELEDALLIENNASEYMKSIDSLGGSNRYSIVMDKRGVPLTSTSAESTLPAQNVSHPQPR

SEQ ID NO: 34771 - protein, 444 aa, Arabidopsis thaliana
MATITVVKARQIFDSRGNPTVEVDIHTSNGIKVTAAVPSGASTGIYEALELRDGGSDYLGKGVSKAVGNVNNIIGPALIGKDPTQQTAIDNFMVHELDGTQNEWGWCKQKLGANAILAVSLAVCKAGAVVSGIPLYKHIANLAGNPKIVLPVPAFNVINGGSHAGNKLAMQEFMILPVGAASFKEAMKMGVEVYHHLKSVIKKKYGHDATNVGDEGGFAPNIQENKEGLELLKTAIEKAGYTGKVVIGMDVAASEFYSEDKTYDLNFKEENNNGSQKISGDALKDLYKSFVAEYPIVSIEDPFDQDDWEHYAKMTTECGTEVQIVGDDLLVTNPKRVAKAIAEKSCNALLLKVNQIGSVTESIEAVKMSKKAGWGVMTSHRSGETEDTFIADLAVGLSTGQIKTGAPCRSERLAKYNQLLRIEEELGSEAIYAGVNFRKPVEPY

SEQ ID NO: 34772 - protein, 437 aa, Oryza sativa Indica Group
MAAASLIKAPVGQNPARMGSGRSSGGGGVVRCSLQGAVVGGRAEWQSSCAVLSSKVAALGAASPHAAAPSFVNGHVAPLVPEQPAAAAEDGGAVLDLVPVSSVNGGGVAKNLPQPLRISDLSPAPMHGSQLRVAYQGVPGAYSEKAAGKAYPGCDAIPCDQFEVAFSAVELWIADRAVLPVENSLGGSIHRNYDLLLRHRLHIVGEVQLPVHHPLMALPGVRKECLTRVMSHPQALAQCEHTLTAMGLNVVREAFDDTAGAAEYVAANGLRDTAAIASSRAAELYGMEVLADGIQDDCGNVTRFVMLAREPIVPRTDRPFKTSIVFAHDKEGTSVLFKVLSAFAFRDITLTKIESRPHRHRPIRLVDDANVGTAKHFEYMFYVDFQASLAEPRAQNALAEVQEYTSFLRVLGSYPMDMTPMTAGSSSTVTSDDSSST

SEQ ID NO: 34773 - protein, 198 aa, Gibberella zeae PH-1
MASHDDDTMPEETQGYKLSQPKQSLAEYQQMDAGDESLQRYKESLGLGGGTDISDPNDPRVCIILSLTMDSPGRPPVTIDLSTPGSETTLKDKPFNIKEGAKFTMSAKFKVQHEILSGLHYVQVVKRKGIRVSKDSEMIGSYAPSTDKQPTYIKKFQEEEAPSGMLARGHYNAISSFVDDDKKKHLEFEWSFDIAKDW

SEQ ID NO: 34774 - protein, 287 aa, Fulvimarina pelagi HTCC2506
MARSALLQVMTQAATKAGRVLARDFGEVQHLQVSMKGPADFVSSADRKAEEVVFKELSRVRPDWGFLMEERGAIEGRDPQHRWIVDPLDGTTNFLHGLPMFSVSIALERDGEIVAAVVFNPAMDEMYTAEKGGGAYLNDRRIRVASRKTLPEALFGTGIPFLGMGDHAGFLYELRQIMGETAGVRRYGAASLDLAFVAAGRLDGFWERALNPWDIAAGVLLIKEAGGIVTGLEGESFDHIRGDIACGNEFIHKALIGQLKQASTKRRAARRAGESRETGEVDPNAPA

SEQ ID NO: 34775 - protein, 491 aa, Oryza sativa Indica Group
MPAASSLVVGVAFTAAVAVAVAAAVARRAWRQQGPPVVFAGKPFIHYIRDLRREYGPIVKLQMGVRTLVVISSAELVHEALVEKGREFATRPAESPIRSIFSSGKFTVNSAVYGPEWRSLRRNMVSGMLSAARLREFRPARLRAMERFVARVRAEAAASRDGASVWVLRNVRFAMFCVLLDMTFGLLDLDEELVVRVDAVMKRVVLAVAARIDDYLPFLRPFLWRQHRQAVALRREQIDTVLPLINRRRAIVRGMRAGSPPDPAVAAPYSYLDSLLELRVEGREAMIYGGTDTTATAIEWSMARVMDNPSIQARLHGEIMQRVGDARPVDDRDTDGMPYLQAFVKELLRKHPPTYFALSHAAVEPGSKLAGYDVPVDANLDIFLPTISEDPKLWERPTEFDPDRFLAGGETADITGSAGVRMIPFSAGRRICPGVGMGTAHIALMVARMVQAFEWRAHPSQPPLDFEDKVEFTVVMKRPLLAMVTPRKLSF

SEQ ID NO: 34776 - protein, 283 aa, Thermobifida fusca YX
MTTPLVPGRISPPRTVPPSIPRPEYVGKKHPVKGVAGDVQTPETIEAMRVAGRIAAQALQEVGKHVKPGVTTDELDRIGHEFLCDHGAYPSPLGYKGFPKSLCTSINEVICHGIPDDTVLQDGDIINIDVTAYIHGVHGDTNATFLVGDVDEESRLLVERTREALMRGIQACKPGRQINVIGRVIESYAKRFGYGVVRDFTGHGVGPEFHSGLIIPHYDDPSADTVMVPGMTFTIEPMITLGTIDYEVWDDGWTAVTKDRKRTAQFEHTLVITDDGAEILTLP

SEQ ID NO: 34777 - protein, 356 aa, Glycine max
MKKGNLGLGLKLSVPVSDQSNFAKFLTESGTFKDGDLLVNRDGVRIVSQNDVEAPPPIKPTDNQLALADIDVIKVVGKGNGGVVQLVQHKWTSQFFALKVIQMNIEESMRKQITQELKINQQAQCPYVVVCYQSFYENGVISIILEYMDGGSLADLLKKVKTIPESYLAAICKQVLKGLVYLHHERHIIHRDLKPSNLLINHIGEVKITDFGVSAIMESTSGQANTFIGTCNYMSPERINGSQEGYNFKSDIWSLGLILLECALGRFPYAPPDQSETWESIYELIEAIVEKPPPSPPSEQFSTEFCSFISACLQKDPKDRLSAQELMAHPFVNMYDDLEVDLSAYFSNAGSPLATL

SEQ ID NO: 34778 - protein, 312 aa, Physcomitrella patens subsp. patens
MEQKTVTLNSGHKMPMVGLGVWRADPGVIHNVILEAIKIGYRHLDCAADYGNEKEVGAALADAFKQGLVKREEMFITTKLWNSDHGHVREACEDSLKNLQLDYLDLYLVHFPVATRHTGVGTTSSALGDDGVLDIDVTISNETTWHAMEDLVSAGLVKSIGISNFDIFLTRDCLAYSKIKPAVNQIETHPYFQRDSLVKFCFKHGISITAHTPLGGGASNVEWFGSTSALEDPVLKDIGKKYNKTAAQIALRWGIQRNTVVIPKSNKVERLKENFDVYDFQLSEDDMKTISSLDKKMRTNQPACFWKIDLFA

SEQ ID NO: 34779 - protein, 124 aa, Azoarcus sp. EbN1
MAISKEDILEAVGSMTVMELNDLVKAFEEKFGVSAASMAVAAPGAGAAAAPVEEKTEFDVILLAAGEKKVEAIKVVRAATGLGLKEAKDLVDGAPKAVKEGISKADAEAIKKQLEDAGAKVEIK

SEQ ID NO: 34780 - protein, 181 aa, Brassica napus
MAYSMLSSAAVVTSPAQATMVAPFTGLKSSSAFPVTRKANNDITSIVSNGGRVNSMQVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 34781 - protein, 160 aa, Oryza sativa Japonica Group
MSGKDQKKAAALEEKLELLRSVTKSSAANETSILVDASKYIKELKDKVSQEPEQLGSTSSSMPMPRVSVSSVELEKKRGFRINVSMEKSQPELLTSVLEAFEELGLDVLDADVSCADDTAFRFEAFGSSQSEAAERSVDEQMVRHAVLQAIKKCMDGSSI

SEQ ID NO: 34782 - protein, 328 aa, Petunia integrifolia subsp. inflata
MAVNGASSGGLIVSFGEMLIDFVPTVSGVSLAEAPGFLKAPGGAPANVAIAVTRLGGNSAFVGKLGDDEFGHMLAGILKENGVKAEGINFDTGARTALAFVTLRADGEREFMFYRNPSADMLLTPDELNLDVIRSAKIFHYGSISLIVEPCRSAHLKAMEVAKEAGALLSYDPNLRLPLWPSAEEARKQIKSIWDKADVIKVSDNELEFLTGSDKIDDESAMSLWHPNLKLLLVTLGEKGCRYYTKNFHGGVEGFHVKTVDTTGAGDSFVGALLTKIVDDQSILEDEARLKEVLTFACACGAITTTKKGAIPALPTESEALTLLKRGA

SEQ ID NO: 34783 - protein, 480 aa, Oryza sativa
MASSMAYIALLCAALAAVVALLRWAYRWSHPRSNGRLPPGSLGLPVIGETLQFFAPNPTCDLSPFVKERIKRYGSIFKTSVVGRPVVVSADPEMNYYVFQQEGKLFESWYPDTFTEIFGRDNVGSLHGFMYKYLKTLVLRLYGQENLKSVLLAETDAACRGSLASWASQPSVELKEGISTMIFDLTAKKLIGYDPSKPSQVNLRKNFGAFIRGLISFPLNIPGTAYHECMEGRKNAMKVLRGMMKERMAEPERPCEDFFDHVIQELRREKPLLTETIALDLMFVLLFASFETTALALTIGVKLLTENPKVVDALREEHEAIIRNRKDPNSGVTWAEYKSMTFTSQVIMEIVRLANIVPGIFRKALQDVEIKGYTIPAGWGIMVCPPAVHLNPEIYEDPLAFNPWRWQGKPEITGGTKHFMAFGGGLRFCVGTDLSKVLMATFIHALVTKYSWRTVKGGNIVRTPGLSFPDGFHIQLFPKN

SEQ ID NO: 34784 - protein, 382 aa, Zea mays
FRRTSNPSGDGVRGGGHTEALLLRGPGPISRLLPDGHQACFPPPRALAPPRQAAPRLRPRRRHRRLPEEEMRAKKEELYCVACNKKFKSDKQWKNHEQSKKHRDKVSELRMAFREEESLKEAEEGEGDWNEVDVGFDFKPTQESDDESAFSDAAEELAEEFEEGLEVHDKENGDKDFDSAEQEVGSYDEASVLEAMLSSCKNRKGGYVAPPEEALSGTAEDDDHHRSSEVNNAKRKGRRRRAAKKEQDESNYAGNEHHGKCEVQPEGSVHGNDVDDIMEGPSSSNVNNGSVSKGDKQNGENTNPKKNKKGTKKKPTVSTDQKSMSKADQKSTSKGKKQKEVSKAPSNDCDTCGGTFESRNKLFSHLEETGHAMLKTRQKNRR

SEQ ID NO: 34785 - protein, 145 aa, Triticum aestivum
  misc_feature (91)..(91): Xaa can be any naturally occurring amino acid
  misc_feature (103)..(103): Xaa can be any naturally occurring amino acid
  misc_feature (116)..(116): Xaa can be any naturally occurring amino acid
MAPTVMASSATSVAPFQGLKSTAGLPVSRRSSSAGLGSVSNGGRIRCMQVWPIEGIKKFETLSYLPPLSTEALLKQVDYLIRSKWVPCLEXFNKVGFVFREHXSSPGVLTMGRYWXTMWKAGYVPGWTDATQGAQTKVGGGQRKE

SEQ ID NO: 34786 - protein, 184 aa, Vibrio cholerae O1 biovar eltor str. N16961
MMSSIRSYKGIVPKLGEGVYVDSSAVLVGDIELGDDASIWPLVAARGDVNHIRIGKRTNIQDGSVLHVTHKNAENPNGYPLCIGDDVTIGHKVMLHGCTIHDRVLVGMGSIVLDGAVIENDVMIGAGSLVPPGKRLESGFLYMGSPVKQARPLNDKERAFLVKSSSNYVQSKNDYLNDVKTVRE

SEQ ID NO: 34787 - protein, 85 aa, Petunia integrifolia subsp. inflata
MSDQRNERPLPRFGEWDVNNPAAAREFSVIFDRARNAKKDVNNDSPWKNKERETTPFTVKSDPQLRKSSSKQKWLCCGHPSYAES

SEQ ID NO: 34788 - protein, 453 aa, Oryza sativa
  misc_feature (85)..(85): Xaa can be any naturally occurring amino acid
  misc_feature (139)..(139): Xaa can be any naturally occurring amino acid
MADGASANPGDPPSPASARSGQRKHVPDWLNSPIWSAPPPPARHRAPSPPRPPPPPPPPTQPAPPPPPPARSGGGGGSDDGSDGXDDEGAASSSRPHLVPEFTVALGRKVVDLAELRRLACQGVPDAAGVRPVVWKLAXLLGYLPTDHALWAYELEKKRSQYSAFKDELLVNPSEVTRRMEEMTISKGNRHNSEGTGVLPRAEIVHDEHPLSLGKTSVWNQFFQESETIEQIDRDVKRTHPEMQFFNGDSSDALSNQESLKRILTIFAKLNPGIRYVQGMNEVLAPLYYVFKNDPEENNAESAEPDAFFCFVELLSGFRDNFCKQLDNSVVGIRSTISKLSQLLKRHDEELWRHLEVVTKVNPQFYAFRWITLLLTQEFKFRDCIHIWDALLGDPEGPQATLLRICCAMLILVRRRLLAGDFTANLKLLQSYPPTNIDHLLHIANKLRGPIPY

SEQ ID NO: 34789 - protein, 69 aa, Triticum aestivum
HPYPRKGRAMASGAVRPKLAYIVCYVKDVPKSAAFYADAFGYSVRRVDDSHKWAELDTGSTTIAFTPLH

SEQ ID NO: 34790 - protein, 356 aa, Magnaporthe grisea
MSRANPPSNSSGSRKISFNVSEQYDIQDVVGEGAYGVVCSAIHKPSGQKVAIKKITPFDHSMFCLRTLREMKLLRYFNHENIISILDIQKPRSYETFNEVYLIQELMETDMHRVIRTQDLSDDHCQYFIYQTLRALKAMHSANVLHRDLKPSNLLLNANCDLKVCDFGLARSAASQENNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEEALKHPYLEPYHDPDDEPTAPPIPEEFFDFDKHKDNLSKEQLKQFIYQEIMR

SEQ ID NO: 34791 - protein, 258 aa, Vibrio cholerae O1 biovar eltor str. N16961
MLTDKQFLRYQRQISLAELGEEGQQKLLNSRVLIVGCGGLGNVVAPYLVGAGVGQVIIADSDRLELHNLHRQICYHEAQIGHNKAELLARYLRELNSEVRVRVIAREVDELILNLEINQVDLVLDCSDNLPTRHAINRACYAAQRPLISGAVIGWEGHLMAFDYRQSTPCYQCVVPDMAERQRCSDRGVIGPVVGMIGNGQALIALHALMGSAHFPANQLLRFDGKSMNWQSLQLHPDKVCPVCSVSSPAQPKEPQPC

SEQ ID NO: 34792 - protein, 629 aa, Zea mays
  misc_feature (35)..(35): Xaa can be any naturally occurring amino acid
MPKRDKAASPRASPPHTPPPGTDSEAEEANRRPGXASAAEMGTYKCCIFFTRRFALGDTSTPEDVRALFSLYAGGSPYMLADDLRRYLAAWGGADGEVPEQIIDRILQDRSRTPRFGRPALTVDDFLHFLFSEDLNPPLRYSKVHQDMNAPLSHYFIYTGHNSYLTGNQLSSDCSDVPIIKALQLGVRVIELDIWPNSCKDDIDVLHGRTLTAPVSLIKCLRSIKEYAFVASPYPVIITLEDHLTPDLQERVAKMVLEVFGDILYYPESKHLQEFPSPEALKGRVMLSTKPPKEYLEAKGDTMKEKEIEARIKRGEREAAAWGVEVPDIQDEMQVADKDEDELLYRERGADGDDGKETKHVAAEYKHLITIKAGKPKGPLVDAIKNDPDKVRRLSLSEQELAKVAAHHGPNIVSFTHRNMLRIYPKGTRFNSSNYNPFLGWVHGAQMVAFNMQGYGRALWLMHGFYKANGGCGYVKKPDFLMQTCPDGKVFDSKADLPVKATLKVKVYMGEGWQKDFKQTHFDSYSPPDFYVKVGIAGVPLDSVMRKTKAVEDSWVPVWEEEFAFPLTVPEIAVLRVEVHEQDVNEDDFGGQTALPVAELRPGIRAVPLFDHKGLKFKSVKVLMSFEFA

SEQ ID NO: 34793 - protein, 469 aa, Zea mays
METADYSGKLFVGGISWETDEDRLREYFGRFGEVTEAVIMRDRSTGRARGFGFVVFADATVAERVTIEKHMIDGRMVEAKKAVPRDDHSIVSKSNTSSIGSPGPGRTRKIFVGGLPSNVTEADFRGYFEQFGVITDVVVMYDHNTQRPRGFGFITYDSEDAVDKALHKSFHELNGKMVEVKKAVPKEQSPGPVARSPAGVGQNYAMNRVHSFLNDFNQGYNPNPIGGYGMRVDGRFGQLSGARNGLSSFGPGYGMGMNVEGRMSGTFGANSGFISNSNGRQMGSYFNGSSNRLSSSIGYLGYDSGSMLSSMSRNFNAGVNYPINPTNMSAFAALGNGGGVNYMGLPSIAPELAQLGNISSLGSGNFSRGAGVNNLSLPSGSYGRSNSTGTIGEPFSASGNAYEVNNPDTYGNNSIYGGTSWRFPSSEVDVPSFSHDLGNVDPNMKSDISANYMGNYSVSNNQPSRGITS

SEQ ID NO: 34794 - protein, 574 aa, Synechocystis sp. PCC 6803
MLRLEHIRKIYPTGEVLKDVNWEVKPEERVGLVGVNGAGKSTQLKIIMGEVEATAGEIIRPAALKIAHLTQEFDVTPSRTLREEMWTVFTEANQVQDAMHHVHQEMEVADPDTLENLIHKLDKLQRQFEGLDGYRLESQIERILPEIGFEPEDGDRLVSSFSGGWQMRISLGKILLQEPDLLLLDEPTNHLDLETIEWLETYLKGLKTPMVIISHDREFLDRLCTKIVETERGISTTYLGNYSSYLVQKEEGNLALASAYEHQQKALAKQQAFVDKFRASATRSTQAKSREKQLEKIERVEAPVGGVRTLKFHFPPAPRSGRQVALIEDISHSFNDKLLFLGANLEIERGDRIAFLGPNGCGKSTLLRMIMGMELPDEGQIKLGEHNILPGYFEQNQAEALDLEKTVMETIHDEVPDWKNEEVRTLLGRFLFSGETVFKKVAALSGGEKARLALAKMLLTPANFLILDEPTNHLDIPAKEMLEEALQEYEGTVVLVSHDRYFISRVANKIVEVRDGELVAYSGDYHYYLEKLEVEKAEEKRRLAAEQAAKKQAEKRAKQAAKKAEQKSKKVIAP

SEQ ID NO: 34795 - protein, 574 aa, Oryza sativa Indica Group
MEIARVVAPPLRLAWCPASRRWGRRKGRPPCPSSLPGPRHDHAVKRPGGEAAGGRSVNGAAPAPAPAPAEAPAKAPQRRQRRGPHDVEDEAWGLLRESVVRYCGSPVGTIAACDPNDASPLNYDQVFIRDFVPSGIAFLLKGDYEIVRNFILHTLQLQSWEKTMDCHSPGQGLMPASFKVRVVPLDGDDDVTEEVLDPDFGEAAIGRVAPVDSGLWWIILLRAYGKCSGDLSVQERIDVQTGIKMILKLCLADGFDMFPTLLVTDGSCMIDRRMGIHGHPLEIQALFYSALLCAREMLTPEDGSADLIRALNSRLIALSFHIREYYWLDKRKLNEIYRYKTEEYSYDAVNKFNIYPDQIPPWLVEWIPPKGGYFIGNLQPAHMDFRFFSLGNLWSIVSSLATSHQSDAILDLVEAKWSDLVADMPMKICYPALEDQEWKFITGSDPKNTPWSYHNGGSWPTLLWQLTVACIKVDRSEIAAKAVEVAERRIANDKWPEYYDTKRARFIGKQSRLFQTWTIAGFLVAKQLLENPDKSRILWNNEDEEILNAMNRMTDASNLKRRRGRKGLKKTYIV

SEQ ID NO: 34796 - protein, 503 aa, Debaryomyces hansenii CBS767
MPQDTETMYSGRVVNKVYNQDFIIDRRFKIVKELGHGAYGIVCSAKYDDGSDNEDGSYVAIKKITNIFSKKILCKRSLRELKLLQFFRGHKNITCLYDLDIIPNPITGEFNEIYLYEELMECDMHQIIRSGQHLTDSHYQSFIYQTLCGLKYIHSADVLHRDLKPGNLLVNADCELKICDFGLARGFLECPEQNVGFMTEYVATRWYRAPEIMLSFTNYTKAIDIWSVGCILAELLGGKPIFRGKDYVDQLNQILLILGTPKESTLTKIGSVRAQNYVRSLPFMRKVHYSELFPTANPLALDLLEKMLTLDPYERITVEEALNHPYLSVWHDPQDEPECQIKFDFKSFETVDDMKSMKNLIIDEVKNFRDFVRKPLQEQQQIQLQMQIQQQEREKQKNDSMDLSTPINQQQFNEMLSSSSNSNSNSNSNPETGVNTDTPKMTNDNDLQYYQSIPKPQELDEFTFSHNSKGLSPTDNNDNHTDLFRLEEELGFGLDGAGMFNNI

SEQ ID NO: 34797 - protein, 143 aa, Triticum aestivum
ARMRERGVTVRTATPNAGAPFGSLVASRGLVPLHVGPARRLPFLEGTLDVVHAGRDLTGGWMVPGDAVALEFALFDVYRVLRPGGLFWLDHFVFPGTQLNSTYAPMLHRVGFKRLRWNAGQKPDGGVEKNEWYLSALLQKPMT

SEQ ID NO: 34798 - protein, 542 aa, Leuconostoc mesenteroides subsp. mesenteroides ATCC 8293
MTTTGYSILRNPFLNKGTAFSAAEREQLGLTGTLPSQVQMIEEQAEQAYKQFQAKSPLLEKRTFLMNLFNENVTLFYHLMDQHVSEFMPIVYDPIVAESIEQYNEIYTNPQNAAFLSIDHPENIESSLKSVADGRDIKLVVVTDAEGILGMGDWGVNGVDIAVGKLMVYTAAAGIDPATVLPVSIDAGTNNKILLENPLYLGNKHERIAGEKYLEFIDKFVTAEQKLFPASLLHWEDFGRSNAQVILDKYKDSIATFNDDIQGTGMIVLAGIFGALNISKEKLVDQRFLTFGAGTAGMGIVNQIFSELKQAGLSDAEARSHFYLVDKQGLLFDDTEDLTEAQKAFTRSRKELVNSEQLDNLEAVVNEIRPTVLIGTSTQPGTFTEAIVKSMAQNTERPIIFPLSNPTKLAEATAENLIKWTDGKALIATGIPAANVTYKGVTYKIGQGNNALIYPGLGFGLVASTAKLLTQETISAAIHALGGLVDADEPGAAVLPPVSNLTEFSQKIAEITAQSVLKQGLNREKIADPKQAVQDAKWSAEY

SEQ ID NO: 34799 - protein, 328 aa, Lactobacillus sanfranciscensis
MDLFESLKSKIKDRKIKLVFPEGEDERIISAASRLANDDLAIPVLLGNEAEIKKTADALNVSLDGIEIVDIENVPGEVRQQMVQAIVERRKGKTTADQAAQWLKDPNYFGTTMVYMDDVDGMVSGAAHPTGDTVRPALQIIKTKPGVNLISGSFVMQKGDQRYLFADCAININPNETQLAEIAVESGKTARLFDIDPRVALLSFSTNGSAKSPEVEKVHNATKLAQEMDPAMPIDGEMQFDAAFVPAVAKAKYSDSKVAGHATVFVFPELQSGNIGYKIAQRMGGFEAIGPILQGLNKPVSDLSRGCNAEDVYKVSIITATQALADKD

SEQ ID NO: 34800 - protein, 541 aa, Xylella fastidiosa Ann-1
MSYLVLARKWRPKRFAELVGQEHVVRALSNALESGRLHHAFLFTGTRGVGKTTIARIFAKSLNCEQGTSADPCGRCTACLDIDVGRYIDLLEIDAASNTGVDDVREMIENAQYMPSRGKFKVYLIDEVHMLSKAAFNALLKTLEEPPPHVKFLLATTDPQKLPVTVLSRCLQFNLKRLDEEQIQRQIAKILTAEQITADDAAIIELSKAADGSLRDGLSLLDQAIAYAGGTLREGAVRDMLGTVDRTQVEVMLAALIAGDGDRLLRVIATLAEFSPDWGGVLEALAEALHRIQVQQLVPSVVFAGDGLNVALLAEQTQPEVVQLWYQMAINGRHDLHLAPSPRVGFEMAVLRMLAFRPVPMVAPGMVSTEGQSVNAPLMASVGKDAHGANGYTMSQSPSDLQKVRVGSLDGKITDVGQWLALVERIELSGPSKQLAAHAAFVSHENNVLSLALAPEFEYLQSTRSVADLTQGLTRLLGQAPEVKIEARNIQVETLHERTYRQKSERQQLAEEAFMSDHVVQHLIYQQAAKVVTDSIHPYDE

SEQ ID NO: 34801 - protein, 466 aa, Bordetella petrii
MSNQDENLDHTPLKRVMGPKLLLLFIIGDILGTGIYALTGQVAAEVGGAAWAPFLVAFVVALLTAFSYLELVTKYPRAAGAALYVHKAFRVHFLTFIVCFTVMCSGLTSAATASRAFSANLFAAIGMDTDPTLVTMGALGFMLLVMIVNFRGASESVKANVVLTLVELSGLLLVIILGFYAIAGGQADFSRVVAFETPENKSVFLAVTSATALAFFAMVGFEDSVNMAEETHEPHRIFPKVMLTGLGITAVIYVLVSICAVALIPVGELAASSTPLVLVVQRAAPNLPMDTIMPIISMFAVANSALINMMMASRLLYGMSRQGVLPKFLARVHTRTRTPWSAILFTTALALGLILLVSASNSKAISALGGTTALLLLGVFAFVNVAVLVLRRDPVKHEHFRANTVLSCLGAAACLFLVTPFTGRDPIQYQVAGWLLALGVVMWGITLLVHRKEDRHHLDPEHLVDE

SEQ ID NO: 34802 - protein, 398 aa, Arabidopsis thaliana
MVLISETSDDGSTGGDHQIKKPKKEEDRNKKLKEKVQVSLPIPEELILRCFLLVRRCHHPSLSLVCRSFHSLMSKLYDDRLRLGYTENVLYAYVGFPPVENPSWYILHRKPYRNLPNTISLKLCKIDSLPPMPWGSTVVTIGSDIYVIGGRVGERRISDVTHINCRFHEYRSLPSMKMARCRAAAGVIDGKIYVIGGRKVRTSDWVEVFDLKKQSWSSVPGPYPEAFGRGEFLTYAVMKEKIYCLDLTRNIHIYDPKESKWESWTHGPLSASWNDSSCVVDNLLFCINTSVYFLGWPIKIYDPEKKTWFYLQGLQGFPANGLFVDGYKMANFGGKLVILSADVHRLRRYDCRKREIWCIEIAWERKEDGTFWGKVESVAVVLTPAKTTSVDICGTVTV

SEQ ID NO: 34803 - protein, 466 aa, Escherichia coli O6
MDKKQVTDLRSELLDSRFGAKSISTIAESKRFPLHEMRDDVAFQIINDELYLDGNARQNLATFCQTWDDDNVHKLMDLSINKNWIDKEEYPQSAAIDLRCVNMVADLWHAPAPKNGQAVGTNTIGSSEACMLGGMAMKWRWRKRMEAAGKPTNKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQVAAYLADEIAKLGPYEFICTGRPDEGIPAVCFKLKDGEDPGYTLYDLSERLRLRGWQVPAFTLGGEATDIVVMRIMCRRGFEMDFAELLLEDYKASLKYLSDHPKLQGIAQQNSFKHT

SEQ ID NO: 34804 - protein, 555 aa, Dunaliella salina
MARLVLLGALLGALCATAVQGSLDGSQVEAGLGRQLTQDKPHEYNYNRHGIDWRDEGLDNCAGSMQSPINIDMATLNRGEERSDVSGLYLNGLASPAYDVAADVTVNAEQDMKITFKDVAQNNMPAIKIDGSDMLFKPVQLHFHHFLSEHAINGAHYPLEAHLVMGDASGNTNQLAVLGIMYQYGEQPDDFVRRLQTKTIDEIATNGAGYGETVNVTDLSVNIMKDVLPPTHHNYVGYDGSLTTPPCDERVKWHVFTEPRTITTGQLEKFLMITKRGHTDAIVTNNRIVQPIGRPLYHYKLTPASYNYARKGIDWREAGLDNCAGDRQSPINIDTTDLQPGAVSGISLNGLESQSFTFTDAYVNLEQDMKVSFTAPTNNLPTVNIDGNDESFRPIQLHFHHFSSEHTVDGMIYPLEAHLVMASQAENSNQLAVIAIFYQYGSEADDFLTRLHTEAISAQQGNANWGDNNVPINLPITFATDLMPSSTEHWAYEGSLTTPPCDERVRWIVMKEPRTTTAEQMETFKTATVNAHYAAEIANNRAIQERNSRPISSIP

SEQ ID NO: 34805 - protein, 369 aa, Triticum aestivum
RAGLCSALPVFLVAPLAAGITLADSDHGLSAATPSQSSLPPSATPAMDDPGFEIECEIPGVVRVHKSGRVVRLNGTETVPPSPSGDPANGVASKDVVLDPAANISARLYLPAATAAEPGKKLPVVVFFHGGAFMIYTAASPLYHKYAASLAAAVPAVVVSVDYRLAPEHPVLAAYEDAFAALKAVVSSCRLDGAEPWLAGHGDASRVVLAGDSAGANMAHRTAVRLRKERIEGYGDKVSGIALLHSYFWGKEPVGGELTDAAIRGGLDQVWHVACGGKLGLDHPYINPAASPEELGQLGCDRVLVATAEHCWFVERSRAYAAGLKACGWGGELRFYETKGDGHVYFLLKPDCDNAAKELTVVADFVRRC

SEQ ID NO: 34806 - protein, 112 aa, Triticum aestivum
  misc_feature (99)..(99): Xaa can be any naturally occurring amino acid
  misc_feature (104)..(104): Xaa can be any naturally occurring amino acid
MALAAIYNLFIINKSGGLIYYKDYGSAGRMDTNDSLRLASLWHSMHAISQQLSPTTGCTGIDLLQAHNFDLHCFQSLTGTKFFVVCETGAPNMEMLLKXIYELXTDFVLKIL

SEQ ID NO: 34807 - protein, 220 aa, Zea mays
MASATGGSSSEMAVDHATGLGTVEKPRFDALMPSEMSGGRTQFRKVTVPQHRFAPLKRCWMEIYTPVYEHMKIDIRMNLKARRVELKTRQDTPDVSNLQKCADFVRAFMLGFDIADAVALLRLDDLYVDSFEIKDVKTLRGEHLSRAIGRLSGKGGKTKYAIENSTRTRIVIADTKIHILGSFVNIKVARDSLCSLILGSPAGKVYSKLRAVSARLAERY

SEQ ID NO: 34808 - protein, 484 aa, Streptomyces coelicolor A3(2)
MTLLDSAVWGGKFSSDGWQGSPTEQPVTEPATGDRLGTVGLASAEDVNRAAARAAEAQRTWAATSPQRRAAVLRRAGELFTEHAAEIEDWLVREAGSVRSKAAFEAGLAIGECFECAGLPTHPQGEVLTSEDARWSLARRRPAGVVSVIAPFNFPLILGLRSVAPALALGNSVLLKPDPRTAVSGGVVIARIFEEAGLPAGVLHLLPGDGSVGRAVVEAPEVRVISFTGSTPVGRAIGEQAGRLLKRAHLELGGNNALVVLPGADVAKAASAGAFGSYLHQGQICMTTGRHIVHESLVEEYTAALAAKAEALPVGDPAREDVALGPIIDRRQLERVHGIVTDSVAAGAKVAAGGEIDGAGYRATVLTGLTTDMPAWREEIFGPVAPVISFATTEEAARIVNDCEYGLSVGILGDVGTAMKLADRIDSGKVHINEQTVSDEPNAPFGGVKASGTGSRFGGAAANVEAFTETQWLTVRPDIADYPF

SEQ ID NO: 34809 - protein, 522 aa, Oryza sativa Japonica Group
ISTMQFSSVFPLEGKACVSPIRRGGEGSASDRLKIGDSSSIKHDRAVRRMCLGYRGTKNGAQCVLTSDAGPDTLHVRTSFRRNFADPNEVAAVILGGGTGTQLFPLTSTRATPAVPIGGCYRLIDIPMSNCFNSGINKIFIMTQFNSASLNRHIHRTYLGGGINFTDGSVEVLAATQMPGEAAGWFQGTADAVRKFIWVLEDYYKHKAIEHILILSGDQLYRMDYMELVQKHVDDNADITLSCAPVGESRASDYGLVKFDSSGRVIQFSEKPKGTDLEAMKVDTSFLNFAIDDPTKFPYIASMGVYVFKRDVLLNLLKSRYAELHDFGSEILPRALHEHNVQAYVFADYWEDIGTIRSFFDANMALCEQPPKFEFYDPKTPFFTSPRYLPPTKSDKCRIKDAIISHGCFLRECTIEHSIVGVRSRLNSACELKNTMMMGADLYETEDEISRLLSEGKVPIGVGENTKINNCIIDMNARVGRNVVITNSEGVQESDRPEEGYYIRSGIVVILKNATIKDGKVI

SEQ ID NO: 34810 - protein, 129 aa, Buchnera aphidicola str. Sg (Schizaphis graminum)
MSLGMITMSITKEQILEAVSEMSVMNVVELISAMEKKFGVSANMSVNTNNNSEKSTIEEKTEFDIFLKSIGPNKVSVIKSVRSATGLGLKEAKDLVESAPTVLKENMSKNDAESLKKTLEDAGAEIEIK

SEQ ID NO: 34811 - protein, 397 aa, Desulfotalea psychrophila LSv54
MTEFRMPSLGADMKEGRLVEWKVKLGDQVKRGDIIAEVETAKGVIEIEVFTDGVIEQILVQRGEKVPVGTVLATIRTAGEQGKVPGEAAPPEPVFKYKACLIAAHREEPAAEPPPAVATAAGKRLRISPLARKLAAELAVELSTVQGTGQGGAITHADIKRAAATKKASAPQVPSAPGAAMRQAIATAMARSNREIPHYYLATRIDMSNTLRWLEAENKKRSIKERILPVVPLIKATALALAKVPELNGYWVDNRQQPEEAVHIGFVISLRQGGLVAPAIHHADLKSLPELMEALYDLITRARSGHLRSSELTDATVTITSLGDLGVEVVHGVIYPPQIALVGFGKILEQPWAKDGMLGIRPILTATLAADHRATDAHRGAQFLEALNHHLQKPEEL

SEQ ID NO: 34812 - protein, 250 aa, Buchnera aphidicola str. Sg (Schizaphis graminum)
MIKHKAQKILKKEPILSNFYQKSILNHKKLSHSLSCILSDKLSTSMISEKDIYNIFNKIYANNISIINSVVKDIKAASQRDPVVKHYLTPLLYLKGFHALEAYRLSHYLWNIKRYELSAYLQSRISTVFSVDIHPAASIGSGIMLDHATGIVIGEGVIIENDVSIFHSVTLGGTGSNTGKNRHPIIRKNVTIGAGAKILGNIEVGQGVKVGAGSIVLKNIPPFVTVVGVPAKIIKKIKNSNKNLFQKEKK

SEQ ID NO: 34813 - protein, 580 aa, Thermobifida fusca YX
MSTPVTMPDLGESVTEGTVTQWLKQEGDTVEVDEPLLEVSTDKVDTEIPSPVSGVLTKILVGEDETVEVGAQIAIITPAGEAPPAQPAPETAAEPAAQPEPEPEPAPQPAAEARTEPAAPVADAGAATPVTMPNLGESVSEGTVTQWLKQEGDTVEADEPLLEVSTDKVDTEIPSPVSGVLTKILVGEDETVEVGAQIALISPAGQAAAPAAPAAPQPAPEPKPEARPEPAPQPAAQPEAAARTEPAPQPRRTRDDETPTVDLETISGTGQVLGTDATSEGYVTPLVRKLAAQEGVDLSQVKGTGVGGRIRKQDVLEAARRMREQRQRAAAAPAPAAADTALRGRTETMSRLRQTFAEQIVESLHTAAQLTQVVEVDVTAIARLREQVGERFAAETGVELGFFPFFALAVVEALQRHPKLNAVIDGTEVTYHDTENLAVVVDTEQGVLAPVVKDAGRLSLRELARRIDDLGARARTARLVPDELSGGTFTMVDSGAYGALVETPIIHQPQVAVLSTGTVVKRPVVVEEPQLGEVITVRSMVYLSLSFDHRLIDGADAARFLSDVKRRLEEGAFEDAVGLK

SEQ ID NO: 34814 - protein, 459 aa, Thermobifida fusca YX
MSESGGTFDLVILGGGSGGYSAAIRASELGMRVALIEKDKLGGTCLHYGCIPTKALLHAGEVADTVRASEKFGVRASFDTIDMARVHEYKDKVVSGLHRGLTGLIKARGITLVEGEGKLTGVDEVTVNGVAYKGRHIILATGSQARSLPGLEIDGERIITSYEALRLDRVPKSAIILGGGVIGVEFASVWRSFGAEVTIVEALPHLVPAEEESSSKLLERAFRKRGIKFELGSPFESVKLTETGVSMTLASGKTVEGELLLVAVGRGPVSQGLGYEEVGIRLERGFVQVDENLHTGVGNIYAVGDLIPTPQLAHVGFAEGIFVAEHIAGLNPVNIDYDGIPRVTYSDPEVASVGITSKTAAERGIETTEFVYNLAGNGKSQILQTQGAVKVIAAKDGPVLGVHMVGSRVGELITEGQLIYNWEALPSEVAQLIHAHPTQSEALGEAHLALAGKPLHVHD

SEQ ID NO: 34815 - protein, 455 aa, Buchnera aphidicola str. Sg (Schizaphis graminum)
MLMKLRFSELLNNISSFEKKVNNLSDIFSYGCLISVNGLLLEVIGLTAPIGSRCYVERIIDGKILNISAEVVGFKKEKTLLFSLEETYGVFPGTRVFLKCFKNTYSITGKIPLSTELLGRVLDSKGRPLDGRSQLNPKFFTFLKSNVVNPLNRKPITEVLDTGIRAINALITVGRGQRIGIFSSSGLGKSILLGMMAKYTKADVVIIGLIGERGREVKDFIENILGSNGLSRSVVIAAPADVSPLLQIEAASYATSIAEYFRKKNKHVLLIMDSLTRYAMAQRAVSLSLGELPVSKGYPSSVFSKIPILVERTGNTDNYGSITSFYTVLTESEEDPQDPIAHICRSILDGHIVLSRHYAELGHYPAIDIENSISRVMPNIISKKQYSQACYFKKLIASYQRNRDLINIGAYLKGTDSTLDHAIKIWPILERFLQQKQSEKSSYLSSCEELNQIFI

SEQ ID NO: 34816 - protein, 345 aa, Ostreococcus tauri
MKSTISVRAKRSSARASRVATRAANAVNIADNVTQLVGCTPMVYLNKVSEGCGAEIAAKLEIMEPCCSVKDRIGWSMIAAAEQEGKITPGKTTLVEPTSGNTGIGLAFIAAAKGYKLTLTMPASMSLERRILLKAFGANLVLTDPAKGMKGAVGKAEEIAAKTADSYILQQFENPANPKVHFETTGPEIWEDTAGQIDIFVAGVGTGGTITGTGRYLKSKNPNCKIVAVEPTESPVLSGGGPGPHKIQGIGAGFIPGILDVDIIDEIVQVASDDAIAMAKQLALQEGLMVGISSGAAAVAAIQLAKRPENAGKLIGTVFPSFGERYLSSALFSTIRDEAEAMVAE

SEQ ID NO: 34817 - protein, 155 aa, Triticum aestivum
ELFSNEEKATHAHFDGCHHVIMYTKEDVATRVKEITGGKGVNVVYDSVGKDTYKASLECLASRGFLVSFGQSSGSPDPISMGDLASKSLFLTRPSVMHYTGTRDELLEAAGEVFANVANGVLHTRVKHTYPLSEAARAHADLEARKTSGSVLLIP

SEQ ID NO: 34818 - protein, 260 aa, Listeria monocytogenes str. 4b H7858
MPRLGFGVWKVQDGDEAVNSVKWAIEAGYISIDTAAAYKNEEGVGQAIKESGVKREDLFVTTKLWNAEQGYESTLAAFDESLRKLELDYVDLYLIHWPVKGKFKDTWRAFEKLYKDKRVRAIGVCNFHEHHLKELMEDAEIAPMVNQIELHPQLTQEPLRKFCAENNIVVEAWSPLGNGKLLSNPEIKAIADAHGKSVAQVILRWDLQIGVVTIPKSVHQERIIQNADIFDFELSEEEVAKISGLNKDERTGPDPDNFNF

SEQ ID NO: 34819 - protein, 192 aa, Campylobacter coli RM2228
MKKILLIDNYDSFSYTIVFYLKELGYQCKIIKNDEFKKAKDLARFDFSHLIISPGPNSPTESKLSLKAIQYFKKDKKILGICLGHQCIGEIFGGKITPMPYPMQGKISRLHLKKNAKKSLLFKGIKNKSKICLYHSLHISKMPKSCEILALNDKNIIMAIKHKKYEIYGVQFHPEAILSQNGKKLLKNFMKI

SEQ ID NO: 34820 - protein, 758 aa, Arabidopsis thaliana
MTSIIGAALPYKSPEKAIASSSYSAENDSSPVDAVIFAGTSLVLGTACRYLFNGTRVPYTVVLLVIGIFLGSLEYGTKHNLGKLGHGIRIWNGINPDLLLAVFLPVLLFESSFSMDVHQIKRCMGQMVLLAGPGVLISTFCLGALIKLTFPYNWDWKTSLLLGGLLGATDPVAVVALLKELGASKKMTTLIDGESLMNDGVSVVVFQLFFKMVMGHNSDWGSIIKFLVQNSFGAVGIGLAFGIASVFWLKFIFNDTVAQITVTLSASYFAYYTAQEWAGVSGILTVMILGMFFAAFARTAFKGDSHQSLHHFWEMAAYIANTLVFMLSGVIIAESVLSGQTISYKGNSWSFLFLLYLYVQLSRCVVVGVLYPLLCRSGYGLDWKESIILTWSGLRGAVSLSLALSVKLSQSSGNSYLSSDTGTRFLFLTGGIVFLTLVVNGSTTQLLLHLLRMDTLTATKKRILEYTKFEMMKTALKAFENLGDDEELGSADWPTVIRHISSLKDLEGRQVNPHDGYEAGSLDPTNIMDIRIRFLNGVQAAYWEMLDDGRITQCTANVLMQSVDEALDLVSTSSLSDWRGLEPRVHFPNYYKFLQSKIIPHKLVTHLIVERLESACYISSAFLRAHRIARQQLHIFLGNSNIASTVINESEVEGEEAKQFLEDVRDSFPQVLSVLKTRQVTHYVLNHLNGYIKNLEKVGLLEGKEVSHLHDVVQSDLKKLLRHPPSLKLPNVDDLITSNPLLKDRSSFRSLAIGETDA

SEQ ID NO: 34821 - protein, 436 aa, Ostreococcus tauri
MVTPLCTQLTYEGLIDEILGIEKGAVAIPQRAFDGDGKKKDVVKTDDPAKREEKYVRARAHKAGPIAMRPKLNNTDRLFDQIRDMNFGRACNVIRDLATAIKEDYDAIKGSNVEDQHVSEIGDFVKKIKANIGGTGLDLHATLAKYLIDCTKKKWFQNRLECERLCVEGEDLQTVMDHLETMIYRGDEAIPCLRMVVLACVCFNGFPPKMHEKIFSDLFNAFGPEILLKLEALETAGLFVDRETAKKRSRGFAQMRKPLKLIADGVDGSEEPNDITFAYSSSGYAPLSVRLVEAATRGSWKSIAPNNSGEDLLKHLPGELFEYTQGENDYGRPVNSKVSYREFNKRREKAAPLDGKDELWPKPTVMVFFIGGVTYAEIACLRHLAKKRQCGCNFVIGTTKIFQGDALIDTCGEDIERLETRLRVDEIAGRGERIRL

SEQ ID NO: 34822 - protein, 489 aa, Ixonanthes reticulata
GPEVSALEKKNLGRIAQIIGPVLDVAFPPGKMPNIYNALVVRGRDTVGEQINVTCEVQQLLGNNRVRAVAMSATDGLMRGMEVIDTGAPLSVPVGGSTLGRIFNVLGETIDDLGLVDTRTTSPIHRAAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPQIVGEEHYETAQRVKQTLQRYKELQDIIAILGLDELSEEDRLTVARARKIERFLSQPFFVAEVFTGSPGKYVALAETIRGFKLILSGELDSLPEQAFYLVGNIDEATAKATNLEMENNLK

SEQ ID NO: 34823 - protein, 489 aa, Malpighia glabra
GPGISALEKKNLGRIAQIIGPVLDVAFPPGKMPNIYNALVVKGRDTLGQQINVTCEVQQLLGNNRVRAVAMSATDGLMRGMEVIDTGAPLSVPVGGATLGRIFNVLGEPIDDLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPQIVGEEHYETAQRVKQTLQRYKELQDIIAILGLDELSEEDRLTVARARKIERFLSQPFFVAEVFTGSPGKYVGLAETIRGFKLILSGELDSLPEQAFYLVGNIDEATAKAANLEMENNLK

SEQ ID NO: 34824 - protein, 71 aa, Enterococcus faecium
RSVGVMGDGRTYDYTVGIRAVTSIDGMTADFARIPWEVLQKISVRIVNEVAHVNRIVYDITSKPPATVEWE

SEQ ID NO: 34825 - protein, 697 aa, Nicotiana tabacum
MNQHLKTLLLYLLITIFSCIQSVSAIDFVFNGFKPSDISLFGIATIESGILTLTNDSTFSIGRALHPSKIVTKAPNSSQVLPFSASFIFAMAPFKDRLPGHGIVFLFVPQTGIDGTTSSQNLGFLNFTNNGNPDNHVFGVEFDVFKNQEFNDINDNHVGIDVNSLASVFAHEAGYWPDKYNKFSDDGSLNEESFETLKLNNGRNYQVWIDYADFQINVTMAPIGMKRPKQPLLDFPLNLSQVFEEEMYVGFTASTGDLAQGHKILAWSFSNSNFSISDALITQGLPSFELPKDPVHRSKGFIAGMTVSLLFLVVVTAVVSLFLIKRNRRMKREREEMEDWELEYWPHRISYQEIDAATKGFADENVIGIGGNGKVYKGVLAGSSEVAVKRISHESSEGARQFLAEISSLGRLKHRNLVSLRGWCKKDRRSLILVYDYMENGSLDKTLFECDETNMLSFEDRIRILKDVASGVLYLHEGWEAKVLHRDIKASNVLLDKDMNARLGDFGLARMHDHGQVANTTRVVGTVGYLAPEFVKTGRASTQTDVFGYGVLVLEVMCGRRPIEEEGKPPLLDWLWELMRRGELINAFDRRLRTSQDFNEEEALRVLQLGMICASLDPKGRPTMRQVVKFFERNSEADESEAEDMDVYLLETLRSNTMLSNFSLSLSHGSHPTFEEIREGLSSSMSISWTNSLVDGR

SEQ ID NO: 34826 - protein, 441 aa, Debaryomyces hansenii CBS767
MLNTHNIHWLTPSKRIYDASDIPNFKRSIAYYKIRHTLSVVIEKVKGCDLPPGILDKSIVTRKINNIPPSNTTHSRPLDLPPPQGEEEGDKCNISHSSNQTIRGEANESNYEGLLRILEVLNRYIDETPPLKGPRRFGNLACRDWHEKMNTKMNDLLKDNIKIHNSSFNLEFDGFIKELKYYIENSFGSAIRLDYGTGHELSFLAFIGGLIDFKLLSLEELTGSDILTIFAKYYDLTRRLILVYSLEPAGSHGVWGLDDHYHLIYIFGAAQFNGDQDKIIPPVQQILTRPVLDRYKETNLYVNAISFIHKIKLGPFNEHSPIIFDIHSSVSLWSKVLSGLLKMFEVEVLGKFPVVQHFWFGSSLYPWRDFETNKELPIYKRDEDEMDEDSLGDFLNGNTGIKTTKHNISMTGAPWNLNATQRQDDLNSTTYRGRQPRLGRN

SEQ ID NO: 34827 - protein, 1341 aa, Magnaporthe grisea 70-15
MARSLRHKQWSEEDIELIYLNRRLRDCKSKSKGSSGSGGGGFNIICEGCIAQMLGLWYAYQKCRLPASEVASMLTPERLAELRHTHAADMAAIERETLEAMGGHDPPSLDCHLLRLWTGILPDHDDDPSLLRAKLMFVMRGSKYGLYDLVDGPKLKEWLQAMEQLQKHRVHELEQLEALRRRSNRSANSGSGSGSGSGSSSGSSSITSRSKTWSSCRCRYQDMGSLTPRGFWDFVKPRLHVSIGNAIESHYFANNNAHPVCAADVYITMAYAPLQADLEKMARTHRAELAVRDRLSMEMRLVEEAFRGLGRGRGSASVVEASAGGSSSSGGGDGGSNASKKSWVSAEDAEREAVRLAYERDSYGLGPLARAYTARQAARDAFARSGVPDIAMSALARAAACRRPQTPSAFPLLLPTQHRPLHTSSSSTSPPPRPPTAYSQTTSNLLIGAHTRVLYQGFTGRQATANAAASIAWGTNVVGGVSPGRSGTHETLGLPVLGSVREAAAALRPDATAIFVAADQTAAAIEEAVQAEIGLVVAVAEHVPMRDMLRVHDVLRTQSRTRLVGANSPGIVAPRGRCRVGFQPLGVFSPGKVGIAAKSGTLSYEVAASTTRAGLGQSLCVGVGGDVLAGTDMCEALGVLLRDDATEAVALVGELGGVGELEAAELIREYRRSGGRKPIVALLAGLGVESERVIGHAGAFWEKRTELARTKQRALEDIGVSLVTHPSEMGEVIKRKLQNDSKHMSDQDQQSRGEFLWTGFDADKGAVTQGQIDPAMVENRLEHSLQRNDISYQWDSSTSCHGITIDVDRSDRRLVAMVEKPGVRTRPVGVRHSSSIHDDDNAVALLTQELGDLRPSSSQKGGSLAPMPAQDTTQRLVRAMTELMHDPFLNTFRATLHIDQHALNNTGELLVRGYSLKPVPVVPAAPNSRCQIRDPVEAEAATHGITHFSLPTEPHQRRCIGVLSNGAGLAMNMIDALHAELGRRRVAAGGRGAEEDVAVANFLDTGGKATSETISRCLGWILRDERVRVVFVNIFGGIIRGDVIAEGLIMALKEMRQGGAVCGQGTGRAAVPLVVRIRGTREKEGQALLAESGLDGVYVFDDFHRAADMAVELAKDARIDDSKLTNGFPNPVRCAAVAGNLRTLCFLLVGDQESSYPLNPNTVDFGATPGLLRSALDATGPGSPAVLDFVHRLPLPQDEASDLVAMPLPESWRRQAVWNMSVLHKAAMGGSLRVLEAVLAAYEGTYDRRVLKKMLTPYVAEALLPAVRREHHHVLVRLVGLARRLGVDTNEAREEASRRRLESMVALLPYRRHLRKELKEYLGLESDDDDDDSPGPILEFV

SEQ ID NO: 34828 - protein, 560 aa, Salicornia bigelovii
MLSQSSSLFYSKMDMLSTSDHASVVSMNLFVALLCGCIVIGHLLEENRWMNESITALLIGLCTGVVILLISGGKSSHLLVFSEDLFFIYLLPPIIFNAGFQVKKKQFFRNFITIIMFGAIGTLGSFSVVSLGAMTIFKKMDIGSLELGDYLAIGAIFAATDSVCTLQVLNQDETPLLYSLVFGEGVVNDATSVVLFNAIQNFDLTNIDHRIAIQFSGNFLYLFFASTMLGAMTGLLSAYVIKKLYFGRHSTDREVALMMLMAYLSYMLAELFYLSGILTVFFCGIVMSHYTWHNVTESSRVTTKHAFATLSFVAEIFLFLYVGMDALDIEKWRFVSDSPGTSVAVSSILLGLLMVGRAAFVFPLSLLINFSKKSHSEKITFNQQIVIWWAGLMRGAVSMALAYNQFTRSGHTQLRGNAIMITSTITIVLFSTMVFGLLTKPLILFLLPHSKHFNSASTVSDLGSPKSLSLPLLDGGQDSEADMDNQDEAVNNRYEGTHNRTIARPGSLRMLLNAPTHTVHYYWRKFDDSFMRPVFGGRGFVPYVPGSPIEQNTDNLLDRT

SEQ ID NO: 34829 - protein, 443 aa, Leuconostoc mesenteroides subsp. mesenteroides ATCC 8293
MAEQYDVVVIGGGPAGNAMASGLKAQGKTVLIVEADLWGGTCPNRGCDPKKILLSAVEARQAAQHLQGQGLIGAPKIDWPALMALKRGYTDGINDGTLNGLKGQDIATLHGQAHFQSDNQLAVGDRVVSATDYVIATGQRPAILPITGHEYFKTSTDFLDLDQMPKRVTFVGGGYVGFELATIANAAGADVHVIHHNDRPLKAFDADLVKDLMAAMTADGITFDLNTDVQAITKTATGLQLTADNFELTTDLVISSAGRIPNADQLGLANVGVTFDRHGIQVNDHLQTANPHIYAIGDVSDTPVPKLTPVAGFEARYLVGELTHPGAAIKYPVVPTQVFAAPKLAQVGISAAAATEHPDEYRVNTLDMTKWFTYYRFGAQQAQAKVVVAKASGQVVGATLLSDVADEMINYFTLLIEKHVTLPDLQRLVLAYPTPASDLQYLY

SEQ ID NO: 34830 - protein, 152 aa, Oryza sativa
  misc_feature (50)..(50): Xaa can be any naturally occurring amino acid
MALEQTFIMIKPDGVQRGLIGEVIGRFEKKGFYLKAMKLINVEKSFAEKXHYADLSSKPFFGGLVEYIVSGPVVAMVWEGKQVVSTGRKLVGATNPLAAEPGTIRGDFAVDIGRNVIHGSDSVENARKEIALWFPEGIAEWRSNQHPWIYEV

SEQ ID NO: 34831 - protein, 342 aa, Xylella fastidiosa Ann-1
MDIPDVGHTVVKQPSVADVLAAQARLRRYLMPTPIHYAERFGVMLKLENLQRTGSYKVRGALNAMLVALERGDNRPVICASAGNHAQGVAWSAYRLGIQAITVMPHGAPATKVAGVSHWGATVRQHGQSYDEAYTFACELAEQNDYRFLSAFDDPDVIAGQGTVGIEITAHEPDVVIVPIGGGGLASGIALVLRSQGVRVIGAQVEGVDAMARAIRGDTREIAPVSTLADGVKVKIPGFITRHLCANLLDDVVIVREAELRETLVRLVLEEHLIAEGAGALALAAGRRVAGKRKCAVVSGGNIDAAVLAKLLSEVRPRPPRKPRRRSADRPNNCGNLPLPFN

SEQ ID NO: 34832 - protein, 707 aa, Magnaporthe grisea 70-15
MFNHRIHDKVTSNVLAWSAHASNEIISEDDAAPEADEPDLRPLGMSPATKKFQKSAVPRVPESASLLTKALQSPSEDDSHDNYSPSKISRRRRSFASTISIASTAEYSCDTGFTTPARTSSPSPRLAQKEVFESTAPRKEEKKRCISFACAAPRPTPVIAAPAPKPAAAEVPQKKSSIRFACNSRPATEQTKPVRNTPPPATLSTPPTVKKYRSPSANSRSARSVTPKRSSNSPVATRKGWFTADFKDLQAEGSRFHEFASDEVQDDDWIRQDKANQRRKLTIDDTLVKELAIRKLGKEAEEEAEQEEAEDDANDDEAADDLEDEDADDDEDDEDEEDEEDLDLDDDESGYGTEPESEGYRTDEEVGFADSDDEDDELVLWWPGTSSGSKTAIASLSRRMSIGQSLGNMSDSSAFSPGCTLQRRMKIPRSSPRATRRPGTPELPDSTDFVCGTLDEDRPLEDEYMSCMAAKRQEKLRLIPQDFDPSFPTSDPEDDDDEAFKPLHRISDEHVWLHGELEDLDHEGDERHDRSRKVTSPRRMHSPPPRARGRSPPPRRLFDRHSPPRRMRSPAPPMASASPQASPIGGQGVVFKSLAFRPGLTHTKSLPRAPAIFTHLKTQHQHAQQRKKSTVAHKDKRHVRGAIDIVKGLEQRRQRRREKLSRQQCNRARKGLAQEKRPAPGKGAERMRELGLLMAGKIGPGNYVLSV

SEQ ID NO: 34833 - protein, 312 aa, Symbiobacterium thermophilum IAM 14863
MPLAREAEAFLKQLAEAGGPALNELSPADARKMTEQMAAFGGDAEPVAGVVDRTVPGPAGKIPVRIYTPAGEGPFPVLLYFHGGGWVLGSPDTVHATCALLANRAGAVVVSVDYRLAPEHKFPAAAEDCYAATVWVAENARTIGGDPRRIAVAGDSAGGNLAAVVSLMARDKGYPDLAYQVLIYPVTDHNFDTPSYRENGNDYFLTTAMMQWFWDHYIRSEADGRDWRASPLQAADVSGLPPAFVITAEYDPLRDEGEAYARKLIEAGSAVTVKRYLGQIHGFCTLLGAMPAGRQALEDAAAHLRLAFAARE

SEQ ID NO: 34834 - protein, 395 aa, Methanosarcina acetivorans C2A
MNEQGLSEKEIFSYLENAKSEDTDYYRVLSSMCTHPHKIAVEANRLFIEANLGDLGLFAGASRLEQEVVGMLGELLHAPSIDVPFGGSCESSACGYLTTGGTESNIQAVRGMKNLVTTGKKELKGAPNIVIPESAHFSFDKVADMMGIEVRRASLDSEFRVDMASIESLIDANTIGLIGIAGNTEFGQIDPIDKLSEIALENELFLHIDAAFGGFVIPFLEKPQPFDFKLPGVTSIAVDPHKMGLSTIPSGALLFRSASFLDSLKVNTPYLTTKAQFTLTGTRSGASAAATCAVMKYLGNEGYRKNVQYCMQLTEKLVIEARKIGFEPLLEPVMNVVALKVPNPDFVREQMLERFGWNVSITRTPRALRLVLMPHNTLEDIEIFVQDLKEVTVEI

SEQ ID NO: 34835 - protein, 114 aa, Leavenworthia stylosa
LVEKFGIDPNNAFAFWDWVGGRYSVCSAVGVLPLSLQYGFSVVEKFLKGASSIDQHFKSTSLEENIPVLLGLLSVRNVSFLGYPARAILPYSQALEKFAPHIQQVSMESNGKGV

SEQ ID NO: 34836 - protein, 103 aa, Synechococcus sp. CC9605
MNALNEPMASYQITITTSEGSSSFACADDQYILDAAEEAGADLPYSCRAGACSTCAGKLSSGSLDQSDQSFLDDEQIAKGFALLCVAYPTSDCQIKGEAEEEL

SEQ ID NO: 34837 - protein, 635 aa, Ostreococcus tauri
MSDGPPAEVARPVDVTHPNDASADDVGAPGDWLFGPDAPPAKKKRKTLAHEAVYLDALPSASMYERSFMHRDVVTHAVFAPSHDFFVTASRDGHIKFWKKRNQGVEFVKHFRAHSSEIVGLCVSADGSACATIGEDKTCKVFDVVNFDMVMMLKLKFKPSACEFVYKRGDAVQAIAIGDDKGVIRVYDALSSSVEPVKTLENLHRSAITALRYNAAKQCVISAEEKGMLEYWSSRPEDEFAALTSSNNTGVDFKYKLDTDLFALAKGKTTAYTIEVSADGEKFSTTGEDRHVRIFRWKNGKLIKDIDETLAYAEDIQRSGNEKYALEDIDFGRRLAVEREMSTSLEKWAWPNALFDESGNFLIYATHLGIKVVNLVTNRCPRIIGKVENTERFTRLALFQGVPQKDKRARGSGKDVKVAEKDPTIVACAFNKVRMYIFSSREPEEGDDVATGRDVFNEKPRAEEMLASSSLPSARSGLATSAVIHTTLGDIHVDFFTNECPKTCENFSTHARNGYYDGIVFHRVIKNFMIQTGDPLGDGTGGHSIWGGEFEDEIVRDLKHDRPFTVSMANAGPNTNGSQFFITTVATPWLDGKHTVFGRVTRGSDVVKAIECAKCDKGDRPLETISMLSITLKYN

SEQ ID NO: 34838 - protein, 114 aa, Leavenworthia stylosa
LVEKFGIDPNNAFAFWDWVGGRYSVYSAVGVLPLSLQYGFSVVEKFLKGASSIDQHFKSTSLEENIPVLLGLLSVWNVSFLGYPARAILPYSQALEKFAPHIQQVSMESNGKGV

SEQ ID NO: 34839 - protein, 114 aa, Leavenworthia stylosa
LVEKFGIDPNNAFAFWDWVGGRYSVCSAVGVLPLSLQYGFSVVEKFLKGASNIDQHFKSTSLEENIPVLLGLLSVWNVSFLGYPARAILPYSQALEKFAPHIQQVSMESNGKGV

SEQ ID NO: 34840 - protein, 328 aa, Ostreococcus tauri
MGSKKPAYSTFSQQQISGRRPALSPVHTAKISFALAIPFMAVGGAVWHGVKDLQTLGYRYDDVTACSNGFFPTAAEEQSKISINGAGTTCSVTLTATEKLKAPVYVYYELGNFYQNHRAYVRDLDYFQLSEGASASQGLCTTNIKNATGADIVPCGVQAWSYFNDTYTVKLDGTTVAIDDNNIAWSADVNYRFGDYAPENMNTEQATRGGAQISGNSVRGDEHFVTWMRTAAFSNFRKLLGKIEVDIQEGTTITVDINNLYNTYKFNGEKHIVFATNSWVGGSNVVLPALYLLVGALFTCLGVFALVMEYYLKNAHSIGYAGYGIEEL

SEQ ID NO: 34841 - protein, 201 aa, Gibberella zeae PH-1
MSLYYGVGGIGSFLTIVGGYMLFTGSGESFDVGAFLEAVSPYTWATLGIAFCIGLSVVGAAWGIFITGSSILGGGVKAPRIRTKNLISIIFCEVVAIYGVIMAIVFSQKVENVSGADLYAAESYYTGYALFWSGITVGMCNLICGVAVGINGSGAALADAADPSLFVKILVIEIFSSVLGLFGLIIGLLVSSKAPAFGEKK

SEQ ID NO: 34842 - protein, 361 aa, Zea mays
DLSDLIGFLQTSKALQEFAGGAFFEVGEYTKYEKVKLPPRLCFLGGLTFMGKNEMPVIFPYSASLKKLDLQYTFLTTEDHCQLIAKCPNLMVLEVRNVIGDRGLEVVADTCKKLRRLRIERGDDDPGQEEQGGVSQIGLTAVAVGCRELEYIAAYVSDITNGALESIGTFCKNMYDFRLVLLDKQNKITDLPLDNGVRALLRSCTKLRRFALYLRPGGLSDAGLGYVGQYSGNIQYMLLGNVGESDNGLIRFAMGCANLRKLELRGCCFSERALAVAVLQMPSLRYVWVQGYRASQTGRDLMLMARPYWNIEFVPPRPESACRVMADGQPCVDTHAQVLAYYSLAGRRPDCPRWLVTLHPA

SEQ ID NO: 34843 - protein, 489 aa, Bischofia javanica
GPGVSALEKKNLGRIAQIIGPVLDVAFPPGKMPNIYNALIVKGRDTAGQQINVTCEVQQLLGNNRVRAVAMSATDGLTRGMEVIDTGAPLSVPVGGATLGRIFNVLGEPVDDLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPQIVGEEHYETAQRVKQTLQRYKELQDIIAILGLDELSEEDRLTVARARKIERFLSQPFFVAEVFTGSPGKYVGLAETIRGFKLILSGELDSLPEQAFYLVGNIDEATAKATNLEMENNLK

SEQ ID NO: 34844 - protein, 529 aa, Debaryomyces hansenii CBS767
MSSDTFHEFGVLFDRIQPYLTSLWAICIGAYILFSISTRINDRILMKKLGAKPMQMNAPNSFWGIPLMFRLLKAKREGTMVDVTKERYKELGVDTFNVNIAGTHAVVTRDPENIKAILATQFNDFALGKRHTHFKPLLGDGIFTLDGAGWKHSRTMLRPQFAREKVAHVKALEPHLQTLAKHIINSKGERFDIQPLFFRLTIDSATEFLFGESVENLHDESVGLTRDPVDFDGKSGFADAFNTSQTWLASRAVTQNLYFLVDGRSFRSSNAKVHKFADYYVRKALEASSEDLEKASRDGYIFLYELVKQTRDPVILRDQLLNILLAGRDTTAGLLSFTFFELARNQDVYDKLKEEIYEKFGEGEDSRVDEITFESLKKCEFLKCVLNEILRMYPSVPQNFRFAIRNTTLPKGGGPDGKSPIFVSKGKNLFYSMYSAHRNPKYYGKDAEEFRPSRWLEPEIRKVGWAFLPFNGGPRICLGQQFALTGASYIVVRLIQMFPNLSSFCEEYPPRKNTQLTMSHQNGVYIGMF

SEQ ID NO: 34845 - protein, 525 aa, Debaryomyces hansenii CBS767
MSSSAHELFRSIEPYLTNWWIICIGTYVLFSILTWINERILMKKLGAKPIQFIAPDPFWGIPLMFRLLRKKKDGTMVDMTKERFEEFGIETFSFRVGGTPVITTKDPENIKAMLATQFNDFALGKRHTYFKPLLGDGIFTLDGAGWKHSRAMLRPQFSREQVAHVRALEPHLQTLAKHIINSKGERFDIQPLFFRLTIDSATEFLFGESVENLHDESVGLTRDPVDFDGKSGFADAFNTSQAWLASRAVSKNLSLFVDGKEFRNSNAKVHKFADYYVRKALEASPEDLEKASRDGYIFLYELVKQTRDPVILRDQLLNILLAGRDTTAGLLSFTFFELARNQDVYDKLKEEIYEKFGEGEDSRVNEITFESLKKCEFLKCVLNEILRLYPSVPLNTRCATKNTTLPRGGGPDGQSSIFIPKGKSVLYSVYATHRNPKYYGKGAEEFRPSRWLEPEIRKVGWAFLPFNGGPRICLGQQFALTEASYIIVRLIQMFPNLNSFCEKYPPRKSSHLTMCHQDGVSIGMF

SEQ ID NO: 34846 - protein, 162 aa, Haemophilus ducreyi
DQLRAMGIEVFNANEVAGLDVYIDGADEITPQGAMIKGGGAALTREKIVSSLAKQFICMVDSSKQVDVLGSSFPLPVEVIPMARSYVARQLVALGGSPEYREGVVTDNGNVILDVHNFNIYEPLKMEHTINNIAGVVTNGIFAQRYANIIIVGTAEGAKIIK

SEQ ID NO: 34847 - protein, 171 aa, Synechocystis sp. PCC 6803
MMSKVFFDITIGSDTAGRIVMELFDEVTPKTAENFRALCTGEKGVGKAGKPLHFKGSHFHRVITDFMAQGGDFTRGNGTGGESIYGEKFADENFQLKHDRPGLLSMANAGPNTNGSQFFLTFVPCPWLDGKHVVFGEVVEGLEILEQLEANGSQSGQTKQAIVISDCGEIK

SEQ ID NO: 34848 - protein, 525 aa, Debaryomyces hansenii CBS767
MSSNFHEVVESIEPYVTNWWFICIGAYVLFSILTWINKRILMKRLSAKPMQVTARDAFVGIPLVFNLLKAKREGTMVDMTKERYEEFGVDTFDFRIAGTHAIATRDPENIKAVLATQFNDFVLGKRHAHFKPLLGDGIFTLDGAGWKHSRAMLRPQFAREQVAHVKALEPHLQTLAKHIINSKGERFDIQPLFFRLTIDSATEFLFGESVESLHDESVGLTRDPVDFDGKSGFADAFNNSQAWLASRAVSQNFYFLLNGKDFKDSNANVHKFADYYVNKALETSPEDLEKASRDGYIFLYELVKQTRDPVILRDQLLNILLAGRDTTAGLLSFTFFELARNQDVYDKLKEEIYKKFGEGEDSRVDEITFESLKKCEFLKCVLNEILRMYPSVPQNFRFSIKNTTLPRGGGPDGKSPILIPKGQNLLYSVYATHRNPKFYGKDADEFRPSRWLEPEIRKVGWAFLPFNGGPRICLGQQFALTEASYIIVRLIQMFPNLGSFCEEYPPRKSSHLTMCHQDGVFIGMS

SEQ ID NO: 34849 - protein, 208 aa, Arabidopsis thaliana
CRSMGKAVIVATNMLESMIVHPTPTRAEVSDIAIAVREGADAVMLSGETAHGKFPLKAAGVMHTVALRTEATITSGEMPPNLGQAFKNHMSEMFAYHATMMSNTLGTSTVVFTRTGFMAILLSHYRPSGTIYAFTNEKKIQQRLALYQGVCPIYMEFTDDAEETFANALATLLKQGMVKKGEEIAIVQSGTQPIWRSQSTHNIQVRKV

SEQ ID NO: 34850 - protein, 101 aa, Zea mays
LHILSVLSRDRVNFVMLNVDSTKWEQELDEIGVEGIPHFAFLDKEGNEEGNVVGRLPKQYFLDNVVALASGNPSVPDARVVGQFSSAESRKVHQVADAKSH

SEQ ID NO: 34851 - protein, 419 aa, Fulvimarina pelagi HTCC2506
MTDTEFSAAVREAETALRDLFPETPLQFNEHLSAKYKARIYLKREDLTPVRSYKIRGAFNFMRKRMANGGNGAKFCCASAGNHAQGFAFACRHFGVKGRIYMPVTTPQQKIAKTRTFGEDTIEIELIGDFFDDCYKAAKAYAEAEGAELVPPFDHTDIVEGQASVALEMLGQLGEEKADIVIMPVGGGGLASGMTRLFHGTEGAPNTLRFVEPLGAPSLKSSLDSGILTKMSKIDGFVDGASVAEIGQIPFDILKRFDSSVVHLAPEGRLCGTMLEMLNVEGIVLEPAGALTIDALKGFGTEIQGKTIVCVVSGGNFDFERLPDVKERALRFEGKKKYFILRLAQRPGALKDFLNLLGPDDDISRFEYLKKSAREFGSILLGIETKDRANFDTLLARFDADGIRYQDITNDPIVADLLI

SEQ ID NO: 34852 - protein, 337 aa, Oryza sativa Japonica Group
MGSAASAAAPPPPPTAQPHMAAPPYGAGLAGILPPKPDGEEEGKKKEVEKVDYLNLPCPVPFEEIQREALMSLKPELFEGLRFDFTKGLNQKFSLSHSVFMGSLEVPSQSTETIKVPTSHYEFGANFIDPKLILVGRVMTDGRLNARVKCDLTDDLTLKINAQLTHEPHYSQGMFNFDYKGTDYRAQFQIGNNAFYGANYIQSVTPNLSMGTEIFWLGHQRKSGIGFASRYNSDKMVGTLQVASTGIVALSYVQKVSEKVSLASDFMYNHMSRDVTSSFGYDYMLRQCRLRGKFDSNGVVAAYLEERLNMGVNFLLSAEIDHSKKNYKFGFGMTVGE

SEQ ID NO: 34853 - protein, 425 aa, Citrobacter freundii
MISKDDVKIAIIGLGYVGLPLAAEFGKIRQVVGFDVNHKRILELKEGIDVNLETTEEELRDARHLTFTSSIDEIRECNFYIITVPTPINDYKQPDLTPLIMASETVGKVLRPGDIVVYESTVYPGCTEEECVPILERMSAMTFNKDFFVGYSPERINPGDKKYRLTTIKKITSGSTAETACLVDEIYRQIITAGTYKTESIKIAEAAKVIENTQRDLNIALVNELAIIFNRLEIDTEAVLRAAGSKWNFLPFRPGLVGGHCIGVDPYYLTHKSQGIGYYPEIILAGRRLNDNMGNYVSGQLIKAMIKKGINVEGTNVLILGSHFKENCPDIRNTRIIDVVKELGNYSCNVDIFDPWVDAEEVEEEYGIIPVSEIKAASYDAIIVAVGHEQFKKMGSTDIRGFGKDKHVLYDFKYILSPEQSDVRL

SEQ ID NO: 34854 - protein, 468 aa, Burkholderia sp. 383
MSLFRKKNVDRMIAGAHAAGLKKALGAIDLTFLGIGAIIGTGIFVLTGTGAVQAGPALMLSFVIAAIACGLAALSYAEFASTIPVAGSIYTYSYATLGELVAWIIGWDLMLEYGLASSAVSVGWSGYLQSLLQGFGLTLPTVLTAAPGAVPGVVTWFNLPAFLVMIVITTLLSIGIRESTRINNIMVFIKVSVVLLVIAVGVFHVTPANWKPFMPHGWNGVFGAAAVMFFAFIGFDAVSSAAEEVKNPKRDLPIGIIASLAVCAVLYVTVAAVATGIVPSAQYANISHPISYALQKAGETWVAGFIDLGAVLGMLTVILVMSYGQTRVIFAMSRDGLLPAALSRVHPRYATPFLTTWLVGLFFGLIAALVPLNVLAELINIGTLAAFSMVSIAVLVLRRTHPDLPRAFRCPGVPVVPILAVASCLFLMLNLQPITWAAFGIWLVIGLVIYFLYSRHHSKLAHGHHDAH

SEQ ID NO: 34855 - protein, 346 aa, Citrobacter freundii
MTAYDELEIQLVLEPKRWLITGVAGFIGSGLLEELLYLNQTVIGLDNFSTGYQHNLEDVRAAVSEEQWSRFTFVHGDIRSFADCQAVCENVDYVLHQAALGSVPRSLQDPITTNSANIDGFLNMLTAARDAHVSGFTYAASSSTYGDHPDLPKIEDRIGRPLSPYAVTKYVNELYAEVFARSYDFNAIGLRYFNVFGRRQNPNGAYSAVIPRWILSLLKDEPIYINGDGSTSRDFCYIENVIQANLLSATTNDLASKNKIYNVAVGDRTSLNELYYLIRGGLNLWRDEQISAEPIYKDFRDGDVKHSQADITRIKTFLSYEPEFDIKEGLKQTLKWYIDKKTALYS

SEQ ID NO: 34856 - protein, 389 aa, Triticum aestivum
  misc_feature (168)..(168): Xaa can be any naturally occurring amino acid
  misc_feature (194)..(194): Xaa can be any naturally occurring amino acid
  misc_feature (208)..(208): Xaa can be any naturally occurring amino acid
  misc_feature (265)..(265): Xaa can be any naturally occurring amino acid
MASATLLKSSFLPKKAEWGVARQVAAPRVSMVVRAGAYDDELVKTAKTIASPGRGILAMDESNATCGKRLDSIGLENTEANRQAFRTLLVSVPGLGNHISGAILFEETLYQSTVDGKKIVDILVEQGVVPGIKVDKGLVPLTGSNDESWCQGLDGLASREAAYYQQGXARFAKWRTVVSIPNGPSELAVKGGRXWGLARYAAISQDKXGWVPIVEPEILLDGEHGIERTFEVAQKVWAETFYQMAQNNVMFEGILLKPSMVTPGXAECKDRATPEQVADYTLKLLSRRVPPAVPGIMFLSGGQSEVEATLNLNAMNQGPNPWHVSFSYARALQNTCLKTWGGRPENVKAAQEALLLRAKANSLAQLGKYTSDGEAAEAKEGMFVKNYSY

SEQ ID NO: 34857 - protein, 349 aa, Desulfotalea psychrophila LSv54
MGTLNILVTGGAGYIGSHTCLELLEAGYEVTVVDDLSNSCYEALSRVEALTGKKITFHQVNVLDQQALDAVFVSSKKPFAAVIHFAGLKAVGESVAKPLHYYHNNVTGTLVLCDLMAKHGVKNIIFSSSATVYGDPATVPITEDFPLSCTNPYGRTKLMVEEILADLHGADHEWNACLLRYFNPVGAHKSGRIGEDPNGIPNNLMPYIAQVAIDRLDFLSIFGNDYPTVDGTGMRDYIHVVDLAKGHVCAVKKVLEGQGITTYNLGTGRGYSVLEMVSAFSRTCGRDIAYKIVARRAGDIAECYADATKALDELDWLASLGLTEMCEDTWRWQKNNPTGYLGNREVSGS

SEQ ID NO: 34858 - protein, 382 aa, Hibiscus syriacus
MSSAGQVIRCKAAVAWEAGKPLSIEEVEVAPPQKDEVRIKILFTALCHTDVYYWECKGYTPLFPRILGHEASGIVESVGEGVTDVKPGDHVLPIFTGECKQCRHCLSEESNNMCDLLRINCDRGVMLADGKTRFSINGKPIYHFVGTSTFSQYTVVHVGQVAKINPTAPLDKVCPISCGICTGFGATVNVAKPKKGQTVAIFGLGAVGLAAAEGARICGASRIIAVDLNPRRFEEAKRFGITEFVNPKDYDKPVQEVIVEMTGGGVDRSVECTGSVQAMISAFECVHDGWGVCVLVGVPKKDDAFKTHPMNLLSERTLKGAFYGNYKPRTDIPMVVDKYLNKELGLDMDKFITHSVPFADINKAFDYMLQGIGLRCMIHLDA

SEQ ID NO: 34859 - protein, 896 aa, Zea mays
MNFSSLLLAELAACEKRLIACIEGVPAKCSVNCQNAFDGFTAPATDDKMSSTKPSLTTSTTIYGAPVFDQYCDADLGDNAMELVQRGPVDIERIDLRRGALAGCYGEQSARGHTPSSFNDDLGASLDSVANSSVHGGHGSVLPHLTPICAGTSRIPVPDDRRLDCAEDFDTNHLDKGFESDPVPLPVVYDRYDEPNHNEIVEVLALLEYNEEARITDAIEGLIREATSRTAALESVEHRRRQVLTAAGEVEQEPTEGIINEVEAEEACEHSEVPPTSPPSRPSPTRSSTATSSTTHRSPRRKSSFHARCTSHPTTTARLLHSLPSPNQAEVVESFELESARPPVVYNSHVELGLYSFTPTIFSVEQVIEEEVPVAMPTRCSRMDLNRDAYSVLDLPVVCIVGGPNSNEYGTNRVLHHTISLPDFSQELRGFQAITYYQAIINNLDDAQEQMDMAIATALRKSKQVYVSVSCNMADLFHSHSCSCRWDSALHKPPWPPPVQPVQFVIPGDGAQDWIPPWPSFSGEIEQLELMVLIELGSSPTFFSDRLSPQLLGVQIVGLMVKVANVVELRLLSVTSQQYAYATLPPSCTEEFDATHLNKAKILLNIMGVIIQLNYRRIFVHDGQPLESKPKEPLRIQKMMTGDSVMMDETDDSWFNCHKIKLPADCGYEFQMKYGLIGWLMGALLGYAQGANHKLFSPLTALHPLVVACCDHGSIMDALTTNFMSNNLVQLCGCLLSVAANKGNFSAFPWDPGDDGAVILGVLGCSSYPIKTKWLNYHQKCYRLLSKVAPPPLGSRHTGCVVNAQRGGDQVWMQPLVHDLGQLNGHQQREIQVSSIISDSISATLWKTVEQTNPSHSFTTGLAQSVGFKQPWPPPMEFECLDCACPPATWRIWSAA

SEQ ID NO: 34860 - protein, 288 aa, Desulfotalea psychrophila LSv54
MKIKKAVFPVAGLGTRFLPATKAMPKEMLPIVDKPLIQYAVEEALDSGIEQLIFVTGSGKSSLENHFDSSYELEDTLSKRGKDELLRTVESLVPASGSIIYTRQSQPLGLGHAIWCARDVVGDEPFAVLLADDLVKSERPVLQQMIHQFDRLRASMVATIEVPREETGRYGILEGEQVYEGVLRLSSMVEKPRPEDAPSNLAAIGRYIFTPRIFDFLGRQQSGAGGEIQVTDAMVALLAEQPIFGVNFEGTRFDCGDKVGFQMANIAFALEHPEIGGPLREYLQNLQL

SEQ ID NO: 34861 - protein, 114 aa, Leavenworthia stylosa
LVEKFGIDPNNAFAFWDWVGGRYSVCSAVGVLPLSLQYGFSVVEKRSYLTLKPLRNLLRTFKFLKGASSIDQHFKSTSLEENIPVLLGLLSVWNVSFLGYPARQVSMESNGKGV

SEQ ID NO: 34862 - protein, 204 aa, Photobacterium profundum SS9
MSYLSHCSNLVYENKGKISKELENLNFDTSRDNFFFSDSDTHTQAFVAGDTKKIIISFRGTEGKIADWVTDIKVFKETWTEANPLGDVHNGFNSALSSIWNDVFDEINTLRTNNQTIWLTGHSLGGALATLAAATFELQQPHVGINGVYTFGQPRIANHKFSRNYNEILKTRTFRCVNNNDVVTRVPPQIFGYSHRYLHKMVTN

SEQ ID NO: 34863 - protein, 505 aa, Thermoplasma volcanium GSS1
MMRPTVFSSKAVISSSSLSASLAGAKIIEKGGNIFDAAIAVSSVLSVTQNNLCGLGGDAFALVRYNGRVKGYNGSGKSSRNVNRGLYFELGYSRIPERGIYSAITVPGLVDLWNSLYLEYATMRFSDLISDAIKYAETGFYITRHYEESLIASSPILGQYNWSNQFMPYGKIPAEGDLFIQKDLAGTLREIAEEGPRSFYDGYLSDIIFKAMEKTNLLIDSKDLSDHKTLAANPVKSTYMDYDVFETAPNSQGATVNYWLALLEQKIQNKIPRPVDIVESGLEAYRWRSMFIGDPERMPFNGDLLSKGAGPYYNNPRVPEDKGDTTYFSISDANGNSISMIQSNYMGFGSGIIPEGTGFVLQNRGSYFTLDDKHHNSLEPRKRTFHTLAACIIEKDGELVYSLGTMGGDIQPQVQVQIITGLINQDLMPQEAIERPRWAFPATIYEQPSVLNVEDTSLINENETRLRINPMKYSSSFGTAQVTALLNGRVAGGSDPRGDGFSIPV

SEQ ID NO: 34864 - protein, 218 aa, Gibberella zeae PH-1
MTMNTPLDGHFVPNITFGPPVVAAIRGHVDQPTEAHGRGTFDCHMMIAEPKKWVKEFKKAGCNLYCFHYEAAFSSAAENPEDQTDEKTNPKALIRYIHDQGLLAGIAIKPDTSVDVLWEILENSEEKERPDMVLVMTVYPGFGGQKFMASELPKVQALRAKYPELNIEVDGGIGPKTIDEAADAGANVIVAGSAVFGANDPSEVIAQLRQSVDARSAK

SEQ ID NO: 34865 - protein, 114 aa, Leavenworthia stylosa
LVEKFGIDPNNAFAFWDWVGGRYSVCSAVGVLPMSLQYGFSVVEKFLKGASSIDQHFKSTSLEENIPVLLGLLSVWNVSFLGYPARAILPYSQALEKFAPHIQQVSMESNGKGV

SEQ ID NO: 34866 - protein, 353 aa, Brachyspira hyodysenteriae
MKGYAMLKIGESGWIEKERPACGPADAIVKPLAVAICTSDVHTLWEGAIGERHNMILGHEACGEVVEVGSLVKDFKPGDKVLVPAITPDWNSVEAQAGYSMHSGGMLAGWKFSNFKDGVFGEFFHVNDADGNLALLPSNIDPVDACMLSDMVPTGFHGAELADVQYGDSVLVIGIGPVGLMGVAGAALRGASRIIAVGTRPNCVEAAKKYGAEEFISYKNGTIDEQVLKMTNGKGVDKVIIAGGGVETFAEAVRSLKPGGKIGNVNYLGKGDYIQIPRAEWGVGMGHKAILGGLMPGGRLRMEKLGALVASGKLNVHHLVSHVFEGWENLEKALFMMRDKPADLIKPVVRIEK

SEQ ID NO: 34867 - protein, 406 aa, Azospirillum brasilense
GFAGDAAARYSSTLGVAAVTYGAGAFNMVNAVAGAYAEKSPIVVISGAPGTTEGNAGLLLDHQGRTLHTQFQVFKEITVAQARLDDPAKAPAEIARVLGAARALSRPVYLEIPRNMANAEVEPVGDDPAWPVDRDALAPAPDEVLAAMRSATSPVLMVCVEVRRYGLEAKVADVAHGLGVRSVTTFMGRGLLADAPTPPLGTYIGVAGDAEITRLVEESDGLFLLGAILSDTNFAVSQRKIDLRKTIHAFDRAVTLGYHTYADIPLDGLVDALLERLPPSDRTTRGKEPHAYPTGLQADDGPIAPMDIARAVNDRVRAGQEPLLIAADMGDCLFTAMDMIDAGLMAPGYYAGMGFGVPAGIGAQCVSGGKRILTVVGDGAFQMTGWELGNCRRLGIDPIVILFNNA

SEQ ID NO: 34868 - protein, 122 aa, Triticum aestivum
  misc_feature (22)..(22): Xaa can be any naturally occurring amino acid
  misc_feature (63)..(63): Xaa can be any naturally occurring amino acid
  misc_feature (71)..(71): Xaa can be any naturally occurring amino acid
  misc_feature (91)..(91): Xaa can be any naturally occurring amino acid
  misc_feature (101)..(101): Xaa can be any naturally occurring amino acid
  misc_feature (108)..(108): Xaa can be any naturally occurring amino acid
MDSSRRPSGIQQLLAAEQEAQXQIVNAARAAKTARLRQAKEEAEREIAEYPLHKWEADFQRKXLETSGDSXGANVKRLLAKRQTLKILATXKQQATKSLQXVIKIFLXTHNCRLKVDDQPCI

SEQ ID NO: 34869 - protein, 262 aa, Brassica napus
MMRIDEHFWSPAHSHELSEDDLWKIIDIVKEENLFRSPVLYFCCDCLEPIADNDRRCRCSLCTKQWHLRCIPASPDDIHHPFHSYHPLKLLIDVPPHNSKRECDACQEELQSYFYHCSMCDFSMHVRCSKDPPPPIVETAKCHEHTLTCMVRNDTFTCNACGTHGERCPYVCAPCGVMFHRECINLPHVININRHDHRVSHTYSLGFGKRKCMICHKKVDWRYGAYSCSKCPDYYVVHSKCATRVDVWDGEELEGVAEGAAH

SEQ ID NO: 34870 - protein, 489 aa, Oldfieldia dactylophylla
GPGVSALEKKNRGRIVQIIGPVLDVVFPRGKMPNIYNALVVKGRDTTGQQINVTCEVQQLLGNNRVRTVAMSATDGLMRGMEVIDTGAPLSVPVGGATLGRIFNVLGEPVDDLGPVDTRTTSPIHRSAPAFIELDTKLKILETGIKVVDLLAPYRRGGKIGLFGGAGVGKTVLIMELINNIAKNHGGVSVFGGVGERTREGNDLYKEMKESGVINEENIAESKVALVYGQMNEPPGARMRVGLTALTMAEYFRDVNKQDVLLFIDNIFRFVQAGSEVSALLGRMPSAVGYQPTLSTEMGSLQERITSTKKGAITSIQAVYVPADDLTDPAPATTFAHLDATTVLSRKLAAKGIYPAVDPLDSTSTMLQPNIVGSDHYETAQKVKQTLQRYKELQDIIAILGLDELSEEDRLTVARARKIERFLSQPFFVAEVFTSSPGKYVGLAETIRGFKLILSGELDSLPEQAFYLVGNIDEATAKATNLEMENDLK

SEQ ID NO: 34871 - protein, 239 aa, Zea mays
MMEGGSRADGRNPNQLRPFTCTGNPLHRAHGSARWAQGDTVVLAAVYGPKSGTRKGENPEKASIEVVWKPKTGQIGRQEREYEMTLKRTLQSICLLTVHPNTTSVVLQVVGDDGSLMSCAINASCAALAFAGIPMKHLAVAISCGVMDNGVVILDTSRAEEQQARSFAHLVFPNSRKSVESKDTTQRDEESERGLITCITHGAMSEDDYFNCIERGVMASSRISDFMRKTLQKEASRDA

SEQ ID NO: 34872 - protein, 528 aa, Cucumis melo
MAIKQILTLARTSHRRSPALFSQAVRSASTFPAVASSSPLPSPPPPNAMIYDRLAEAVKSKLKQLENPDPRFLKYGSPHPTITDHTRILSAPETRVTTLSNGLRVATESNLAARTATVGVWIDAGSRFETEETNGTAHFLEHMIFKGTEKRSARQLEEEIENMGGHLNAYTSREQTTYYAKVLDKDVPKALDILADILQNSKFDEHRISRERDVILREMEEVEGQTEEVIFDHLHATAFQYTPLGRTILGPAQNIRTITKDHLQSYIQTHYTAPRMVIAASGAVKHEDFVEQVKKLFTKLSAEPTTAAQLVAKEPAIFTGSEVRIVDDDVPLAQFAIAFNGASWTDPDSIALMVMQAMLGSWNKSAGGGKHMGSELAQRVAINEVAESMMAFNTNYKDTGLFGVYAVAKPDCLDDLAYAIMYETTKLAYRVSEADVTRARNQLKSSLLLHIDGTSPVAEDIGRQLLTYGRRIPFAELFARIDAVDASTIKRVANRFIYDRDIAIAALGPIQGLPDYNWFRRRTYWNRY

SEQ ID NO: 34873 - protein, 489 aa, Picrodendron baccatum
GPGVSALEKKNQGRIVQIIGPVLDVVFPPGKMPNIYNALVVKGRDTTGQQINVTCEVQQLLGNSRVRTVAMSATDGLMRGMEVIDTGAPLSVPVGGATLGRIFNVLGEPVDDLGPVDTRTTSPIHRSAPAFIELDTKLEIFETGIKVVDLLAPYRRGGKIGLFGGAGVGKTVLIMELINNIAKNYGGVSVFGGVGERTREGNDLYKEMKESGVINEENIAESKVALVYGQMNEPPGARMRVGLTALTMAEYFRDVNKQDVLLFIDNIFRFVQAGSEVSALLGRMPSAVGYQPTLSTEMGSLQERITSTKKGSITSIQAVYVPADDLTDPAPATTFSHLDATTVLSRKLAAKGIYPAVDPLDSTSTMLQPNIVSSKHYETAQKVKQTLQRYKELQDIIAILGLDELSEEDRLTVARARKIERFLSQPFFVAEVFTSSPGKYVGLAETIRGFNLILSGELDSLPEQAFYLVGNIDEATAKATNLEMENDLK

SEQ ID NO: 34874 - protein, 282 aa, Ostreococcus tauri
MRDGSTIMRVGFIGYGNMADALASGFVGANVVKFADLTMCNKSNVERRESFRARGGTVVETARDVTEKSDVIFLAVKPPYIKSVLDEVRREISEEALEPKVFVSVAAGVTLEAMEGVWTTHDQKPPAIVRVMPNTPCLVGAAASGICKGSTCSEESLHRALALMSTVGVCKVIMESQMSALTGVSGSGPAYVFVLIEAMADGGVRAGLPRDVALELAAQTFYGASKMVLETGEHPGVLKDKVCSPGGTTIAAVHALEQAGVRAAMMNAVLAAANRGDELAKM

SEQ ID NO: 34875 - protein, 576 aa, Ostreococcus tauri
MVARARVHASRGVDARRVRARGRARVDVIARAVKEPSSAPEEALPDENFKPEQLKFQDIVSLWVTQILQTYGGKESKDNAPVCEGVIDDLVGGPIFLALYPYFRRYGGVFKLAFGPKVFMVLSDPVIVREVLKEKPFSFDKGVLAEILEPIMGQGLIPAPYAVWKNRRRQLVPGFHKAWLDHMVGLFGHCSNELVRNLDKSAEDGEVVDMEERFCSVSLDIIGLAVFNYDFGSVTKESPIISAVYNCLQEAAHRSTFYFPYWNIPFATDIVPRQREFKQNMKIINETLNGLIQKAQKFEGTEDLEELQNRDYSKVKDPSLLRFLVDIRGADVTDSQLRDDLMTMLIAGHETTAAVLTWGLFCLMQNPELMKRIQADIDEVMGDDDRTPTYDDIQKLESVRLCIAEALRLYPEPPILIRRCLEDVTLPKGAGDAEVTLIKGMDIFISVWNLHRSPECWENPEEFDPFRFKRPFANPGVKDWAGYNPELFTGLYPNEVASDFAFIPFGAGARKCIGDQFAMLEATIAMAMVLRRYDFELTTDPKDIGMTMGATIHTEKGLPCRVRRRQPVTTATAAAV

SEQ ID NO: 34876 - protein, 427 aa, Synechococcus sp. CC9605
MTKPLDIPAILLFLATMFGAINHKFVKLPHTIGLMIVALAASLSLIALDLIFPSLGMSVLVNKFLGNIDFNVTLMQGMLSFLLFAGALHVDLDQLLENKWTILAFASFGVLVSSFVIGGGFWLISGAVGLSLPFLICLLLGVMVSPTDPVAVLGVLKTLQVPSPLKAKIAGESLFNDGVAVVLFSVLVSLVFGNGGEEGLETSFQLTSVIWLLTKEALGGLFLGLISGYIAFWLLRQIDDYVLEVLITLALVTGAYSIALHLHLSGPIAMVIAGLLIGNQGTSMAMSETTRMHVETFWELVDEILNSVLFLLIGLKIVFLFQHSSYEIAYPLLISLFIAITLLSLFARFVAIALPVQIKSLNSEVNPGTVQILTWAGIRGGVSVALALSLPSSSESELLLFVTYLVVLFSVAIQGLTIENVIKRYYP

SEQ ID NO: 34877 - protein, 489 aa, Scagea oligostemon
GPGVSALEKTNRGRIVQIIGPVLDVAFPRGKMPNIYNALVVKGRDSTGQQINVTCEVQQLLGNNRVRTVAMSATDGLMRGMEVIDTGAPLSVPVGGATLGRIFNVLGEPVDELGPVDTRTTSPIHRSAPAFIQLDTKLEIFETGIKVVDLLAPYRRGGKIGLFGGAGVGKTVLIMELINNIAKEHGGVSVFGGVGERTREGNDLYKEMKESGVINEENIAESKVALVYGQMNEPPGARMRVGLTALTMAEYFRDVNKQDVLLFIDNIFRFVQAGSEVSALLGRMPSAVGYQPTLSTEMGSLQERITSTKEGSITSIQAVYVPADDLTDPAPATTFAHLDATTVLSRPLAVKGIYPAVDPLDSTSTMLQSNIVGKEHYETAQSVKQTLQRYKELQDIIAILGLDELSEEDRLTVARARKIERFLSQPFFVAEVFTNSPGKYVGLTETIRGFKLILSGELDSLPEQAFYLVGNIDEATAKAANLEMENDLK

SEQ ID NO: 34878 - protein, 450 aa, Brachyspira hyodysenteriae
MSSQMNEQLEAIYNKIVKRNPGEAEFHQAVKEVLITLEVVLKKKPHYIEQKIIERICEPERQIMFRVPWMDDKGEIHVNRGFRVQFSSVIGPYKGGLRFHPSVYLGIIKFLSFEQIFKNALTGLPIGGGKGGSDFDPKGKSDNEVMRFCQSFMTELQRHIGYDIDVPAGDIGVGAREIGYLFGQYKRLKNRFEPGVLTGKGLGYGGSLARREATGYGLVYFTDLMLKTNGKNGFECKKVIVSGSGNVAIYAMEKATQLGAKVIACSDSNGVIYDENGINLDTVKRLKEVERKRIKEYVNAHSSAKYIENGNIWDIACDIALPCATQNELDAKSAETLVKNGCISVTEGANMPATPEAVEVFQKAGILYAPGKATNAGGVATSALEMQQNASMDKWDFDYTDGKLKNIMTNIHDTCYHTAEEYGCKGDYLKGANIAGFVKVADIMIPYGLI

SEQ ID NO: 34879 - protein, 506 aa, Lithospermum erythrorhizon
MALPAIPLAIIIFLIISYKLYQKLRLKLPPGPRPLPIIGNIYQVKPVKFRCFYNWSKTYGPIFSIYYGSQMNVIVSTTELAKEVLKENDQHLADRFRTRSSASMSRGGKDLIWADYGPHYVKVRKLCNVELFSPKRLEAIRPMREDEYTALVESIYKDCTKPELKGKSLLVREYLSSVAFNNITRLAFGKRFMDSNGVVNEQGQEFKKITHDGIKITAKLSIAEYIPWIRWMFKVEQDALDKFAADRDHLTRVIMEEHIKSGNTKQHFVDALLTLQKQYDISEDTIIGLLWDMIAAGMDTATISTEWAMAELVRNPRVQRKAQEELDRVVGPDRIMTEADVPKLPYLQCIVKESLRLHPPTPLMLPHRASANVKIGGYDIPKGSIVHVNVWAIARDPAYWKNPEEFRPERFMEEDIDMKGTDYRLLPFGAGRRICPGAQLAINLITSSLGHLLHQFTWSPQPGVKPEEIDLSENPGTVTYMRNPVKAVVSPRLSAVHLYKRVESDM

SEQ ID NO: 34880 - protein, 489 aa, Bruguiera gymnorhiza
GPGGSTLQKKNLGRIAQIIGPVLDVAFPPGQMPNIYNALVVKGQDTVGQQINVTCEVQQLLGNNRVRAVAMSATDGLMRGIEVIDTGAPLSVPVGGATLGRIFNVLGEPVDNLGPVNSRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEENIEESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPQIVGEEHYETAQRVKQTLQRYKELQDIIAILGLDELSEEDRLTVARARKIERFLSQPFFVAEVFTGSPGKYVGLAETIRGFKLILSGELDSLPEQAFYLVGNIDEATAKATNLEMENNLK

SEQ ID NO: 34881 - protein, 451 aa, Saccharomyces cerevisiae
MLRTRLTNCSLWRPYYTSSLSRVPRAPPDKVLGLSEHFKKAKNVNKIDLTVGIYKDGWGKVTTFPSVAKAQKLIESHLELNKNLSYLPITGSKEFQENVMKFLFKESCPQFGPFYLAHDRISFVQTLSGTGALAVAAKFLALFISRDIWIPDPSWANHKNIFQNNGFENIYRYSYYKDGQIDIDGWIEQLKTFAYNNQQENNKNPPCIILHACCHNPTGLDPTKEQWEKIIDTIYELKMVPIVDMAYQGLESGNLLKDAYLLRLCLNVNKYPNWSNGIFLCQSFAKNMGLYGERVGSLSVITPATANNGKFNPLQQKNSLQQNIDSQLKKIVRGMYSSPPGYGSRVVNVVLSDFKLKQQWFKDVDFMVQRLHHVRQEMFDRLGWPDLVNFAQQHGMFYYTRFSPKQVEILRNNSFVYLTGDGRLSLSGVNDSNVDYLCESLEAVSKMDKLA

SEQ ID NO: 34882 - protein, 489 aa, Carallia brachiata
GPGGSTLQKKNPGRIAQIIGPVLDVAFPPGQMPNIYNALVVKGQDTVGQQINVTCEVQQLLGNNRVRAVAMSATDGLMRGMEVIDTGAPLSVPVGGATLGRIFNVLGEPVDDLGPVNSRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEENIEESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPQIVGEEHYETAQRVKQTLQRYKELQDIIAILGLDELSEEDRLTVARARKIERFLSQPFFVAEVFTGSPGKYVGLAETIRGFKLILSGELDSLPEQAFYLVGNIDEATAKATNLEMENNLK

SEQ ID NO: 34883 - protein, 119 aa, Triticum aestivum
  misc_feature (43)..(43): Xaa can be any naturally occurring amino acid
MAGGKEPIEVKFRLFDGTDIGPNKYDPATTVTALKEFVLARWXPQDKDIIPKTLNDVKLINAGRILENNKTLAESRVPVGEVPGGVITMHVVVRPPQSDKSDKHLSNSPKQNRCGCTIL

SEQ ID NO: 34884 - protein, 264 aa, Fulvimarina pelagi HTCC2506
MALDGRVAVVTGGAKGIGYAVARRFLHEGAKVVIADVNERAGQEAADDLSEYGEVHFVATNVAEKLDVHNLIASSLDAFADIDILVNNAGMVQKAGFLDLDVADFQKVLDVNLKGAFLCGQAIAQHMVEKVKQGGSAGTIVNMSSINAEFALADQVGYSVSKGGLKSLTKVMALALAPHGIRVNAIGPGSIMTELLNSVANDPAAKRTILSRTPLGRIGDPKEIAAIAAFLASDDASYITGHTIYADGGRLALNYLVPVKDDED

SEQ ID NO: 34885 - protein, 394 aa, Fulvimarina pelagi HTCC2506
MLQTISAFDRIGEENAFAVLARANTLSGEGHDVVNLGIGQPDFLTPPHIVEAAVKALQDGHHGYTPATGLPATREAVARRTFSLTGVEISPDSVMIMPGGKPTMFAAILMFGEPGAEILYPDPGFPIYRSMIEFTGAKPVPVPIREENGFAFSAEETLSLITDKTRLLILNSPANPTGGVTPKQEIDKLVAGLENFPDVAILSDEIYDVMTYDGEVHTSLLTYPEIRDRLIVLNGWSKTWAMTGWRMGWSIWPEKLYGMVRKLAVNCWSCVNAPSQIAGIAAIDGPQEDVKRMMEAFDRRRKLVVERANALPGVTCATPKGAFYAFPNISQTGWKSKKLSSALLEKAHVALVGGPDFGILGEGYIRISYANSEMNIARAMDRVAKFLEETEPQT

SEQ ID NO: 34886 - protein, 86 aa, Triticum aestivum
  misc_feature (26)..(26): Xaa can be any naturally occurring amino acid
  misc_feature (33)..(33): Xaa can be any naturally occurring amino acid
  misc_feature (41)..(41): Xaa can be any naturally occurring amino acid
  misc_feature (43)..(43): Xaa can be any naturally occurring amino acid
  misc_feature (54)..(54): Xaa can be any naturally occurring amino acid
  misc_feature (59)..(59): Xaa can be any naturally occurring amino acid
  misc_feature (64)..(64): Xaa can be any naturally occurring amino acid
  misc_feature (66)..(66): Xaa can be any naturally occurring amino acid
  misc_feature (74)..(74): Xaa can be any naturally occurring amino acid
  misc_feature (79)..(79): Xaa can be any naturally occurring amino acid
SCRISARAPGVFEFDAFANGTKETLXAAVEAAXQGKIVIIXGXDTATVAAKYKXEDKLXHVSTXGXASLELLKXKELPXVTALSST

SEQ ID NO: 34887 - protein, 446 aa, Desulfotalea psychrophila LSv54
MKITIFGVGYVGLVQAAVFADVGHDVCCVDVDAVKIEGLQVGTIPIYESGLESLVEAGVTSSRLHFTTDLKEGVAHAQVYFIAVGTPPDEDGSADLRYVLSVAETIAQGMDGEAIIVNKSTVPVGTGDKVRARVESVLQERGVNIPFSVVSNPEFLKEGSALADCARPERIIIGTDSPYAEEVMREIYAPFSRNREKMLVMDQRSAEFTKYAANCMLATKISFMNEMANLAECMSADIEQVRRGIGSDSRIGYSFIYPGCGYGGSCFPKDVQALARSAGEYGYNAAILSAVEETNARQKEKIFKYIVQHYGVENIRGKTLALWGLSFKPDTDDMREAPSRVLLEALWQAGAKVHAYDPEAMEEAQRIYGYRSDLTLMGTKEAVLQGADALLIVTEWKHFRVPDFELLQSSLADRVIFDGRNLYDPQSVEQLGLAYYGIGRGRSCRQ

SEQ ID NO: 34888 - protein, 519 aa, Burkholderia sp. 383
MVTRPPEALAHDGMTPLERELALASFGPEHHTAHDTAQDTTPHIAAAASDAAGATPRAPNNPHLAHWRTHLNGLTARSRRALPLRPCGRLTRAAGLVLEAIGLRLSVGAECTIELPPGSTLPHAEAEVVGFAGDRLFLMPTTDVAGVLPGARVWPRESAPVADPLAGAKRLPVGWEMLGRVVDASGRPLDGLGPLASKVDAPLSAPSINPLEREPIHHVLDVGVRAINALLTVGRGQRMGLFAGSGVGKSVLLGTMARYTSAEVIVIGLIGERGREVKEFIEQILGEDGLARSVVVAAPADVSPLLRMQGAAYATSLAEYFRDQGKHVLLLMDSLTRYAMAQREIALAIGEPPATKGYPPSVFAKLPALVERTGNGPEGGGSITAFYTVLTEGDDQQDPIADSARAILDGHVVLSRALAEAGHYPAIDIEASISRAMTALIDETHLDHVRQFKQMLSRYQRNRDLIAVGAYAPGRDAQLDRAIALYPRIEAFLQQGFRECAPFASSLAGLDALFDAYGG

SEQ ID NO: 34889 - protein, 417 aa, Polaromonas sp. JS666
MYQHIKVPAQGQKITVNADNSLNVPDEPVIPFIEGDGTGADITPVMLKVVDAAVAKAYGGKKKIHWMEVFAGEKSTKVYGPDVWLPEETLHAVRDYVVSIKGPLTTPVGGGIRSLNVALRQELDLYVCLRPIQYFAGVPSPVKEPQKTNMVIFRENSEDIYAGIEFESGSDKAKKLIKFLQDELGVKKIRFPNTSGIGIKPVSSEGTERLVRKAIQYAIDNDKPSVTIVHKGNIMKFTEGGFRDWAYALAQKEFGAELIDGGPWCKFKNPKTGKDVIVKDSIADAFLQQILLRPAEYSVIATLNLNGDYVSDALAAQVGGIGIAPGANLSDTVAMFEATHGTAPKYAGKDYVNPGSEILSAEMMLRHMGWTEAADLIISSMEKSIESKKVTYDFARLMEGATQVSCSGFGQVMIDHM

SEQ ID NO: 34890 - protein, 244 aa, Deinococcus radiodurans
  misc_feature (106)..(106): Xaa can be any naturally occurring amino acid
MQTLLALNWKMNKTPTEARSWAEELTTKYAPAEGVDLAVLAPALDLSALAANLPAGIAFGGQDVSAHESGAYTGEISAAMLKDAGASCVVVGHSERREYHDESDAXVAAKARQAQANGLLPIVCVGENLDVRERGEHVPQTLAQLRGSLEGVGADVVVAYEPVWAIGTGKTATADDAEELAAAIRGALREQYGARAEGIRVLYGGSVKPENIAEICGKPNVNGALVGGASLKVPDVLGMLDALR

SEQ ID NO: 34891 - protein, 240 aa, Zea mays
MMEGGSRADGRNPNQLRPFTCTGNPLHRAHGSARWAQGDTVVLAAVYGPKPGTRKGENPEKASIEVVWKPKTGQIGRQEREYEMTLKRTLQSICLLTVHPNTTTSVVLQVVGDDGSLMPCAINASCAALAFAGIPMKHLAVAISCGVMDNGVVILDTSRAEEQQARSFAHLVFPNSRKSVESKDPTQRDEESERGLITCITHGAMSEDDYFNCIERGVMASSRISDFMRKTLQKEASRDA

SEQ ID NO: 34892 - protein, 383 aa, Brucella abortus
MTHSHNNKILSLIGKIMGFKCGIVGLPNVGKSTLFNALTKTAAAQAANYPFCTIEPNTGEVAVPDPRQNEIARIAGSKEIIPTRINFVDIAGLVRGASKGEGLGNQFLANIREVDAIVHVLRCFEDDDITHVEGRIDPVSDAQTVETELMLSDLESIERRIVQIRKRATGKDKEALAILPVMEKALELLQNGQPVRLMLKDISPEDLLTLKGLNLLTSKPVLYVCNVAEGDAANGNAFSAAVDKMAEEQGAQTVIISAAIEAEVAQLPDEEAGEYLESMGLEEPGLDRLIRAGYKLLDLITYFTAGPKETRAWTIKRGTKAPAAAGVIHTDFERGFIRAQTIAYEDYVKYNGELGAKEAGKARDEGKEYIVHDGDVMLFRFNT

SEQ ID NO: 34893 - protein, 501 aa, Gibberella zeae PH-1
MAPKTTMSDPDPENMCPGSGPMHRAQQQSKRPYSQYKNGEHRISIISVYIMMPSVRRFHGQTMVAAAPSICSGPAASSTIKMASSSASWTTYLWRLILAVLAPSTALLPFGAWVVSVWGSPVLDLHVQPHFSVQQKAPIQTGIPFEISTTSGFNCFNPNLPNVTIYATGGTIAGSASSADQTTGYRSAALGVDSLIDAVPQLCNVANVRGVQFANTDSIDMSSAMLRTLAKQIQNDLDSPFTQGAVVTHGTDTLDESAFFLDLTIQSDKPVVVTGSMRPATAISADGPMNLLSSVTLAAAASARGRGVMIAMNDRIGSARFTTKVNANHLDAFQAPDSGMLGTFVNVQPVFFYPPSRPLGHRHFDLRPITNNGRRFGRSTAPGAGSSALPQVDVLYAYQELSVGMFQAAIDLGAQGIVLAGMGAGFWTSKGTEEIRRIVHETDIPVIVSRRPEGGFVGPCEAGIGAGFLNPQKARIQLQLALETKMDNDAIKALFEHSGVH

SEQ ID NO: 34894 - protein, 380 aa, Ostreococcus tauri
MTSTSESDAAFVFGMGFLGREVARALGRDDGAKTTRGTTRSAEVGRVKERNVRAWDGGFDADVAACVRRARVVVSCVPPVEASDGTWSDPVYDAYAETLASAHPDGTNVTRFFGYCSTTSVYGDHGGGWVNETSACAPDSDKARARLDAESKWRALAARSNGALKAVSFRLGGIYGPNRSALETAMRRAGKDASESASSRARDARAFTSRVHVRDAANVIAAIARAGDEASDVYNVVDDYPVSRLSAVKFAGQILGLCPGDDRTESTRDEDSKSWTGEKRVRNDLIMRELARFGERTSLEFPSVYHGLRDIAVSEGKLPVDEAFDEWFAKNFPKLASGEYAGIRYFTCDDARDVPTGENVMEMRRNLGHDRWFFEFIRPR

SEQ ID NO: 34895 - protein, 489 aa, Crossostylis grandiflora
GPGGSTLQKKNLGRIAQIIGPVLDVAFPPGQMPNIYNALVVKGQDTVGQQINVTCEVQQLLGNNRVRAVAMSATDGLMRGMEVIDTGAPLSVPVGGATLGRIFNVLGEPVDDLGPVNSRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEENIEESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPQIVGEEHYETAQKVKQTLQRYKELQDIIAILGLDELSEEDRLTVARARKIERFLSQPFFVAEVFTGSPGKYVGLAETIRGFKLILSGELDSLPEQAFYLVGNIDEATAKATNLEMENNLK

SEQ ID NO: 34896 - protein, 353 aa, Brachyspira pilosicoli
MKGYAMLKIGQSGWIEKERPACGPTDALVKPLAVAICTSDVHTLWEGAIGERHNMILGHEACGEVVEVGSLVKDFKPGDKVLIPAITPDWNSVEAQAGYSMHSGGMLAGWKFSNFKDGVFGEVFHVNDADGNLAILPSNIDPVDACMLSDMVPTGFHGAELADVQYGDSVLVIGIGPVGLMGVAGAALRGASRIIAVGTRPNCVEAAKKYGAEEFISYKNGPIDEQVLKMTNGKGVDKVIIAGGGVETFAEAVRSLKAGGKIGNVNYLGKGDYIQIPRVEWGVGMGHKAILGGLMPGGRLRMEKLGSLVSSGKLNVHHLVSHVFDGWDNLEKALFMMRDKPADLIKPVVRIEK

SEQ ID NO: 34897 - protein, 286 aa, Bradyrhizobium japonicum USDA 110
MSKLKIAFQGEPGANSHIAIVEAYPDAEPMPCATFEDALSAISSGEADLGMIPIENSVAGRVADIHHLLPASGLFIIGEWFLPVRHQLMAVKGAKISDIKSVESHVHALGQCRRIIRKLGIKPIVHADTAGSARDISERKDKTVAAIASRLAAKIYGLDILAEDIEDEAHNTTRFVVLAREPKWAAQGSGPLVTTFVFRVRNLPAALYKALGGFATNGVNMTKLESYMVDGNFFATQFYADVDGHPEDKGLAFAIEELKFFSREFRIVGVYPGHPFRATFSETQQD

SEQ ID NO: 34898 - protein, 218 aa, Zea mays
  misc_feature (62)..(62): Xaa can be any naturally occurring amino acid
  misc_feature (92)..(92): Xaa can be any naturally occurring amino acid
QLPYLCRGLFFCVAIGPWAGLIIGFVTEYYTSNAYSPVQDVADSCRTGAATNVILGLALGYXAALGMLSTIATGLAIDAYAPISDNAGGIAXRTDAVDAAGNTTAAIGKGFAIGSAALVSLALFGAFVSRARVMVVDVLSPKVFIGLIVGAMLPYWFSAMTVKSVGSAALKMVEEVRRQFNTIPGLMEGTAKPDYATYWKISTDASIKEMIPPGALVM

SEQ ID NO: 34899 - protein, 601 aa, Gibberella zeae PH-1
MRGLTQAAAAVLTPVLVLAHGPHHPPPPPPPPPPMGFLPSALDVTPSAFVTLNVPWSDTEAYPLTLRFDVEESEEVCGPASIKLNGEPLNQDAKGHGVGSFLVNNETIISAEWAFECIGPKEFPFGQSMRFNVKALDDMAVNDESSFWMTFKQTAPVRISDVGNAAYVWSLSVPFSKENNTSTGDKSTADHPPPIWESTHRDFQDPEEELQVELMELEALHKQILQLEQLVEEREASVAKKLGKKYPPPPPSTYKKIKDCDGVQCVLHTVKDGVRHTAHRFYDHVFGHPPPPPHHGPPHGPHHGNGTHPHPPHHGPPHHGPPPPPPPHHGHPFPFPGGHPPPPHCPPCACDPHHGNPPPPPPPPHHHEDGPHGPHHGGPHHPEGFRAEGHEGHPPPPPPHHPIIVILGVLAIALALFSGIAIAYIHRRIARLSPESRRAIRRAFRQSPEERRKGSALKAAYRAFVSRCVENDEDEKEAMLHGERRRRSSSASSVTMEEEIASFREAANMVDGIVAAEEGHSAHARSYSYISGSSGSSHPTHHSAPAAYRNFPDDESLPAYDDDERDSSVVSDGCRYTPGSSDYTPSATGSNASDVLGDTKN

SEQ ID NO: 34900 - protein, 475 aa, Burkholderia pseudomallei K96243
MNIHPVILCGGSGSRLWPMSRGGYPKQYLKLAGDRSLVQQTALRLRNIPDTTAPIVVTNNEQRFLVAEQLRQVDITPSSIVLEPVGRNTAPAIAIAALLAMHDSPEALLLVLPSDHVILNEPAFITAAREAAAIAADKHLVTFGITPTQAHTGFGYIRRGPLLADGGQAFKVDAFVEKPDASTAERFVRDSGYYWNSGMFMLKAATYMEELHRHAPEIARQAEFALASAKRDHDFLRLDADAFFACPNVSIDYAVMERTERAAVIATADLGWSDIGSWSALADIADTDAQGNALVGDVFTDSVKNSYIRAEHRMIAALGLDDIVIVETADAVLVAHRDKAQDVRKIVEWLNASGRHESVTHRRVVRPWGSYEGIDQGERFQVKRIVVNPGAQLSLQMHHHRAEHWIVVKGTALVTNDGKEIILTENQSTYIPLGATHRLTNPGKIPLELIEVQSGSYLGEDDIVRFEDTYGRTST

SEQ ID NO: 34901 - protein, 344 aa, Glycine max
  misc_feature (80)..(80): Xaa can be any naturally occurring amino acid
  misc_feature (100)..(100): Xaa can be any naturally occurring amino acid
MDFFTRDINEDSMLRCPFLRNINEPTNFSFSSPLALPMPVRGAKGPIFEDGPNFDLAFRLFHGSDGVVPLSDRSFRPSGXKVQAEPPKSQFNPLAAKAAXTISLSSFGFGGAFGFDAFSEKWNNQKRKSKSSKNNPSSQDGSKHEAGNDWLQNGNCPIAKSYRAVSNVLPLVAKVIQPPPGIKYKCPQAVVAARAAIARTAFAKNLRPQSLPTKVLVIGMLGMAANVPLGIWREHTKKFSPTWFAAVHAAVPFIAMLRKSVLMPKSAMAFTIAASVLGQVIGSRAERYRLKAVAARKVSITETSGVGPLQLPVATKKDKHCGDAVDWNAVSLQLATTSPTDVFC

SEQ ID NO: 34902 - protein, 101 aa, Bassia scoparia
TNPSNPLGTVLDRETLSTILSFSTEKNIHLVCDEIYGATVFGYPNFVSISEIMLDQDYNPELIHIVYSLSKDLGFPGFRVGIVYSYNDRVVSCARKMSSFG

SEQ ID NO: 34903 - protein, 422 aa, Vibrio cholerae O1 biovar eltor str. N16961
MSELSITFSQLGLDSRLLNTLSELGIANPTPIQQQAIPHVLQGKDVLAGAQTGTGKTAAFGLPLIQRFIEQPWQREANSKEIRALVLVPTRELAQQVLDSLQAYAKGTELKIVAVYGGTSMKVQLNHLRGGVDILIATPGRLLDHAHVKSLFLGKVEVLVLDEADRMLDMGFMPDLQRVLRRLSPLRQTLFFSATFDSKIKAVAYRIMRDPIEVQVTPSNSTAETVQQMVYPVDKKRKRELLSYLIGSKNWQQVLVFTKTRQGSDALAEELKLDGIKAVSINGDKSQGARQKALDDFKAGKVRALIATDVAARGLDIAQLEQVVNYDMPFKAEDYVHRIGRTGRAGLAGLAVSLLSHDEQPQLEAIERLLNTRLPQEWLKGFEPSPVVHEENSPRRSAGRSSEKRKLKAQLKIHAQRGKKAR

SEQ ID NO: 34904 - protein, 489 aa, Orthion subsessile
GPGVSAQENKNLGRIAQIIGPVLDVAFPPGKMPNIYNALVVKGRDTIGQQINVTCEVQQLLGNNRVRTVAMSATDGLMRGMEVIDTGAPLSVPVGGATLGRIFNVLGEPIDDLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPQIVGEEHYETAQRVKQTLQRYKELQDIIAILGLDELSEEDRLTVARARKIERFLSQPFFVAEVFTGSPGKYVGLAETIRGFKLILSGELDSLPEQAFYLVGNIDEATAKATNLEMENNLK

SEQ ID NO: 34905 - protein, 494 aa, Oryza sativa
  misc_feature (371)..(371): Xaa can be any naturally occurring amino acid
MAESYHKEVIAGLKDKSLFIQEAFIDGQWVAKDNKFDVFEPSTATVLGQVANCALEDFQTAIKSADVAQTNYFDSTTGASRGALLRTWYDLVLANQEDLANILSLENGKTYSEALGEVLYSASFISWFAEEATRSYGVTIPSSAPHTTLMTVREPVGVCGIITPWNFPAAMITRKIAPALAAGCSVVIKPPSETPYSALAFTKLAIDAGLPPATIQVLPTRDRQAATELATNPLVKKISFTGSTGVGKYLAKLAAGTLKKLSLELGGNAPFIVFEDADLDLAAEGAMFCKFRCSGQTCVCANRLYVQKSVAKEFTAKLVEKVNALKMGSGLDKSTTQGPLVNKAAVDKVKEHIADATSKGAQIATGGSTPXSPGFFHQPTVLTGVTQEMAVAKDETFGPLAPIFEFDTEEDAIRLANDTEFGLAGYFFSKDISRVMRVAHKMQVGMVGANTGKISAAEAPFGGVKESGYGKEGSLYGMAEYQNIKSITIGNLNN

SEQ ID NO: 34906 - protein, 338 aa, Vibrio cholerae O1 biovar eltor str. N16961
MKVLVTGGMGYIGSHTCIQMIQAGMTPVILDNLYNSKVTVLDRIEKVIGVRPQFVQGDIRDKALLVDLMQQHNIEAVVHFAGLKAVGESVQKPLEYYDNNVNGTLVLVAAMREAGVKSLVFSSSATVYGEPTSVPITESFPTKAANPYGRSKLMVEECLTDFQKANPDWSITLLRYFNPVGSHPSGELGEDPQGIPNNLMPFVTQVAVGRREYLSVFGSDYPTKDGTGVRDYIHVMDLADGHIAALKKVGTCAGLHIYNLGTGKGYSVLDVVKAFETASGRTVPYKLVDRRPGDIAEYWADPTKAAQDLGWKATRNLHTMAQDAWCWQSNNPQGYPEA

SEQ ID NO: 34907 - protein, 373 aa, Porphyra yezoensis
MAFITPAAAASVTARVAARPAVIGARATAFAGAAVAPTSRRSVVRAAPAALRMAQSGETLEEFLAGSDPKLAKCVAAMFASCKEVAYKIRTASCDKMACFNDFGDEQLAIDMLADKIIFDNLEASGVVATASSEEVPKEVTITAGAPYSVAFDPLDGSSIIDTNFTVGTIFGVWPGDKLVGTTGRELVAGGMVLYGPRTTVTLAMDGVEGAHEFLLIDDFSSRHGSWVHTATFTSVNEGKLYAPGNLRAAEDNPGYADLIDYYRKEKFQLRYSGGMVGDVNQILVKGKGVFCNPSSPSAKAKLRLLYEVAPIGYVMEKAGAKSSDGSGSVLDIKVQTTEDRSQVCYGSAGEVARFEQMVGKKVEMNATVDTTA

SEQ ID NO: 34908 - protein, 552 aa, Gibberella zeae PH-1
MTEPENFEDDLFADLYDDNDAPKPAPAAPVAAPAAPPAPEVQPPTNNTHDNDDHNATYQHQDVAGDEYMTQDQDDDDDDVDFNLGGGGGGYGSHTGQAGMHDDDQAPPYGTVHKASAKEDGKMFIGGLNWETTDQSLRDYFAQFGEVVECTVMRDSSTGRSRGFGFLTFKDAKTVNIVMVKEHFLDGKILILLQIDPKRAIPRDEQEKTSKIFVGGVSQETTDQEFKEYFAQFGRVVDATLMMDKDTGRPRGFGFVTFENEAGVDACINVPLEIHGKPIEVKKAQPRGNLREEEEASRRGKFRKDGDQSNQGSMGQQMGNNNGMTPQVMAQYFQRMQQYFTMMQSQMAMSRGMPMNPAMWQNMMQMQQMQQQMMGGRGGGANAQNMMQNMNPQMAQQMQQQMQQMMQQQGQQGGQDAGSGSASPTASTNGGAGRGYDNNNNFNQYQQQQPQGGRRGGRGGYGGHGGGHGGYNMGGGGGAPTSWEGMYDDVPQPNPNQGPGSFNRAGSVGGSSDPQHAPPANAPTGPKNAGKPGANYRGGGRGGNRGFHPYSR

SEQ ID NO: 34909 - protein, 389 aa, Fulvimarina pelagi HTCC2506
MKIAVAGLGYVGLSNSVLLAQHNEVVAIDVAEDRVEMVNRGVSPIIDDHLQAFLNTERLALMATTDPVRAYKGAEFVLIATPTNYDPQTGAFDTTSIETVIDEVLNINPDVTIIVKSTIPVGYTANLRTRPGCGNVIFSPEFLREGKALYDNLYPSRIIVGERSDRGRKFADLMKQGARKEDIEVLLTDSTEAEAIKLFANTFLAMRVAFFNELDTYAASHGLDTRQIIEGVCLDPRVGGHYNNPSFGYGGYCLPKDTKQLLSNYQDVPQNLIRAIIDSNSTRKDFIANQIIDMAPSRVGIYRLVMKAESDNYRASSIQGIMKRVKAKGIEVVVYEPILEDVDDFFHSRIERNLQRFKSECDVIVANRMVDELADVAEKVYTRDLFGNN

SEQ ID NO: 34910 - protein, 480 aa, Burkholderia sp. 383
MKNDLPELAPQALPSVDALTALLRDQRAAYLRAPYPAWETRVQHLRALRTMLIDHADALAEAISADFGHRAKQEVLLSEIWMAKEEIDDALKHGKRWMKPIRKPMNKWLRPARAKVIPQPLGVIGIVVPWNYPVLLAAGPLICALAAGNRAIIKMSELTPRTSALFEQLIAKTFTRDHVAVVNGDAEVGAAFSGLPFDHLLFTGSTHVGRHVMRAAADNLTPVTLELGGKSPAIVGPNARFDAAVDAIVAGKTLNAGQTCIAPDYVLLPRGMEAAFIERARARFAKMYPDLSANGDYTTIVSPRHYARLQQLASDAQSAGAQLHPLSDAQSDPASRRFVPCAVTQVPAASQLMQEEIFGPLLPLVPYERLDEAIAYVNARPRPLALYLFDEDGGTIDRVMRETISGGVSINETLMHIACGSLPFGGVGASGMGAYHGYDGFVTFSKMKPVLTQPRLNARNLLAPPYGKRFAALIKLMLKF

SEQ ID NO: 34911 - protein, 512 aa, Spiroplasma kunkelii
MKTTNKIIILDFGSQYTQLIARRIRDLEVYCEVWPYNTALEKIKTTSMKGIILSGGPASVYEEDAFLIDKQLFELKVPVLGICYGMQIISHLHEGTVQRATKQEFGFSELIIDNQEDLFANIPVKSQVWMSHADYIEGMPTNFIQIAHSENSISAIKHSEKKIYGLQFHPEVTHTLIGQQLLSNFVFNICGCQPKWKITEFISAAITEIKNKVGTDNVVLALSGGVDSSVCAVLLHKAIGKQLTCIFVDTGLLRQNSGWNDLQKFQEKFKLNIIKINAQERFLTALKGVTNPEEKRKIIGNLFIEIFNEEAIKIQNVKWLGQGTIYPDVIESVSVKGPSATIKSHHNVGGLPKDLPFQLIEPLRELFKDEVRRTGEALGIDFKFVYKHPFPGPGLAVRIIGEITAEKIALLQAADQIFIDELYQANLYDQVAQAFVVLLPVQSVGVMGDVRTYGYTAVVRSVDTTDFMTANWSRLPFELLEKVSARIVSEVHGINRITYDITSKPPGTIEWE

SEQ ID NO: 34912 - protein, 302 aa, Physcomitrella patens subsp. patens
MNRLKKLRQQPDNRICADCGAPDPKWASTSIGVFLCIKCSGVHRSLGVHISKVVSVTLDDWSDEQVDLMEAIGGNASANSVYEACMPSDVRKPSPDASVDERSEFIRRKYEDQEFLKPNLRMKSQPTSRARTITSQAGMVEFLGMLKVRIVRGTNLAVRDLLSSDPYVVATLGAQTAKTKVVNRNLNPVWNEELMFSVPSPPQPLKLQVFDHDVLSADDSMGEAAIDLEPLILAAQMHQGMFEEFGCEQIGKWLATDDNALVKDSNIEVIDRQIKQDVHLKLQNVERGQIEVSLEWVPLSGF

SEQ ID NO: 34913 - protein, 459 aa, Symbiobacterium thermophilum IAM 14863
MEITMPQLGESVTEGTINRWLVAPGDVVKRYQPIAEVITDKVNAEIPAPADGRILTLDVPEGSTVPVGARIATMEVAGEDAGQAPAPVGASAQAASQAAAPQGAPAVGGGSGAPDRASRGRYSPAVLRLAQEHGVDLSQVRGTGLGGRITRKDVEAFIAARAAGAPAAPPAAAAAPAGVAAPAPAGVAASAPAAPASGVAVAATSAPSVAAPTPSAPAAAPVQPAPGDRVIPVDPVRRRIAAKMVQAKHEAPHAWTMMQVDVTNLVKLREQAGPEFRARTGRPLSYVPFFIKAVVESLREYPILNSQWNGDEIVIRQDINISVAVATEDALAVPVIKHADRLSIAGLNEAVADLAERARAGRLTLDDVTGGTFTVNNTGAFGSFLSAPIINYPQAAILSFEKITKMPVVLENDAIAIRSMMNICLSLDHRILDGLVCGRFLQAVKRRLESYGPGTVSLY

SEQ ID NO: 34914 - protein, 359 aa, Glycine max
MSCFSCFVSRRKDVRRVEIDNGSRSATATATSSSESERKRESSEGKGKKSVSSSSNKGSTAAASFGFRELAEATRGFKEVNLLGEGGFGRVYKGRLATGEYVAVKQLSHDGRQGFQEFVTEVLMLSLLHNSNLVKLIGYCTDGDQRLLVYEYMPMGSLEDHLFDPHPDKEPLSWSTRMKIAVGAARGLEYLHCKADPPVIYRDLKSANILLDNEFNPKLSDFGLAKLGPVGDNTHVSTRVMGTYGYCAPEYAMSGKLTLKSDIYSFGVVLLELITGRRAIDTNRRPGEQNLVSWSRQFFSDRKKFVQMVDPLLHENFPVRCLHQAMAITAMCIQEQPKFRPLIGDIVVALEYLASHSNP

SEQ ID NO: 34915 - protein, 614 aa, marine gamma proteobacterium HTCC2143
MTNKYLQKAYAAVVFWLIVHGVFLRGLIMVVSSVFGVALQNSKQLRLAFCLALFCSFSIASEDNNGYVADYSQPQNYARTSRNDAGAVATVHPLATEAGLKVLNNGGNAIDAAVAAALTLGVVDSHNSGIGGGNFAVIHFADGTVQAIDGREMAAKAAHRDMYMRNGEADGSLSKTGALSIGVPGSLAVYEYMIDHGGKLTLKELLLSAADIADKGFVLSQVSADRLKSTAERLRLFPASAAILLDDKGEPWNAGHLLIQQDLATTYKNIAKHGVDYFYRGDFAKAVDGWMAANSGIVTFDDFDGYRMLIREPVKSEYRGYTIYGFPPPSSGGVHVAQILNMLANFDVAALSDADRYHVLSESMKRAFADRAHFLGDPDFVPVPKGLMDRAYADQLAAQITMDAASTDVQHGLPPRADIDLFGKHTTHISAADKWGNWVSITTTVNTSFGSKVIIPGTGVIMNNQMDDFSIHPGVPNAFGLVGKEANSVQPGKRPLSSMSPTIVVKDGKPVISIGAAGGPTIITQVVQGLVNMIDLAMPVEQALATPRIHNQWRPPVNMIESSIDPAIKTELEGRGHAFYVRPYGGSSQAIRASADGGFEAAAEPRIVKRNRSQ

SEQ ID NO: 34916 - protein, 226 aa, Brassica napus
  misc_feature (7)..(7): Xaa can be any naturally occurring amino acid
ELERVYXEEIWKKSKVDESSFSDVSIDELRAYAREIVEKEIGKHAADGLGRVDYALASGGAFVMDHSDPFLVGNWFGTSRRRVHSKAVKMLTPSFGEPGQCFPLKGSNGFVQVRLRAPVVPEAVTLEHVSKAVAYDRTSAPKDCRVSGWLEDKDMESETRLLLREFTYDLDKSNAQTFDIAESAHSGLVNTVRLDFTSNHGSDSHTCIYRFRVHGRELDSVSAVHA

SEQ ID NO: 34917 - protein, 603 aa, Achromobacter xylosoxidans
MAATDNRKVVEGVHKMTPSEAFVETCVANGVSEMFGIMGSAFMDAMDIFAPAGIRLIPVVHEQGAAHMADGYARVSGRHGVVIGQNGPGISNCVTGIAAAYWAHSPVVIVTPETGTMGMGLGGFQEANQLPMFQEFTKYQGHVCNPKRMAEFTGRVFDRAMSEMGPTQLNIPRDYFYGEIECEIPKPMRVDRGHGGEASLQAAVELLKTAKFPVILAGGGVVMGDAVEEAKQLAERLGAPVATGYLRNDAFPAKHPLWAGPLGYQGSKAAMKLIAQADVVIALGSRMGPFGTLPQHGMDYWPKAAKIIQIEADHTNLGLVKKIAVGINGDAKAVAAELSRRLADVTLGCDATKAARADTIATEKAAWEKELDGWTHERDPYSLDMIEEAKGERTPTGGSYLHPRQVLRELEKAMPARVMVSTDIGNINSVANSYLRFDEPRSFFAPMSFGNCGYALPTIIGAKCAAPDRPAIAYAGDGAWGMSMMEIMTAVRHDIPVTAVVFHNRQWGAEKKNQVDFYNRRFVAGELESESFSDIAKAMGAEGIVVDHIEDVGPALQKAIDMQMKEGKTCVIEIMCTRELGDPFRRDALSKPVRMLDKYKDYV

SEQ ID NO: 34918 - protein, 308 aa, Oryza sativa
MSARAAAGGGDGDGGGRRKTLAKVSLSSLSAAAAEAATFPIDAVKTRLQLHRGTGGSGGGGGGVMRVAGELVRDGGIYRGLSPAVLRHLFYTPLRIVGYEHLRSTFASGGRDAGLLEKALAGGVSGVVAQVVASPADLIKVRMQADSRLLSQGIQPRYTGIFDAFTKIVRAEGFRGLWKGVVPNAQRAFLVNMGELTCYDQAKHFIIRKQICGDNLYAHTLASVASGLSATTLSCPADVIKTRMMNQGKDAKVLYRNSYDCLVKTVKHEGLTALWKGFLPTWARLGPWQFVFWVSYEKLRQASGISSF

SEQ ID NO: 34919 - protein, 316 aa, Polaromonas sp. JS666
MNRQTIVILGTGGTIAGRAASASDNIGYTAAEVGIEQLVAAIPGLADAGPLIAEQVAQLDSKDMSFAVWAKLAGRVNHFLAQPDVAGIVVVHGTDTLEETAYFLQAVCGPAKPVVLTCAMRPATALVPDGPQNVLDAVAVARHSGAKGVVAVCAGSVHTARDVQKVHPYQVDAFSSGDAGPLGYVEEGSLRLLRNWPEADASRAPDATKIMAALDDATDWPHVEIVMSHAGARGAVVQALMQQGVRGLVVATTGNGTVHQALEAALLKAQAAGVSVVRATRCPNGRVLPKPGDLIPDSQGLSPVKARIDLMLRLLG

SEQ ID NO: 34920 - protein, 415 aa, Schizosaccharomyces pombe
MDVSTQTRHATYFQDENQLQKDHIYVKKKSHIKLNTGVPAPFKAVDNINQQDEPTLIEGNNESSISSSTGDTFEEDFAYQDKVEIEERSIRSTPKSIGDDDLENREGSFDAPEGILTHGKHRLPTIPEWTKEDLAALSEAAARLQANPSPEDIETDPSMVPDYDPEIFHYMQSLERKLAPPPNYMSVQQEIDWVTRHMLVDWIVQVQIHFRLLPETLFLAVNLIDRFLSIKVVSLQKVQLVGLSALLIACKYEEIHPPSIYNFAHVVQGIFTVDEIIRAERYMLMLLDFDISWPGPMSFLRRISRAHSYDHDIRMLAKYLQEVTLMDEIFIGAHISFIAATAYYLSMQMLGHLDWTPCHVYYSGYTARQLKPCANIIWECLVDAPNHHNAIYRKYSENRMKRVSAFAHNWVLSVI

SEQ ID NO: 34921 - protein, 344 aa, Clostridium thermocellum ATCC 27405
MLQSVMVSPGKIEFHEVEKPELKPGQVLIKIMRIGICGSDIHVNHGKHPFTKYPVTQGHEVSGKIVEVAEDVEHLKVGQKVTIEPQVVCGKCHPCRTGKYNLCEELKVMGFQTVGAGSEYFAVDAKNVTTVPDHLSYDEAAMIEPLAVTVHAANRVGDVKDKDIVVIGAGPIGILLVQTLKAKGARKVMVTDVSDYRLELALKCGADFAVNTKKEDFGEAMLRCFGPDKADVIYDCAGNNTTMEQAIKHSRKGSIIVLVAVFEGMATVDLATLNDKELDLNTTMMYRHEDYVEAIELVEAGKVKLTPLMSKHFAFRDWEKAYEYIDNNREITMKVLIDVNNDDD

SEQ ID NO: 34922 - protein, 449 aa, Brachyspira pilosicoli
MSSRVKESIESIYSSIVQKNAGEKEFHQAVKEMLSTLEVVLEKHPEYIEKKVIERICEPERQIIFRVPWMDDKGEIHINRGFRVQFSSVMGPYKGGLRFHPSVYLGIIKFLSFEQIFKNALTGLSIGGGKGGSDFDPKGKSDNEVMRFCQSFMTELHRHIGADIDVPAGDIGVGAREIGYLFGQYKRLSGRYEAGVLTGKGLDYGGSLVRKEATGYGLVYFTELMLKTRNESFEGKKVIVSGSGNVAIYAMEKASQLGAKVIACSDSNGVLYDENGINLDTVKRLKEVERKRIKEYADIHKSAKYQENGCIWDIACDVALPCATQNEINADNAKTLVKNGCKCVAEGANMPATPEAIDVFLNANILYAPGKATNAGGVATSALEMQQNASRDSWDFEYTDGKLKNIMTNIHNTCYTTAEEYGFKGNYLKGANIAGFVKVAETMIPFGLI

SEQ ID NO: 34923 - protein, 507 aa, Synechococcus sp. CC9605
MVATMTNPLRVGLRQERVIAPQCLVIFGASGDLTHRKLVPALFELFKQRRLPSEFALLGCARRPWSDEEFRGKMAEALASTIEDDPQAWEQFVGKLFYEPVDLQQPQDVVRLGTRLEQIDQQCATRGNRTFYLSVSPKFYGSGCRSLADAGLLKDPKRSRVVIEKPFGRDYGSAQALNRVVQACGQENQIFRIDHYLGKETVQNIMVLRFANTIFEPIWNRNYISSVQITAAETVGVEERAGYYESAGALRDMVQNHLTQMLAITAMEPPGRFDPEAIRNEKAKVLQAARLADELEPWNCCIRGQYGPGGSAESPLAGYRHEPGVDPNSTTETYVAMKLFIDNWRWQGVPFYVRTGKRLAKRTSEVVLTFREAPVHLFDAATGGPTANQLILRIQPDEGAEFRFEVKSPGSGMRSRPIDMEFSYDESFGEPSDEGYVRLLADAMLSDPTLFTRSDEVEAAWRLYTPLLELIEDSPWQLPVHPYESRTWGPAAADALLAKDGLLWRRP

SEQ ID NO: 34924 - protein, 296 aa, Brassica napus
MANQPESSDPKGAKRDFSTAILEKKKAVNRLVVDEAINDDNSVVSLHPETMEKLQLFRGDTILLKGKKRKDTVCIALADDTCDEPKIRMNKVVRSNLRVRLGDVVSIHQCPDVKYGKRVHILPLDDTIEGITGNIFDAYLKPYFLEAYRPVRKGDLFLVRGGMRSVEFKVIETDPDEYCVVAPDTEIFCEGEPIKREDEERLDEVGYDDVGGVRKQMAQIRELVELPLRHPQLFKSIGVKPPKGILLYGPPGSGKTLIARAVANETGAFFFCINGPEIMSKLAGESESNLRKASEE

SEQ ID NO: 34925 - protein, 480 aa, Triticum aestivum
  misc_feature (183)..(183): Xaa can be any naturally occurring amino acid
MVKICCIGAGYVGGPTMAVIAIKCPAIEVVVVDISKPRIDAWNSDTLPIYEPGLDDVVKACRGKNLFFSTDVEKHVAEADIIFVSVNTPTKTRGLGAGKAADLTYWESAARMIADVSKSDKIVVEKSTVPVKTAEAIEKILTHNSKGINYQILSNPEFLAEGTAIEDLFKPDRVLIGGRETPXAQKAVQALKEVYAHWVPEENIITTNLWSAELSKLAANAFLAQRISSVNAMSALCEATGANVSEVSYAIGKDSRIGPKFLNASVGFGGSCFQKDILNLVYICECNGLPEVANYWKQVIKINDYQKSRFVNRVVSSMFNTVSGKKIAVLGFAFKKDTGDTRETPAIDVCKGLVGDKAQVSIYDPQVTEDQIQRDLAMNKFDWDHPMHLQPTSPTAVKQVSVVWDAYEAAKGAHGVCILTEWDEFKKLDYQKIFDNMQKPAFVFDGRNVVDAEKLREIGFIVYSIGKPLDGWLKDMPAVA

SEQ ID NO: 34926 - protein, 327 aa, Glycine max
MEISFPWILVATMVMAMRPLSFRIKANQLSYDYYKFSCPNLESIVKSELLSLFLTDATAPAAFLRLMFHDCQVQGCDASILLDSNYLAHSHSSEMISSRNFGIRKRETIGQMKSILEEECPGQVSCADIIVLAAKESVSLSGGPHIEIPLGRKDSRTCSFHEADAKLPSPIITVDEFISIFMSIGMNIEESVSILGAHTLGIGHCFNIVGRLYDPRLGDKMDFALEASLRLACPTEIPLTNLTFVPNDMTPVIFDNQYYRDIMMGRGLFGIDSSISRDPRTAPFVMRFAMDQNYFFKAFSSAFVKLSSTNVLTDVQGDVRRQCNQVN

SEQ ID NO: 34927 - protein, 403 aa, Polaromonas sp. JS666
MLSCQVVFFQLPRENPMPGLLPNVDPDGLLEFSVVYTDRALNHMSRSFQGVMTDISSILKEVYNAPSAVLVPGSGTYGMEAVARQFATGKQVLVIRNGWFSYRWTQIFDMGSIPASSTVLKAHQTGPGAQAPWAPAPIAEVQATIAKEKPAVVFAPHVETASGMILPDSYLRAVADAVHAVGGLFVLDCIASGAMWVDMKATGVDVLISAPQKGWSSSPCCAMVMLSERARAAIEGTTSTSFACDLKKWLQIMETYEKGGHAYHATLPTDALTRLRAAMKETQAYGFAKVRAEQEALGGKVRALFESRGLPSVAADGFKAPGVVVSYTTDHEIQSGKKFMAQGLQTAAGVPLQCDEGADFMTFRVGLFGLEKWHQSDRTVGQLAGALDRIGLVERVAADALAG

SEQ ID NO: 34928 - protein, 624 aa, Oryza sativa Indica Group
MGIAEVALHSMPGAFAAHSPASNLPLAADAARGRRRRSANSLHSSRALQGPVRFPGLRAAVECQCQRIDDLARVTEGNGAWVKDAVDKASHALGDVRVPGQAVGGNGSVNGSAAKPPPQRRKASSVEDEAWELLRESVVYYCGSPVGTIAANDPNDANPMNYDQVFIRDFIPSGIAFLLKGEYEIVRNFILHTLQLQVFFFRHIIALSLEEVRTMSWEKTMDCHSPGQGLMPASFKVRTIPLDGDEDATEEVLDPDFGEAAIGRVAPVDSGLWWIILLRAYGKCSGDLTVQERIDVQTGIKMILKLCLADGFDMFPTLLVTDGSCMIDRRMGIHGHPLEIQALFYSALLCAREMLTPEDGSADLIRALNNRLIALSFHIREYYWVDMQKLNEIYRYKTEEYSYDAVNKFNIYPDQVSPWLVEWIPPKGGYFIGNLQPAHMDFRFFSLGNLWSIVSSLATTHQSHAILDLIESKWSDLVAEMPLKICYPALENQEWKIITGSDPKNTPWSYHNGGSWPTLLWQLTVASIKMNRPEIAAKAVEVAERRIAIDKWPEYYDTKRARFIGKQSRLYQTWSIAGYLVAKQLLDKPDAARILSNDEDAEILNALSTNRKRGKKVLKKTFIV

SEQ ID NO: 34929 - protein, 388 aa, Vibrio cholerae O1 biovar eltor str. N16961
MKIAIAGTGYVGLSNGILLAQHNEVVALDIVVSRVEQLNDKISPIADPEIESFLQHQPLNFRATCDKRDAYQDAQFVVIATPTDYDPQTNHFDTRTVEAVIDDVLAINPQAIMVIKSTVPVGYTKRIKQRLCCNNLIFSPEFLREGRALYDNLYPSRIIVGEKSERGQAFATLLAQGAKKMDIPILLTHSTEAEAVKLFSNTYLAMRVSFFNELDTYAETHGLDTKQIIEGVGLDPRIGNHYNNPSFGYGGYCLPKDTRQLLRNFEDVPNNLIRAIVDANTTRKDHIAFSILNRNPKVVGIYRLIMKSGSDNFRASSILGIMKRIKAQGVEVVIYEPVLNESTFYGSPVIRDLAQFKAMAEVIVTNRRVAELEDVAEKIYTRDLFGQD

SEQ ID NO: 34930 - protein, 302 aa, Candida glabrata
MVSEAEFLASYPQKCPAGSLPGTPGNTDEAQEGALKQLRSELEAAGFKERLDDSTLLRFLRARKFDVALAKEMFENCEKWRKEYGTNTIMQDFHYDEKPLVAKYYPQYYHKTDKDGRPVYFEELGAVNLTEMEKITTQERMLKNLVWEYESVVNYRLPACSRAAGYLVETSCTVMDLKGISISSAYSVLSYVREASYISQNYYPERMGKFYLINAPFGFSTAFRLFKPFLDPVTVSKIFILGSSYQSELLKQIPAENLPSKFGGKSEVDEAAGGLYLSDIGPWRDAKYIGPEGEAPEMFSMK

SEQ ID NO: 34931 - protein, 370 aa, Arabidopsis thaliana
MSQNGKIIPNLDQNSTRLLNLTVLQRIDPYIEEILITAAHVTFYEFNIELSQWSRKDVEGSLFVVKRSTQPRFQFIVMNRRNTDNLVENLLGDFEYEVQGPYLLYRNASQEVNGIWFYNKRECEEVATLFNRILSAYSKVNQKPKASSSKSEFEELEAKPTMAVMDGPLEPSSTARDAPDDPAFVNFFSSTMNLGNTASGSASGPYQSSAIPHQPHQPHQPHQPTIAPPVAAAAPPQIQSPPPLQSSSPLMTLFDNNPEVISSNSNIHTDLVTPSFFGPPRMMAQPHLIPGVSMPSAPPLNPNNASHQQRSYGTPVLQPFPPPTPPPSLAPAPTGPVISRDKVKEALLSLLQEDEFIDKITRTLQNALQQ

SEQ ID NO: 34932 - protein, 606 aa, Oryza sativa
MATWRLRRAAAAIAASSAVVAAGAAWPSASASDPSPAALEAARRRVAQPGAAPPPRAAQRAALAGSTPADPLDVLVVGGGATGCGVALDAATRGLRVGLVEREDFSSGTSSRSTKLIHGGVRYLEKAVFNLDYGQLKLVFHALKERKQVVYYWFGLKFYDIVAGRRLLHLSRYYSVDESVELFPTLAKNSHDRSLRGTVVYYDGQMNDSRLNVGLACTAAVVGAAILNYAEVVSLIKDESGERIIGARIRDTLSGKEFDAFAKVVVNAAGPFCDSVRKMANNDVVPMISPSSGVHIVLPDYYSPDGMGLIVPKTKDGRVVFMLPWLGRTVAGTTDSSTAITMLPEPHEDEIQFILDAICDYLNVQVRRSDVLSAWSGIRPLAMDPSAKNTESISRDHVVFEDYPGLITITGGKWTTYRSMAEDAVNAAIRSGNLKPANGCVTDHLHILGGYGWDPASFTVLAQNYKRMKRTYGGKIIPGAMDSAVSKHLSHAYGTLATQVASIAQNEGLGKRLAHGYPFLEAEVAYCARHEYCESAVDFIARRCRLAFLDTDAAGRALPRIIEILALERKWDKARQKLELQKGKDFLETFKSSKNAQFRDGKHNGQ

SEQ ID NO: 34933 - protein, 351 aa, Prochlorococcus marinus str. AS9601
MSLSNTSANKNLPNSVPSERLWLRSELMGTQVITTDTGRRLGVVGEVVVDIDRREVVALGLRDNPLTRFLPGLPKWMPLESIKQVGDVILVDSLDSLSESFSPERYGKVINCQVITESGQLLGRVLGFSFDIETGDLISLVMGAVGVPLLGEGVLSTWEIPVEEIVSSGTDRIIVYEGAEEKLKQLSSGLLEKLGVGGSSWDEREVNGYSANLVPVENQLLSGSESEQQNNLVEEYEEVVEQDDYEDDYEDDYEDELEYIEIKGSEAELNNRKKLYMDNDDSDQIQNQNIVNQINEKNNIDLKQKKQSTTNLASKRPIQNATETLDIEPLNEQNLVQDNKKSEKFEIDDPW

SEQ ID NO: 34934 - protein, 350 aa, Oryza sativa Japonica Group
MALPRGVRSPKPMAAAAASASPPQPRPGHMLVLGTGFVGRYVSQRLLAQGWRVSGTCTSPAKKTELEMLGMDASIFDATSSRCCFFFFFLLFLFFVPSSLTNLRSLQDATHLLISIPPIPGIGDPLLSSHSNLQTTLSNSNLQWLCYLSSTSVYGDCGGAWVDEDHTVNPKTESVKLRYAAEKGWLNVIDDLDLSAFVFRLGGIYGPGRSAVDTIAKSKSLSRRQKSRESKQYTARIHVADICQAILASMSIRSARRIYNVVDDDPAPRSEVFAFARSLVERKHPGLIMDSVVLPATQDRIVAAEKRVSNARLKEELGVKLLHPTYKSGLQSILDSWSVESSFSNRNVDV

SEQ ID NO: 34935 - protein, 356 aa, Gibberella zeae PH-1
MSTLFGSASSAAATSIGDLKQDVALSDPPTDTISGLSFSPAPNGPDFLAISSWDNKVRIYEIATNGQSQGRHAYEHSQPVLSCDFSKDGTKIVSAGADKNIKVCDLASQQDIVVGTHDQPVRTARFFDSGNGPMVVSGSWDKTVKYWDLRQQGPAATVACQERVYTMDVRDNLCVVGTADRYINVIDLKNPTKFYKTLQSPLKWQTRVVSCFTDSAGFAIGSIEGRCAIQYVEAKDSSANFSFKCHRDPPANGVTNVHAVNDISFHPVHGTFSTAGSDGTFHFWDKDAKHRLKGYPNVGGSITSTTFNKNGSIFAYAVGYDWAKGYQHNTQSYPIKVMLHPVTNDECKPRPSAKKR

SEQ ID NO: 34936 - protein, 323 aa, Clostridium thermocellum ATCC 27405
MFDVVAVGELLIDFLPAGTNENGMPLFSSNPGGAPANVLAMLSKLGAKTAFIGKVGKDGFGQFLKATLDNAGIDTSNLLMSSSEMTTLAFVHLNEKGDRSFSFYRKHCADVSLDAGELDKDLLRTCHFLHFGAVSLTDEPSRTATLEAARIAKEAGAIISYDPNYRPALWSNEHEARKYMLKAVEYADLVKVSEEELWLLAESEDFSKGAHKLLAMGPSVVFVTCGEKGSYVFTGSCKANHCGYDVKVVDTTGAGDAFVGAMLWQLRGMSLEEISQICEQKWGELLAFSNAAGTIVATKKGAIPAMPDLDTINTFMRQFLEEK

SEQ ID NO: 34937 - protein, 436 aa, Fulvimarina pelagi HTCC2506
MTQQITRLDNGLTVVSDRMDNLESAALGFWVKTGARDEHEGEHGIAHLLEHMAFKGTARRSARDIAEEIENVGGELNAGTSVESTSYYARVLKDDVPLALDILSDILLNSRFDPVELEREQHVILQEIGAAEDTPDDIVFDHFQETAFTDQIVGRPILGTRDSVRSFSPSDLRAYLDRQYGPDRIVVSAAGAVEHDAIVAQVSSLFEHRRSPILEPANVKRSAARYTGGEYRERRDLADAQLLIGFEGRPYYQRDFYSSQVLSMVLGGGMSSRLFQEIRERRGLCYSIYAFHWSFSDSGLFGIHAATGEEELQELGETIVEELVKASEEISDTEVVRARAQMRSSLMMGQESPAVRAGQMARQLMFNGAIISSEELFDRLAAIDAARLKDLAGRLFIDGAPTLAAIGKLERLASVDALAMPLKAGQTRPRSAAGMA

SEQ ID NO: 34938 - protein, 233 aa, Campylobacter coli RM2228
MAQALAYGLKDSYNIYIVGRNLEKLQILEKEGFKTLLYKDFNIENKNIILAFKPYALESVAANLKGKAKILISVLANTDFDKLKLIQAQNYARIMPNTAAKYKASTTPYVLKNSNFKDEVIEILNTFGKAYELNEEKQMNAAMAISGCAPAFLALVAESIANAGVYEGLSKDLSLNLTRSLFKSAAALLENEHPAIIKENICSPAGVTIKGIKVLEQKGIRGTFFEALNASAT

SEQ ID NO: 34939 - protein, 358 aa, Glycine max
MSHFKGKYHDELIANAAYIGTPGKGILAADESTGTIGKRLASISVENVESNRRALRELLFTAPGALKYLSGVILFEETLYQSTAAGKPFVEVLKEAGVLPGIKVDKGTVELAGTNGETTTQGLDGLGQRCAKYYEAGARFAKWRAVLKIGPNEPSELAIHENAYGLARYAVICQENGLVPIVEPEILVDGSHDIHKCAAVTERVLAACYKALNDHHVLLEGTLLKPNMVTPGSNSAKVSPQVVAEHTVRALQRTVPAAVPAIVFLSGGQSEEEASVNLNAINQVNGKKPWSLSFSFGRALQQSTLKAWSGKEENVKKAQEALLVRAKANSEATLGTYKGNSKLADGASESLHVEDYKY

SEQ ID NO: 34940 - protein, 296 aa, Synechococcus sp. CC9605
MSAEFDFKAYLGKAKEQVEAALDGSLGPERPESLREAMRYSLLAGGKRLRPILCLAACELAGGEATQALPTAVALEMIHTMSLIHDDLPAMDDDDLRRGRPTNHKVYGEAVAILAGDALLTRAFEMVALRSPGVPAERLLKVVGELSLVAGAPGLVGGQVVDLESEGKEVDLETLEYIHLHKTGALLSACVITGAMIGGADEALIKALRTYARGIGLAFQIIDDILDITASSEVLGKTAGKDLIADKTTYPKLLGLDESRRRADALVNEAKESLQPWAEKAVPLLALADFITSRDR

SEQ ID NO: 34941 - protein, 376 aa, Burkholderia pseudomallei K96243
MAKRDYYEVLGVAKNASDDEIKKAYRKLAMKYHPDRNPDSKDAEEHFKEAKEAYEMLSDGQKRAAYDQYGHAGVDPNVGAAGAQGFGGFADAFGDIFGDIFGQAAGGGRARGGPQVYRGADLRYSMEITLEQAAHGYDTQIRVPSWAACGVCHGSGAKPGTKPETCPTCHGQGTVRMSQGFFSIQQTCPKCHGTGTYIPEPCVHCHGSGKVKETKTLEVKIPAGIDDGMRIRSAGNGEPGINGGPSGDLYVEIHIKPHAVFERDGDDLHCQMPIPFTTAALGGEIEVPTLAGRASFTVPEGTQSGKTFRLRGKGIKGLRSSIAGDLYVHVQVETPVKLTDQQRDLLKQFEKSLAEGGPRHSPQSKSWFDRVKSFFE

SEQ ID NO: 34942 - protein, 161 aa, Neurospora crassa
MPLESLGLGGGNDLSDPNDPRVCIIHSLSMESPGREPVVIDLSTPGSLEDLKKKPFTIKEGAKFTMKAQFKVQHEILSGLHYVQTVKRGKIRIPGGKTSEMIGSYAPNTDKNPMYTKTFAEEEAPTGMLARGNYNAVSRFVDDDGKTHLEFEWSFDIAKDW

SEQ ID NO: 34943 - protein, 324 aa, Vigna unguiculata
MVKAIRVHEQGGPQVLKWEDVEIGEPKEGEVRVRNKAVGVNFIDVYFRKGVYKPPSFPFTPGMEAVGVVTAVGAGLTGRQVGDLVAYAGQPMGSYAEEQILPANKVVPVPSSIDPPIAASIMLKGMTTHFLVRRCFKVEPGHTILVHAAAGGVGSLLCQWANALGATVIGTVSNKEKAAQAKEDGCHHVIIYKEEDFVARVNEITSGNGVEVVYDSVGKDTFEGSLACLKLRGYMVSFGQSSGSPDPVPLSSLAAKSLFLTRPSLMQYVVTRDELLEAAGELFANVASGVLKVRVNHTYPLSEAAKAHEDLENRKTSGSIVLIP

SEQ ID NO: 34944 - protein, 180 aa, Streptococcus pyogenes MGAS8232
MIKKENIPNLLTLVRIAMIPFFLFITSSSNKVGWHIFAAVIFAIASFTDYLDGYLARKWHVVSNFGKFADPLADKMLVMSAFIMLVGLGLVPAWVSAVIICRELAVTGLRLLLVETGGKVLAAAMLGKIKTATQMLSIILLLCHWIFLGNVLLCIALFFTIYSGYDYFKGASFLFKDTFK

SEQ ID NO: 34945 - protein, 530 aa, Bradyrhizobium japonicum USDA 110
MRRAPAFDMERTHLLTSFQDFGLAEPIARALSEENYVTPTPIQAQTIPTALTGRDVVGIAQTGTGKTASFALPILHRLLEHRIKPQPKTTRVLVLSPTRELSGQILDSFNAYGRHIRLSSTLAIGGVPMGRQVRSLMQGVEVLVATPGRLLDLVQSNGLKLGSVEFLVLDEADRMLDMGFINDIRKIVAKLPIKRQTLFFSATMPKDIAELADSMLRDPARVAVTPVSSTAERINQRILQVDFSAKPAFLTKLLKDEPINRALVFTRTKHGADKVVKTLEKAGIAASAIHGNKSQNHRERTLAQFRSGDIRTLVATDIAARGIDVDGITHVINFDLPNVPETYVHRIGRTARAGAEGTAISLVAGGEELSYLRDIERLIKVALPREDLRTDAGRRDAGPPPSQQRQGRPGRPGQRPQGARHGERHGDGRRTDERHGDGRHHSAGKQGDGRPGEGRHGDARHVDGRPGSGPKASKGSRRRRSGGKMHSSQTDRPEQRSAHSAGTPDGIQGVAFLRRDSRPMGQPTRKPYSH

SEQ ID NO: 34946 - protein, 564 aa, Oryza sativa Japonica Group
  misc_feature (23)..(23): Xaa can be any naturally occurring amino acid
  misc_feature (56)..(56): Xaa can be any naturally occurring amino acid
  misc_feature (104)..(104): Xaa can be any naturally occurring amino acid
  misc_feature (126)..(126): Xaa can be any naturally occurring amino acid
MASAAVIPSSAPGAAAAGAAAVXSAGWVVDERDGFISWLRGKFAAANAIIDLLLLXLRSVGEPGEFEHVAAAVQQRRHHWAPVIHMQQFFPVGDVAYALQQAGXRRRAPPHHQQQGPGASPSPPPXPPRGRPSFSASHSHHRHGGHHHRSDSVRGGGTGATAGSDKDGREVHNKEEKGMKEAENVVEAKSSQLESLVSHEGEKTPRPQAVAEGSSKVVPTPVEYTVNDIIDGKTVNAVEGLKVYEGLVNENEKNKILSLLNETKASFRRGGLEAGQTVIIGKRPMKGHGREIIQLGIPIVEGPPEDDYPRETKVEAVPGLLHDLFDRLCQKEIIPTKPDYCVIDYYNEGDYSHPHQSPPWYGRPFCTFCLTDCDMVFGRVISGERGDHRGPLKLLLSTGSLLVLHGKSADVAKRAIPAACKQRILLSFGKSLSRKQVPSESVSRFTTPLTPPPMPWGPPRPANMARHSSSPKHFGYAPNSGVLPAPAIGAHHIPPSDGMQPLFVAPAPVAAAAMPFPSPVPLPNLTNSLDGRSCSKVCSTTTPSSWHGGLPSSWIGSRTASSDD

SEQ ID NO: 34947 - protein, 334 aa, Leuconostoc mesenteroides subsp. mesenteroides ATCC 8293
MAVLVLGGAGYIGSHMVKRLVEAGRDVVVVDALFTGHRAAVNPAATFYQVDIRDKAELSAVFDKENIEQVVHFAAFSIVPESVANPLKYFDNNTSGMITLLEVMKAHDVKQIVFSSTAATYGNPVHIPIKETDPQNPINPYGESKLMMEKIMNWSDQADGVKWVALRYFNVAGAAEDGTIGEDHNPETHLVPIILQAGLGQRDYIEMFGDDYNTPDGFNVRDYVHVLDLADAHILALQYLADGHESNQFNLGSATGFSVKEMVEAAREATGVDIPAKIGPRRAGDPDILIANSDKAREVLGWAPKYDNVQDIIKTAWQWHQSHPKGYDERHEDQ

SEQ ID NO: 34948 - protein, 539 aa, Schizosaccharomyces pombe 972h-
MSSTEVPGEVSTSVSSYFDTILILDFGSQYSHLIARRLREIHVYAELLPCTQKIEALPFKPIGVILSGGPYSVYDDIAPHVDPAVFELGVPVLGICYGMQEIAWLNGRCVEPGIEREYGPATVSMEPEIKTEVFKSFFNSMPKEFEVWMSHGDRLSALPNGYETIGRTKNSPFAVIAHVTKPIIGLQFHPEVTHTPLGLQLIKNFAIEICHAKPNWSMENFVDKEILRIRKMIGPSDHVIGAVSGGVDSTVASKVLKEAIGDRFHAIMVDNGLLRLNEAEIVRETLNKHLGIQLTVVDASEEFIGKLKGVTDPEKKRKIIGNTFIHVFEREAERIVKETNGKVEYLLQGTLYPDVIESISFKGPSQTIKTHHNVGGLLKDMKLKLIEPLRELFKDEVRALGELLGIEHSLVWRHPFPGPGLGIRILGEVNAAQLEIARKADHIFITEIRNHGYYDKISQAFAALLPVKAVGVMGDKRTHEQVIALRAITTSDFMTADWYDGFSIKFLKLVSSRICNEVSGVNRVLYDISSKPPATVEME

SEQ ID NO: 34949 - protein, 214 aa, Oryza sativa Japonica Group
MRDVVVAVGGGTKAASRQQGQGGVTLAAAAAGSGSGSAASPCAACKLLRRRCAAGCVFAPYFPPGEPHKFANVHKVFGASNVSKLLQEIPVQHRGDAVSSLVYEANARVRDPIYGCVGAISSLQQQVEALQAQLALAQAEMVRLRMSNDYIGRRLRARGCGGGGGGGGGSTTTTTGSPSSMSSPAKTAEPEPLCKPTPELDMVVDQPDFGFWSY

SEQ ID NO: 34950 - protein, 583 aa, Schizosaccharomyces pombe 972h-
MSSPDRSIDIDLEKYPSTATKSVYGQSKDDKNVFDIHPTESEVIPGEVEYADTPSHQNFLQKFFSDFKPVKADREDGVALKRHLKGRHMQMIAIGGAIGTGLFVGSGSSLADGGPASVIIDYTLIGIMMFFTVYALGELAVSYPVAGGFYNYAVRFIDPAWGFAVGWNYFMNYFVTFPLELTTCAITFRYWTDINSCAWITIFLVFVICINLFGVRGYGEVEFILSTLKVVATTGFIILAIIINCGGVPTDPRGYIGGKIIKNKPFRHSFKGFCSVFTTAGFSFSGTEVVGLAAAEAEDPQKSLPRATKQVFWRIAIFYVVSLILIGLLVSPDDPRLMGNSSDGSTSPFVLAIKEANIRGLPSVFNAVIIISTVSVANSCTFTASRTLHAMAAKGDAPRFFAYTDRLGRPLLAMAVCLLFGFFAYINAAGDVSDTVFDWLLAISGISNFFSWGSINLCHIVFRLAMKKQGRSLDQLGFVSPMGIWGSAIGLAFNILCLMAEFYVSLFPIGSKPNANDFFQGYLAAPIVIAFFIGYKIYDRSHIPSLSKLDLDTGLRTYPPKDKESEKIRDAKGFFKWIWQSLC

SEQ ID NO: 34951 - protein, 170 aa, Mycobacterium smegmatis str. MC2 155
MSNGTPTHTLSVLVEDKPGVLARVSSLFSRRGFNIQSLAVGATEQKDMSRMTIVVSVEDSPLEQITKQLNKLINVIKIVEQEEDNSVSRELALIKVRADATTRGQIIEAVNLFRAKVVDVSTESLTIEATGTPEKLEALLRVLEPYGIREIAQSGVVSVSRGPRGIGAAK

SEQ ID NO: 34952 - protein, 417 aa, Prochlorococcus marinus str. AS9601
METIQNFPEITKKDFPLLNNNIKNNEQIIYLDHAATTQKPIQVLKKIDEYYRNFNANVHRGAHQLSAKATEEFENARFSISKYIKANSPKEIIFTRNATEAINLAARSWGEYSLGENDEILLSIMEHHSNIVPWQMVAAKNKCKLKFIGIDKNGQLDLDDFKSKLTSRTKLVSLVHVSNTLGCCNPIKEITKLAKQKGSLVLIDACQSLAHQKLDVIDLDIDFLAGSGHKLCGPTGIGFLWSRQEILEKIPPFFGGGEMIQDVFEETSTWADLPHKFEAGTPAIAEAIGLAEAINYINTIGLNEINEYEKTITKYLFEKLNQIENIEIIGPPPEIDPDRASLATFYIKNIHSNDIAEILDSKGICIRSGHHCCQPLHRYIGIKSTARISMNFTTNKEEIDIFLEKLKDTIDFLKINS

SEQ ID NO: 34953 - protein, 357 aa, Triticum aestivum
MWSGQGPQKPNPRRARLSPLVLSPRPAASEIRASPAAMGGDWQELAQSAVIGLIFAFLVAKLISVVLAFKEDNLRITRSAPAPAPSPDATAPALDGGTSGGDGDSDGDWEGVESTELDEDFSAASAFVAASAAGVPEEAQLRLYGLYKIATEGPCTAPQPSALKLKARAKWNAWNKLGAMPTEEAMEEYITIVDEIFPNWADGSKKKDGETTMSASGSKGPMGPVFSSLMYEEDQGNESELGDIHVSAREGAIEDVKKHLAAGVQINLRDSEERTPLHWAVDRGHLDAVEVLVNSNADVNAQDNEGQTALHYAVLCEREDIAELLVKHHADLQIKDGDGNTARDLCSSAWPFMKPAN

SEQ ID NO: 34954 - protein, 463 aa, Glycine max
MEKKQGFFSALKDEVVRGLSPSRSRSTSPARTVSPITGLLRRKKRSPSPDSSVARSVSLRPLGETLTPLMEGPDPDGTENGDPKRIGSGLGHWMKGQLSRAPSVSSYKRSDLRLLLGVMGAPLAPVHVSSTDPLPHLSIKDTPIETSSAQYILQQYTAASGGLKLQNSIRNAYAMGKVRMVASEFETATRVVKNRSRCAESGGFVLWQMDPDMWYVELAVGGSKVHAGCNGKLVWRHTPWLGAHTAKGPVRPLRRALQGIDPRTTASMFADAKCIGEKNINGEDCFILKLCTDPETLKARSEGPAEIIRHVLFGYFSQKTGLLVHIEDSHLTRIQSNGGDAVYWETTINSFLSDYKPVEGIMIAHSGHSVVTLFRFGEMAMSHTKTRMEEAWTIDEVAFNVQGLSVDCFIPPADLRTASVSEACELPQDERAKNSLAVHRAKVVALEKSHNCSIDSMIWKMEI

SEQ ID NO: 34955 - protein, 270 aa, Brassica napus
MASLASTTTLISSSSVLLPSKPSPFSPAASFLRTLPSTSVSTSSSLRSCFSSISPLTCIRSSSRPSFAVKAQADDLPLVGNKAPDFEAEAVFDQEFIKVKLSEYIGKKYVILFLYPLDFTFVCPTEITAFSDRYEEFEKLNTEVLGVSVDSVFSHLAWVQTERKSGGLGDLNYPLVSDITKSISKSFGVLIPDQGIALRGLFIIDKKGVIQHSTINNLGIGRSVDETMRTLQALQYVQENPDEVCPAGWKPGEKSMKPDPKLSKEYFSAI

SEQ ID NO: 34956 - protein, 402 aa, Streptococcus pyogenes MGAS8232
MKIAVAGSGYVGLSLGVLLSLQNEVTIVDILPSKVDKINNGLSPIQDEYIEYYLKSKQLSIKATLDSKAAYKEAELVIIATPTNYNSRINYFDTQHVETVIKEVLSVNSHATLIIKSTIPIGFITEMRQKFQTDRIIFSPEFLRESKALYDNLYPSRIIVSCEENDSPKVKADAEKFALLLKSAAKKNNVPVLIMGASEAEAVKLFANTYLALRVAYFNELDTYAESRKLNSHMIIQGISYDDRIGMHYNNPSFGYGGYCLPKDTKQLLANYNNIPQTLIEAIVSSNNVRKSYIAKQIINVLKEQESPVKVVGVYRLIMKSNSDNFRESAIKDVIDILKSKDIKIIIYEPMLNKLESEDQSVLVNDLENFKKQANIIVTNRYDNELQDVKNKVYSRDIFGRD

SEQ ID NO: 34957 - protein, 165 aa, Streptomyces coelicolor A3(2)
MSNSKVYFDIDIDGQDAGRIVFELFEDVTPKTARNFLELATGEHGFGYAGSPFHRVIPQFMLQGGDFTNGNGTGGKSIYGEKFADENFQLKHTEPYLLSMANAGPNTNGSQFFVTTVPTPWLDGKHVVFGKVVEGTDVVDKIEGYGSSPAGKTSKEIKVRASGKL

SEQ ID NO: 34958 - protein, 304 aa, Streptococcus pyogenes MGAS8232
MTKVRKAIIPAAGLGTRFLPATKALAKEMLPIVDKPTIQFIVEEALKSGIEEILVVTGKAKRSIEDHFDSNFELEYNLQAKGKNELLKLVDETTAINLHFIRQSHPRGLGDAVLQAKAFVGNEPFVVMLGDDLMDITNASAKPLTKQLMEDYDKTHASTIAVMKVPHEDVSSYGVIAPQGKAVKGLYSVDTFVEKPQPEDAPSDLAIIGRYLLTPEIFDILERQTPGAGNEVQLTDAIDTLNKTQRVFAREFKGNRYDVGDKFGFMKTSIDYALEHPQVKEDLKNYIIKLGKALEKSKVPTHSK

SEQ ID NO: 34959 - protein, 332 aa, Streptomyces coelicolor A3(2)
MTRIGINGFGRIGRNVLRALLERDTKLEVVAVNDLTEPATLARLLAFDSTAGRLGRPVTVDGDTLVVDGHRIKVLAEREPARLPWAELGVDIVLEATGRFTSADAARAHLTAGARKVLVSAPSSGADVTLAYGVNTDAYDPAAHTIVSNASCTTNALAPLAAVLDELAGIEHGFMTTVHAYTQEQNLQDGPHRDARRARAAGVNIVPTTTGAAKAIGLVLPGLDGKLSGDSIRVPVPVGSIVELNTTVARDVTREDVLAAYRAAADGPLAGVLEYSDDPLVSSDITGNPASSIFDSALTRVEGRHIKVVAWYDNEWGFSNRVIDTLALLATR

SEQ ID NO: 34960 - protein, 151 aa, Zea mays
MTTRVNSRMCFPAPTRFARVYGMESISEVVVEGLSRVKRCTDEGRVLMSLDLQVLNFQFNYVTYLEVKMARHSDSFDVLSAKSWQRGLPLTVLVPIKQAYYLPETEYVHWARSHPEYSKSQVVGLVNLVATMKGWKRKTRLETVEKIEAGP

SEQ ID NO: 34961 - protein, 334 aa, delta proteobacterium MLMS-1
MKILITGSAGFIGNALALRLLERGDEVIGVDNVNAYYDPTLKESRLNRVRGCAGFTEERVSLEDRPAMERVFRQHQPQRVVNLAAQAGVRYSLENPHSYVDANIVGFTNILEGCRHHGVEHLVFASSSSVYGANTEMPFSVHHNVDHPLSLYAASKKAGELMAHTYAHLYRLPVTGLRFFTVYGPWGRPDMALFLFTQKILAGEPIDVFNYGNHRRDFTYIDDIVEGVIRTLDHPAEPNPDWNGATPDPCTSTAPYRLYNIGAHRPVELMHYIEVLEENLGRKAEKNLLPLQPGDVPDTYADVADLKADVGYEPTTPVEEGVARFVEWYLEYYR

SEQ ID NO: 34962 - protein, 346 aa, delta proteobacterium MLMS-1
MAILITGGAGYIGSHTTLELLNAGHEVVVLDNLSNSSPASLERVAALTGKAPVLVQGDINDQELLAELFARHQISAVIHFAGLKAVGESVAQPLAYYHTNVGGTVNLCRAMAAAGVFRLVFSSSATVYGEQQQMPLTEDCPTGKPTNPYGRTKLMIEELLQDLVRADQRWSVALLRYFNPVGAHPSGLIGEDPRGTPNNLLPYISQVAIGKRPELQVYGNDYPTRDGTGVRDYIHVVDLARGHLAALDYLQRQTGVGVWNLGTGRGYSVLEMVEAFASAAQRPVPYRIVARRPGDIAEYWSDPGKARRELGWQAEKGLPEMMADAWRWQCRNPDGYSSQTLLHCNA

SEQ ID NO: 34963 - protein, 187 aa, Pseudomonas syringae pv. syringae B728a
MPIINSQVKPFKATAFKNGAFVDVSDADFKGKWSVVFFYPADFTFVCPTELEDLADNYEEFKKLGVEIYSVSTDTHFAHAAWHNTSPAIGKIQYTMIGDPTLTISRNFDVLIEEAGLADRGTFVINPEGQIKIVELNDGGVGRDASELLRKIKAAQYVAAHPGEVCPAKWKEGEATLAPSLDLVGKI

SEQ ID NO: 34964 - protein, 185 aa, Gibberella zeae PH-1
MDSFQQQQQQQPRGACYSCGSTAHQARDCPTKGPAKCYNCGGEGHMSRDCTEPMKDNKSCYKCGQPGHISRDCPMSGGSGQATECYKASSNCRLLIGHIARNCNKSSYGNNYGGGFQQQGGAGKTCYSCGGFGHMSRECVNGMKCYNCGESGHYSRDCPKESAGGEKICYKCQQPGHVQSQCPGN

SEQ ID NO: 34965 - protein, 281 aa, Coccidioides immitis RS
MSRPEDSLPPDLYYNDAESRKYTSSSRIQNIQSEMTHRALELLELHSPSLILDIGCGSGLSGEILSSVPPSQGGPHTWIGMDISPSMLDIALQREVDGDLFLADMGQGIPFRPGTFDAAISISAIQWLCNAETTDVSPEGRLRRFFDGLYASLRRGARAVCQFYPKNDAQRNMISAAAMKAGFGAGILEDDPGTKNGKLYLVLTVGGGGLQGDITGVVKGMDDVEVVDGRRKSQNLRKGTNPADVKGSKAWILRKKEQMARKGKVVKASSKYTGRKRRPVF

SEQ ID NO: 34966 - protein, 182 aa, Arabidopsis thaliana
  misc_feature (134)..(134): Xaa can be any naturally occurring amino acid
MASSMLSSAAVVTSPAQATMVAPFTGLKSSAAFPVTRKTNKDITSIASNGGRVSCMKVWPPIGKKKFETLSYLPDLSDVELAKEVDYLLRNKWIPCVEFELEHGFVYREHGNTPGYYDGRYWTMWKLPLFGCTXDSAQVLKEVEECKKEYPGAFIRIIGFDNTRQVQCISFIAYKPPSFTEA

SEQ ID NO: 34967 - protein, 137 aa, Mycobacterium smegmatis str. MC2 155
MTIPAPKLSLTDDEWREKLTPQEFAVLRRAGTERPFTGEYTDTKTEGVYQCRACGAELFRSSEKFESHCGWPSFFDPADSDAVILRPDDSLGMRRVEVLCANCHSHLGHVFEGEGYPTPTDKRYCINSISLRLVPAE

SEQ ID NO: 34968 - protein, 377 aa, Streptococcus mutans
  misc_feature (1)..(1): Xaa can be any naturally occurring amino acid
  misc_feature (17)..(17): Xaa can be any naturally occurring amino acid
  misc_feature (29)..(29): Xaa can be any naturally occurring amino acid
  misc_feature (91)..(91): Xaa can be any naturally occurring amino acid
  misc_feature (178)..(178): Xaa can be any naturally occurring amino acid
  misc_feature (274)..(274): Xaa can be any naturally occurring amino acid
  misc_feature (303)..(303): Xaa can be any naturally occurring amino acid
  misc_feature (338)..(338): Xaa can be any naturally occurring amino acid
XAKRIKNTTPKQDGFRXPGEFEKQKQIWXLWPWRNDNWRLGAKPAQKAFLEVAEAISEFEPVSLCVPPLQYENALARVSELGSHNIRIIEXTNDDAWIRDCGPTFLVNDKGDLRAVDWEFNAWGGLVDGLYFPWDQDALVARKVCEIEGVDSYKTKDFVLEGGSIHVDGEGTVLVTEXCLLHPSRNPHLTKEDIEDKLKDYLNCVKVLWVKDGIDPYETNGHIDDVACFIRPGEVACIYTDDKEHPFYQEAKAAYDFLSQQTDAKGRPLKVHKXCVTKEPCYLQEAATIDYVEGSIPREEGEXAIASYLNFLIVNGGIILPQYGDENDQLAKQQVQEXFPDRKVVGVRTEEIAYGGGNIHCITQQQPATLEHHHHHH

SEQ ID NO: 34969 - protein, 368 aa, Pseudomonas putida KT2440
MKTLNSTPRADGFHMPAEWAPQTQVWMVWPERPDNWRLGGKPAQAAHVTLAKAIARFEPVTVAVSAGQYENARRQLDQPNIRVVEISNDDAWVRDTGPTFVINDHGEVRGVDWGFNAWGGFDGGLYAPWNRDEELAAKVLEMERCQRYQTEGFVLEGGSIHVDGEGTVITTEECLLNRNRNPHLSREQIEAVLRDHLAVDTVVWLPDGLYNDETDGHVDNFCCYVRPGEVLLAWTDDSNDPNYARCHAAMDVLKNTRDAKGREFIVHKMPIPGPLFATAEECAGVDQVAGSQERDPSVRLAGSYVNFLIVNGGIIAPSFDDPADAEARAILARIFPDHEVVMIPGRELLLGGGNIHCLTQQQPAPVKR

SEQ ID NO: 34970 - protein, 426 aa, Mycobacterium smegmatis str. MC2 155
MVAEPNPVPPAATARSAPRHIRLTSHHGAEGALAIRWGAPTAAERGPLIGTTTTRAHRNVIGTHSGSYSVYRALAVASGALSPEHRADLTNTAPTDVIGPYAQWSDPSAIVSLDPWGAMVAEAFTTELAAGFDIRPTIAITKAHVILPEIADAIAKGRLQPDGRILLPNGAALVTKAAIEPVWYLPGVAARFGCSETTLRRVLFEETGGMYPELVTRSDLEVFLPPIGGQTLYIFGNARDLADSSVELTARVHDECNGSDVFGSDICTCRPYLTHAIEECIRGAQRGGVGLVAYSRKEGRALGEVTKFLVYNARKRQAGGDTADQYFARTECVAGVQDMRFQELMPDVLHWLGIRKIHRLVSMSNMKYDAIVGSGIEVGERINIPEELIPADARVEIDAKMAAGYFTPGPVPDAEELKIAKGRELA

SEQ ID NO: 34971 - protein, 507 aa, Salmonella enterica subsp. enterica serovar Typhi
MVLVILDGYGYREEQQDNAILNAKTPVMDALWAKRPHTLIDASGLEVGLPDRQMGNSEVGHVNLGAGRIVYQDLTRLDVEIKERTFFANPVLTNAVDQAKNAGKAVHIMGLLSAGGVHSHEDHIMAMVELAAERGAEKIYLHAFLDGRDTPPRSAEASLKKFEDKFAALGKGRVASIVGRYYAMDRDNRWDRVEKAYDLMTLAQGEFQADTAVAGLQAAYARDENDEFVKATVIRAEGQADAAMEDGDTLIFMNFRADRAREITRAFVNADFDGFARKKVVNLNFVMLTEYAADIKTAVAYPPASLANTFGEWMAKNDKTQLRISETEKYAHVTFFFNGGVEEPFAGEERILINSPKVATYDLQPEMSSAELTEKLVAAIESGKYDTIICNYPNGDMVGHTGVMEAAIKAVEALDNCIEQVTKAVESVGGQLLITADHGNAEQMRDPATGQEHTAHTNLPVPLIYVGEKNVKAVEGGKLSDIAPTMLSLMGMEIPQEMTGKPLFIVE

SEQ ID NO: 34972 - protein, 288 aa, Leuconostoc mesenteroides subsp. mesenteroides ATCC 8293
MNFKTLNNGAQMPQLGFGVFQIPAEETKQAVVDAINAGYRSIDTARVYGNEAETGQGVNEAIANAVVAREELFLTTKLWLSEFSYEAAKGAIDDSLKKLGTDYADLILLHQPYGDVYGAYKALAEAQADGKVKSIGISNFYPAKFVEFIKVIKTMNLPVPQIDQIEFHPYYQEKVARQLHDKYGVQIEAWGPLGRTANKYDTFHQPELVEIAAKHDKSVGQVVLRWIMQSNIITVAKSVNPSRMAENIDIFNFELDDDDMKKIETLDKNEPIFNHLDISTVERMYGWV

SEQ ID NO: 34973 - protein, 446 aa, Oryza sativa
  misc_feature (441)..(441): Xaa can be any naturally occurring amino acid
KWSRDYNWNSSQFALSNRGSPVLNNQSTPQTGHGYGDNDLTYIDWPAIDNFEDVDNLFRRCDSTYGQQQLPNTDELSWIPSSDAMYSSDVAMQPGFESSYSDYGILDDLSAFNCTEDKSLTTADPSSAVCDEQFDDSYLFNEQKTEDVYGEQIGNRYSSENAMEQPEDQKFSIASGSQLSSSQNLLNQKNHLDSTSPSNITSESYPERNCQIIPSGASFAERNLKVQKKVASSASGQLISDNVTGHPGHQTLTRRASYPCENHEIGKRSLGKRGLGHSDVAMGTSMVVDGSFVSSISSDNSVEENSFRQLQDAVSQLDVKTKMCIRDGLYRLARSAQNRQVFPNTMNNNGDSHNVKDMQNAETSGKFVDPGSIETQTNPIDRSIALLLFHQPSEHVTGAVDEAASLKSHNDNHQAAAKNQRVMHASSVHSPRGQGDPMDAXSCRNN

SEQ ID NO: 34974 - protein, 459 aa, Xanthobacter autotrophicus Py2
MGTPSPSGSDLDEAKAFLARHPDLQAIDIILTDYHGIGRGKTIRRHELEALYSTGRGMPASLFGQDVAGDDVEESGLILTDGGGDQVCWPIPGTLGLLPATGRGQVLVSMYHGDGTPLGVEPRHALGRQVARARAAGFEPMGALELEFYLVDRERDASGRYQPARYALTGRRSLATNTMSVDELDEMSPLFDAIYAGAAELGVPLESLISEYAPGQYELTIRYRDLARATDDVIIAKRLIRATARRFGMEACFMAKPFGDRSGSGMHLHLSLAGAGGANLFADLPSGELSPLMLHAIGGIRATIADTMLVLAPFLNSWRRFASVVYSPVSDTWGVENRTVAVRVPSGSAKGRHFEHRVAGVDANPYLVAAVTLAGALDGIAQRRDPGPPAEGNSYAGARAVHLPRSWLDAIDCFAQSDFAKQALGAELHHSFAAIKRAEWLRLALEVSDAEWALYGFTV

SEQ ID NO: 34975 - protein, 480 aa, Pseudomonas fluorescens Pf-5
MQLKDAQLFRQQAFIDGAWVDADNGQTIKVNNPATGEILGTVPKMGAAETRRAIEAADKALPAWRALTAKERATKLRRWYELLIENQDDLGRLMTLEQGKPLAEAKGEIAYAASFIEWFAEEAKRIYGDVIPGHQPDKRLIVIKQPIGVTAAITPWNFPAAMITRKAGPALAAGCTMVIKPASQTPFSALALVELAHRAGIPKGVLSVVTGSAGDIGGELTSNPIVRKLSFTGSTEIGRQLMAECAKDIKKVSLELGGNAPFIVFDDADLDKAVEGAIISKYRNNGQTCVCANRLYIQDSVYDAFAEKLKAAVAKLKIGNGLEEGTTTGPLIDEKAVAKVQEHIADALKKGATLLAGGKSMEGNFFEPTILVNVPKDAAVAKEETFGPLAPLFRFKDEAEVIAMSNDTEFGLASYFYARDLGRVFRVAEALEYGMVGVNTGLISNEVAPFGGIKASGLGREGSKYGIEDYLEIKYLCLGI

SEQ ID NO: 34976 - protein, 662 aa, Arabidopsis thaliana
MTTISDLSDDLVGDILSRVPFTSLISVRSTCKKWNALSKNQIFGRKTAARNQFLEFMILDSRVCSLRLDLQGIRNEDKEDFVDPSMKLISIPSNDDQVEISQVYHCDGLLLCIAKENSNVFVWNPYLGQTKWIRPRNTFHRYDRFALGYDNNRNHKILRFLYDEESNESSRRTHIDVYDFSSDSWRVLDVNPDCDIPFYQTGVSLKGNTYFFGQEVTQATKVTEIETCLLCFDFTTERFGPCLPLLFYPPCPSFETVTLSWVRDEKLAVLYNHYVTAEIIEIRISTKIEPNAVSWSSFLTVDMSLVNGLPDHFSMYFEAKSFFIDEEKKVVVLFDSKEIKTCRYQMAYIVGDDGYFKSVNIGEKVGDRERNGSQMKTSLLCIAEDNSGLVVWNPYLCQTKWIRLRNTFHRYDVFALGHDNNRNHKILRFLYDAKKYRTGRGRDNDVYDFSSDSWRRVFDVNPHRGELFYYSGVSLKGNSYFFGQEVTIEEEEEEVISQPRDYLLCFDFTTERFGPRLSLPFNPPSPNFDYLTLSWARDEKLAVLYNHYNTREIIEIWISTKIEPNTVSWSTFLTVDTSLINGLPDRFSTFYGPRSFFIDEEKKVAVFFDNKGTETGCYQVAYIIGDNGYFKSVKIGVISNSQWQQGILVCSSYVPSLVQLQD

SEQ ID NO: 34977 - protein, 425 aa, Pseudomonas fluorescens Pf-5
MSKTNASLMKRREAAVPRGVGQIHPIFADSAKNATVTDVEGREFIDFAGGIAVLNTGHVHPKIIAAVTEQLNKLTHTCFQVLAYEPYVELCEKINAKVPGDFAKKTLLVTTGSEAVENAVKIARAATGRAGVIAFTGAYHGRTMMTLGLTGKVVPYSAGMGLMPGGIFRALYPNELHGVSIDDSIASIERIFKNDAEPRDIAAIIIEPVQGEGGFYVAPKEFMKRLRALCDQHGILLIADEVQTGAGRTGTFFAMEQMGVTADLTTFAKSIAGGFPLAGVCGKAEYMDAIAPGGLGGTYAGSPIACAAALAVMEVFEEEHLLDRCKAVGERLVTGLKAIQAKYPVIGEVRALGAMIAVELFENGDSHKPNAAAVAQVVAKARDKGLILLSCGTYGNVLRVLVPLTSPDAQLDKGLAIIEECFAEL

SEQ ID NO: 34978 - protein, 258 aa, Zea mays
  misc_feature (162)..(162): Xaa can be any naturally occurring amino acid
LRHCRHLPAPTPHLRFAMNPSSSSTSSSGGYHSRAAAFASPQPRGGGGGGGRDGSDRIDALGRLLTRVLRHMAAELRIDMRTDGYVRVRDLLKLNLQTFAKAPLKSHTVDEIREAVRQDNKQRFSLLEEDGELLIRANQGHTVTTVTSESLLKPILSPDEVXRKNLDSILQFGLKRMARLHIHFSSGLPSDGEVTSGVRQNVNILIHLDVSKALKGGMKLYISDNKVILTEGFDGVVPVKYFERVETWPGRAPIPFQR

SEQ ID NO: 34979 - protein, 630 aa, Ostreococcus tauri
MNNSPETPFLLPPFSRPTTTRVDKRCASDRATSIDRTDRTAAKRSPVPFVSLARTTHPSPSASTVVVTVSLSIDRPTPNPNCRARSASRVLKLAPVPVARARDPTPSSHTLCACASLPISHVTRAQHPRPSPPSASPSSSFANVTSPNTSAVGDANDFRFILAARASPLEPVATARAAAHAANAAHVTRAARRRALARSPPRMRATLCRQSSSRIIMNDDDADVDPAQRVIRKTYRIAKRSIAELVRGYFAHNASARTACEHLMRVSGETMENLTDAEYVARETPLDHLAFRSLGTKDMGIDGVCERFEACGYVLCEESEDGPAATYRFPEKRVRARWMRPPETPIGEIALPRIFVSELVLEECDADLRSLVEGVLARVSDGKVFQSGEYADGRIARWQLPAASTYAKLQKLSEYASWTLLHGYAVNHIAVSLFQLRKKYPETPIRALEDVDKAFAANAALARKPWNDRGGRIKRSPSGLLLQSSLMSEPHRFNLYKQTQAIRNRYGRDDEEEIFKEYKLPGSYIEFVQRMPRPEHADKAFEELNEQDLRDGFESSNADQIFESTSVVLASAQRNQNPPISGAAAPSEPPAGPRSGAPQAVAPRIHAKTERVDNMPGRGKQGNADVIDLT

SEQ ID NO: 34980 - protein, 595 aa, Gibberella zeae PH-1
MAPHDVERGSISKMKEESLAPGSSFSMREPEYADILPPSYWGRFVDGFRRDQRSSLFTNDPLGQQEGLGRVHDGAHYYDLQSAMLETANSGLARELKGRHLQMIAIGGSIGRALADGGPASILLAFTIVGAMLFCTCQALGELAVIFPIAGSFSSWATRFIDPSWGFAMGWNYAMQWLIVLPLEIIAASLTLSYWDESLTRAIFVSAFLVLIIVINMFGVKGYGEAEFIFSIIKVIAVIGFILLGIVLNCGGTPDSGYIGGRFWHEPGAFNNGFKGMCNVFVTAAFSFAGTELIGLAAAETANPRKSLPTALKQVFWRITLFYIVALTLVGLLVPYNDPRLTKGTSDADAAASPFVIAIEEAGIQVLPSVMNAVILCAVLSVGNSAVFGSSRTLAALANLRQAPKILGYVDRKGRPLVAIAIASAFGLIAFLADLPQQGAVLDWLMSISGLSTIITWGSICVCHIRFRRAWAARGRSVSELPFQSQVGVVGSWIGITLNVLVLIAQFWVGAFPIGWQDLTSSQVAQNFFHKWVGAPCVLAFYIFHKLYFRTTFVRTRDMDVDTGRRDFNVPILVAQEKQERARWPRWKRYYKFMC

SEQ ID NO: 34981 - protein, 124 aa, Synechococcus sp. CC9605
MFSLETVAKFSLNSPAYMSSAAAVTDASFEQDVLQSDVPVLVDFWAPWCGPCRMVAPIVEEIAKEFDGQIKVFKLNTDENPNVASQYGIRSIPTLMVFKGGQKVDTVVGAVPKATLSGTISKYL

SEQ ID NO: 34982 - protein, 483 aa, Gloeobacter violaceus
MEGGLDTDASVHNNPLLQLDYEPAFASLGDDYYDLVAAAPFPEHRLRFRGDGVLRLLGLDPATVGEEHFIEAFGRFAGRGPFLAMRYHGYQFGEYNPYLGDGRGFLYGQVRGLDGELYDFGTKGSGTTPYSRGGDGRLTLKGGVREVLASEALHHLGVRTSRSLSLIETGEALWRGDEPSPTRSAVLVRTSRSHVRFGTFERLHHFKRKDLIQKLLDYVIAVYYPHYGAEPERYALFYRELVGRTAELAAQWMAVGFTHAVLNTDNMSITAESFDYGPYAFIDRFDPGFTAAYFDHYGRYSYGNQPLVCRINLEALQLPLSMVIPIADLEAGLAIFDTHYAAHYTARMLAKLGFGALGPVLGPELVKATLNYLEAAQAGYHGFFQALAASFDRSWQSDQGAIPAPVVGAPEAFELWRESYFRALASLSDSELLRVGERLNRHNPTTVLLRPAIEAVWAAIDQNDDWQPFYDLIGRLRKPYAIA

SEQ ID NO: 34983 - protein, 391 aa, Picea sitchensis
MDIGRICKARGRTPFALLRHPCEQRLPRSFIKLSSSSSASLFSCKSKNIAALTFNSNSDSRGRRHLCGVSNSWRSRMDVAPLQTAQADFPISETFFRNALASMEKTYLSKNLTVSSVLDFVRTYDGGQVCYDHFAFRTFNVDNCGISALAQFFLDFGYITRGELSFPGKHLRALWFSPPQHLLDCNGEGVNGPLPRIFISELLVDKLSPESQAIIKKYTSISSGGSKYAALASVLGSLTWPTPLLSDYHRLARESEYAAWTLVNGYALNHLTISVHRLKSDVQKIGKLNELIQSNKFKLNTEGGILKVSPDGRLLQSSTVADSMVFHFAEGISESVPASYIEFAERLVLPEYENLSVDKILELHRRDGFEVGNADKIFESTSAEQLRRKVA

SEQ ID NO: 34984 - protein, 232 aa, Burkholderia pseudomallei K96243
MSDLAARLASVHRRIDEAARAAGRAPGSVTLLAVSKTFPADAVRAAYAAGQRAFGENYVQESIDKISTLADLRAELEWHFIGPLQSNKTRPVAERFDWVHTIDRLKIAQRLSEQRPAHLPPLNVCVQVNISGEASKSGVAPADAAGLARAVAALPALRLRGLMAIPEPETDPEAKRAPHRALHALFEQLRAGGLALDTLSMGMSDDLEAAVAEGATIVRIGTAIFGARDYAH

SEQ ID NO: 34985 - protein, 270 aa, Burkholderia pseudomallei K96243
MKIAFIGGGNMAAALIGGLVKRGVDASGLLAVDVNEDARQRAQAQFGVRTAAAVDATLAGYDAIVLAVKPQVLKDVALALAPHLTTQLVVSIAAGIRGADLSRWLGDYPRVVRTMPNTPALVGLGVTGLSALPGVDAAGRDLASKVLGAVGETVWFDDESQLDAVTAISGSGPAYVFYFIEALQEAARQLGMNDEQGRALAVATFAGAAQLAVQSGEPAGVLRERVTSKGGTTAAALASFDAQHVKDAIVRGVLAAQARAREMGDELGGA

SEQ ID NO: 34986 - protein, 229 aa, Chlorobium tepidum TLS
MESISSNLTAVREQIAEACRKAGRREDEVTLIAVSKTKSAAAIREAWDAGQREFGESYVQEFLEKVEAPELSGLPVSWHFIGHLQSNKVRQIVDKVTMVHGIDKVSTAKELSKRAGQHDLTVDYLLEVNVSRESTKYGFSPDSVLQAAEECFALPNVRLRGLMTIASPAPSEARREFAELRQTLDKLRQNAPEPSLLTELSMGMSGDFEEAILEGATMIRIGTAIFGWR

SEQ ID NO: 34987 - protein, 159 aa, Streptococcus pyogenes MGAS8232
MKVKLICVGKLKERYLKDGISEYQKRLSRFCQFEMIELTDERTPDKANFADNQLIMSKEAQRIHKKIGERDFVIALAIEGKQFPSETFSELISGVTVKGYSTITFIIGGSLGLDSIIKKRADMLMSFGLLTLPHQLMRLVLTEQIYRAFMITKGSPYHK

SEQ ID NO: 34988 - protein, 452 aa, Pseudomonas syringae pv. syringae B728a
MAFDFDLFVIGAGSGGVRAARFAAGFGARVAVAESRYLGGTCVNVGCVPKKLLVYGAHFSEDFDHAKGFGWSLGEAEFDWATLIANKDREINRLNGIYRKLLVDSGVTLLEGHARLTGPQQVEINGQTYSAERILVATGGWPQVPDVPGREHAITSNEAFYLKTLPKRVVVVGGGYIAVEFASIFNGLGADTTLVYRRELFLRGFDGGVRTHLHEELLKRDMTIRFNSDIERIDKQADGSLLLSMKGGGTLETDCVFYATGRRPMLDNLGLDSVDVKLDEHGYIKVDEHYQSSEPSILAIGDVIGGVQLTPVALAEGMAVARRLFKPEQYRPVDYNHIPTAVFSLPNIGTVGLTEEDAIKAGHDVQIFESRFRPMKLTLTDDQERTLMKLVVDAKTDRVLGCHMVGPDAGEIVQSLAIAIKAGATKQVFDDTIGVHPTAAEEFVTMRTPVKR

SEQ ID NO: 34989 - protein, 279 aa, Pseudomonas syringae pv. syringae B728a
MIKKCLFPAAGYGTRFLPATKAMPKEMLPVVNKPLIQYGVEEALAAGLTEISIVTGRGKRALEDHFDISYELEHQIKGTDKEKYLVGIRKLIDECSFSYTRQTEMKGLGHAILSGRPLIGNEAFAVVLADDLCVNPEGDGVLAQMVKLHKHYGCSIIAIQEVDPQETNKYGVIAGEEIKPGLFRVTNMVEKPKPEDAPSNLAIIGRYILTPDIFEKIEQTEPGKGGEIQITDALMKQAAEGNVLAYKFKGERFDCGGAEGYIQATNFCFEHFYKTGKAH

SEQ ID NO: 34990 - protein, 514 aa, Saccharomyces cerevisiae
MEEQREILEQLKKTLQMLTVEPSKNNQIANEEKEKKENENSWCILEHNYEDIAQEFIDFIYKNPTTYHVVSFFAELLDKHNFKYLSEKSNWQDSIGEDGGKFYTIRNGTNLSAFILGKNWRAEKGVGVIGSHVDALTVKLKPVSFKDTAEGYGRIAVAPYGGTLNELWLDRDLGIGGRLLYKKKGTNEIKSALVDSTPLPVCRIPSLAPHFGKPAEGPFDKEDQTIPVIGFPSPDEEGNEPPTDDEKKSPLFGKHCIHLLRYVAKLAGVEVSELIQMDLDLFDVQKGTIGGIGKHFLFAPRLDDRLCSFAAMIALICYAKDVDTEESELFSTVTLYDNEEIGSLTRQGAKGGLLESVVERSSSAFTKKAVDLHTVWANSIILSADVNHLYNPNFPEVYLKNHFPVPNVGITLSLDPNGHMATDVVGTALVEELARRNGDKVQYFQIKNNSRSGGTIGPSLASQTGARTIDLGIAQLSMHSIRAATGSKDVGLGVKFFNGFFKHWRSVYDEFGEL

SEQ ID NO: 34991 - protein, 551 aa, Herbaspirillum seropedicae
MEIPSSQAGVVKEVKVKVGDKVAEGSLLLLVEAAGQAAAAPAPAAPPAPAAAAAPAPAAAPAAAPTAAPTAASFGGSADVQCDVMVLGGGPGGYSAAFRAADLGLNTVIVEREATLGGVCLNVGCIPSKALLHVAAVIDETAAMASHGVTFGKPQIDIDKLRAYKDKVIGTMTGGLAGMAKARKVQVVNGDGQFAGPNHIEVTAADGSKKVVQFKHAIIAAGSSVVNLPFVPQDPRIVDSTGALELRQVPKRMLVIGGGIIGLEMATVYSTLGARIDVVEMMDGLMQGADRDMVKVWQKFNEKRFDNVMVKTKTVAVEALPEGIKVTFEAAEAGATAPEPQLYDLVLVAVGRSPNGKKLSADKAGVIVSDRGFIAVDKQMRTNVPHIFAIGDLVGQPMLAHKAVHEGHVAAEAIAGEKSFFDASVIPSVAYTDPEVAWVGVTEDEAKAKGIKIEKGHFPWAASGRAVANGRSEGFTKLLFDAETHRIIGGGIVGTHAGDMIGEVALAIEMGADAVDIGKTIHPHPTLGESLGMAAEVAEGHCTDLPPQRKK

SEQ ID NO: 34992 - protein, 228 aa, Phytophthora infestans
LARRAFPRSAASLAPSCAAPKYFSRAFSVAEQSQRHVIAALVVNQPGCLAEIANLFAARGYNIDSLVVGRTEVEELSRMTVVVNGTAQSVVNMKKQLEDVVYVAVVNILSSGKNAEKNYVERDLMLAKVSTAEAGSRAEVVELANLFDAKVIDVRPHQVMVQLAGTPGRIEAFLDLLKPLGITEIHRSGVIAMARSTSVTDDLGDLSTFEGATRTLLDEADDEEFDVS

SEQ ID NO: 34993 - protein, 356 aa, Polaromonas sp. JS666
MQVKLNIQKLVAGMGLAFLATFAAAQAAKPNVVILATGGTIAGAGASALNSATYAAAKVPVDKLLAGLPELANVANIKGEQVSQIASESFTNDNLLKLGKRISALVKQPDVDGIVVTHGTDTLEETAYFLNLVIRTNKPIVVVGSMRPGTALSADGALNLFDAVSVAASKDAAGKGVLVTMNDEIQSGRDVSKTINIKTEAFKSQWGPLGMVVEGNNYWFRAPVKRHTLQSEFNIDEMDALAPVEVVYGYGNVSRTALDAVGKSGIKALIHGGTGNGSVADRIVPALQDVRARGIQVIRSSRVPDGFVLRNAEQPDDKYDWVVAHDLNPQKARILAAVAMTKTVDSKELQRIFWQY

SEQ ID NO: 34994 - protein, 334 aa, Haemophilus somnus 2336
MTIKIGINGFGRIGRIVFRAAQTRDDIEVVGINDLIDVEYMAYMLKYDSTHGRFDGTVEVKDGNLVVNGKAIRVTSERDPANLKWNELGVDVAVEATGLFLDDATARKHITAGAKKVVLTGPSKDATPMFVNGVNFDAYAGQDIVSNASCTTNCLAPLAKVINDKFGIKDGLMTTVHATTATQKTVDGPSAKDWRGGRGAAQNIIPSSTGAAKAVGKVIPALNGKLTGMAFRVPTPNVSVVDLTVNLEKPATYAEICAEIKRASENEMKGVLGYTEDAVVSTDFNGCSLTSVFDAAAGIALTDTFVKLVSWYDNETGYSNKVLDLVAHVHNYKG

SEQ ID NO: 34995 - protein, 356 aa, Herbaspirillum seropedicae
MQQAQFKKIGAVMILSLACAFSAQAQDKKPNVVVIGTGGTIAGAGASSVNTAAYQSAVVPVDKIIAAVPEISKIANVRGEQIFQIGSESFNDERLIKLGKRVSELLKQNDVDGIVITHGTDTIEETAYFLNLVLKSDKPVVVVGSMRPGTALGADGALNLYDAVLVAGSKEAAGKGTLVVMNDEIHSGRDVTKSNTFKVETFRSPYGPLGYVVENKLSFYRLPARPHTTQTEFDIDKISSLPRVDIVYNYGNVSRTAYDAFVAAGAKAIIHDGTGNGSVAEQIVPVLQEVRSKGVQVIRASRTGSGVVIRNGEQPDDKFDWVVTDDQNAQKARILAELALTKTNDPKELQKIMWKY

SEQ ID NO: 34996 - protein, 255 aa, Coccidioides immitis RS
MPAPTSRLRAPEELGKNAAASAPQINQNEDDVLIDSSAPLPEITTTSQDADTDMHVDEEGRPLFTPITATDGAYRIENRKVPVPPHRMSPLKAAWPKIYPPLVEHLKLQVRMNIKSKAVELRTSKNTTDTGALQKGEDFIKAFTLGFDVDDAIALLRLDDLYIETFEIKDVKPLNGEHLGRAIGRIAGKDGKTKFAIENASRTRVVLADQKIHILGGFRNIRIAREAIVSLILGSPPGKVYGNLRTVASRMKERF

SEQ ID NO: 34997 - protein, 722 aa, Oryza sativa
MPRPAASSSSRPPPEGEPASSRATSSAESSIASLIDRATSTTSPSVDPALLRAIKSAARASDGAIRDAFRILLSLMSKPHAHVRLLAFIIADELFMRSKLFRSLLTDVLDGFLPLAVGFRRAHPLPPPAASATLLRKAAVQALERWHHLFGAHYRQLRLAVEYLKESARVQFPGLRAAVEARAAREARTQEILTAKVEQLRRNLAAIKAEIRSAIDEIRNGLDIIRIESEKFNNYANDEDEEHEIASLAMRSIRMASLMAGEWVPETHEYEAVFDALRESYRLLVSKHLGTVHEWISVLVRVNLADNRFRDSALKEFIDVKNEIRAVRNRCSELGLNLDNVHRRKGVQEEEDDDFWVEGNIEVPSPGRVGTSADVASSSKDTRKGKKPVGGTDTDDGKAPNAGNSPQELDPERAKLHAEAPVLPWSSVLDRWGSNRDALVNQRGLELESHWGRVDNDAVIPAAKIAELNVHSSIYREDPVEILPCLAPLKKGGLCQRRDLKICPFHGPIVPRDAEGNPIHQSDGHCDAEGNPVGQTDGHYDAAVSPIDPNEDSSDVRENMIMPDGSSDGECIYESSPSRTANINNDISDSDVGHDLGKITVEQLARQAVQNVRKRDRDDKKALEKAQRARIRQHNQDVLREAALASTSRSAADYDLPSPAVSRRGRRGKTKGPTLASMLKKKVTSKDRIAERLLNARARDATIREVSHTEDMSYREAFPNQW

SEQ ID NO: 34998 - protein, 94 aa, Triticum aestivum
PGAGEEKKFSFKVILPSAPKFPLKLFRVPEGAPFPRGFKFPPGGLKVPPQTRAFFPKEGVGFTPPQSAGTVFFKQGFKLALIPPHKVGAPGGFF

SEQ ID NO: 34999 - protein, 292 aa, Leuconostoc mesenteroides subsp. mesenteroides ATCC 8293
MEYKTLASDIKMPVLGFGVFQVQEKGAAKQAVIDAIKTGYRLIDTAASYGNEREVGEGIAEAIETGLVTREELFVTSKMWVQDVSADKAAAAIQASLDRLKLDYLDLYLLHQPYNDVFGAWRAMEAAYKAGQLKAIGVSNFDIAQLTNLAEFSEIKPMLNQIEANPFQQNKKDAAYFAEYGVQVEAWAPFAEGKNGLFSNELLQGIADKYNKSIAQVVLRWLTQRDIIVVAKSVKPERMAQNLDVLDFKLTDEEMQEIATLDTNISQFFDHADPDMIKWMAGREISYDVTAD

SEQ ID NO: 35000 - protein, 510 aa, Pseudomonas syringae pv. syringae B728a
MGLSRGSAEQKTEVAPPTTLFLFGAHGDLVKRLLMPALYNLSRDGLVDEGLHIVGVDHNAISDADFAKKLENFIRDEAAGKVAGGGKDPLDPALWSKLAERISYVQGDFLDDSTYQDIASKIESTGTANAVFYLATAPRFFSEVAQRLGSSGLLQETEEGFRRVVIEKPFGSDLASAVELNGCLLKVMSEKQIYRIDHYLGKETVQNILVSRFSNGLFESFWNNHYIDHVQITAAETVGVETRGSFYEHTGALRDMVPNHLFQLLAMVAMEPPAAFGADAVRGEKAKVVGAIRPWSQEEALANSVRGQYAKGVMGDRQVVGYRQEDRVEPDSSTETYVALKVMVDNWRWVGVPFYLRTGKRMSARSTEIAICFKPAPYAQFRDTEVDRLKPNYLRIQIQPNEGMWFDLFAKRPGPKLEMEDIALGFAYKDFFEMQPSTGYETLIYDCLTGDQTLFQRADNIENGWRAVQPFLDAWAAQPQVQLYEAGKDGPQAGEELLSRDGREWRELNV

SEQ ID NO: 35001 - protein, 259 aa, Coccidioides immitis RS
MTTFLETSRPSEAIGYSFSKESGSNKQHGFYPYTDNGGSTLGITGPDFAILAGDTRSVSGYNINTRFAPKIFKIGADETGEGGHIILSVVGFSADGQALKERLDAIVKMYEYHHGKRMSVKACAQRLSTILYSKRFFPYYVHAILGGLDEDGKGALYSYDPVGSYEREYCRAAGAAASLIMPFLDNQVNLKNQYVKSAEHGGELVQVTPEPLSRATALELVRDAFTSAVERHIEVGDGLQTMIITADGIEEVITPLKQD

SEQ ID NO: 35002 - protein, 524 aa, Kluyveromyces lactis NRRL Y-1140
MSPVEVSNVFDTILVLDFGSQYSHLITRRLREFNVYAEMLPCTQKIADLHWKPKGVILSGGPYSVYEKDAPHVDKAIFDLGVPILGICYGLQEIAWINNTEVGRGEKREYGPATLRVEDKSCPLFANVDHSTVWMSHHDKVHNLPAGFKITATSENSPFCGIANEDKQIYGIQFHPEVTHSTQGKTLLRNFAVDICKASQSWNMENFIDTEINRIRELVGPDAEVIGAVSGGVDSTVAAKLMDRAIGDRFHAIMVDNGVLRLNEAATVKKTLGEGLGINLTVVDASDEFLDKLKGVTDPEKKRKIIGNTFIHVFEREAAKIQPKNGKEIEFLLQGTLYPDVIESISFKGPSQTIKTHHNVGGLLENMKLKLIEPLRELFKDEVRELGELLGISHELVWRHPFPGPGIAIRVLGEVTREQVAIARKADYIYIEEIRKAGLYNNISQAFACLLPVKSVGVMGDQRTYEQVIALRAIETTDFMTADWYPFEHSFLKKVASRIVNEVDGVARVTYDITSKPPATVEWE

SEQ ID NO: 35003 - protein, 419 aa, Clostridium thermocellum ATCC 27405
MYKRIKLENGVRVVCEKIPYLRSVSIGIWVGTGSRNESQSNNGISHFIEHMLFKGTDNRSAREIADSIDSIGGQLNAFTGKECTCYYTKTLDSHADIALDVLSDMFFNSRFEEKDIEVEKKVILEEIGMYEDSPEELVHDILSETVWEDNSLGLPILGTRETLLNINKDKIKAYINERYLPQNTVIAVAGNFEEDRIIDVIKEKFGGWNASGKDSKTIEDAKFKVNSKIKVKDTEQIHICMGFEGVAHGSDELYPLLAVNNVLGGGMSSRMFQKIREEKGLVYSIYSYPSSYKNAGLFTIYAGMNAEHLEKVVELIIKEIKILLKEGLSKDELEKSKEQLKGSYILGLESTSSRMNSMGKSEVLMDRIYTPDEILKKIDAVNQESVERVIKQIFCLDKISFAIVGNIKKEIDIRKIINA

SEQ ID NO: 35004 - protein, 183 aa, Capsicum chinense
GAYGIVCSALNSETNENVAIKKVANAFDNKIDAKRTLREIKLLRHMDHENIVAIRDIIPPPQREAFNDVYIAYELMDTDLHQIIRSNQALSEEHCQYFLYQILRGLKYIHSANVLHRDLKPSNLLLNANCDLKICDFGLARVTSETDFMTEYVVTRWYRPPELLLNSSDYTAAIDVWSVGCMF

SEQ ID NO: 35005 - protein, 121 aa, Glycine max
PRVRESLLKPILSPDEVSVCVHGTYRKNLDSILQFGLKRMARLHVHFSSGLPSDGEVTSGVRQNVNILIHLDVSKALKGGMKLYISDNKVILTEGFDGVVPVKYFERVETWPGRAPIPFQR

SEQ ID NO: 35006 - protein, 227 aa, Streptococcus thermophilus LMG 18311
MTIEENKNDVYQAVKRACEKANRSSEEVNIIAVTKYVSSEIAEELVETGIKHIAENRVDKFLDKYQALKKYDLTWHLIGTLQRRKVKDVINLVDYFHALDSVKLAEEIQKRADHTINCFLQVNVSGEESKHGFSPEELDTVLNQIKNLDKICIVGLMTMAPIDANTQELDKIFAETNELRQSIQDKKLKNVPCDQLSMGMSRDYDIAIQNGSTFVRIGSAFFKENGE

SEQ ID NO: 35007 - protein, 180 aa, Capsicum chinense
GAYGIVCSALNSETNEHVAIKKIANAFDNKIDAKRTLREIKLLRHMDHENIVAIRDIIPPPQREAFNDVYIAYELMDTDLHQIIRSNQALSEEHCQYFLYQILRGLKYIHSANVLHRDLKPSNLLLNANCDLKICDLGLARVTSETDSMTEYVVTRWYRPPELLLNSSDYTAAIDVWSVG

SEQ ID NO: 35008 - protein, 520 aa, Oryza sativa Japonica Group
MASALLRKATVGGSAAAAAARWASRGLASVGSGSDIVSAAPGVSLQKARSWDEGVATNFSTTPLKDIFHGKKVVIFGLPGAYTGVCSQAHVPSYKNNIDKLKAKGVDSVICVSVNDPYALNGWAEKLQAKDAIEFYGDFDGSFHKSLDLEVDLSAALLGRRSHRWSAFVDDGKIKAFNVEVAPSDFKVSGAEVDAFAAEPFKGNPAAVCLLEGEDAAAAADERWMQSVAAEFNLSETAFLIRDPSSSAAAADAAPRVPPPLVNLCGHATLASAHFLFTTVLAKQQHAAAAMVEFVTRSGILTAKKVPAPPPPANDGGVPGEEKLFIELDFPMIDLVEYDSAETLSIPETLNGARVVSVWKSSTAGDLIIKMEVMNHGNATATIISLRERIANLLRMLILNEELVELSSGKEVADIIPNINEIKKCDGRGVIVTGPAPAGSDYDFFSRFFCPKFGIDEDPVCGSAHCVLAPYWGGKLGKQKLTAFQASPRSGTLYLELDGENRRVRIQGEAVTVMAGTLLA

SEQ ID NO: 35009 - protein, 183 aa, Capsicum chinense
GAYGIVCSALNSETNEHVAIKKIANAFDNKIDAKRTLREIKLLRHMDHENIVAIRDIIPPPQREAFNDVYIAYELMDTDLHQIIRSNQGLSEEHCQYFLYQILRGLKYIHSANVLHRDLKPSNLLLNANCDLKICDFGLARVTSETDFMTEYVVTRWYRPPELLLNSSDYTAAIDVWSVGCIF

SEQ ID NO: 35010 - protein, 249 aa, Triticum aestivum
  misc_feature (66)..(66): Xaa can be any naturally occurring amino acid
MAATTTATSRRAPAVLVLVLLLLPGAASARGDGNGVYEPCADATVSRGDGFTFGVAFAGRDAFFSXGGVQLSPCDSRLNLANAGPLLALFRPTVDEISLLTVNASDPKALTSAGGYMVAFAGRKFAARSPPVFVGNSSYTVTGFTLVFEFHKGTLQNLFWKADGCSSCSGNPNFGCVENSCAIKTSSCRGNGGGQVDCSPGIQLAFSGTDKHEAVLNSWYEVSKLKQYSLFGLFSNLKDSLAGQFSNFF

SEQ ID NO: 35011 - protein, 407 aa, Schizosaccharomyces pombe
MGCMSSKYADTSGGEVIQKKLSDTQTSNSSTTGSQNARVPVLENWLNIVLRGKPQNVESSGVRVKGNSTSGGNDIKVLLLGAGDSGKTTIMKQMRLLYSPGFSQVVRKQYRVMIFENIISSLCLLLEAMDNSNVSLLPENEKYRAVILRKHTSQPNEPFSPEIYEAVHALTLDTKLRTVQSCGTNLSLLDNFYYYQDHIDRIFDPQYIPSDQDILHCRIKTTGISEETFLLNRHHYRFFDVGGQRSERRKWIHCFENVTALLFLVSLAGYDQCLVEDNSGNQMQEALLLWDSICNSSWFSESAMILFLNKLDLFKRKGSHFPIQKHFPDYQEVGSTPTFVQTQCPLADNAVRSGMYYFYLKFESLNRIASRSCYCHFTTATDTSLLQRVMVSVQDTIMSNNLQSLMF

SEQ ID NO: 35012 - protein, 1037 aa, Saccharomyces cerevisiae YJM789
MTVANTETHSAAKPSSTIGPWKLGETLGFGSTGKVQLAQHERTGHRTAVKVISKSIFNNNGNHSNDDSVLPYNIEREIVIMKLLSHPNVLSLYDVWETNSNLYLILEYAEKGELFNLLVDHGPLPEREAINCFRQIIIGISYCHALGIVHRDLKPENLLLDSFYNIKIADFGMAALQTDADLLETSCGSPHYAAPEIVSGLPYEGFASDVWSCGVILFALLTGRLPFDEENGNVRDLLLKVQKGQFEMPNDTEISRDAQDLIGKILVVDPRQRIKIRDILSHPLLKKYQTIKDSKSIKDLPRENTYLYPLADSNNHTSASIDDSILQNLVVLWHGRHADDIVSKLKENGTNKEKILYALLYRFKLDSVRGSNKKNRNKIKKTKKNKRSSTLSSSSSLLLNNRSIQSTPRRRTSKRHSREFSSSRKRSSFLLPSNPTDSSPIPLRSSKRITHINVASANTQATPSGVPNPHKRNSKKRSSKRLSYMPNTKRSSLTSKSLSNFTNLIDDDDWEYIEKDAKRTSSNFATLIDEIFEPEKFELAKREKAELQRKVQEAKRQSVNAQKINEDEFGSEVSDGMKELKKINDKVSSPLINYEFSQQELLQDIDTLLTNRYQLSSYTRPISRLDPGLTPVTETLPNNLKEKTALLQDTEKKIIETIRRSKFLGSLLNVRGGLSPGKSELAPIEESPIVSTTPLIYNDRMEPRRISDVEVPHFTRKSKHFTTANNRRSVLSLYAKDSIKDLNEFLIKEDPDLPPQGSTDYESRSEDPEIAESITDSRNIQYDEDDSKDGDNVNNDNILSDFPQGVGISQEYDMKDKNPNQSPISKSAEPTLVVKLPSLSSFQGKNASGLGLYQREPSKVTLPSLTSNNSSVGENIEDEAEKGTESEKITASLSDDDVKEDNGKKDNDTVNAPTTVKKPPNSVLLKKFSKGKILELEIHAKIPEKRLYEGLHKLLEGWKQYGLKNLVFNITNMIITGKLVNDSILFLRSTLFEIMVLPNGDGRSLIKFNKKTGSTKTLTKLATEIQIILQKEGVLDK

SEQ ID NO: 35013 - protein, 247 aa, Vitis vinifera
MSALVGAISKDFTFNPVMEKEENKDGEPTRECDDSEKPDDEGREDDEDDEAEEDGKPKSEKELENKELELGPQVSLKEQLEKDKDDESLRRWKEQLLGTVDFSAVGESNEPEVRIQSLSILCKDRPDLVFAIPLAANSKDRLFTLKEGSRYHLKFSFVVSNNIVSGLKYIHTVWKTGIKVDNTRIMLGTFSPQQEPYTYELEEETTPSGMFARGSYSARSKFIDDDRKCYLDFSYTFDIQKNWPSAS

SEQ ID NO: 35014 - protein, 118 aa, Campylobacter coli RM2228
MKKLNKEEARVILNKGTEAPFSGKYNNFYEKGIYLCKQCGSKLYRSEDKFKSGCGWPSFDDEIKGAIKRLPDKDGIRTEIVCANCNGHLGHVFEGEGFSAKNIRHCVNSISLEFVKGE

SEQ ID NO: 35015 - protein, 274 aa, Herbaspirillum seropedicae
MATPSSSTATASRCWPSATPPSCPWGELGVDVVLECTGFFTTKEKASAHLKGGAKKVIISAPGGKDVDATVVFGVNHGVLKASDTVISNASCTTNCLAPLVQPLHEKIGLENGLMTTVHAYTNDQVLTDVYHEDLRRARSATQSMIPTKTGAAAAVGLVLPELNGKLDGYAIRVPTINVSIVDLSFVASRDTTVDEVNAILKAASENGPLKGILTYNTDPLVSVDFNHNPASSNFDATLTKVSGRLVKVSSWYDNEWGFSNRMLDTTVALANAK

SEQ ID NO: 35016 - protein, 123 aa, Glycine max
  misc_feature (86)..(86): Xaa can be any naturally occurring amino acid
MATKRSAVTLKEGDLIAKRGLARFDLNVPLDDNLIITGDTRVRAAVPTIKYLTAFQAKMILPSHLRLSILLTPKYNLKPLEPRLSXLVKIYVTMTNNSIGDVVIKFATHLSECWALLLHDVKF

SEQ ID NO: 35017 - protein, 683 aa, Kluyveromyces lactis NRRL Y-1140
MGSSLNGFITKNTGGSKHSGGSIFQREPVAKSHSSTKSNLSLAIQTQINSEEHIPIPIPGSNSSKDADALLLGSNKNSVDNDDDDDDDYSSCDEKNEESAKDYKPGGYHPAYKGETYKEGRYVLVRKLGWGHFSTVWLAKDTETGSHVAMKIVRSDKVYTESALDEIKLLQGVNPLQNQSFSEHKGSAHILRLLDNFIHSSVNGEHVVMVFEVLGENLLALIKKYEHKGIPIVYVKQIAKQLLLGLDYMHRKCGVIHTDIKPENVLMEIGDVEAIVRIVEEMDQVKREQRKLQRRASRAHLENISRHNSFNTAFDNPSISASSSSTTIRSRRPRRATIVTGSQPLPSPLASSSFLELKSHMFGNTTASISRQQSFCGKSGQPTLQNNNCNTTNTLLTEQTLTNNTNATSAATTTLTSPVGQNSNASISRLHNLLSTENKDVNSSSEQLAHSFSSMEIVDNKVPGDESTKEAAFNTSINENRPDVIQVKIADLGNACWYDEHYTNAIQTREYRSPEVILDCSWGASADIWSFACLIFELLTGDFLFEPQNGHSYTKDDDHIAQIIELLGNIPESLMTTGRAVRTFFTSRGELRNISRLKYWPLKSVLIEKYNMAPKEAEEISDFLLPMLSIDPRKRADAGGMLNHPWLSDTLGMEDITIPDRKLYQSGADIPGWYKEVQGHPKH

SEQ ID NO: 35018 - protein, 541 aa, Prochlorococcus marinus str. AS9601
MIRFEGVSKIYSTDVVLKNISWEIKKGEKVGLVGSNGAGKSTQFKILIGEEEQTSGTIIKEGNPKIAHLKQEFDCNLNFSVRQELESSFIDIQIVAIKLLEIENKMKSLDIKKNSDELEILVNQLAKYQAKFEALGGYKMQSDVEKILPKLGFSLADADKLVGNFSGGWQMKVALGKIILQKPDLLLLDEPTNHLDLETIFWLEEYLSSLKIAVIIISHDRYFLDKLCKKIIFVDRGISETYNGNYSFFVEQKSLNEESQNKAYQLQQKEIELQKRYIDRFRASATRSSQAKSREKQLKKITKIEAPIAKSKSPVFNFPECPRSGKLVLNIKNLSHSFEDKILFLDINLKISSGEKIAILGPNGCGKSTLLKIIMKKISPEIGEINLGKHNIITNYYEQNQAEALSLDETVIDLICNKSPEWSQKKVRTFLGGFGFQNETVFKYIKQLSGGEKARLALALMIINPSNFLLLDEPTNHLDLQSKENLELAIKNYKGSLLIISHDRYFISKVANRIIEIKDSKLYSYDGNYEYFLEKTQSQKI

SEQ ID NO: 35019 - protein, 589 aa, Candida albicans
MTRTTRIDTQEATKHKDLPPVPSPLSLSSNPNPECLMESKSLGRKNFKKLSLDASPVKSTSGSLRSSDMMSIKEPTSLRQKRQRPPPILHLPTASSSATSTPTSNITGSSSASSIQFAQKSPGSGVIVSQTLSRPSSAGGIPSSGYSSLNVNQSNRNVDPDNVVSTDMILNQISNLDLTSMNHHRQHYQNSHHHLPTTNRKRQTVISSISPTKSSAASSPLEPQIQSLPASSQSPIATTSALKLNNKDLLTLKQLGSGNSGSVSKILHIPTQKTMAKKIIHIDSKSVIQTQIIRELRILHECHSPYIIEFYGACLNNNNTIVICMEYCNCGSLDKILPLCENKQFPTFVLKKLSFAILSGLTYLYTTHKIIHRDIKPNNVLMTHKGEFKLCDFGVSRELTNSLAMADTFVGTSMYMSPERIQGLDYGVKSDVWSTGLMLIELASGVPVWSEDDNNNDDDEDDEDDAYVRQGSIAAERNGQNSPSRSRKNKQKGNGYNSYNGPEGILDLLQRIVNEDAPTLTNKINPVTKLPYDKYLCQFIDLCLIKDDSVRKTPWQLLEDKEHFFKGVEEGVYDKEHKSWAKKIRKCKV

SEQ ID NO: 35020 - protein, 411 aa, Vibrio cholerae O1 biovar eltor str. N16961
MDIFKHHESQVQSYANHFPVLFGTAKGSWLYSQQGDAYLDFLSGAGALNYGHNNAVLKQALLEYIERDGLTHGLDMHSEAKAHFIQALQTHILEPRGLNYKLQFTGPTGTNAVEAALKLARKVTGRHNVVTFTNGFHGCSLGALAATGNQHHRQGAGLALSGVYRVPYDGYAGVDGLTLFETMLQDNSSGLDKPAAVLLETVQGEGGLNVASDAWLQRVQAICRAQQILLIVDDIQAGCGRTGTFFSFEPSGIEPDMVTLSKSLSGYGLPMALVLFKPEWDQWKPGEHNGTFRGNNHAFVTATRALEAYWANQDFQTHIAARSEQVTQALLQCLSRYPTLFSGLKGRGLMQGLACHNGDIARDIAALCFQKGLIIETAGAEDEVLKVFCPLTITEADLAHGLTIIERVLLE

SEQ ID NO: 35021 - protein, 389 aa, Xanthobacter autotrophicus Py2
MPLTGDAMDNAIDTTAASGIPSTGVGAAPKGAGTPKFHRLAVREVRRETIDAVSITFEVPSALAADFAFAPGQYLTLKATMEGEEIRRSYSICSGPDDGELRIAVKQVEGGLFSTWVNESLKPGDELEVMTPTGRFGLEQAPGNARIHVAFAAGSGITPVLSIARGVLAREPDSRFFLFYGNRSTDNILFRTELEELKDRFLGRLSVFHVLSREQQDLAILNGHLDGEKVRLLLTAMVPAAAVDHAFVCGPTAMIDELEATLADLGLPKDKVHVERFVSALGGKPRPKPVVAPDAAPAHVASLIVDGKRRDVPVAEGEAILDAALRAGMDLPFACKGGMCSTCRAKVVEGAAEMEVNYSLEPWELEAGFILTCQARPTSARVVVDFDQV

SEQ ID NO: 35022 - protein, 112 aa, Schizosaccharomyces pombe 972h-
MLSRFSSQLRFISAVRPVIPKFQPLRFYSVARPDAEKRILKVVSSFDKIQDPKKVTPTSTFANDLGLDSLDAVEVVMAIEEEFSIQIPDKDADEITSVGDAISYITKNPEAK

SEQ ID NO: 35023 - protein, 784 aa, Oryza sativa
  misc_feature (354)..(354): Xaa can be any naturally occurring amino acid
MAAILPDLATQVLVPAAAVVGIAFAVVQWVLVSKVKMTAERRGGEGSPGAAAGKDGGAASEYLIEEEEGLNEHNVVEKCSEIQHAISEGATSFLFTEYKYVGLFMGIFAVLIFLFLGSVEGFSTKSQPCHYSKDRMCKPALANAIFSTVAFVLGAVTSLVSGFLGMKIATYANARTTLEARKGVGKAFITAFRSGAVMGFLLAASGLVVLYIAINLFGIYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTPMLYPLLISSVGIIACLITTLFATDFXEIKAVDEIEPALKKQLIICTVVMTVGIALVSWLGLPYSFTIFNFGAQKTVYNWQLFLCVAVGLWAGLIIGFVTEYYTSNAYSPSCPSHLEFPLSSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNSIPGLMEGTTKPDYATCVKISTDASIKEMIPPGALVMLSPLIVGIFFGVETLSGLLAGALVSGVQIAISASNTGGAWDNAKKYIEAGASEHARTLGPKGSDCHKAAVIGDTIGDPLKDTSGPSLNILIKLMAVESLVFAPFFATHGGILFKWF

SEQ ID NO: 35024 - protein, 509 aa, Schizosaccharomyces pombe 972h-
MSSSAVSPKQWVAGLNSELDIPAVNRRTSIICTIGPKSNNVETLCKLRDAGMNIVRMNFSHGSYEYHQSVIDNARKASATNPLFPLAIALDTKGPEIRTGLTVGGTDYPISSGHEMIFTTDDAYAEKCNDKVMYIDYKNITKVIQPGRIIYVDDGILSFTVIEKVDDKNLKVRVNNNGKISSKKGVNLPKTDVDLPALSEKDKADLRFGVKNGVDMIFASFIRRAEDVIHIREVLGEEGKNIKIICKIENQQGVNNFDSILDVTDGIMVARGDLGIEIPASQVFVAQKMMIAKCNIAGKPVACATQMLESMTYNPRPTRAEVSDVGNAVLDGADLVMLSGETTKGSYPVEAVTYMAETARVAEASIPYGSLYQEMFGLVRRPLECATETTAVAAIGASIESDAKAIVVLSTSGNTARLCSKYRPSIPIVMVTRCPQRARQSHLNRGVYPVIYEKEPLSDWQKDVDARVAYGCQQAYKMNILKKGDKIIVLQGAVGGKGHTSIFRLTVAE

SEQ ID NO: 35025 - protein, 461 aa, Pseudomonas putida KT2440
MSGNNSNDLAQGLKQRHVTMLSIAGVIGAGLFVGSGHAIAAAGPAVLLAYAAAGTLVVLVMRMLGEMAVASPDTGSFSTYADRAIGRWAGFTIGWLYWWFWVLVIPLEANAAAAILHAWFPAVDLWAFSLIITLALTLTNLCSVKNYGEFEFWFALLKVLAIIGFIAVGCAALFGFVPSSQVSGTSHLFDTQGFMPNGLGAVLAAMLTTMFSFMGTEIVTIAAAESKDPGKQISRATNSVIWRICLFYLVSIFLVVALVPWNDPALAETGSYQTVLSRIGVPNAKLIVDIVVLIAVTSCLNSALYTSSRMLFSLSKRGDAPAIAQRTTKAATPHVAVLLSTAAAFLCVFANFVAPAQVFEFLLASSGAIALLVYLVIAVSQLRMRAQREARGEKITFKMWLFPGLTWATIAFIVAILVVMALREDHRAEIIATALLSIGVVAAGLLVHRKREAAGRAALDS

SEQ ID NO: 35026 - protein, 567 aa, Crocosphaera watsonii WH 8501
MSSRYKPSAEPCVTTFDEFVRLADYSLMDTLNADPEATVDGNDHRPRQVFSGHFVPVTPTPLAEPEYVTHSSTFFKELGLSDELAFNEQFRKVFSGDMSATGEPMRQFGWATGYALSIYGTEYIQNCPFGTGNGYGDGRAISVFEGIINGQRWEMQLKGAGLTPYGRGADGRAVLRSSVREFLGQDYMQALGTPTSRSLTLYVSKSETVTRPWYSEDSHSSDPDILVDNPVAISTRVAPSFLRVGQLELFARRVRSNAHPRALEELRMIVSHLIEREYKSDINQNLSFADQLVELAKQFRQRLTTLVANWLRVGYCQGNFNSDNCAAGGFTLDYGPFGFCENFDPWFQPWTGGGKHFSFFNQPMAAEANYYMFWKAVRPLLAEDAEALEQFDQVGRGFPEAMQKQIQKMWAAKLGLTEYKPKLFEELIQLMIDSEVDYTIFFRELSQIPDDVEPLKKSFYLKTSQQIDEQWQSWLLSWRNLLINYGNLPEISTKMKQTNPKYTWREWLIVPAYQQAMEGDYTLVKELQEVFSHPYDEQSQEIEDKYYRLKPKAFFDAGGVSHYSCSS

SEQ ID NO: 35027 - protein, 519 aa, Trametes versicolor
MGLQRFSFFVTLALVARSLAAIGPVASFVVANAPVSPDGFLRDAIVVNGVVPSPLIRAKKGDRFQLNVVDTLTNHSMLKSTSIHWHGFFQAGTNWADGPAFVNQCPIASGHSFLYDFHVPDQAGTFWYHSHLSTQYCDGLRGPFVVYDPKDPHASRYDVDNESTVITLTDWYHTAARLGPRFPLGADATVINGLGRSASTPTAALAVINVQHGKRYRFRLVSISCDPNYTFSIDGHNLTVIEVDGINSQPLLVDSIQIFAAQRYSFVLNANQTVGNYWVRANPNFGTVGFAGGINSAILRYQGAPVAEPTTTQTPSVIPLIETNLHPLARMPVPGTRTPGGVDKALKLAFNFNGTNFFINNASFTPPTVPVLLQILSGAQTAQELLPAGSVYPLPAHSTIEITLPATALAPGAPHPFHLHGHAFAVVRSAGSTTYNYNDPIFRDVVSTGTPAAGDNVTIRFQTDNLGPWFLHCHIDFHLEAGFAIVFAEDVADVKAANPVPKAWSDLCPIYDGLSEADQ

SEQ ID NO: 35028 - protein, 704 aa, Xanthobacter autotrophicus Py2
MDAVTPPVTVTRHGGGQGKVGVIAIDFAPVNALSKAVRQGLLDAVRTLEADPDVAALVISGGPGRFIAGADIREMSQPPDAPFLPDVVAAVDACAKPVVAAIAGAALGGGCEIALACDLRLGGPKALVGLTETRLGLIPGAGGTQRLPCLVGVAQAIALICEGRVLKAGDALALGLLDEVVEGDLLATAIARAPGMPKRRLSALPVPARDAAAEEAAAARARKAAKGVPAIDEAIRVIRAAGEGDFASGLALERAAFLALRESAEAKALRHLFFAEREAGKVPGLEGVAPRPVEAVAVIGAGTMGAGIAMALADAGLAVTLIERDAEAAAAGFQRVSDLYARQVKSGRLTDAQGAERRARVTATADWGRLSAVDLVVEAAFEDMAVKADIFRRLDAVAKPGAVLATNTSYLDLDAIAAATSRPQDVVGLHFFAPANVMKLLEVVRPARSAPDVIATALALAKRMGKQPVVAGNCDGFIGNRIYALYRRHAEVLVEDGTSPQEVDAALEAYGFAMGLFAVSDMSGLDIAYAMRKRRAATRDPAERYVAIADRLVEQGRLGRKTGAGWYAYDAAGAKTCDPVVEAVIAEARAEKGITPRAFSAGQIQRRLLAVMANEGAKALAEGIALRASDIDLAFVHGYGFPRTKGGPMWAADQMGLRAVLTEVEAAHAAGGAGSEPAPLLVALARDGHSFADWQPTQLGGQQP

SEQ ID NO: 35029 - protein, 309 aa, Saccharomyces cerevisiae YJM789
MLRSLLQSGHRRVVASSCATMVRCSSSSTSALAYKQMHRHATRPPLPTLDTPSWNANSAVSSIIYETPAPSRQPRKQHVLNCLVQNEPGVLSRVSGTLAARGFNIDSLVVCNTEVKDLSRMTIVLQGQDGVIEQARRQIEDLVPVYAVLDYTNSEIIKRELVMARISLLGTEYFEDLLLHHHTSTNAGAADSQELVAEIREKQFHPANLPASEVLRLKHEHLNDITNLTNNFGGRVVDISETSCIVELSAKPTRISAFLKLVEPFGVLECARSGMMALPRTPLKTSTEEAADEDEKISEIVDISQLPPG

SEQ ID NO: 35030 - protein, 363 aa, Synechococcus sp. CC9605
MLKAGIVGLPNVGKSTLFNALVANAQAQAANFPFCTIEPNVGTVAVPDERLDRLTELSKSKDTIPTRMGFVDIAGLVKGASQGEGLGNKFLANIREVDAIVHVIRCFEDDDVIHVSGSVGPSRDAEVINLELGLADLAQIEKRRERLKKQMRTSKEAQVEDAALERIQAVLENGGAARSVDLNDEEAVMIKPLGLLTAKPIIYATNVSEDDLAEGNAFCTEVVELAAKEGAETVRISAQVEAELVELGDEETADYLEGLGVKEGGLQSLIRATYRLLGMRTYFTTGEKETRAWTFKAGMTAPQAAGVIHTDFERGFIRAQTIGWEKLLEAGSLSEARNKGWLRSEGKEYVVDEGDVMEFLFNV

SEQ ID NO: 35031 - protein, 269 aa, Oryza sativa Japonica Group
MARCSNGLLGLLNAGVLVLAVVVLGGGIWLSNRAATTDCERFMERPVVALGVLLLALSLAGLAGALCGASCLLWLYLLALFLLILALFVFTVFAFVVTNRGAGWVVSGRGYREYRLGDYSTWLQRRVENSANWAKIRSCLQDGKVCEKLGARRETMDQFVGSNLSPIQSGCCKPPTGCNFAYVSETVWTKPSGFNSTDDPDCTTWSNDQTALCYDCQSCKAGVLANLKNDWKKIATVNIIFLIFLIIVYSVGCCAFRNNRRDNSYPAWK

SEQ ID NO: 35032 - protein, 551 aa, Bradyrhizobium japonicum USDA 110
MYAYDEIDRTLVNERVSEFRDQVQRRLSGELTEDEFKMLRLQNGVYLQLHAYMFRVAIPYGTLASNQLRALAHVARKYDRGYGHFTTRQNIQFNWIKLSDLPDALADLAEVGIHAMQTSGNNMRNVTSDQWAGVAPGEIEDPRIWSELIRQHTTLHPEFSFLPRKFKIAITASDHDRAAIKVHDIGLRLIKNEKGETGFEVLVGGGLGRTPFIGKTIKHFVHGRDLLSYIEAILRVYNQYGRRDNIYKARIKILVHELGIEKFSREVEEEWQHIRNSSLQIDDEVIEDIRSRFIYPAYEKLPHMPDELRQAAADPEFEAWRKNSVAPHKNPGYSIVTISLKPIGAPPGDATAEQMDALADLADRYSFGEIRVGHEQNLALPHVAKRDLPALWKALDKLGLATPNVNLITDIIACPGLDYCSLANARSIPIAQELTRRFANHELANLIGRLHINISGCINACGHHHVGHIGILGVEKNGEEVYQITIGGRADEGAALGNLIGPGVKFDEVADVVEDIVEAYLALRARPEELFIDTVKRLGVEPFKERVYATR

SEQ ID NO: 35033 - protein, 472 aa, Photobacterium sp. SKA34
MDEKLDQYITKQKQAFLQCPIPELQKRLTDLDKISLLITQNQHAICHAIAQDFGQRSASETALLEIFTSIECIKNSQKNLSRWMRVQKRHTSMWFKPAKNRVIPQPVGVVGIIVPWNYPLFLAIAPLVAAIAAGNSVMVKMSENSPELCRLLQQLFTDTFALEKVRFIAEEGNTGKAFSALPFDHLVFTGSSATGKAVMANAAKNLVPVTLELGGKSPAIIADDYDLNKALERILGGKTYNSGQTCVAPDYLYVPEALLPEVVAKSKKIIAKRFVDINHQDYTSIIDSQSFERLVTTLEDAKAKGADIYNLIPNSSPDLNSRKFPLHLITGVDDTMQVMQREIFGPILPILGYQSIEQAISSINKGDRPLALYLFSNNKDLQQKVIQQTRSGGVTINDVMLNVAQEDLPFGGSGNSGIGHYHGKEGFERLSKMRPVMYQASISSLKLLYSPYSSLGKRMINFIINRKFGKYD

SEQ ID NO: 35034 - protein, 472 aa, Picea sitchensis
MAGCISKFGLSAPQEVQNQLHSMSTVNISTICSAQVPPDYDLRCRNSIRAFARIPHAASRMSVSRGFPASLQIGYRQHTIQKKKKRKEGFLALASNEDSEPKAIELYGQIERLITNTARQSQDTWGATGNWEEIEGAWVLRPNKTNPIAVIHFVGGIFVGAAPQITYRLFLERLSMRGFLVVATPFASGFDHLRIADEVQFKFDRSFRFLQGDVQDLPTFGVGHSLGTVIHLLIGARYAVQRTGNVFMAFNNKEASLAIPLFSPVIVPMAQSFGPVLAQLTSSRTIRRGAEIALKQLENLSPPLLKQVLPLVEQLPPLYFDLVNGREDFTPRPEETRRLIKSYYGVSRNLLVKFKDDTIDETPVLSQILSFESAVSSSLDMSVRTLPGDHSLPLQQVFPEVPSAMADAVTRGGEILANLATGTPWETVAKDVGISLGTDTKARGLRQQIIQDIEQLVDEITIWVMSSRKMLP

SEQ ID NO: 35035 - protein, 258 aa, Ustilago maydis 521
MADAAPRGRGGFGRDRGGRGRRGPRRGGRRDGEKEEWVPVTSVGRLVKDGKIKSIEEIYLFSLPIKEYQIIDLLLPKLKDEVMKIMPVQKQTRAGQRTRFKAFVAVGDSDGHLGLGVKCAKEVATAIRGAIIVAKLSTIPVRRGYWGNALGEPHTVPMKVSGKTASVMCRLVPAPRGTGIVAAPASKRMLQLAGIEDCYTQSSGQTATMGNFLKATFEAVSKTYAFLTPNLWREIAPPATPYVEFASHLARTQKKSLY

SEQ ID NO: 35036 - protein, 821 aa, Physcomitrella patens subsp. patens
MQIVAELEKNLQIASIIVKVQSSLLLVMVDQLKLCMCSECLLLLEECPDLTAVQEVYQSIEEWLQRTIIKVDALLMEVCRKFETEKYKVVVNAYTLLDDATSLADKVQSFFAQNVVTETHDVLKHLLLEGEDAQTALKKSRFPYRDLCMQLPEEKFRPFLCKTLEVLFDLMCLYHTTMTWHRKTESAEIKFPAEDQAICSNGNHHHRRSGSHGDLSQIVKESRHVRTESHSGELFAIPMSPTSVHASRMLSRSGSRRRSFSDKSEMNENGTFASGDFDGKFLGESGISDNLAKREEIVSITVARALERGRKTVWELAARRVAAFLSNDAVFLTSPEQFLQSLDWVNKFILAGEAFCGTEAVSLRTKLTKQGEQYFGAYHCQNLEVLRMIVEKELWQPLSSLALKSVELAGLTGHGLSLAPTSVLGESPGAPQRPSSPSSGHGMTGFAEWLERGNPFAEKSQHRSAIPKVTDEDAVRINGIDKVGLGANDSVKVEEEEDNEDEDLLADFIDEDSQLPGRLYNNFQHSAMRSKRDQGSNEDKNLTHEQISKVDGENAANFYKCVEVLTPRLRATLLRISQELEEQRLKQSISMSASSGHTNTTGIQSDIPPNSSFGGAEIVMTATNFYALKERTVATESLACLVQMLKSSRLLLQAVLGQDSMLSVELVYTRTVFTRVGFELMVLAHIQIDAVPDLRDHVYKAMVRMLLNLRTLDYHLDFNWHELSLLSCYIDRIANVKWKLKDLGMENNRYVDSLLGAYKQYSTKLDCGGLEQEMHEFLLEYGVDTLAETIVEGFSRVRRCNNEGRALMSLDLQDHVANPIK

SEQ ID NO: 35037 - protein, 263 aa, Pseudomonas syringae pv. syringae B728a
MSAVQLADGQLNYLLEGPAGAPVLVLSNSLGTDLHMWDNQVPAFSRHFQVLRYDTRGHGKSLVSEGSYSIEQNARDVLALLDALGIDKAFFCGLSMGGLIGQWLAINAPQRLHKVVLCNTAAKIGNPDVWNPRIETVLRDGQAAMVALRDASIARWFTPSFADAEPAAVDTVVGMLARTSPQGYAANCAAVRDADFREQIASIELPVLVVCGTQDAVTTPADGRFMVERIKGAQIIELHAAHLSSVEAGEAFTVPVLAFLTAE

SEQ ID NO: 35038 - protein, 439 aa, Methanosarcina acetivorans C2A
MRIWTEPEMNRYESNSLTLTGAVSLGTGVMIGAGIFALLGQIAELAGMLFPIIFLIGAVVTAFSAYSYVKFSNTYPSAGGIAMYLEKAYGKGVMTGFGALLMAFSMVINESLVARTFGTYTIQLFNMDEGSFLVPLLGVGLLVFAFAVNISGNRVIEKFSFFMALIKITGIAIFGIVGLWLADFSFTYTSTDAMATTTEEYLAAVALAVLAYKGFTTITNSGSEIVDPHQNVSKAIVISIAICTIIYFLVSLAVAGSLTLPEIIEAKNFALAEAARPVFGNYGLWFTVALAIIATISGIIASVFAVSRMLAMLTDMDLIPHRHFGMPGDIQKHTLVYTIVVAILLTIFFDLSRIASLGAIFYLVMDIMIHWGLLRNMREKIKIRSYIVITAIILDAAVLSALLLTKASTDTLLVVISLIMMLLIFAGEKLFLRSHPNQE

SEQ ID NO: 35039 - protein, 146 aa, Brassica napus
QKGLTLKETRQMEFLSQVVDETLRVITFSLTAFREAKTDVEMNGYLIPKGWKVLTWFRDVHMDPEVFPDPRKFDPSRWDKGFIPKTGAFLPFGAGSHLCPGNDLAKLEISIFLHHFLLKYRVKRSNTECPVMYLPHTRPTDNCLAR

SEQ ID NO: 35040 - protein, 170 aa, Zymomonas mobilis
MDSGEVIDAHTLSVTVDNVAGILARISGMFLPEAIISKSLTVADVTKDNAISRLSIVTSGLPHVIDQMVHQLDRLPPVHRVVDLTAIGPHVERELALIKVVGVGDNRIEALRLAEVYHARVVDATIASFIFEVTGTTEKVEKFLELMGELGLVEVARTGIAAMARGRDAF

SEQ ID NO: 35041 - protein, 239 aa, Gibberella zeae PH-1
MAAEKPDKKEKKDKKRSDESGISKPKKEKKDKKDKKEKLAAALEEKVQQDAPVAVAAAKNDDSDAEEEKADELPLERVVVPFAIPVADDKGMKKVYKTIRKAAKNNTLKRGVKEVVKTLRKSAPSGPGNTSFPGVVIIAGDISPMDVISHLPVLCEDHNVPFIFVTSRAELGAAAKTKRPTSVVMIMEKAEGKKSKDKSADKDGEDDGEAFGESYASLVKYVQKEYGKQAFWVKGGSKY

SEQ ID NO: 35042 - protein, 413 aa, Ustilago maydis 521
MSGAQEIGRSKNSDAVAPTPQNTPLSNAPLTREALSRPTVGTIGEEDENAVDVAAALQGNSALAAMVQDKLSSLVGRSSGYVESLPTHVRRRVEGLKGVQVEHHKIEADFQKEILELEKKYAQRYKPLYERRAAIIQGKQEPTADEVKAGEAVDADEEDDEEPESLADVQAPADGAHGIPEFWLTALKNHIALSELITERDEEALRALVDVRMSYLVDQAGFKLEFEFDASKNDYFSNPVLTKTYYYQDEVGFSGDLVYDHAEGCKIEWREDKDLTHKVETKKQRNKNTNQTRTVKRSVPVESFFNFFNPPKPPKNGEVEDEDADLDELDERLELDYQIGEDLKDRIIPHAVDFFTGKALQYEDLDELDDADFDDDDDEAEDEDDDQPRRSQLGASVGSQMAGSQDPQECKQQ

SEQ ID NO: 35043 - protein, 407 aa, Coccidioides immitis RS
MTRARPGHSISMTYYFVLATVLFLSALAQPYDGTSRRVSQKLFDSLEELARIVDITYCVGTTGIYKPFRCAGRCKEFEGFELVKTWNTGPLLSDSCGYLALSHPPWPKRIILAFRGTYSITNTIVDLSAVPQVYVPYPERPGRDDGGDRCLNCTVHAGFMTSWVNARAAILGPLSDTFAKYPDYQLVVTGHSLGGAVAAIASLELRARGWNPQVTTFGEPRIGNRALAEYLNDQFSLPTDSLPPSFVRNEEKSSPSFCRVTHADDPVPLLPLSEWGYYPHAGEIFISKPDLPPSLDDLRFCIGDADPRCSSHQRFLGLEQVAQLFNSDDKLYEHESCLERVHVEKYQDQYSMSVPMAYKPWDLIFAHRDYFWRIGVCLSKPENWIPGWKDPKWPWKWKWKWPWQSRI

SEQ ID NO: 35044 - protein, 1402 aa, Desulfococcus oleovorans Hxd3
MTLKSKALEVNLASYHVDVSIEDRYMVLRDVMADFQGLAERLDTFLKELSHPYRNWRFIVSEARTFSLDYFYQLRNHAKGPQAADLYVKIFAGAISAAQQMQVKVDAADNLLLFLQKAAKEGGADMAPVLQAGIDTIARLEGESFSFFINSYYQLTDVAAAMLKGGAADLLDAARLGRLLEKYLVAVCRCWQQEKDSLAWLKKEIGWTAPATPAQEEVVALVSGVSHNAISQMLVRIRQLETKTPDSRERCRQLAQLPGYEFFVSAYRNLPDALYAAGVDTGNGHQWKLLALFLVLNMSSLSGLHEEALREINTTLTYLISSSDIKKSREWIKRTFQVLQDQTARFPATALNCVRNVGESVYKTGDAELVSYFIDGVIGLGFHAPMVEGVDNDWKIKANKAHIQNIRAWLALIRENPQRSSRLLSALIVHLTLEGVFIRDTDLFPRDITELLNSDIGPVYNMVKQFARLLPVFFNDIGAEGALRDISTELDEICHRKDVLVHFLRKQGHVEGSNRLIPFMEAAIAFWLTKDKTGLRAFLPPDMYEQVRESGPYVDQMHALFSHLADSGVDLPRGLLALDAEAVAALCEKVPAAPDRERRRVVLVTEFYKLLDQKYTINPSDVEGYVARLNTVDFPDLKELKRAFAESKAKNKATRLITYLEQLKALILSDERFEIEQNIYEKRHIAVDIPSMYGSYRETKFDALGLTFRLEALLNVLFEEIVNDIDLGLITKTTFFQIYNCLRLFVRALAVDGFSTKEIELQLDLLSQGINTRGFSFTQFLDIFKRFATAVKHIIADHFHNRHAKNLRTILSGQPSGVVLPKYLPGDGSRSADMDHDKLTHRVSEIFFREKIALSLGLPQLDLLLTRVLNVLFHQANTLPAERLERLLNYDPARTIAAIDVRETKKYGIIHLGNKGFNIIKLSGYGYPVPPGFIITTEVFRCRDIMDAYAPAEEIFRQQMAHHLKHLEKSAGRKFGDPANPLLLAVRSGAAISQPGMMDTALNVGMNEEITQGLAQQTRNAWFAWDSYRRFLQYYGMAFGLKRDDFDAIIREHKARRSIPLKRYFSGDQMRQVALDYKKMLEDCKIKVAENPFDQLYVTVKNVFASWYSQKAENYRKIVGISDDWGTAVTVQSMVFGNLSRQSGSGVFFTHSPRMPGDTPRLWGDFTIGNQGEDVVSGLVNTLPISVMQKEAEQRRTDITLETHFPEIYAALKQWVDELIYEHGWNPQEMEFTFEGPTKSQLYFLQTRDMTIRESKNITIFDPDDVLESDRFLGQGIGVSGGAMSGRIVFSLEEIDKWAMVEPDTHLILIRGDTVPDDIREISGTDGLLTARGGLSSHAAVLAHSLGKTCVVGCGALVCDEVKKTCRFHDVVLNAGDYISLDGAEGSVYSGFLKTRKVEAYL

SEQ ID NO: 35045 - protein, 686 aa, Xanthobacter autotrophicus Py2
MSGPVHCVVDDGVALVTIDNPPVNVTSQAVRQGLQRALDQAEAAGAGRVVLTGAGKTFIAGADAREFAAAPVEPHLPDIIRRIEAFPVPVVAAINGAALGGGLEVALACRARIAAPGATLGLPEVTLGIVPGAGGTQRLPRLVGLEAALSLIGEGRIINAHEAEDIGLMDAIAADPVTVARTFPIPDRPATGALPAPPPDPAGVEAARKQAGKRSPGQIAPLKAIDLVDASTRQSLDAGLALERETFLTLKTSDQAAALRHVFFAERAAMAQGKGGGTDIGSAVVVGGGTMGAGIAYALAGLGIAVALVESDAAGVGRARANVARLYADAVKRGKTTAGAAEAEQATRFSFHEGYGALPPADLAIEAVFEDMGVKREVFTALDAALPESTILATNTSYLDVNRIAEAVRRPERFLGLHFFSPAHVMKLLEVIRARTTSAETLATALRLAARLKKIPILAGVCDGFIGNRILTRYRQTCDIMLMEGALPAQVDRALRGFGMAMGPYEVQDLSGLDIAYANRKRLGWRTKDGFRYIPIADRVVEETGRLGRKTGAGWYDYDGGKASPSTLIDRIVVEEAVRAGIARRAFSDEEIVARAISSMVEEGFRILEEGIAARAADIDLVMIHGYAFPRWRGGPMHHAGRVGLSEIVRRIEAFAVEDPLSWGVPELLRRAAQEGLSPDDLKASQ

SEQ ID NO: 35046 - protein, 851 aa, Arabidopsis thaliana
MKTHPQAILLCVLFFITFGLLHVVEAGNQEGFISLDCGLSPNEPPYVDAATDLTYTTDNDFVQSGKTGTIDKELESTYNKPILQLRYFPEGVRNCYTLNVTLGTNYLIRASFVYGNYDGLNKELEFDLYLGPNLWANVNTAVYLMNGVTTEEIIHSTKSKVLQVCLIKTGESIPIINSLELRPLINDTYNTQSGSLKYLFRNYFSTSRRIIRYPNDVNDRHWYPFFDEDAWTELTTNLNVNSSNGYDPPKFVMASASTPISKNAPFNFTWSLIPSTAKFYSYMHFADIQTLQANETREFDMMLNGNLALERALEVFTVIDFPELETNQDDVIAIKNIQNTYGVSKTSWQGDPCVPKRFMWDGLNCNNSYISTPPTITFLNLSSSHLTGIIASAIQNLTHLQNLDLSNNNLTGGVPEFLAGLKSLLVINLSGNNLSGSVPQTLLQKKGLKLNLEGNIYLNCPDGSCVSKDGNGGAKKKNVVVLVVVSIALVVVLGSALALFLVFRKRKTPRNEVSRTSRSLDPTITTKNRRFTYSEVVKMTNNFEKILGKGGFGMVYHGTVNDAEQVAVKMLSPSSSQGYKEFKAEVELLLRVHHKNLVGLVGYCDEGENLSLIYEYMAKGDLKEHMLGNQGVSILDWKTRLKIVAESAQGLEYLHNGCKPPMVHRDVKTTNILLDEHFQAKLADFGLSRSFPLEGETRVDTVVAGTPGYLDPEYYRTNWLNEKSDVYSFGIVLLEIITNQHVINQSREKPHIAEWVGVMLTKGDIKSIIDPKFSGDYDAGSVWRAVELAMSCVNPSSTGRPTMSQVVIELNECLASENSRRGMSQNMESKGSIQYTEVSTNFGTEYTPEAR

SEQ ID NO: 35047 - protein, 322 aa, Phyllostachys edulis
MASTLSFPVIDMGLLGGDERPAAMELLRDACENWGFFEILNHGISKELMDEVEKMTKGHYKMVREQRFLEFASKTLKDGCDAQGVKAENLDWESTFFVRHLPESNITEIPDLDDDYRRVMKRFAAELEKLAEGLLDLLCENLGLEKGYLARAFRGSKGAPTFGTKVSSYPPCPRPDLVKGLRAHTDAGGIILLFQDDHVSGLQLLKDGEWVDVPPMRHSIVVNLGDQLEVITNGRYKSVLHRVVAQTDGNRMSIASFYNPGSDAVIFPAPALVEEEAGGTYPKFVFEDYMNLYVRHKFEDKEPRFEAFKSMERESSKRIAIA

SEQ ID NO: 35048 - protein, 719 aa, Polaromonas sp. JS666
MKTIQYALTEESFGRVATITFDEPGSPVNTMCRQWQDDLSEVTAQVLKDREAIQGVILASAKSTFFAGADLKAAMRLTAADASQVYAEIERVKKNFRTLETLGKPVVSCLNGAALGGGWELALVGHYRVAVDDSKVRFGLPEVTLGLLPGASGVTKMTRHLGLMAAQPYLVEGKTFGPREALALSLVHALVPDAAALRAQALAWIAANPRAQHPWDARDYEIPGGTPASPEVAAALSVAPAMLKKKTRGLYPAPEAILACMVEGALVDLETALRIESRYLARLMTGPNARAMINTFFFNMNAIKSGQSRPSSVPHATPLKVGVLGAGMMGAGIAYAQASRGLATVLKDVSLDKAEAGKAYSARLTQPQVEKGHMTPANQAALLSRITATDQLADLAGCDLIIEAVFEQRDLKAKVTQEAEPLLAAGGFFASNTSTLPISGLAVASSRPEKFIGIHFFSPVDKMKLVEIIRGRQTDDETVARAFDYVQALGKIPIVVNDSRGFYTSRTFAAFVMEGAAMLGEGIPAAVIENAGMQAGMPVGPLAVLDETALSLSVHVLDQTRADFAAEGKTYIATPGELLVERMVKEFQRNGRAEGGGFYDYPAEKGAKKMLWPHLKALFEKSGTPWDITGIKDRLLYRQAVEAARCLSEGVLTTVAEANIGSIFGIGFPAWTGGTLQFIYGMGLDDFIRRCDELAAKFGPGFMLTNTVRSALRKHQPVY

SEQ ID NO: 35049 - protein, 506 aa, Picea sitchensis
MALELTQAASAADSNLSSSSSIDTSSHSSFSTITSLSSGISSINVSDVAKTAENDSNFNKSGKSSCSSDETTSCSAPLSNGCFKKPHKASNDPGWEAIQAVKKREGGIGLNHFSLLKRLGRGDIGSVYLVELKGTGCFFAMKVMDRGSLASRKKMLRAMTEREILSSLDHPFLPTLYTHFETEQFSCLVMEYCSGGDLHTFRQRQPAKRFSEEAVRFYASEVLLALEYLHMMGVVYRDLKPENVLVREDGHIMLSDFDLSLRCVVRPTLVKPVPLDLGPSCSVPTLCVKPTCIEPACVMPACIQPSCFVPSLFAQRLRKSRKTNKDVIKQVISLPELIAEPTNARSMSFVGTHEYLAPEIIKGEGHGSAVDWWTFGIFLYELLHGKTPFKGAGNHATLSNVAGQPLKFPEAPAISSGARNLIKGLLAKGPQHRLGSRRGATEIKQHPFFEGVNWALIRSITPPEVPKPTGLDFYTNKVGVSDPSVDKKIADSEASSSGPNLGFDLY

SEQ ID NO: 35050 - protein, 90 aa, Physcomitrella patens subsp. patens
MAAPLRNLASMKVKDVPNHLKSNLSREKVMSSTWSWLYKYNEKYIQTGSIRPLMDVMLSVGFLSYAIAWPTEIRHLRHAEEAAKHGKDHH

SEQ ID NO: 35051 - protein, 375 aa, Rhodopirellula baltica SH 1
MSFTRPPHAHLVPVRPMNSSIVLLPGDGIGPEIVEQARLVLVKVAERFGHTFDFSSHQIGGIAIDETGDPLPQPTIDACRNAAAILLGAVGGPKWDDPSAKTRPEAGLLKIRKELGLFANLRPIKLFDELADASPLRADIVKGTDILFFRELTGGIYFGESGTSGSGEEETAFQSMTYSVGEVKRIVRMAAQAARGRSNRLTSVDKANVLEPSRLWRRVAAEVMANEFPDVQYDVVLVDSMAMHLINRPSEFDVVVTGNMFGDILTDEASMLPGSLGMLPSASLGDGGPGLYEPIHGSAPDIAGKSVANPLATILAAAMMLRHSLGLTDEAEAIEKAVAGVITDGLRTPDLARGDQSKSVSTEEMGAAVVAKLAS

SEQ ID NO: 35052 - protein, 208 aa, Zea mays
  misc_feature (174)..(174): Xaa can be any naturally occurring amino acid
MLLRPALPVAVSSTLPLISHLAAVRRRCSIAATGMAGVSAASPAAAQIGSFLSKKPYAPPSWASHLALAPSHTFSLGHFPTPIHKWNLPNLPEGTEVWIKRDDLSGMQLSGDKVRKLEFLLSDAVAQGADCVITVGGIQSNHCRATAVAAKYLNLDCYLILRTSKLLVDQDPGXLVGNLLVERLLGAHIDLVSKEEYGKIGSVALADL

SEQ ID NO: 35053 - protein, 167 aa, Glycine max
  misc_feature (42)..(42): Xaa can be any naturally occurring amino acid
PLASRCAKFRFKPLSEEIMSSRILYISQEEGLCLDAEALSTXSFISHGDLRRAITYLQSAARLFGSSISSENLISVSGVVPAKVVEALLKACKSGNFDLANKEVNNFIAEGYPASQMLTQKARISKKLGEADKCLVDGADEYLQLLDVVSNTIKAFNSLPEAFAYEC

SEQ ID NO: 35054 - protein, 253 aa, Azoarcus sp. BH72
MQGMLEQKVVIVTGAGSGIGRAAAELMAREGAIVIASDLKLDTVEDTAHRITLAGGRAVAVRTDVAKLAELDALHDLAIAEFGRLDGAFNNAGIPGPGVALADHEEAAFDALIAINLKAVWYGMKRQIELMLPGGGGAIVNTASVGGIVGKPGLSVYCATKHAVIGLTKTAALEYGSRGVRVNAVCPGVIRTPMVDQVIAGQPGAEEEWNRLQPIGRMGTPEELAETVVWLMSPRASLVHGHALVADGGLTVA

SEQ ID NO: 35055 - protein, 158 aa, Brassica rapa subsp. pekinensis
TMGISVKEFPWIKGFNFDVPHVVQVAQVLDGVENVGGDMFDSVPKCDAVLIKWVLHDWGDRDCIRILKNCKEAVPPNIGKVLIVESVIREKKKAMIVEDRDEKLEHVRLMLDMVMMAHTTTGKERTLKEWDFVLNEAGFARYEVRDIDDVQCVIIAYR

SEQ ID NO: 35056 - protein, 423 aa, Ashbya gossypii ATCC 10895
MSQSRGIRRLQTSSYPQKLGHSQPNEFKVLEEIGRGSFGSVRKVLHVPTSKLMVRKEIKYGHMNSKERQQLIAECTILAGLRHENIVEFYNWDHASSRTGNSVDYGNGEVLYLYMEYCSCGDLSQMIKHYKGMRKYVPERDIWRIAVQLLLALYKCHTSCDLPQLDTIYDKISKSAIESEAGKVTSVIHRDLKPGNIFLTGDGVGGRGSVDYSKVEVKLGDFGLAKSLQSAIEFATTYVGTPYYMSPEVLMDQPYSPLSDIWSLGCVIYELCALRVPFPARNFMELQRMIQRADVQPLPDYYSKELQQLVISCINPNEKLRPSAFDLLQCLQLRVARKALQLERFEKNLLVYEKELTEIGEMLEKQASDYDKEINDMRTQCRKDFELAVEKRARELVSGKRIQDVPDIHARYHVRTPTNPWRS

SEQ ID NO: 35057 - protein, 315 aa, Brassica napus
MANALRYFELNTGAKIPSVGLGTWQASPGLVGDAVAAAVKIGYRHIDCAQIYGNEKEIGTVLKKLFEDNVVKREELFITSKLWCTDHDPQDVPEALKRTLQDLQLDYVDLYLMHWPVRMKKGSVGAKPENLLPVDIPSTWKAMEALHDSGKARAIGVSNFSTKKLADLMELARVPPAVVQVECHPSWRQTKLREFCKSKGLHLTAYSPLGSPGTTWLKSDVLKNPILNTVAKKLGKSAAQVALRWGLQMGNSVLPKSTNEGRIRENFEVFDWSIPDDLFSKFPEIEQARLLTAPFFVHETLSPYKSLEELWDGEI

SEQ ID NO: 35058 - protein, 82 aa, Brassica rapa subsp. pekinensis
IGTIRYGLKTLNYQKPPGKKIVEDYDITKLPVNSNTTKGSGIYNFQLGRVVGVILQNSNVLNGRGSEIHPWHLHGHDFWVLG

SEQ ID NO: 35059 - protein, 219 aa, Physcomitrella patens subsp. patens
MGRRRCGWWRQVLLIVGMWLVLARRAQGIRFVIDKKECFQHEVPFDGDHVRVSYVVIKSESSWSFEHTPVGLDLIVEGPAGHQVHSSKALVEDKFDFTAARKGLYKFCFFNRNSMHETVDFDVHVGYHILNADEEHVKDEHIEPLMMQIESLEESLYSIQFEQHWLLAQTDQQEIVNKAMSRRVVYKAMLEALALMGCSVLQVVLLRRLFEKKLGQSRV

SEQ ID NO: 35060 - protein, 244 aa, Corynebacterium glutamicum
DHQQAIGTVQKLAFALPKEYFEKVDVAVTVPFTDIRSVQTLVEGDKLEVTFGAQDVSQHESGAYTGEVSASMLAKLNCSWVVVGHSERREYHNESDELVAAKAKAALSNGISPIVCVGEPLEIREAGTHVEYVVEQTRKSLAGLDAAELANTVIAYEPVWAIGTGKVASAADAQEVCKAIRGLIVELAGDEVAEGLRILYGGSVKAETVAEIVGQPDVDGGLVGGASLDGEAFAKLAANAASVA

SEQ ID NO: 35061 - protein, 132 aa, Pseudomonas aeruginosa PAO1
MSKIDKPLDSWREELTEEQFHICRLGGTERAFSGEYHATKTPGIYHCTCCGTALFDSDAKYDSGSGWPSYFQPVDAEAVRELDDFSHGMHRIEVRCGRCDAHLGHVFPDGPRPTGLRYCINSASLKLVPRES

SEQ ID NO: 35062 - protein, 467 aa, Ustilago maydis 521
MSDEGDTSRPAVILPAADPFKVFRPDLFKGKVLFCTGGGSGICYEMTKTIMSFGANAAILGRKADRLARASKELSSATGQECLPCPADVREPEQLREAARKTIEKFGRIDFVIAGSAANWLAGIEQNTEKGFKTVIDIDLIGSYNTVKATLEEVTKNKGSYIFISATLHYYGLPYQSHASAAKAGVDALSRVLAVEMGPLGVRSNVIAPGPIADTEGMDRLAPKGVGEAVAEGVPMQRMGKKSDIASAGVYLFSDAATFITGTQMVVDGGAWQVQGPMLPYPTTSLDPKSLSSLYFAYGDHDKSEQADTHTHTFCCKSKRAATYASLLVKRVMCHGSPAKQYNRAKLEPELGKIGRRVFRVPGPEFGVGTPFLRRQPKNSAGATSHSFGKLKLYLKRSASSANAPNPKERDVRSLALENFQRKSASRARQYIKMPSQKTFRTKVKLAKAQKQNRQTKRPEWDTMRSY

SEQ ID NO: 35063 - protein, 532 aa, Mesoplasma florum L1
MNVKKPVILAILDGWGIEEAGVGNAVANADQKFVKEMMGMYPWVKAHASGEWVGLPEGQMGNSEVGHIHLGAGRINMESLAKLNHEVKVDGFLTNEVLVDTFKYVKEHNSALHLMGLFSDGGVHSHMNHMISMYKAAVKFGLTNIKFDLITDGRDTAPKVAEQYINQLLQVIKDNNNIGEIASISGRYFAMDRDKRFERSAAAYITMTERKVDQPKFTDPIEYVKAAYENGLDDEMIVPAYNASVVDSELKANDAMIFTNFRPDRAIQMASIMTNNNYPAWNDEAFKDVEFIGDKIRFVSTMKYADSVTSQFIAYPPTPLTNTLGEYISSLGLKQLRIAETEKIAHVTFFFDGGNDYFKNGLAKPEEISLPHASIDLISSPKVATYDLKPEMSAVEITDKLLEEVKKDEFDLIVLNFANCDMVGHTGNNDATVKGVKVLDEQLKRIHDEFVLKHNGVMVITADHGNAEIMIDETGGPNKKHTTSLVPIIVTDKTIELSDFDPAIAKVAPTILDIMGLEIPKEMTQPSMIIKK

SEQ ID NO: 35064 - protein, 256 aa, Mycobacterium sp. MCS
MTDAEMTVDLDFSLTGKVALVTGGASGIGAAIASAFAAKGARVAVADLNEPGAQAHAAALATESSGFRCDVSDPASVAATVDAVAGTFGRIDILVNSAGVARLAPAEDLTLTDWESTIDINLKGTFLMCQAVGRRMLADGGGSIVNLASQAASVALDQHVAYCASKFGVVGVSKVLAAEWGGRGIRVNTISPTVVLTELGHKAWDGPRGDALKKLIPIGRFAYPPEIAAAAVYLASDAAAMVTGADLVVDGGYTVK

SEQ ID NO: 35065 - protein, 323 aa, Triticum aestivum
  misc_feature (12)..(12): Xaa can be any naturally occurring amino acid
FGTRYKTKRSQXQRLEVMGLVDIFRAKVVDLSDHTLTVEVTGDPGKIAAVQRNLSKFGIKEVARTGKIALRREKMGQTAPFWRFSVASYPDLEVKMPSKSTLSTAKTTSGDSEESSQGDVYPVESYESFSMNQILDAHWGAMTDSDPTGFCSHTLSILVNDSPGVLNVVTGVFARRGYNIQSLAVGPAEKTGTSRITTVVPGNDESIAKLVQQLYKLIDVYEVQDLTHLPFAARELMIIKVAGNTSARREILDIAEDVFRAKTVDVSGHTITLQLTGDLDKMVALQRLLEPYGICEIARTGRVALCRESGVDSKYLRGYSLPG

SEQ ID NO: 35066 - protein, 348 aa, Magnaporthe grisea 70-15
MRFPSVLTLLATALTCSASVLPAGLTYTKTVEGRDVTVSETDLDNFRFYAQYSAATYCNDAAASGAAVACSNDGCPAVVANGAKIIRSLNQDTSTNTAGYLALDPKRKNIVLALRGSTSLRNWITNLTFLWTRCDFVQDCKLHTGFATAWSQVQADVLAAIADAKAQNPDYTVVVTGHSLGGAVATVAGVYLRQLGYPVEVYTYGSPRIGNQEFVQWVSTQAGNVEYRVTHIDDPVPRLPPIFLGYRHVTPEYWLNSGTSNTVNYTVADIKVCEGFANINCNGGSLGLDTNAHLYYLTDMIACGSNKFVFRRDDANAISDAELEQRLTMYAQMDREFVAALEANKTVA

SEQ ID NO: 35067 - protein, 511 aa, Bacillus megaterium
MSKKPVALIILDGFALRDEDKGNAVTHAKKPNFDRFWNEYPHATLQASGEAVGLPEGQMGNSEVGHLNIGAGRIVYQSLTRVNVAIREGEFEQNETLLAAVKHAKEKGTNLHLFGLLSDGGVHSHIEHLYALLRLAKSEGLEKVYIHGFLDGRDVAPQSAETYLKELNEKIEEYGVGEIATLSGRYYSMDRDKRWERVEKSYRAMVYGEGPSYTSAEECVKDSYDNGIYDEFVLPSVITKEDGSPVATIQDEDAVIFYNFRPDRAIQISNTFANEDFRSFDRGEKHPKHLHFVCLTHFSETVDGYVAFKPINLDNTLGEVLSQNNLKQLRIAETEKYPHVTFFMSGGREAEFPGETRILIDSPKVATYDLKPEMSAYEVTDALLAEIEGDKQDAILLNFANPDMVGHSGMLEPTVKAIETVDECLGKIVDAILAKGGTAIITADHGNADEVITLEGNPMTAHTTNPVPVIVTKQGLELREDGILGDLAPTMLTLFLDVAQPKEMTGKTLIK

SEQ ID NO: 35068 - protein, 205 aa, Triticum aestivum
QDEEEEDQQDMAPVKMALGPQVPLKDLLHLHKEEEEGEDESLRRWKEQLLGPDAVHTTNLLHALGAETVEPEVTILNLTILAPGRPDLLLPIPFVPDDKGHAFALKDGCAYSFRFSFAVSNNIVSGLKYSHTVWKTGVKVENQKVMLGTFSPQQEPYTYKAEEDSTPSGIFARGSYSARLKFVDDDGKVYLDMRYSFEIRKDWPN

SEQ ID NO: 35069 - protein, 174 aa, Zea mays
  misc_feature (39)..(39): Xaa can be any naturally occurring amino acid
  misc_feature (144)..(144): Xaa can be any naturally occurring amino acid
RPASFARSPEWGATRQDAAPKTPTGSMVVRAYDYDDELXMTAKMIVLSGRCILEMDESNATCGKRLETIGMDNTEDNREAYRKLLVTGPGLGQYISSVILFEETMDQAAVDGRKSVDILAEQGIETGIKEDKGLVPIAGSNNEXWCQGLDGLVYREDVYYQQGARIDKWHTDDS

SEQ ID NO: 35070 - protein, 347 aa, Populus trichocarpa
MIIGRLLAGIGIGISSAIVPLYISEISPTEIRGALGSVNQLFICIGILLALVAGLPLAGNPIWWRTMFGISAVPAVLLALGMAFSPESPRWLFQQGKFSEAEKSIMTLYGKERVADVMTDLNVASQGSAEQEAGWFDLFSSRYWKVVSVGVALFFFQQMAGINAVVYYSTAVFRSAGIESDVAASALVGASNVFGTTIASSLMDRQGRKSLLITSFFGMAASMLLLSLSFTWKALAPYSGTLAVLGTVCYVLSFSLGAGPVPALLLPEIFASRIRAKAVALSLGMHWAANFVIGLYFLSFVNKFGISSVYLGFSGICLLGVLYIAANVVETKGRSLEEIERALDPAI

SEQ ID NO: 35071 - protein, 350 aa, Arabidopsis thaliana
MAEEIRFFELNTGAKIPSVGLGTWQADPGLVGNAVDAAVKIGYRHIDCAQIYGNEKEIGLVLKKLFDGGVVKREEMFITSKLWCTYHDPQEVPEALNRTLQDLQLDYVDLYLIHWPVSLKKGSTGFKPENILPTDIPSTWKAMESLFDSGKARAIGVSNFSSKKLADLLVVARVPPAVNQVECHPSWQQNVLRDFCKSKGVHLSGYSPLGSPGTTWLTSDVLKNPILGGVAEKLGKTPAQVALRWGLQMGQSVLPKSTHEDRIKQNFDVFNWSIPEDMLSKFSEIGQASDFPHIVVHIGQRAFFVLLTHLGYRILKTCVSMLQGRLVRGMSFVHETSPYKSLEELWDGEI

SEQ ID NO: 35072 - protein, 354 aa, Novosphingobium aromaticivorans DSM 12444
MSESRNVARALDALRHGWAIRVTGPEGALDLLPAETAFVQPGIYAARLLISAARAATLKLANQRDAAVPEAPVMIHGAEPFSLSAARNLADPAQDLGSPLRGPFKADAIEAHEAAVAAMDMARLAGILPAFLISTGVEIAAEVSTADLAAFKDPLNLSIQARARLPVHACEHAEIIAFRARDDLREHVALVLGTQTSEREPLVRLHSECLTGDVLGSLKCDCGPQLDAALARMAEEANAGGWGILLYLRQEGRGIGLINKLRAYELQDQGFDTVDANERLGLPSEARDFPVAARMLDLLGVRSLRLLTNNPQKVATLQALGLEVTERVAHQLPSNPHNQRYLDTKRDRTGHLLR

SEQ ID NO: 35073 - protein, 501 aa, Oryza sativa Japonica Group
MAPPPSLLATALLLLLLAIAGGPNAAAVAEAVRYQTLVATPLSPHPYTATAVEDDGLFQGSLAADEGGAAASTVGLRVVHRDDFAVNATAAELLAHRLRRDKRRASRISAAAGGAAAANGTRVGGGGGGSGFVAPVVSGLAQGSGEYFTKIGVGTPVTPALMVLDTGSDVVWLQCAPCRRCYDQSGQMFDPRASHSYGAVDCAAPLCRRLDSGGCDLRRKACLYQVAYGDGSVTAGDFATETLTFASGARVPRVALGCGHDNEGLFVAAAGLLGLGRGSLSFPSQISRRFGRSFSYCLVDRTSSSASATSRSSTVTFGSGARGALGRRVLHPDGEEPQDGDVLLRAAHGHQRRRRARPGRGRVRPPPDPSTGRGGVIVDSGRPSPAWARAGRTPPCATRSRAAAAGLRLSPGGFSLFDTCYDLSGLKVVKVPTVSMHFAGGAEAALPPENYLIPVDSRGTFCFAFAGTDGGVSIIGNIQQQGFRVVFDGDGQRLGFVPKGC

SEQ ID NO: 35074 - protein, 148 aa, Brassica napus
MASSVASSTTLISSTQVSPAKSSLPSPSSLSFLRTVSSPLRSGSALRSSLSSCSRRSFAVKAQADDLPLVGNKAPDFEAEAVFDQEFIKVKLSEYIGKKYVILFFYPLDFTFVCPTEITAFSDRYAEFEKLNTEVLGVSVDSVFSHLA

SEQ ID NO: 35075 - protein, 409 aa, Triticum aestivum
  misc_feature (200)..(200): Xaa can be any naturally occurring amino acid
THSSLRSSGKGGRSIGPPIDPSAGKMNSLTATGSSSGAGSSGGGGGGEMRAADGEGYLRADGFDLVNLDMQLEKTRSRVWLDQQRGASPAQPGELLEWEIDLAKLDIQNQVASGTFGVVYRGTYDGNDVAVKVLDWGQEGQESSSKHREAFEKEVAVWQKLDHPNVTKFVGASMGTSQLKIPASKKGGSSHGPGQRCVVXVVEYQHGGTLKTLLFQHRDKKLPYKKVVQLALDMARGLSYLHSQKIVHRDVKAENMLLDRKKSVKIADFGVARVEAQDDDNMTGQTGTLGYMAPEVLEGRPYDHKCDVYSFGVLLWETYCCALAYPNYSIADISYHVVKLGIRPDIPRCCPKPLSEIMTRCWDGNPDHRPEMAEVVAMLERIDTTKGKSMTPAVPDHTSQGCSCFGFSK

SEQ ID NO: 35076 - protein, 504 aa, Glycine max
MFSPRDMPSPSSIFSAYASMTASIMLLRSMANDLVPQPIRGYLYSTFRYLIKPRSPTLTLIIEESTGIARNQVYDAAEAYLSTRVSPENERLKISKSAKEKKLTVRLEKGEKVVDCFDGACFKWRFICAESEKNNPNDHSNNNSISVRSEKRSFELSFPKKYKEMVLDSYLPFILEKAKEMKDEERVLKMHTLNTSYCYSGVKWDSINLEHPSTFETLAMEPELKNAVIEDLDRFVKRKEFYKRVGRAWKRGYLLYGPPGTGKSSLIAAMANYLKFDIFDLQLGNIVRDSDLRKLLLATANRSILVIEDIDCSVDLPERRHGDHGRKQTDVQLTLSGLLNFIDGLWSSCGDERIIIFTTNHKERLDPALLRPGRMDMHIHMSYCSYQGFKILASNYLETPSDHPLFGEVEGLIEDIQITPAQVAEELMKNEDPEATLEGFVKLLKRKKMEGDVCENSTPDKAEPTHQQSKRRKVGCKQKRGVGINKSISGVTQIRTRRMRGCSL

SEQ ID NO: 35077 - protein, 276 aa, Oryza sativa Indica Group
MAACCSSLATAVSSSSAKPLAGIPPASPHSLSLPRSPAAAARPLRLSASSSRSARASSFVARAGGVDDAPLVGNKAPDFDAEAVFDQEFINVKLSDYIGKKYVILFFYPLDFTFVCPTEITAFSDRYDEFEKLNTEILGVSIDSVFSHLAWVQTDRKSGGLGDLKYPLISDVTKSISKSFGVLIPDQGIALRGLFIIDKEGVIQHSTINNLAIGRSVDETMRTLQASSLEYTLLSAHTALQYVQDNPDEVCPAGWKPGDKSMKPDPKGSKEYFAAI

SEQ ID NO: 35078 - protein, 617 aa, Arabidopsis thaliana
MSGPVDRFAIPCFEGILSSDEKKERKSDFENSEDERRTRIGSLKKKAINASTKFKHSLKKKRRKSDVRVSSVSIEDVRDVEELQAVDEFRQALVMEELLPHKHDDYHMMLRFLKARKFDIEKAKHMWADMIQWRKEFGTDTIIQDFQFEEIDEVLKYYPHGYHSVDKEGRPVYIERLGKVDPNKLMQVTTLDRYIRYHVKEFERSFMLKFPACTIAAKKYIDSSTTILDVQGVGLKNFTKSARELITRLQKIDGDNYPETLHQMFIINAGPGFRLLWSTVKSFLDPKTTSKIHNYSILLCFAYISDVSFICFSELPEFLGGACTCADQGGCMLSDKGPWKNPEIVKMVLHGGAHRAKQVVKVLNSDGKVIAYAKPSYPWIKGSDTSTAESGSEAEDIVVSPKAVKSYSHLRLTPVREEAKVGSGETSFAGSFAGYDEYVPMVDKAVDATWKVKPTAINRAPSKGAHMPPNVPKDHESFSARVLVTFMAFVMAILTFFRTVSNRVVTKQLPPPPSQPQIEGSAAAEEADLLNSVLKKLTELEEKIGALQSKPSEMPYEKEELLNAAVCRVDALEAELIATKKALYEALMRQEELLAYIDRQEAAQHQKKNKRKQMFCF

SEQ ID NO: 35079 - protein, 601 aa, Haemophilus somnus 2336
MVAEGANPLVSVVTLLAAAVVAVPLFKRLGLGSVLGYLAAGLVIGPFGFGLFTDPEGIIHIAELGVVMFLFIIGLEMKPSHIWGLRNYIFLLGAFQITLCTSALTYIATLFGFDWKVAFVAASGFVLTSTAIVMQELSERNDLTSPRGQRIISILLFEDLLIVPLLAFVAFLSPDKVTSTDPLWHKIAISGTAFAVLVAAGLWLLNPLFKMLAKTKTREVMTAAALLVVLGSALLMEEGGFSMAMGAFLAGVLLSESSFRHQLEADIEPFRGLLLGLFFLGVGMSLNLSVVAENWFLIIFGVLLFMLVKGFIIYLIALITKTGNANSIDRAFIMAQGGEFAFVLFSAAASQNVISEEMQANMTAIVVLSMILTPLFIIAQKKYIIPRLKPTQPERKADHIDEQHPTILIGLGRFGQVVNRMLVMTGHHPTIIDKDANLIAGMKKLGIKCYYGDAARPELLHAAGVENAELLIIAIDNREQTLQIVEQARKMNPQIKIIARAHDRIHVYNLYGAGANIQIRETFDSALRTSKQALLSLGMNEDIVAEIGDVYFRKDCHSVKLMAEVYDPKLSRFENKELIQIALDVDQEMMAEIQQIMKKEH

SEQ ID NO: 35080 - protein, 109 aa, Brassica napus
  misc_feature (26)..(26): Xaa can be any naturally occurring amino acid
  misc_feature (34)..(34): Xaa can be any naturally occurring amino acid
  misc_feature (46)..(46): Xaa can be any naturally occurring amino acid
  misc_feature (79)..(81): Xaa can be any naturally occurring amino acid
  misc_feature (83)..(83): Xaa can be any naturally occurring amino acid
  misc_feature (86)..(86): Xaa can be any naturally occurring amino acid
MTVEAVNPKAYPLADSQLAITILDLXQQATNYKXLKKGANEATKTXNRGISEFAVMAADAEPLEILLHLPLLAEDKNVXXXFXPSXCRCHDCPPPALIPTPPPHRDSSR

SEQ ID NO: 35081 - protein, 769 aa, Oryza sativa Indica Group
MENGRLYPERPRTFSTVRTKSSLPPIFRVLMRINPRAFIVLLLLVFSGVLYVGASTSPIVLFVFCICTLSLFFSLYLTKWVLAKDEGPPEMSEIYAVFFIGCLLDVQISDAIRDGAEGFFRTQYGTISKMACILALVILGIYLFRSTTPQQEASGVGRTTSAYITVASFLLGALCSGIAGFVGMWVSVRANVRVSSAARRSAREALQIAVRAGGFSAIVVVGMAVFGVAILYATFYVWLEVDSPGSMKVTDLPLLLVGYGFGASFVALFAQLGGGIYTKAADVGADLVGKVEQGIPEDDPRNPAVIADLASLFCLSCNIIDKNAKLSSDNSYPSGFILFPLVVHSFDLVISSVGILSIRGTRDSGLISPIEDPMAIMQKGYSITILLAVVTFGVSTRWLLYTEQAPSAWLNFALCGLVGIITAYAFVWISKYYTDYKHEPVRLLALSSSTGHGTNIIAGVSLGLESTALPVLVISVAIISAFWLGHTSGLVDESGNPTGGLFGTAVATMGMLSTAAYVLTMDMFGPIADNAGGIVEMSQQPESVREITDILDAVGNTTKATTKGFAIGSAALASFLLFSAYMDEVAAFAQLPFKEVDIAIPEVFVGGLLGSMLIFLFSAWACSAVGRTAQEVVNEVRRQFIERPGIMDYNEKPDYGRCVAIVASASLREMIRPGALAIISPMAVGIIFRMLGHATGQPLLGAKVVAAMLMFATVAGILMALFLNTAGGAWDNAKKYIETGALGGKGSESHKAAVTGDTGKQIRKYGFRK

SEQ ID NO: 35082 - protein, 396 aa, Escherichia coli
MFENITTAPADPILGLADLLRADERPGKIDLGMGVYNDETGKTPVLTSVKKAEQYLLENETTKNYLGIDGIPEFGRCTQELLFGKGSALINDKRARTAQTPGGTGALRVAADFLAKNTSVRRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSKNFGLYNERVGTCTLVAADSETVDRAFSQMKAAIRVNYSSPPAHGASVVATILGNDALRAIWEQELTDMRQRIQRMRQLFVNTLQEKGANRDFSFTIKQNGMFFFGGLTKEQVLRLREEFGVYAVASGRLNVAGMTPDNLAPLCEAIVAVL

SEQ ID NO: 35083 - protein, 162 aa, Haemophilus somnus 2336
MIRIGHGFDVHAFGGEGPIIIGGVAIPYEKGLVAHSDGDVALHALTDALLGAMALGDIGKLFPDTDIQYKGADSRRLLRTAYQAILDKGYQVGNVDITIIAQAPKMRPYIDSMRTVIAQDLHCDIEQVNVKATTTEKLGFTGRSEGIACEAVVLLIKQNGTK

SEQ ID NO: 35084 - protein, 177 aa, Mesorhizobium loti MAFF303099
MRIEAIATGKNPPEDVNVIIEVPIGGEPIKYEMDKEAGTLFVDRFLHTSMRYPGNYGFVPHTLSGDGDPIDVLVCNTRALVPGCVINVRPIGVLVMEDNAGQDEKVIAVPSPKLTLRYENVTEYTHLPEITRQQVQHFFEHYKDLEPGKWVKIEGWHDSKYAKKMIVDAIERAKKGK

SEQ ID NO: 35085 - protein, 300 aa, Ashbya gossypii ATCC 10895
MTENRKTVKLFLLRHGESELNHAKIFCGWIDAHLTDKGKDQARSSASLIASFCREHGIEPPLVGYTSRLLRTIETMQVIMKELRRAAVFQTVVDTADALAVVDKVTAAGQTPVLQVWTLNERHYGSWQGQRKSSVLEQFGKSDYMLIRRDYNGRPPAVDLGREMIQEDNEQGPLTGYDFKEPNRRLKYGPELEKAIELPRNESLADVIKRLAPFLNEVVLKLLHELGESAIIVAHGSTVRSVLKILANISEEDIKDIDIPTGNPLVIELNASDMSFVRHFYLDPESARKEAENVRNEGCN

SEQ ID NO: 35086 - protein, 318 aa, Physcomitrella patens subsp. patens
TSKFRNSLKKRRSNSLTRVTSLALPIVDIRDDKDQKAVEELRKELFDKNLLPPQHDDYHALLRFLKARKYDVKKTIEMWRNMLAWRKDFRTDTIIEDFLFTEIDTVRRFYPQGHHGVDKEGRPVYIERIGKIQAQSLLEVTTLERYLKFHVQEFEKLLNLKFPACSVAANRHIDTTTTILDVSGVGLKNFSKPARDLILAIQKVDNDNYPETLAGLFIVNAGPGFKMLWSTVKGFLDPNTAAKIHVIGTNYQKKLLEIIDESNLPEFLGGGCNCQTEGGCLQSDKGPWKDSDILKVKGQLTFCIIISPCSQLEDVTLT

SEQ ID NO: 35087 - protein, 510 aa, Rhizobium leguminosarum bv. viciae 3841
MKEILEELERRRGIARLGGGEARIAAQHKRGKLTARERIDLFLDEGSFEEFDMFVEHRSTDFGMDKSRIAGDGVVTGWGTVNGRTVFVFAKDFTVFGGSLSEAHAEKIMKVQDMALKNRAPIVGIYDAGGARIQEGVAALGGYAEVFQRNVLASGVIPQISVIMGPCAGGDVYSPAMTDFIFMVRDTSYMFVTGPDVVKTVTNETVTAEELGGAVVHTVRSSIADGAFENDVETLLQVRRLIDFLPLSNTAPLPEIECYQSVTDIDASLDTLVPASSNKPYDIKELIRKVSDEGDFFEIQASFAKNIVCGFGRVEGSTVGFVANQPMVLAGVLDSDASRKAARFVRFCDCFNIPIVTFVDVPGFLPGTAQEYGGLIKHGAKLLFAYAEATVPKLTVITRKAFGGAYDVMASKHLRGDLNYAWPTAQIAVMGAKGAVEIIFRKDTADPEKIAAHTKMYEDRFLSPFVAAERGYVDEVIMPHSTRRRLARGLKMLRNKDLANPWKKHDNIPL

SEQ ID NO: 35088 - protein, 569 aa, Ashbya gossypii ATCC 10895
MSDAVERHTFKVFTQDFMVDKRFQLIKEIGYGAYGIVCSARFMESVEDTTVAIKKVTNVFSKALLCKRSLRELKLLRHFRGHKNITCLYDMDIVLLPDGSFNGLDLYEELMEWDMHQIIKSGQPLTDAHYQSFVYQILCGLKYIHSADVLHRDLKPGNLLVNADCQLKICDFGLARGYSENPIENDQFLTEYVATRWYRAPEIMLSYQGYTRAIDVWSCGCVLAELLGGRPIFKGKDYVDQLNRILQVLGTPPEETLKRIGSKNVQDYIHQLGYIPKVPFERLYPNANPDAADLLERMLALDPKTRITVDEALEHPYLSIWHDPSDEPVCCKKFDFSFESVNEMEELKRMVIEEVKDFRRFVRQPNIRDTSLQEQEEQQPQQPQQPQQPQPEQPQHQRQHQQAQAQAQAQAHEQQQQHHRTQYQRSGAVQRQPQTVEHGQHLQHRSGHHSEHLQRAHGQQEQYLPKKDDSRAFQSRPVGTSISDSRSSYEEHDYVQQMMFAHSPTLAHDSFIGIHSENLPEHNTDFPPRPQENMLASPMGFSDGTHSNAEFGDFLDLEKELEFGLDRKI

SEQ ID NO: 35089 - protein, 275 aa, Mesoplasma florum L1
MLLSFLFHWFSYCYIIKNVQKNKRRNIMRQKVIFGNWKMNGTNAELVTFLKKVDKAAKKSDVVAGLGLPFTLLSKGIEKAKNVKVAAQNVHFAEKGAFTGEVSISMLQEVGVQYVIIGHSERREMFAETDETVNKKATALLAAGITPIICCGETLETKEAKKTVTFVNAQIKKAYKGISAEDALKTIIAYEPIWAIGTGKTATSEDAEKVCEAIRKNLTKIYDEKTAQQITIQYGGSVNPSNIAELMSQPNIDGALVGGASLKADDFIALINYKK

SEQ ID NO: 35090 - protein, 518 aa, Saccharum hybrid cultivar H65-7052
MAGGGMAALGVKTERAAQYKGRMTLAVAMTCLVAAVGGAIFGYDIGISGGVTSMDPFLEKFFPVVFHRKNSGGKNNYCKYDNQGLAAFTSSLYLAGLVASLVASPVTRNYGRKASIVCGGVSFLIGAALNVAAVNLAMLILGRIMLGVGIGFGNQAVPLYLSEMAPAHLRGGLNIMFQLATTLGIFTANLINYGTQNIKPWGWRLSLGLAAAPALLMTLAGLFLPETPNSLIERGRVEEGRRVLERIRGTADVDAEFTDMVEASELANTIEHPFRNILEPRNRPQLVMAVCMPAFQILTGINSILFYAPVLFQSMGFGGNASLYSSVLTGAVLFSSTLISIGTVDRLGRRKLLISGGIQMIVCQVIVAVILGAKFGADKQLSRSYSIAVVVVICLFVLAFGWSWGPLGWTVPSEIFPLETRSAGQSITVAVNLLFTFAIAQAFLSLLCAFKFGIFLFFAGWITVMTVFVCVFLPETKGVPIEEMVLLWRKHWFWKKVMPVDMPLEDGWGAAPASNNHK

SEQ ID NO: 35091 - protein, 409 aa, Zea mays
MQFALALDTNSGPHQIRSCEGDGIDRLEKLSIGGRKQEKALRNRCFGGRVAATTQCILTSDACPETLHSQTQSSRKNYADANRVSAIILGGGTGSQLFPLTSTRATPAVPVGGCYRLIDIPMSNCFNSGINKIFVMSQFNSTSLNRHIHRTYLEGGINFADGSVQVLAATQMPEEPAGWFQGTADSIRKFIWVLEDYYSHKSIDNIVILSGDQLYRMNYMELVQKHVEDDADITISCAPVDESRASKNGLVKIDHTGRVLQFFEKPKGADLNSMRVETNFLSYAIDDAQKYPYLASMGIYVFKKDALLDLLKSKYTQLHDFGSEILPRAVLDHSVQACIFTGYWEDVGTIKSFFDANLALTEQPSKFDFYDPKTPFFTAPRCLPPTQLDKCKMKYAFISDGCLLRECNI

SEQ ID NO: 35092 - protein, 331 aa, Neisseria meningitidis MC58
MNLKNRHFLKLLDFTPEEITAYLDLAAELKAAKKAGREIQRMKGKNIALIFEKTSTRTRCAFEVAARDQGAGVTYLEPSASQIGHKESIKDTARVLGRMYDAIEYRGFGQEVVEELAKYAGVPVFNGLTNEFHPTQMLADALTMREHSGKPLNQTAFAYVGDARYNMGNSLLILGAKLGMDVRIGAPQSLWPSEGIIAAAHAAAKETGAKITLTENAHEAVKNVDFIHTDVWVSMGEPKEVWQERIDLLKDYRVTPELMAASGNPQVKFMHCLPAFHNRETKVGEWIYETFGLNGVEVTEEIFESPASIVFDQAENRMHTIKAVMVAALGD

SEQ ID NO: 35093 - protein, 394 aa, Pelargonium x hortorum
YFDGWKAYDRDPFHPSQNPNGVIQMGLAENQLSSDLIEDWVRSNPEASICTLEGVGKFKDVANFQDYHGLLEFRHAVAKFMSRGRGGKVTFDPHRVVMSAGATGANELIVFCLANPGDAFLLPSPYYPANDRDLQWRTGAQIIPVHCNSSNGFKITREALERSYAQAQESNINVKGVLLTNPSNPLGTILDRDTLKSIVSFVTDNNIHLVIDEIYAATVFVAPEFVSVSEILQEMDDTTCNPDLIHIVYSLSKDLGMPGFRVGIVYSFNDDVVSCARKMSSFGLVSTQTQHLLAAMLSDDVFVERFLAETRRRLGRRHGVFTKGLEELGIGCLKSNAGLYFWMDLRKLLEEETFEAEMVLWKVIINEVKLNVLLGSSFHCVGPGWFRVCFANMD

SEQ ID NO: 35094 - protein, 416 aa, Gibberella zeae PH-1
MGDLQGRKVFKVFNQDFVVDERYTVTKELGQGAYGIVCAAVNNQTNEGVAIKKVTNVFSKKILAKRALREIKLLQHFRGHRNITCLYDMDIPRPDNFNETYLYEELMECDLAAIIRSGQPLTDAHFQSFIYQILCGLKYIHSANVLHRDLKPGNLLVNADCELKICDFGLARGFSVDPEENAGYMTEYVATRWYRAPEIMLSFQSYTKAIDVWSVGCILAELLGGRPFFKGRDYVDQLNQILHILGTPNEETLSRIGSPRAQEYVRNLPFMPKKPFPSLFPQANPDALDLLDKMLAFDPSSRISVEQALEHPYLQIWHDASDEPDCPTTFNFDFEVVEDVGQMRGMILDEVQRFRQNVRTVPGQSGGGLQGQGVPVPLPQGNGQWTAEDPRPQEYAGHGNTGLEQDLQGGLDASRR

SEQ ID NO: 35095 - protein, 345 aa, Cryptococcus neoformans var. neoformans B-3501A
MSTPAYLAKLESIPKEKFLFGPSPISYLPNLTAVLGGKVKLYAKREDCNSGLAYGGNKVRKLEYLVADAKAKGCNTLVSVGGVQSNHTRAVTAVAVASGLKAVTVQEKWVPIDPPLYSETGNILLSRLMGGDVRLNQETFDIRHKKATEDAFKDVEAKGGKPYYIPAGASDHPLGGLGFTNWVVELAKQEKELGVFFDVVIVCSVTGSSHAGTVVGAVAEGRKRKIIGIDASGKPEATRNQVLKIARNTAALLDERLEIKEEDVILDDRFHAGIYGIPDDETIAAMKLAAQTDAFITDPVYEGKSMAGMIRLVKEGAIKEGSNVLYIHLGGQPALNAYSSYFPHA

SEQ ID NO: 35096 - protein, 163 aa, Neisseria meningitidis MC58
MRHILSVLIENESGAMSRVVGLFSARDYNIDSLAVAPTEDKTLSRMTIVTHGDEQVIEQITKQLNKLIEVIKVVDLNESRFVERELMLVKVRAAGKDRDEFLRLTEIYRGSIIDVTDRSYTIEITGSTDKLDSFLETVGRAQILETVRTGAAGIGRGERILKI

SEQ ID NO: 35097 - protein, 322 aa, Prochlorococcus marinus str. AS9601
MEIANDITSLVGNTPLVKLNRIRKYFDCYPEIIAKLESFNPSASVKDRIAYSMLCKAEEEGLITPDKTTLIEATSGNTGIALAMVAAAKGYKLILTMPDTMSIERRAMLRAYGAELQLTPGKDGMKGALDLANELSSTIANSYQFNQFENFANPDIHERTTAQEIWSQSNNNLDGLVTGVGTGGTITGCARFLKKVNPNCKIYAVEPKKSAVISGEKAGSHSIQGIGAGFVPKVLNTKLIDEIIKIDDDEAFYFGRLLARLEGLLSGISSGAALAATIKIGKRKELMKKRLIVILPSFGERYLSTAMFESNTSIQARKDGYL

SEQ ID NO: 35098 - protein, 561 aa, Schizosaccharomyces pombe
VNELLEAVKKEFEDICQKTKTVEAQKDDFEYKAMISAQINEMALMKQTVMDLEMQQSKVKDRYEEEITSLKAQLEARRKEIASGVVPQSSKTKHGRNSVSFGKYGNAGPFNSDNSSKPLILNNGSSGGTPKNLRSPAIDSDGTVLAPIQTSNVDLGSQYYSSPHVRPAVGATMAGSAMRTFPSNLPLGHPPPPSDSANSSVTPIAAPLVVNGKVSGNPPYPAEIIPTSNVPNREEKDWTVTSNVPNKEPPISVQLLHTLEHTSVICYVRFSADGKFLATGCNRAAMVFNVETGKLITLLQEESSKREGDLYVRSVAFSPDGKYLATGVEDQQIRIWDIAQKRVYRLLTGHEQEIYSLDFSKDGKTLVSGSGDRTVCLWDVEAGEQKLILHTDDGVTTVMFSPDGQFIAAGSLDKVIRIWTSSGTLVEQLHGHEESVYSVAFSPDGKYLVSGSLDNTIKLWELQCVSNVAPSMYKEGGICKQTFTGHKDFILSVTVSPDGKWIISGSKDRTIQFWSPDSPHSQLTLQGHNNSVISVAVSPNGHCFATGSGDLRARIWSYEDL

SEQ ID NO: 35099 - protein, 367 aa, Mycobacterium smegmatis str. MC2 155
MVRQRRSATLPEFPWDTLADVTALARSHPDGIVDLSVGTPVDPVAPVIRDALAAGSSSPGYPTTAGTPELREAMVRALDRRYGITGLTPQTVLPVIGTKELIAWLPTLLGLGSDDVVVVPELAYPTYEVGARLAGAQVLRADSLTQIGPQVPALIYLNSPSNPTGRVLGRDHLRKVVTWARERGVLVASDECYLGLSWDADPVSVLHPSVCDGDHTGLLAIHSLSKTSSLAGYRAGFVAGDPAVVAELLAVRKHAGMMVPGPIQVAMVAALDDDEHEALQRDRYAQRRNLLLPAFREAGFTVDHSEAGLYLWATRGEACRDTLRWLAERGILVAPGEFYGPAGDRYVRVALTATDERIQQAAERLAG

SEQ ID NO: 35100 - protein, 522 aa, Populus trichocarpa
MASMAAIGVMRPPSSSSLSSSSSSNLSRRTAFRSLSFSSSSNLSGGKVCSTAFSVRRDTGRNERTPMIVSPKAVSDSRNSQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEFLVLAGDHLYRMDYERFIQAHRETDADITVAALPMDEKRATAFGLMKIDEEGRIIEFAEKPKGEQLKAMKVDTTILGLDDERAKEMPYIASMGIYVVSKNVMLDLLREKFPGANDFGSEVIPGATSIGMRVQAYLYDGYWEDIGTIEAFYNANLGITKKPVPDFSFYDRSSPIYTQPRYLPPSKMLDADVTDSVIGEGCVIKNCKIHHSVIGLRSCISEGAIIEDTLLMGADYYETDADRRFLAAKGSVPIGIGKNSHIKRAIIDKNARIGDNVKIINGDNVQEAARETDGYFIKSGIVTVIKDALIPSGTVI

SEQ ID NO: 35101 - protein, 229 aa, Zea mays
MAGNEGLKVLGLQVSPFVLRVCMALNTKGVSYEYVEEDLSNKSELLLKSNPVHKKVPVLIHNGKPICESLVIMQYVDELFAGRPILPTDPYERATARFWAAYADDKLFPAWYGMVKAQAEEERAEKAKETLAAIEHMEVAFAKCSGGNAFFGGDSIGYVDIVLGSFLFWFEAVRRVFDLEIINASKTPLLAAWAERFVGTVEAKEVLPLPTADMAVQYINKLHAPLPPP

SEQ ID NO: 35102 - protein, 333 aa, Vitis vinifera
MARSFLQVAATEEVASPLRVVQIEGLVILKIIKHCKEFSPALVTGQLLGLDVGSVLEVTNCFPFPIREEDEEIEADGANYQLEMMRCLREVNVDNNTVGWYQSTLLGSFQTVELIETFMNYQENIRRCVCIIYDPSRSNQGVLALKALKLSDSFMELYRNNNFTGEKLREKNLSWVDIFEEIPIKVSNSALISAFMTELEADTPVTQCDYDRLQLSTNPYMERNLEFLIECMDDLSMEQQKFQFYYRNLSRQQGQQQAWLQKRRAENMARKTAGEDPLPEEDPANPIFKPIPEPSRLDSFLITNQISNYCNQINGVAGQSFSRLYLMKALHEN

SEQ ID NO: 35103 - protein, 539 aa, Populus trichocarpa
MFPSSSATQIPSAKTMISAAASAAATIVLFRSLVKEHLPYEFQSYIFYKLKTLINSFSSEFTLVIEEYDNLNHNNLFKAAELYLEPIIPPDAKKLKISLTKKESKFSFSLDRNQEIVDTFNGITLKWKFISKQVPIKYIPSPDNFNSMPKSEDKFFELSFHKKHKDVVIDVYLKHVIEKSKETKEEKKSLKLFSLRHDRMSGRRGDVWQSVNLHHPATFDTLAMDMEGKRVIMEDLERFVKRREFYRRVGKAWKRGYLLFGPPGTGKSSLIAAIANYLKFDIYDLELTDLRTNSELRNLLISTENKSVLVVEDIDCSIELQDRLAQARAMMPSRHHPPYNQANQYQVTLSGLLNFVDGLWSSCGDERIIIFTTNHKERLDPALLRPGRMDVHIHMSYCTPCGFKLLASNYLGFTEHPLFPCVEALIEKARVTPAEVGEQLLRYEEPESAITGLIEFLEDKSERLKREDGNKDSNGESGTSEGKLAQELDGNNGEVVKKEIDESTGEVVKKEEGAQEPDGENGDIVKEEGRNRGAMVKIQ

SEQ ID NO: 35104 - protein, 255 aa, Rhodobacter sphaeroides 2.4.1
MGSAMLEGWLGRGLALSAVWVTDPRPSDWLKSLAARGLHLNEALPDEPAVVLVAVKPQMMSEALPGLAALGEGRVLFLTVAAGTPISYYERTLGAATPVIRAMPNTPAAVGRGITALVGNAAASEAQMALAEDLLSAVGQVVRLEGEHQMDAVTAVSGSGPAYVFHLIEALAAAGEAEGLPADLAMTLARATVTGAGELAHRAPESASQLRVNVTSPGGTTAAALGVLMDPESGLPPLLRRAVKAAADRGRELGR

SEQ ID NO: 35105 - protein, 437 aa, Clostridium thermocellum ATCC 27405
MATIDFSKYYDVLDNRDFIEYTGKVSKVVGLTIESNGPEVNIGEICKINALRENKVISAEAVGFRDNKVLLMPLGDMNGIGPGSKVVATRDYLSVGVGNALIGRVIDGMGRPIDGKGEIVTETTYPVENKPPHPLKRNRIKEPLPLGVKTIDGLLTVGKGQRVGIFAGSGVGKSTLIGMIARNTKADVNVIALIGERGREVREFIEKDLKEEGLKRSVVVVATSDQPALIRLKGALMATAIAEYFRDQGKDVLLLMDSLTRFAMAQREIGLSIGEPPVSRGYTPSVFSIMPKLLERAGNSQSGSITGLYTVLVDGDDLTEPVTDTARGILDGHIVLSRNLANKNQYPAIDVLASVSRVMPDIVDDEHQKIANDIKKTMAIYREAEDLINVGAYAKGSNEKIDYAIEVIDKIQEFIKQGVHERYSYEETINLMKNVLI

SEQ ID NO: 35106 - protein, 522 aa, Zea mays
MDKAYIAALSAAALFLLHYLLGRRAGGEGKAKAKGSRRRLPPSPPAIPFLGHLHLVKAPFHGALARLAARHGPVFSMRLGTRRAVVVSSPDCARECFTEHDVNFANRPLFPSMRLASFDGAMLSVSSYGPYWRNLRRVAAVQLLSAHRVGCMAPAIEAQVRAMVRRMDRAAAAGGGGVARVQLKRRLFELSLSVLMETIAHTKTSRAEADADSDMSTEAHEFKQIVDELVPYIGTANRWDYLPVLRWFDVFGVRNKITAAVGRRDAFLRGLMALVWSLPRSCGGDSDSDKKSMIAVLLSLQKSEPEVYTDTMIMALCGNLFGAGTETTSTTTEWAMSLLLNHPEALKKAQAEIDAVVGTSRLLAAEDVPRLGYLHRVISETLRMYPAAPLLLPHESSADCKVGGYDVARGTLLIVNAYAIHRDPLVWEDPDEFRPERFEDGKAEGRLLMPFGMGRRKCPGETLALRTISLVLGTLIQCFDWDRVDGHEIDMAAGGGLTLPKAVPLEATCKPRAAMRHLLLEL

SEQ ID NO: 35107 - protein, 376 aa, Rhodobacter sphaeroides
MSALRPPARGGLGLSRLAPLPSRRFQLIAERVPFLGRIGRREGEELFDIVAGFVHSQVLYALVELRVLHLVAEGPQTVQALAAATLAPERMHLLLQGGAALKLLTRRRDGQFDLAVRGAAFLAVPGLEAMVGHHHVLYRDLADPVAFLKGETEPELARFWPYVFGAGGATDPEVTAKYSRLMTESQGLVAEDALRLVELMGVRRLMDVGGGTGAFLAAVGRAYPLMELMLFDLPVVAEAAPQRLTEAGLAGRFTVHGGSFRDDPLPLGADAISLVRVLFDHSDETVKLLLHRVREALPAGGRVIVAEAMSGGARPHRETDTYMAGDTAAMRTGRVRSAAEIADVLTGQGFSEIKIGPGLRPYVASAVTACRPSDAP

SEQ ID NO: 35108 - protein, 307 aa, Yarrowia lipolytica CLIB122
MFRLTTARIASVRGFSTSASLSKKVDSLSVIGAGQMGLGIALVAANKAGLQVNLIDANQGALDKGLKFMDKLLEKDVGKGRLTSDEAQAVRGRVTGHTNLQSAVADVDMIIEAVPEIPKLKFDIFRDLNEWTQKDTILATNTSSISITKIAAAAGAGAPRVISAHFMNPVPVQKGVEIITGLQTSPETLATTLEVVKRMGKIPSISKDSPGFLANRILMPYINEAIITLETGVGEKEDIDNILKNGCAMPMGPLALADFIGLDTCLAIMRVLYEDTGDSKYRPSVLLNKYVDAGWLGKKSGKGFYDY

SEQ ID NO: 35109 - protein, 483 aa, Oryza sativa Japonica Group
MAMGFLAWMVAAAAAAVLASWAFSAVVHLVWRPRAISRRLRAQGVGGPGYRFFSGNLGEIKRFRGDGAGVVLNVSSHDFLPIVQPHFRKWIPLYGRTFLYWFGAQPNICLADVSMVWQVLSDRTGIYPKNLTNPHFVRLLGKGLVLTDGDEWKRHRKGGLVEIELSRRFEELTADVISHTAFGSSYKEGKQVFLAQRELQFLAFSTFLTVQIPGFSYLPTMKNFKTWSLDKKVRGMLMDIIKTRHANKDVAGYGNDLLGLMLEACAPEHGESCPQLSMDEIIDECKTFFFAGHDTTSHLLTWTMFLLSTHPDWQEKLREEIAMECGDKVPTGDMLNKLKMVNMFLLETLRLYSPVSLIRRKVDTDIELGGIKMPEGALLTIPIATIHRDKEVWGEDADEFRPERFENGVTRAAKHPNALLSFSSGPRSCIGQNFAMIEAKAVIAMILQRFSFTLSPKYVHAPTDVITLRPKYGLPMILKSLKL

SEQ ID NO: 35110 - protein, 324 aa, Oryza sativa
MGVPPVEWEADSYPAYSDFAAIPLFAVFLFAVRYLLDRFVFEVVMVFTVLFPHHAHFRIVTGVWLARRLIFEKDEKLDLATHAGRIKIRKFKESAWKCIYFLSAELLALSVTYKESWFTSTKNFWVGPGDQVWPDQRIKFKLKLVYMYAAGFYTYSIFALQFWEIKRSDFGISMVHHVVSVILIALSYIFRFARVGSIVLAIHDASDVFLELGKISKYSGYQLLADVSFLIFVCSWAVLRLIYYPFWILWSTSYEVVPMLDKKKHKFDGPLHYYVFNCLLFSLLVLNIYWWVLMYRMLVEQILSKGHVGDDVRSDSEGEEEHED

SEQ ID NO: 35111 - protein, 219 aa, Physcomitrella patens subsp. patens
MGMGGENGEERGALVLVERNLDEGVGTMKSTVRNAEKLAMVLGDMVVDIAGAIGCRGKQPLTERLEGAVTSHAPRLQQAVHRVGADVLQWMHQGGFWRTLLVVSVGLISVTALTGLTALLMVVLVATVNAVIIGFLMSLSAVGAFLAMFCTSLTVIYIGALAATAFAIGSAVVVTSCTVLFFTGWILFAWAICEVMKKSLNFARNTLTGVSKRQEAVIA

SEQ ID NO: 35112 - protein, 561 aa, Yarrowia lipolytica CLIB122
MPKLQLFAREPKKITVSDGVTDNSVVASLAPETGAVKNCIYAPNGSLFAYAVADGVHVVDPETCQETLRLDEPNVLEIGFSPLGSFIITWEIPKKDPASGNFKPNLKVFNSKTGDHVQSFVQKSQTGWNLQYTFDEKYCARMVKDEIQFFESDVLTKVWAKLRVENCADFSVSPGKNYSVAVFVPEKKGLPAKVQIYHVPNFNQAVAQKTFFKAEEVGLKWNALGTSLLVLAQTASDATGRSYYGETTLYLLGITGAFDSRITLDKEGPIHDVAWSPNSREFAVVYGYMPSKTTFFDARGNEIHTLAECSRNTIRFSPHGRLVLLGGFGNIQGAVDILDRQSKFAKVATLHAANASHVAWSPDSQYVLTATTAPRLRVDNGFRIWHVKGNLMYAQDFPELFAADWRPLPSSEFPSGHTISECPEAHESAKTAKEGAKAPVAAKPAGAYRPPHARGQPERAARGSLAASPDPSSGPKVRGAGGRVIPGAAPKKHEEKNGAVPVATVDDKKIRALLKKLRAIEDLKAKQTNGEKLEDTQIQKISTEGNVRDELKKYGWDGVSK

SEQ ID NO: 35113 - protein, 537 aa, Physcomitrella patens subsp. patens
MATESLNFSFQGLRRSLNVSLSQYEPVLLVLASVATWIALSVTSSTLGAVYGSFSEKGEIVMLLVLLPGGAKYLNKEQKKVMDKLTSGTKGKELWATELPKQGLGPQVIERMLEIKKQDKPWEGRCSGAVYIGGTETEGHFRLVNEAYCMFAHTNPLHPDVWPSIPRFESEVVNMTASFLGSKLQASGGMVCGNMTSGGTESILMAVKTTRDYMKASRGITAPEMIIAESAHSAYDKAAQYFQIKLRRAPVADDLRADVKAMKRLINKNTIMLVASSPGFPHGVIDPIEELSALALQYNICLHVDLCLGGFVLPFAKKLGYPIPPFDFRVAGVTSISVDVHKYGLGPKGTSVVLYRNHELRKYQFVAVTEWSGGLYVSPSMAGSRAGALIAAAWASMMSLGESGYTQITRKLMEAARNIKLGIPDIEGLYVLGKPDMTVVAFASKELNIYKVNEAMAEKGWSLNALHKPSSVHICVTLQHVDVVDKFLDDLKAAVKYVRDNPGKYEDGMAPIYGAGATLPDRGTIRDILVDYMDSTC

SEQ ID NO: 35114 - protein, 459 aa, Pseudomonas syringae pv. phaseolicola 1448A
MSSGRIVQIIGAVIDVEFPRDSVPSIYNALEVQSAAGTTLEVQQQLGDGVVRTIAMGSTEGLKRGLEVTDSGAAISVPVGKATLGRIMDVLGNPIDEAGPIATEERWGIHRPAPSFAEQAGGNDLLETGIKVIDLVCPFTKGGKVGLFGGAGVGKTVNMMELIRNIAIEHSGYSVFAGVGERTREGNDFYHEMKDSNVLDKVALVYGQMNEPPGNRLRVALTGLTMAEKFRDEGNDVLLFVDNIYRYTLAGTEVSALLGRMPSAVGYQPTLAEEMGTLQERITSTKNGSITSIQAVYVPADDLTDPSPATTFAHLDATVVLSRDIASLGIYPAVDPLDSTSRQLDPNVIGQEHYDTARGVQYVLQRYKELKDIIAILGMDELSETDKQLVNRARKIQRFLSQPFFVAEVFTGASGKYVSLKDTIAGFKGILNGDYDHLPEQAFYMVGGIEEAIEKAKKL

SEQ ID NO: 35115 - protein, 482 aa, Pelargonium x hortorum
MENKSKQLLSKIATNDGHGENSPYFDGWKAYDRDPFHPSQNPNGVIQMGLAENQLSSDLIEDWVRSNPEASICTLEGVGKFKDVANFQDYHGLLEFRHAVAKFMSRGRGGKVTFDPDRVVMSGGATGANELIVFCLANPGDAFLLPSPYYPANDRDLQWRTGAQIIPVHCNSSNGFKITREALERSYAQAQESNINVKGVLLTNPSNPLGTILDRDTLKSIVSFVTDNNIHLVIDEIYAATVFVAPEFVSVSEILQEMDDTTCNPDLIHIVYSLSKDLGMPGFRVGIVYSFNDDVVSCARKMSSFGLVSTQTQHLLAAMLSDDVFVERFLAERRRLGRRHGVFTKGLEELGIGCLKSNAGLYFWMDLRKLLEEETFEAEMVLWKVIINEVKLNVSPGSSFHCVEPGWFRVCFANMDDETVHVALKRIRAFVRKKEVGPVKRKRFMDNLNLRLSFSSLRYDESVMLSPHIMVSTHSPLVRART

SEQ ID NO: 35116 - protein, 573 aa, Mesoplasma florum L1
MSKQFKGIGASEGIAVAKALVLAEDHIEIKKTKVSDIEAEVSKLENAVNKSIEDLENLKATTLEKLGPEKAAIFDAHKEIASDPAIKDEIINVIKSESICAEFAAEQVTNNFYEMFASMDDPYFKERSADIKDVASRIIKHILGIAIVDLSTISEEVIIVAEDLTPSQTAQLNKQFVKGFATNIGGRTSHAAIMARSLEIPAVLGLRTITSDVKNGEVFALNGTTGIVELDLTDTIKSEYEKLAKEFSDLKAELQKFKDLPSKTADGQEKLIEANIGSPTDVESVIEHGGEGIGLFRSEFLYMDNDHFPTEEEQYIAYKQVMDAMKGKLVVIRTLDIGGDKKLSYFEFPHEMNPFLGYRAVRFTLDRKDIFKDQLRALLRASAHGELGIMFPMIATVDEFKRAKAIVEECKEELRKENIAFDENVQVGMMVEIPAAAVNADKFSKYADFFSIGTNDLIQYSMAADRMSENVSYLYQPLNPAILKLIDLTIKGAHKNNKWVGMCGEMAGDIQALPLLLGMGLDAFSMSATSMLRARALMSKITMAEAEELANKALSSDDTPEVIELVDAFLATK

SEQ ID NO: 35117 - protein, 386 aa, Pyrococcus horikoshii OT3
MEIMEFEEAFKEVYEMVKPKYKLFTAGPVACFPEVLEIMKVQMFSHRSKEYRKVHMDTVERLREFLEVEKGEVLLVPSSGTGIMEASIRNGVSKGGKVLVTIIGAFGKRYKEVVESNGRKAVVLEYEPGKAVKPEDLDDALRKNPDVEAVTITYNETSTGVLNPLPELAKVAKEHDKLVFVDAVSAMGGADIKFDKWGLDVVFSSSQKAFGVPPGLAIGAFSERFLEIAEKMPERGWYFDIPLYVKYLKEKESTPSTPPMPQVFGINVALRIIEKMGGKEKWLEMYEKRAKMVREGVREIGLDILAEPGHESPTITAVLTPPGIKGDEVYEAMRKRGFELAKGYGSVKEKTFRIGHMGYMKFEDIQEMLDNLREVINELKKQKGIN

SEQ ID NO: 35118 - protein, 341 aa, Triticum aestivum
  misc_feature (296)..(296): Xaa can be any naturally occurring amino acid
  misc_feature (305)..(305): Xaa can be any naturally occurring amino acid
  misc_feature (313)..(313): Xaa can be any naturally occurring amino acid
MEPRVGNKYRLGRKLGSGSFGEIYLGTNVQTNEEVAIKLENVKTKHPQLLYESKLYRVLQGGTGISNVKWFGVEGDYNVLVMDVLGPSLEDLFSFCNRKLSLKTVLMLADQMINRVEFIHSKSFLHRDIKPDNFLMGLGKRANQVYMIDFGLAKKYRDTSTHQHIPYRENKNLTGTARYASVSTHLGIEQSRRDDMESLGYVLMYFLRGSLPWQGLKAGTKKQKYEKISERKIATSIEALCRGYPSEFQSFFHYCRALRFEDSPDYQYLKRLFRDLFIREGFQFDYVFDWTILKYXQSQMTSAPXRAIAAAAXQTRGWSNASIRQHEEEDGGSVHTLSHSG

SEQ ID NO: 35119 - protein, 425 aa, Schizosaccharomyces pombe 972h-
MAGDELKGKKRKYRDSHSGDEKSVKILPLSESSLPPLVTTISGFYPPENTRFQLLKKSNQSNRDASLIGRTERVQFEAKNQSTATVEANYCLAVADKTGRVKKIVPAKYLNTFERNILALQEKDKFLKKKHGTVSGTVMEQRANLGLAFGTRKSQKAIMEESANRVKAETLGDVKDQLVSNVQKATEALPTQEDIAAAQAQDRPIPPVNVGAESIEDAYKLEDIIPKEEFSAIYIKPLLENPDERNWAKLLPYRHSLFINERFQRLLSIEEVDQKRARILYYISLLQAFLFSRRSVGNRETLRKKLADPPEILIDGLIKRFTQTTGIGSVQVSSREVDKIICYILVLCLIVDNYSTDVLTLANDLNVKTMKANELFRTVGCRIMAYTETQRMALGLNKTDAKNHKRAVLKIPLEFPKPRRGRARN

SEQ ID NO: 35120 - protein, 215 aa, Haemophilus influenzae Rd KW20
MNQSILSPFGNTAEERVLNAINAFKNGTGVLVLDDEDRENEGDLIFPAETITPEQMAKLIRYGSGIVCLCITDERCQQLDLPPMVEHNNSVNKTAFTVTIEAAKGVSTGVSAADRVTTIQTAIADNAVLTDLHRPGHVFPLRAANGGVLTRRGHTEASVDLARLAGFKEAGVICEITNDDGTMARAPEIVEFAKKFGYSVLTIEDLVEYRLAHNI

SEQ ID NO: 35121 - protein, 275 aa, Schizosaccharomyces pombe 972h-
MLGSFVKLNNGLKCPQFAYGSYMVNRTKCFDSVYAALQCGYRHIDSAQMYHNEADCGRAILKFMEETGTKREDIWFTSKLNDLSGYKSTLSSIDASVKACGLGYIDLFLLHSPYGDRIESWKALEKGVEEGKLRAIGVSNFGPHHIQELLDSHPKIIPCVNQIELHPFCSQQKVVDYCESKGIQLAAYAPLVHGEKFGNKQLLAIASKYNKSEAQIMIRYCLQRGFIVLPKSSTPRRIKENGDVFDFEISKEDMEKLYNLDEDYHSDWNPCVSPL

SEQ ID NO: 35122 - protein, 486 aa, Mycobacterium sp. MCS
MSSSEKSTAGTAQIGVTGLAVMGSNIARNFARHGYTVALHNRSVAKTDALLAEHGSEGSFVRTETIPEFLAALEKPRRVLIMVKAGEATDAVINELADAMEDGDIIIDGGNALYTDTIRREKAIRERGLHFVGAGISGGEEGALNGPSIMPGGPAESYESLGPLLEEISAHVDGVPCCTHIGPDGAGHFVKMVHNGIEYSDMQLIGEAYQLLRDGLGKSAPEIAEVFDEWNRGDLDSFLVEITAQVLRQIDEKTGKPLVDLILDEAEQKGTGRWTVKSALDLGVPVTGIAEAVFARALSGSVAQRQATTGLASGDLGEKPSDAEQFTEDIRQALYASKIIAYAQGFNQIQAGSAEYDWGITPGDMATIWRGGCIIRAKFLNRIKDAFDNDPDLPTLIVDPYFRDAIENAIDSWRRVVVKATELGIPIPGFSSALSYYDGLRTERLPAALTQGLRDFFGAHTYGRIDTDRDKRFHTLWSGDRSEVEA

SEQ ID NO: 35123 - protein, 553 aa, Schizosaccharomyces pombe 972h-
MSVDENQLENGQLLSSENEASSPFKESIPSRSSLYLIALTVSLLGVQLTWSVELGYGTPYLFSLGLRKEWTSIIWIAGPLTGILIQPIAGILSDRVNSRIGRRRPFMLCASLLGTFSLFLMGWAPDICLFIFSNEVLMKRVTIVLATISIYLLDVAVNVVMASTRSLIVDSVRSDQQHEANSWAGRMIGVGNVLGYLLGYLPLYRIFSFLNFTQLQVFCVLASISLVLTVTITTIFVSERRFPPVEHEKSVAGEIFEFFTTMRQSITALPFTLKRICFVQFFAYFGWFPFLFYITTYVGILYLRHAPKGHEEDWDMATRQGSFALLLFAIISLAANTALPLLLEDTEDDEEDESSDASNNEYNIQERNDLGNIRTGTNTPRLGNLSETTSFRSENEPSRRRLLPSSRSIMTTISSKVQIKGLTLPILWLSSHVLFGVCMLSTIFLQTSWQAQAMVAICGLSWACTLWIPYSLFSSEIGKLGLRESSGKMIGVHNVFISAPQVLSTIIATIVFIQSEGSHRDIADNSIAWVLRIGGISAFLAAYQCRHLLPINF

SEQ ID NO: 35124 - protein, 187 aa, Neisseria meningitidis MC58
MPWNLPIFLTWLRVLLIPVLTALFYLPFPWFAEETINLTAAVIFAVAALTDWFDGFLARLWKQTSDFGAFLDPVADKLMVAVSLLLLVKLDRTYVLFAMIIIGREITISALREWMAQMGKRNSVAVATVGKFKTAAQMLAIFLLLLNFPDFYGFNLAFIGNVLMFIASLLTVWSMLYYLKMAWKEIA

SEQ ID NO: 35125 - protein, 586 aa, Zea mays
  misc_feature (131)..(131): Xaa can be any naturally occurring amino acid
AFPILSSAARRLQLQWEPVSTAALLLFLLLAAAGAAAASAAPAGRREAVTSPHGAVAADDLRCSRIGRDALREGGSAVDAAVASAFCLGVVSPASSGVGGGAFMLVRLADGTAVVYDSRETAPLAASRVSXDRAYIYPFLGALSIAVPGEIAGLHEAWKHHGKLPWKRLVLPAARLALAFRVSPYLRIQMEATRDGILANNGTRAVYAPGGDILRAGDVCRNPRLAQTLRAVAEHGPTVFYGGAVGARLVRDVREAGGVVTLEDLKRYQVKVRRPLTGNVLGLQVVTMPPPSAGGAGMMLVLNILEQYGVPAGFAGSLGIHRLIESLKHYMAVKMNLGDPDFVNNSEVVSDMMSPKFAAELKKTIYDNMTFAPKHYGGRWNILEDHGTSHLSIVDSERNAVSMTSTVNAYFGSLILSPRTGVLLNNEMDDFSMPANASENSPPPAPANFVSPLKRPLSSMAPTVVVKDGKLVAAVGASGGGMIPAGTIEVFINHFVKNMDPLASVMAPRVYHQLIPNEVRYENWTTVTGDHFELDAATRADLHRRGHVLTPIAGGTISQLVVHNVGRQGDLTAVSDPRKGGVPAGY

SEQ ID NO: 35126 - protein, 542 aa, Populus trichocarpa
MLPLKISIQRARNLKALKPSIFALRSSYYFSTGVVEPSSSLRSPPRVPNLIGGKFVDSQSSSTIDVINPATQEVVSQIPLTTNEEFKAAVSAAKHAFPAWRNTPITTRQRVMLKLQELIRRDTDKLAMNITTEQGKTLKDAHGDVFRGLEVVEHACGMATLQMGEYVPNVANGIDTFSIREPLGVCAGICPFNFPAMIPLWMFPVAVTCGNTFVLKPSEKDPGASIILAELAMEAGLPNGVLNIVHGTNDIVNAICDDDDIRAISFVGSNTAGMHIYSRASAKGKRVQSNMGAKNHAIVLPDANTDATLNALVAAGFGAAGQRCMALSTVVFVGDSQSWENKLVECAKSLKVNAGTEPDADLGPVISKQAKERVCKLIESGVESGARLLLDGRNIVVPGYEDGNFIGPTILSGVTADMDCYKEEIFGPVLLCKEADSFEEAIHFVNRNKYGNGAAIFTTSGAAARKFQTEIEAGQVGINVPIPVPLPFFSFTGSKASFAGDLNFYGKAGVNFYTQIKTITQQWKDLPGGSGVSLAMPTSQKL

SEQ ID NO: 35127 - protein, 433 aa, Arabidopsis thaliana
MAASVQPACLDLHFSGKHPPLLKHNAIIVRCVSSPNVIPEADSISGPPDIINTNRDQRKVVRIAWEKLVRWSRSLRAKAKTDVLERTRKVVVLGGGSFGTAMAAHVARRKEGLEVNMLVRDSFVCQSINENHHNCDKVDSVASKYFPEHKLPENVIATTDAKAALLDADYCLHAVPVQFSSSFLEGIADYVDPGLPFISLSKGLELNTLRMMSQIIPIALKNPRQPFVALSGPSFALELMNNLPTAMVVASKDKKLANAVQQLLASSVEIAGALKNVLAIAAGIVDGMNLGNNSMAALVSQGCSEIRWLATKVMGAKPTTITGLSGTGDIMLTCFVNLSRNRTVGVRLGSGETLDDILTSMNQVAEGVATAGAVIALAQKYNVKLPVLTAVAKIIDNELTPTKAVLELMNLPQVDYRFHRFPFRLGYSSGIFI

SEQ ID NO: 35128 - protein, 396 aa, Bacillus cereus ATCC 10987
MIQTKDIIELTDTYGANNYHPLPIVISKAEGVWVEDPEGNRYMDLLSAYSAVNQGHRHPKIINALIDQANRVTLTSRAFHSDQLGPWYEKVAKLTNKEMVLPMNTGAEAVETAIKTARRWAYDVKKVEANRAEIIVCEDNFHGRTMGAVSMSSNEEYKRGFGPMLPGIVVIPYGDLEALKAAITPNTAAFILEPIQGEAGINIPPAGFLKEALEVCKKENVLFVADEIQTGLGRTGKVFACDWDGVTPDMYILGKALGGGVFPISCVAANRDILGVFEPGSHGSTFGGNPLACAVSIAALEVLEEEKLTERSLQLGEKLVGQLKEIDNPMITEVRGKGLFIGIELNEPARPYCEQLKAAGLLCKETHENVIRIAPPLVISEEDLEWAFQKIKAVLS

SEQ ID NO: 35129 - protein, 2223 aa, Schizosaccharomyces pombe
MPRTHGPKPSENDPKEPTCSPSPAFYSVNGEMKDYKLMALELEDKSVLQGYSFGADHSVSGELVFQTGMVGYPESLTDPSYRGQILVFTFPTVGNYGVPDRRILDEISGLPKYFESNQIHVAAIIISSYSQNYSHFLAHSSLGEWLKEQGIPGIFGIDTRALTKKIRDQGSMLGRLLIQKDESPINPSSITGLGKDWSTAFEDIPWKNPNTENLTSQVSIKEPKLYEPHPTTAIKKADGKIIRILVIDVGMKYNQIRCFLNRGVELLVVPWDYDFTKETYDGLFISNGPGDPSLMDLVVDRVKRVLESKTVPVFRYFFGHQIMARAAGASTTKMKFGNRGHNIPCTCMISGRCYITSQNHGYAVDASSLSNGWKELFVNANDGSNEGIYNTEYPFFSVQFHPESTPGPRDTEFLFDVFIDVVKRSADAKSLQPFKLPGGTIEENRSRHPLVDAKRVLILGSGGLSIGQAGEFDYSGSQAIKALREEGIYTILINPNIATIQTSKGLADKVYFLPVNADFVRKVIKQERPDSIYVTFGGQTALNVGIELKDEFEQLGVKVLGTPIDTIITTEDRELFARAMDEINEKCAKSASASSIEEAIKVSKDISFPVIVRAAYALGGLGSGFADNEAELIDLCTLAFATSPQVLIERSMKGWKEIEYEVVRDAFDNCITVCNMENFDPLGIHTGDSIVVAPSQTLTDEDYNMLRTTAVNVIRHLGVVGECNIQYALNPFTKEYCIIEVNARLSRSSALASKATGYPLAFTAAKLGLNIPLNEVKNSVTKVTCACFEPSLDYVVVKIPRWDLKKFTRVSTQLSSAMKSVGEVMSIGRTFEEAIQKAIRAIDYSNTGFNVKDALMSIDTELQTPSDQRLFAIANAMASGYSVDRIWELTRIDKWFLEKLMGLIRTSQLISKHDISSLPISLLKTAKQLGFADVQIAAFMNSTELAVRRIRTEAGIRPFVKQIDTVAAEFPAFTNYLYTTYNAVEHDIHFNDKGVMVLGSGVYRIGSSVEFDWLQFAQVRTLRDRGVKTIMVNYNPETVSTDYDEADRLYFENIGLETVLDIYEQESSSGIIIAMGGQTANNIALPLHRENVKILGTSPEMIDGAENRFKFSRMLDDIGVDQPKWKELTSFDEADKFCDTVGYPVLVRPSYVLSGAAMNTVYSQSDLHSYLQQAVAINKDHPVVISKYIENAKEIELDAVAREGKMVMHVISEHVENAGVHSGDATLVLPPQDLAPTTIERIVDAAAKIGEALNITGPYNIQFIAKDNEIKVIECNVRASRSFPFVSKVIGVDMISMATDVIMGNPIQPYPDVDLPRDYVAVKVPQFSFSRLSGADPVLGVEMASTGEVACFGHNKFEAYLKAMISTGFRLPKKNILISIGSYKEKADVLPYVKKLYENNYNIFATAGTSDYFMESGVPCKYLADLPAEEANNEYSLSAHLANNMIDMYINLPSNNRYRRPANYISSGYKSRRLAIDYSVPLVTNVKCAKLMIEAICRNLDFSLSTVDFQSSFQTANLPGLINISAFLPEFTSEAVSDYTKECIASGFTMARFLPFSTSSTLADKDSLSAVKKLALDHAHCDYNFSVIASSTNEVTISELTSESGCLFFHFEKDDSGIDHVTAVASHFNVWPDTQTVMTDAKSTTLASLLLLASLHNRRIHITNVSSKDDLNLIVLAKQRSLPVTFDVSVYSLFLNQNDYPGATFLPTADDQVEIWNKLSYIDCFSIGSIPSRLAKFVGNTAFTGFGVREAIPLLLTAVNEGRLTLKDVVDRFYSNPKAIFRLHDQDDSGVQLEVDRSVSWSSKDWTPFNGKKLYGSIQSVQFDGHDVFFDGELNFEHTYGRDYSSASLADKSKATRKVSALMSPGLPHAAPSLAEAFGQAPENKAHPDISLNMTPNFKPSHELVQLINSSPFYRKHIISVHQVTRSDLHVLFAIAHQMRIIVERQGVIDLCYEKLLCTMFFEPSTRTSSSFDAAMQRLGEKVVAVTASASSVNKGESLADTIRTLGCYGDAIVLRHPSIESARIAANFSPVPIINGGNGSKEHPTQAFLDLYTIREELGSVNGLTITFIGDLKYGRTVHSLARLLAFWHVELHLVSPEQLALPDDVKDDIRANGLNFIEHRELTKEVVAQSDVLYCTRVQKERFASVDEYEKLKDSFIVDNSVLASAKSHCIVMHPLPRNREISEEVDFDQRRAAYFRQMRYGLYIRMALLACVMGATEVAN

SEQ ID NO: 35130 - protein, 271 aa, Zea mays
MQARVVVFPVKGRAWCFALPRASAAAPAADGALPRPTLRDLWRGISSGSRTAPEKAEAVVDFVADKMNRAWVGFGSAPEGSMKSRIHSFGLKLLSRVRPSEVLLKSVTKDVSALEIVHPASINSRLVRRRLRHIAVRGASVHKKFLYGSVCLLPVTSVFMVLPLPNIPFFWVLFRAYSHWRALQGSERLELLVSDCSDKWKVLEEKINSVKDGKPSENARNSPWKLRPSEKLDRFLEGRNLDEGLDCDTILSICQEYDLDKIDVLKYRDLL

SEQ ID NO: 35131 - protein, 75 aa, Triticum aestivum
  misc_feature (15)..(15): Xaa can be any naturally occurring amino acid
  misc_feature (37)..(37): Xaa can be any naturally occurring amino acid
  misc_feature (68)..(68): Xaa can be any naturally occurring amino acid
SWLWRTTDDRGHLPXDSLTQHLERAVSGVQPWEDTAXACIYPHRYCLRNFLLLGPSCESTIAGDVMTXDNKLITV

SEQ ID NO: 35132 - protein, 479 aa, Chlorobium tepidum TLS
MSGTLDNFTIVIFGASSDLASRKLFPSIFQLARWGHMPESFRLIGVGRQEQSHEEFRAFVRSRLLEHSPEAAGDAARLDAFCLRLFYARVDLDDPASYEVLRDEIMREEKVGGSTCRNLMFYLSIPPSLAPAVVRNLGKAGLGGREQSCTGWRKLIAEKPYGHDLESARELNRVINEVFEENQVYRIDHYLGKEPVQNIMVFRFSNGIFEPLWNRQYIAQVQITIAEDFGIRDRGAYYEESGLLRDIIQNHGLQLLTAIAMEPPVDLSADSIRDEKAKVLRSVRHFTPDSVRESVVIGQYEGYRNEKNVAPDSKVETFAAVKFHVDNWRWSGVPFYMKAGKNLAKRVTEIVITFRCPPQNYYGPSGGAACCTPNQVVLGIQPDETVAIRFGAKRPGEQMITDPVFMKFDYRDTFQGEGLTPYHRLLLDAIEGNQMNFIRKDSVEYSWEIIDSLKNSIDGQVPEQYPVHSWGPESSRIYG

SEQ ID NO: 35133 - protein, 413 aa, Rhizobium leguminosarum bv. viciae 3841
MDKIAPATQYDVESIRRDFPILAEKVHGKPLVYLDNGASAQKPQVVIDAISHAYSHEYANVHRGLHYLSNVATDAYEAAREKVRRFLNAPSVNDIVFTKNSTEAINTVAYGWGMPKIGEGDEIVLTIMEHHSNIVPWHFIRERQGAKLVWVPVDDEGAFHIEDFEKSLTERTKLVAITHMSNALGTIVPVKEICRIAHERGIPVLIDGSQGAVHLPVDVQDIDCDWYVMTGHKLYGPSGIGVLYGKKERLFEMRPFQGGGEMIFEVAEDMVTYNDPPHRFEAGTPPIVQAIGLGYALDYMEKVGREAIARHEADLATYAVERLKSVNSLRVFGTAPDKGSIFSFELAGIHAHDVSMVIDRQGVAVRAGTHCAMPLLKRFGVTSTCRASFGMYNTRAEVDALADALDYARKFFA

SEQ ID NO: 35134 - protein, 340 aa, Nicotiana tabacum
MDSEGILLGMGNPLLDISAVIDQDFLNKYDIKPNNAILAEEKHVSMYDEMTSKFSVEYIAGGATQNSIRVAQWMLQIPGATSYMGSIGKDKYGEEMKKNAKDAGVNVHYYEDESPTGTCAVCVLDGERSLVANLSAANCYKVDHLKRPENWALVEKAKYYYIAGFFLTVSPESIQLVAEHAAAKNKVFSMNLSAPFICEFFKDQQEKVLPYMDFVFGNETEARTFSRVHGWETDNVEEIALKISQWPKASGTHKRITVITQGADPVVVAEDGKVKLFPVIPLPKEKLVDTNGAGDAFVGGFLAQLVQGKPIEDCVKAGCYASNVIIQRSGCTYPEKPNFE

SEQ ID NO: 35135 - protein, 261 aa, Photobacterium sp. SKA34
MDIFVVDAFTDQHFKGNSAAVMPVTTFPDASLMQRIAAENNLSETAFIKPTDANTYAIRWFSPLTEIDFCGHATLASAFVLYQFYQLKGEITFTTEQVGTLTVKQATNGNIEMNFPCQPGEEVEPPAALLKGLSITPTKVLKNRQAYVAVLPSEQAIQDVICDSEQLKKLAPHDIVITAQSSQYDFVSRYFWPANGGYEDPVTGSIHTALAPYWAEQLDKRELTAYQASQRGGVLHCKMIDNDRIIIAGSAVLYLRGNVYL

SEQ ID NO: 35136 - protein, 119 aa, Arabidopsis thaliana
  misc_feature (72)..(72): Xaa can be any naturally occurring amino acid
MFSSMPSAVVEETSPAQASGVTPYTGGKSFAANPVTRKTNKDITTIASNGGRGSCMKVRPPIGKKKLETISXSPDLSDVQLAEEGDHTLRNKGIPCGEFRLEHPFEYPEHGNHSGYHQG

SEQ ID NO: 35137 - protein, 152 aa, Oryza sativa Japonica Group
MATDPRGRRPRHHAAVNEVLSTLAAANSTLADVQRRLDADFRAAYPDHANPVKLVARLKRIQEEVAAVKGLCRDLLTQKQELIDAMRTSLAVQRSAVQRLLASSGLPPMSEEDAATDANLNQIIDEWTAHVGPDTGDDKDEDTNQIFFAAVV

SEQ ID NO: 35138 - protein, 399 aa, Pseudomonas putida KT2440
MSGNRGVVYLGAGKVEVQKIDYPKMQDPRGKKIEHGVILKVVSTNICGSDQHMVRGRTTAQVGLVLGHEITGEIVEKGRDVERMQIGDLVSVPFNVACGRCRSCKEMHTGVCLTVNPARAGGAYGYVDMGDWTGGQAEYVLVPYADFNLLKLPERDKAMEKIRDLTCLSDILPTGYHGAVTAGVGPGSTVYVAGAGPVGLAAAASARLLGAACVIVGDLNPARLAHAKSQGFEVVDLSKDTPLHEQIVDILGEPEVDCAVDAVGFEARGHGHEGAKHEAPATVLNSLMQVTRVAGNIGIPGLYVTEDPGAVDAAAKIGALSIRFGLGWAKSHSFHTGQTPTMKYNRQLMQAIMWDRINIAEVVGVQVINLDQAPEGYGEFDAGVPKKFVIDPHKMWGAA

SEQ ID NO: 35139 - protein, 428 aa, Glycine max
MAGAASALFLLDIKGRVLIWRDYRGDVSALDAERFFTKLIEKQADPQAQDPVVHDNGVTYMFIQHSNVYLMIATRQNCNAASLLFFLHRIVDVFKHYFEELEEESLRDNFVVVYELLDEIMDFGYPQYTEAQILSEFIKTDAYRMEVTQRPPMAVTNAVSWRSEGINYKKNEVFLDVVESVNILVNSNGQIIRSDVVGALKMRTYLSGMPECKLGLNDRVLLEAQGRTTKGKAIDLEDIKFHQCVRLARFENDRTISFIPPDGSFDLMTYRLSTQVKPLIWVEASVEKHSKSRIEIMVKARSQFKERSTATNVEIELPVPVDATNPNVRTSMGSASYAPEKDALIWKIRSFPGGKEYMLRAEFRLPSITDEEATPERKAPIRVKFEIPYFTVSGIQVRYLKVIEKSGYQALPWVRYITMAGEYELRLI

SEQ ID NO: 35140 - protein, 514 aa, Kluyveromyces lactis NRRL Y-1140
MLGRTQVTTLRRFIRLYSQLPLKVPVQLPNGITYEQPTGLFINGEFVPSRQHKTFEVLNPSNEEEITHIYEAREDDVDIAVAAAKKAFNNGWSTAEPEDRAKCLLKLADLIDQHAETLASIESLDNGKSLFCSRGDVALVAKYLRSCAGWADKIYGKVIDTGADHFSYTKREPLGVCGQIIPWNFPLLMWSWKVGPALATGNTVVLKPAEATPLSALYACQLVQEAGVPKGVVNIIPGFGKIVGERICTHPDIKKVAFTGSTATGRHIMKTCADSIKKVTLELGGKSPNIVFGDADLDKAVKNIAFGIFYNSGEVCCAGSRIYVQDTVYEEVLEKFKQYAESLKVGNPFEENVFQGAQTSQMQIDKILSYVDVGTSEGARVITGGERIGNKGYFIKPTIFADVKEDMQIVKEEIFGPVVTVSKFTTVDEVVAKANDSEYGLAAGIHTKDVNKAIDVSNRVKAGTVWINTYNNFHQNVPFGGFGQSGIGREMGAEALDNYTQTKAVRMAIDHPNY

SEQ ID NO: 35141 - protein, 462 aa, Archaeoglobus fulgidus DSM 4304
MRIVMKFGGVSVKDGENIYHCANLVKKFSEGNEVVVVVSAMQGVTDALLKAAHRCCSEPSAGFIKMFIADMMKRHYEAIEYAVRNDEIKAKVIAAVERLLDELEKVLLGISYLGELTRRSEDYIVSFGERLSAPIFSAALLSLGVDSVALTGGDAGIITDRNFGRAKPLPGVYTTIRNRLEPLLTIKKTIPVVTGFIGATDDGSITTLGRGGSDYTATILAAALDADEVWLWKEVDGIMTCDPKYVPNARVIPEISYQEAMELSHFGAKILHPRALEPVMRKNIPVRIKNTFNPDAPGTVIGPTTKDSSEIVKALSLIPQAGIVNVSGAGFDFAEIMSEVFGRLAEERVNVIMVAQSSSELNLSIVVDIRDLEKAYNALKSLENGVIKVEKIPYIAVVSAVGSGMAGTPGVAGKIFSALGKNGINVIMISQSCSEYNVSFVVDGSDGVNAVKVVHDEFGLGN

SEQ ID NO: 35142 - protein, 1142 aa, Triticum aestivum
METGEAGSPSPDDAVLFFGVALVLGIASRHLLRGTRVPYTVALLVLGVALGGLEYGTKHGLGKLGAGIRIWSAINPDLLLAVFLPALLFESSFSMEVHQIKKCMAQMVLLAVPGVVISTVLLGAAVKLTFPYDWNWKTSFLFSGLLSATDPVAVVALLKDLGASKKLSTIIEGESLMNDGTAIVVYQLFYRMVLGKTFDAGSIIKFLSQVSLGAVALGLAFGIASVLWLGFIFNDTIIEISLTLAVSYIAFFTAQDALEVSGVLAVMTLGMFYAAFAKTAFKGDSQQSLHHFWEMVAYIANTLIFILSGVVIADGVLQDNIHFERHGTSWGFLVLLYVFVQISRAVVVGVLYPLLRHFGYGMDIKEATVLVWSGLRGAVALSLSLSVKRASDSVQTYLKPEVGTMFVFFTGGIVFLTLILNGSTTQFLLHLLGLGKLSATKLRVLKYTQYEMLNKALEAFGDLRDDEELGPVDWVNVKKYITCLNNLEDEQAHPHDVPDKDDHIHTMNLKDTRVRLLNGVQAAYWGMLEEGRITQSTANILMRSVDEAMDLVSSQSLCDWKGLRSNVHFPNYYRFLQMSRLPRRLVTYFTVERLELGCYICAAFLRAHRIARRQLHDFLGDSEIARIVIDESTAVGEEAKKFLEDVRVTFPQVLRALKTRQVTYAVLTHLSEYIQDLGKTGLLEEKEIVHLDDALQTDLKKLKRNPPLVKMPRVRELLNTHPLVGALSADVRDPLLSNTKETIKVHGTILYREGSRRTGIWLVSTGIVKWTSRRLCTRHSLDPILSHGSTLGLYEALTGKPYICDIITESVVHCFFIEAEKIEQLRQSDPSIEDFMWQESALVIARILLPQIFEKMAMREMRVLISERSSMNVYIKGEAIELGHNNVGILLEGFLKTENRTLITAPAVLLPSNTDLNLFGLQSSAMNQIDYCYTAPSYQVEARARAIIFEIGRLDIEADLQRSASLLSSTLGPSRTQSKEHVGLLRWPESFRRSSGPGNASLAEIRGQPGSFSARALQVSMYGSMTDGMHRARRQPRLAHVEGNQKHSVSYPKVPSRAADTRPLLSVRSEGSNAMKRKSAPAPAIAPALAPFPPPLAEGQQRRAVGEDDDSSDESVGEEVIVRVDSPSMLSFNPPSGPPRGS

SEQ ID NO: 35143 - protein, 406 aa, Mycobacterium smegmatis str. MC2 155
MSTRDFLVPDLGEGLQDATITSWNVDVGDTVELNQTLCTVETNKAEVEIPSPYAGKVEALGGAAGDTLAVGSLLVRIATSSDEPVEAQPMNGEVPQRKSVLVGYGADDSMDASRRRTHGPRARAKPPVRKLAAELNVDLGALDPGSGPDGIITRDDVLAAAGRSPAAQSAGTPQPSQTRDVRGVQAEMARRMALSRREIPDAHARVDVDCTALLRLRDRIRSAETELPITPFVLTLRLLTVALRRHVVLNATWMETTGGPQIHQHSAVHLGIGVAAPRGLLVPVVRDAQGMTTRQLAVTVARLVESARAGTLSPAELTGSTFTVSNFGALGVDDGVPVINYPEAAILGMGSLRERPVVVDGAVVARPTMSLTCVFDHRIADGAQAAAFLGELRGLIEEPDLALLDL

SEQ ID NO: 35144 - protein, 458 aa, Xanthomonas campestris pv. vesicatoria str. 85-10
MSDPSAPDHLQRSLSNRHLQLIAIGGAIGTGLFMGSGKTISLAGPSILFVYLIIGAMLFFVMRAMGELLLSNLEYKSFIDFSTDLLGPWAGFFCGWTYWFCWIITAIADVIAIAAYAQFWFPGLAPWIPAILCVLLLLSLNLVTVKLFGEMEFWFALIKIIAIAALIITGAGLVAWGFRSPSGNVASLSNLWNDGGMFPMGIGGFFAGFQIAVFAFVGIELVGTTAAETADPRRNLPKAINSIPVRILIFYVLALIAIMAVTPWRQVVADKSPFVELFVLAGVPAAASLINFVVLTSATSSANSGIFSTSRMLYGLAEEQHAPKGFAKLSGAAVPARGLLFSCLCLLLGAMLVYLIPNLVTAFTLVTTLSAVLFMFVWSLILCAYIAYRRKRPEQHAASAFKMPGGVLMCYVCLAFFAFVIVLLTLQDDTRQALLASPVWFLLLAIGYAVKRRGNRQH

SEQ ID NO: 35145 - protein, 644 aa, Zea mays
MISARTAAASPASLWKRGGQSEGGGSCDGCRTYRNTLRRAAAAKVRALPSRAVEAVKMGSAAEVEQEEAEVAAAADGVVVEDHYGEDSATEELPIMPWAFSVASGYTLLRDPHHNKGLAFTEKERDAHHLRGLLPPAVVPQELQIKKIMHNLRQYQVPLQRYMAMMDLQERNERLFYKLLIDNVEELLPVVYTPTVGEACQKYGSIFRQPQGLYVSLRDKGKVLEVLRNWPHRNIQVICVTDGERILGLGDLGSQGMGIPVGKLALYTALGGVRPSACLPITIDVGTNNEKLLNDEFYIGLRQKRATGEEYHELMEEFMAAVKQIYGEKVLIQFEDFANHNAFNLLAKYSKSHLVFNDDIQGTASVVLAGLLAALKVVGGTLAEHTYLFLGAGEGGTGIAELIALEISKQTSAPIEECRKKIWLVDSKGLIVDSRKNSVQSFKKPWAHEHEGLTTLYDAVQCIKPTVLIGTSGVGRTFTKEVVEAMASFNERPIIFSLSNPTSHSECTAEEAYNWTQGRVIFASGSPFDPVEYDGKVFVPGQSNNAYIFPGFGLGLVISGAIRVHEDMLLAASEALAAQATQENFDKGSIFPPFTNIRKISARIARAVAAKAYELGLATRLPPPRDLVKYAQSCMYTPVYRNYR

SEQ ID NO: 35146 - protein, 414 aa, Brucella suis 1330
MDQKNPLTMAYDVEAIRRDFPILSRQVHGKTLVYLDNGASAQKPQSVIDAVTHAYANEYANVHRGLHFLSNAATDAYEKSRETVRRFLNAGSVDEIVFTKNATEAINTVAYGYGMPFIGEGDEILLSIMEHHSNIVPWHFIRERQGAKLVFTPVDDNGVFHIEEFEKRLSERTKLVAITHMSNTLGTVVPIKKIVELAHARGIPVLVDGSQGAVHLPVDVQDLGCDWYVFTGHKVYGPSGIGVLYGRAQMLEKMRPFQGGGEMIEEVTEENVTYNHPPHRFEAGTPPIVQAIGLGAALEYMEKIGRHAILAHEADLRDYAHERLGRINSLRIFGNAPDKGAIISFALEGIHAHDVSMVIDRAGVAVRAGTHCAQPLLKRFGVTSTCRASFALYNTRAEVDALAEALEKARKFFG

SEQ ID NO: 35147 - protein, 222 aa, Zea mays
  misc_feature (201)..(201): Xaa can be any naturally occurring amino acid
LPSPATFLGGASRIRDRRNPKLLHRPEGRSSSTKEQTQQREVTLQEENAAYEKAISECKQKIQEKQMEATQLLSNLEEMEVTEHNLKTQLENALKELEAAQHKASTATSGTAENALLEAKSVTDLKSKDLEEKKRELELLDNKVQTLEKEWSVVEEESLKKPTPAQREKVLERQLHSLIEQLTAKQAQAEILATDVHSKEXELERLNHLQENLYGGHETGAP

SEQ ID NO: 35148 - protein, 147 aa, Populus trichocarpa
MGSSASSSQKPDNTQGDVNYASVSDGEWKKKLTAEEFYVTRQKGTERAFSGEYWNTKTPGTYHCICCNTPLFESSTKFDRGTGWPSYYQPIGNNVKSKLDLSIIFMPRQEVLCAACDAHLGHVFDDGPPPTGKRYCINSASLKLNPK

SEQ ID NO: 35149 - protein, 324 aa, Rhodobacter sphaeroides 2.4.1
MTDHAIVATRPGGPDVLEWAERPAGRPGPGEVRLRQTAVGLNFIDCYFRSGLYPWPADELIPGGEAAGVVEELGEGVSGFAPGDRVAYTMPNGACRTARVLPADRLVRLPEGVTDEVAASIMLKGLTAQYLIHSSFRVEAGHHVLVHAAAGGVGQLLGQWLKAKGAITYGTVGGAAKAEMARASGFDHVIDYEATDFAEAVRELTGGRGCDVVYDSVGRTTWRGSLKSLRPRGSFVCFGQSSGPLDEFRFSDLAAGSFTANRPSLFHYIATRDELEARAADLFALVAEGRIVPRIGQTFALKDTAEAHRALEGRRTTGATVLLP

SEQ ID NO: 35150 - protein, 421 aa, Novosphingobium aromaticivorans DSM 12444
MKIAILGLGYVGCTAAGCIASQGHHVVGIDVNLGKVETLNTGKSPVYEPGLDDLIAKARAEGRLHAVTEIGSALDDCDIAIVCVGTPSGVDGAHNMSFIVQVSRAIAASVRPDRKTPLTVVYRSTMRPGTTEQMILPIFRSVIGEDCEKLIELVYNPEFLREATAIEDYFHPPKIVLGTIDGAPSEKMVALHEGIEAPIFHVGIREAEITKFVDNTWHAVKVAFANEVGRVCQNLGISAKQVHEIFVSDTKLNISAYYTRPGGPFGGSCLPKDVRALQHIAADTGAQTHLVDSLLRSNDAHKHHQFLQVTKDLQPGARVLLVGLAFKADTDDLRESPAVDMARKLLDAGYALDIYDPQLRPESLVGQNLGYAYAILPSIDGLLVDKTTAEARDYGVVIATNRLIRDLALPGRRIVDVSAIA

SEQ ID NO: 35151 - protein, 393 aa, Streptococcus thermophilus LMG 18311
MTKLSNRVLQMEESVTLAASARAKALKAKGRDILSLTLGEPDFVTPKNIQDAAIASIENGKASFYTVASGLPELKDAVSTYMENFYGYTVKHSEIVVGTGAKFILYAFFATVINPGDEVIIPTPCWVSYVDQVKMVEGVPVTFQTTEANHFKATVEQLEAARTEKTKVVLLNSPSNPTGMIYSKEELQSIGDWAVEHDILILADDIYGRLVYNGNTFTPISSLSDAIRKQTIVINGVSKTYAMTGWRVGFAVGEPEIISGMAKIISQTTSNLTSVSQYAAIEALTGDQSSIEEMRKAFEERLNTIYPLLAEVPGFEVIKPQGAFYLFPNVKKAMEIKGYTDVNDFTNAILEEAEVALVTGAGFGAPENIRLSYATDLDILKEAVRRIKAFMEK

SEQ ID NO: 35152 - protein, 520 aa, Amanita muscaria
MPPAATGNGGIDPKNKFTGIAMTAFSAFGGILYGYDTGIISGILAMDDFKRTFGQQASDGTCSLPLSSQSLFVSILSAGTFVGALFGAPMGDIIGRKWGIVIAAAIFSIGIALQTASVTAAPFVVGRVFAGLGVGLVSCLVPMYQSECSPKWIRGAVVSLYQWAITIGILLAAVINNATQGRSNHSAYQIPISIQFVWAFILGFGMMLLPESPRFLVRQGRDEDAALSLSRLTRLSPDDPVVRNELAEIRTNFEAELALGESSYLDCFRPSHNKILLRTLTGIFIQAWQQLTGINFIFYYGTQYFQNAGINQAFLITIATGIVNVFMTLPGLYGVERYGRRSLLLIGALGMTICEFIVAIVGVTIPASNLAGQRVLIAFVCIYIAFFASTWGPMLWVIVGEIFPLQVRAKGISLSVASNWLWNFGIAFATPYLVNTQAGSAGLGSKVFFIWGTTCACCLVFTYFCVPETKGLSLEQIDEMYQEVMPLKSYQYRRRLAIEGGFRTEKADIIHEETAEKESG

SEQ ID NO: 35153 - protein, 624 aa, Zea mays
MWLGQSHVGAWSGTRRARQGGSGDGPLGVYSYMGDAVISAKNGQQAWAYLEDKGNNIDLVLTEVFMPGVSGISLLSRIMRHNIFKNIPVIMMSSSDDMSTVFKCLSKGAVDFLVKPIRKNELKNLWQHVWRQRCHSSSGSGSESGIQTQKCAKSKGVNESGNNSGSNDDEAGMGLNARDDSDNGSGTQDLNDLVGLGGVQRMAQNSWTKLAVEIDSPQATSLDQLADPPNSTCAQVIHSKSEICSNRWLPDKSNRNCKKPKNTNDDFKGKDLEIGGPENLYMGHQSSPNGRSIKAADHENNSKESMMENLEEPTVRAADLIGSMAKNMDTPQAARAAEDTPNFSSKVPEGKVTTFIARYHTSAASNQGGTGLVGSCSPHDNSSEAVKTDSTYNMKSNSDAAPIKQGSNGSSNDNDMGSTTKDVVTKPMLPSAIKANGYTSAFHPVQQWMVPANATAGKTKADENTARNHCVHFENGGSGALQCGSSNVFDPPLEGQATNNYGGVKAGSNSGSNKGQNNGSTAAANAGLAETEIQAMDKSGVGGGNGNGNGSGSGSGNDTYVRRLAANMTPRQAQLKKYREKKKDRNFGKKVRYQSRKRLADQRPRVRGQFVKQAVQNQDGARER

SEQ ID NO: 35154 - protein, 474 aa, Burkholderia sp. 383
MRTSQQSYIDGQWLDPADSRSIDVIDPSTARPYAQLRIGGTADVDRAVGAAKQAFDTYSRWPVDERVALLRRVLEIYQHRYEEVAQTISQGMGAPIAFARAAQAAVGTAHLEQTIRALQSFRFSTQTDSLLVSHEPIGVCALITPWNWPINQIVCKVAPALAAGCTMVLKPSEIAPFSAILFAEILDEAGVPPGVFNLVHGYGHEVGDALSRHPDVDMVSFTGSTRAGVEVAKAAADTVKRVHQELGSKSPNLILPDADIEDAVTRGVRSCFSNSGQSCNAPTRMLVHVDHLALAEQAARREAERTVVGDPRSTETGIGPVVSRTQFDRIQHFIRLGIEEGAMLVAGGPGRPDGLGDGFYVRPTVFSNVTPDMTIAREEIFGPVLAIMTYRTEDEAVALANDSVYGLAAYVQTKDPERARKVAARLRVGNVHINYPPWNPAAPFGGYKRSGNGREYAEFGLVEYLETKGTTGYA

SEQ ID NO: 35155 - protein, 98 aa, Populus trichocarpa
MFLDCERRNFVVQKYHRDVLEQMAHPPPVYPPPPPSLLQLPPSPPVLVNEPPIQTTPETSTVKVIGAPVRKAPARRGRRSGSRRHRKVVAGAKDTDAS

SEQ ID NO: 35156 - protein, 357 aa, Saccharomyces cerevisiae YJM789
MRLAVVVTLLVHCFLVTCSPGDNLDEFIDCTYACEYNRRCPNSQINYIDPETNMFHDIEFFDTPPLYSKLLFWDCISDCDYQCQHIITRWRIDEEEEIYQFHGKWPFLRVLGTQEFFSTIFSIGNFIPHYKGFVKFSRIIREEGDRRRKNSRSILIWNYLYVTVAGMLAWTASSVFHCRDLIITEKLDYFFAGLTVLTGFHAIFARMTSMFLYPKIAQAFTASVAAIFALHILRLYVDWSYTYNMRFNIFFGVLQYILLIMLSCQNYHALQKQKLMGEFKKTAYSSFKGQIFKLCVIPILLVIVTTMAMSLELFDFFSYEWQIDAHALWHLCTIWPSWVLYDFFLEDYAYWGNRQLY

SEQ ID NO: 35157 - protein, 404 aa, Arabidopsis thaliana
MAAFLQTNIRLEIIPGRYSSLTDHKFRAPYRIRCAAASPVKKRYNITLLPGDGIGPEVISVAKNVLQKAGFLQGLEFDFQEMPFGGAALDLVGVPLPEETSTAAKQSDAILLGAIGGYKWDKNEKHLRPEMGLLNIRRDLNVFANLRPATVLPQLVDASTLKKEVAQGVDMMIVRELTGGIYFGEPRGITINENGEEVGFNTEIYAAHEIDRIARVAFETARKRRGKLCSVDKANVLDASILWRKRVTALASEYPDVELSHMYVDNAAMQLVRDPKQFDTIVTNNIFGDILSDEASMITGSIGMLPSASLGESGPGLFEPIHGSAPDIAGQDKANPLATILSAAMLLKYGLGEEKAAKMIEDAVVDALNKGFRTGDIYSPGNKLVGCKEMGEEVLKSVDSKVPV

SEQ ID NO: 35158 - protein, 364 aa, Populus trichocarpa
MDHNYQRRQHPTYIADNFNSLDQVISALREAGLESSNLILGIDFTKSNEWTGRHSFHRKSLHAIGSTLNPYEQAISIIGRTLSPFDEDNLIPCFGFGDASTHDKYVFSFYPDNRPCNDLEEALARYREIVPHLKLSGPTSFAAIINAAIDIVEKSGQYHVLVIIADGQVTRTPDTPPGRLSPQEQATVNSIVAASKHPLSIIFVGVGDGPWNAMQQFDDNIPQREFDNFQFVNFTKIMLDNTEASKKETAFALAALMEIPLQYRATQRLQHTDHDLVGGPRTRPLPPPREVIDHDNAVKSIPHITNFETVQPSTSVEPVCPICLTNPKDMAFGCGHLTCRDCGASLSTCPICRQPITTRLKLFT

SEQ ID NO: 35159 - protein, 394 aa, Candida albicans SC5314
MNYLLRCTFTIGLLAYTALASPGDDLYAFQDCLYQCEQITCNNNPYHIIQQEFYTELSNNPDYEFRYYNPHWQFDPMPLPLHLRLLGWNCESNCDYQCQRIITGERIKNHEEIYQFHGKWPFLRVLGIQELTSVVMSLGNLYVNYQSFKKIWSSVITNDSVPSNLKYQFTNIFVVQIVTMCAWLFSTIFHVRDYILTERLDYYFAGLTVLTQFHALGARYFNLYKHSRVVYRWLFSLACILAYVYHVHRLYTDWSYTYNMQANICVGLSQNVFYCLVCFGLYVKYYNLEQTENKVILNHLNYVDSQRIILSSFFTRSSKLFSLYPLLLCFIVVCGMALEVFDFPPVFFDLVDAHSLWHLVTIVPVYMGWYDWLVWDVYENVWSNIQEEDKKKKE

SEQ ID NO: 35160 - protein, 460 aa, Chlorobium tepidum TLS
MTYDASTHAGLRCYFDSGQTRPFEWRRAQLRGLDAFLREREHEIAAAVHADLRKPVAETWLTETAWLRSEIRFVLKRLHRWMRPKKVGVPLHYQPARAFVERDPLGVVLIIGAWNYPLQLCLAPLIGALAGGNVSVVKPSEMAPATSALLASELGRYVDPQAVRIVEGDGEASARLLEHCFDHIFFTGSRRTGQAVMQSAARHLTPVTLELGGKSPVIVTEKADLRLAARRIAWAKFLNAGQTCVAPDYLLVQEGVKEPLQGLMKEALRLYYGSDPEASADYGRIVDDRNFRRLEALLCEGSLVEGGGSNKASRYIAPTILHDVPEDSDLMKEEIFGPVLPVRSFTTLEEAVSMVRALDAPLAVYLFSRDRSELRYLIEQTRSGGVCCNDLLFQASIPGLPFGGRGMSGMGRYHGKAGFDTFTTERSVLDRGGFPDPDLRYPPYSSGRFDLLKKIVTLFS

SEQ ID NO: 35161 - protein, 108 aa, Chlamydomonas reinhardtii
MLAEIVKAFSDEYKKTPVRVKVLDAFLVYALATAAVQFAYMLLVGTFPFNAFLAGFLSCVGFFALTVCLRMQVDPANKEFSGISPERAFADYCLANLVLHLVVWNYMG

SEQ ID NO: 35162 - protein, 409 aa, Zea mays
MQFALALDTNSGPHQIRSCEGDGIDRLEKLSIGGRKQEKALRNRCFGGRVAATTQCILTSDACPETLHSQTQSSRKNYADANRVSAIILGGGTGSQLFPLTSTRATPAVPVGGCYRLIDIPMSNCFNSGINKIFVMSQFNSTSLNRHIHRTYLEGGINFADGSVQVLAATQMPEEPAGWFQGTADSIRKFIWVLEDYYSHKSIDNIVILSGDQLYRMNYMELVQKHVEDDADITISCAPVDESRASKNGLVKIDHTGRVLQFFEKPKGADLNSMRVETNFLSYAIDDAQKYPYLASMGIYVFKKDALLDLLKSKYIQLHDFGSEILPRAVLDHSVQACIFTGYWEDVGTIKSFFDANLALTEQPSKFDFYDPKTPFFTAPRCLPPTQLDKCKMKDAFISDGCLLRECNI

SEQ ID NO: 35163 - protein, 401 aa, Pyrococcus horikoshii OT3
MTLMIRASKRALSIEYAIRDVVLPARELEKKGIKVIRLNIGDPVKFDFQPPEHMKEAYCRAIQEGHNYYGDSEGLIELREAIVKREKEKNGVDITPDDVRVTAAVTEALQLIFGALLDPGDEILIPGPSYPPYTGLVKFYGGKPVEYRTIEEEGWQPDIDDLRKKISERTKAIAVINPNNPTGALYDKKTIEEIINVAGEHDLVVLSDEIYDLMTYEGKHISPGSLTKDVPVIVMNGLSKVYFATGWRLGYMYFVDPEGKLSEVREAIDKLARIRICPNTPGQFAAIAGLTGSMDYLKEYMKKLKERRDFIYKRLNEIPGISTTKPQGAFYIFPRIEEGPWKSDKEFVLDVLHNAHVLFVHGSGFGEYGKGHFRIVFLPPIEILEEAMDRFEKFMRERLSS

SEQ ID NO: 35164 - protein, 248 aa, Herbaspirillum seropedicae
MYKIVFMRHGESTWNLANRFTGWVDVDLTEKGVAEARQAGKLLKEAGFTFDLAYTSVLKRAIRTLWTTLDEMDQMYIPIKNDWRLNERHYGALQGLNKAETAAQYGDEQVLVWRRSYDTPPNPLTPGEERDAFGDPRYAGLSREQVPLTECLKDTVARVLPAWNDAIAPAIRAGKQIIISAHGNSLRALIKYLDGISDNDIVGLNIPNGQPLVYELDADLKPIKSYYLGDQSAIEAALKAVANQGKSK

SEQ ID NO: 35165 - protein, 1483 aa, Ashbya gossypii ATCC 10895
MRARSEGPGRNLSPRTGVPRSPAVVSSQGILRSPSLKSGASPMSTLGLGWKHGQQSPTGHVAQYLSPLSADSSSAPSRKTSITGLSTLRGGSPSRKPRSNSVSSNFKMAEDAENNTPTLVLPPSLASLNSQSTLSTVYTGNPAAAANPEASSSSSKSGNSATSSLRSGYKPMKRQYVLNEQLYLSRMKNSHLDDYYTRGIAPTMNDDEEDDTDLDTPDVNIDNDDQAFGSNVFTFHDRETSRSVDNELVMLSTKHLLGKMNWLRELDPGNPDIEAPLEFLARAENVSINSATPQDNRQDIEGMLGKLSRNPLVQERLEWQTMLWNVLRGDIVNSEKTKLAEQRTTDELTTQFSDELWLELKSWLYGRSVEDQRTWLQYLRASTDSIFERIIEFRLEDDIEIPDAVVKVESLLNEYYKVIPYWKNCQQMYKEKPITNSDDFKLRIETLNTYVVMYAAFKTEITALHQWIGNDDPEAEGAAGGIEDIKCAEKPIAEQVLKEKDIETIFQNKIFYRHGPWVFKAKLAAIEYGDYFNLMNLPSLNGYLTTLITFPMKLIKEIILIRLNYARKLQKPTMMMIDQMIDDFKSYIKLAVQIIYTINLYCSNKELQLGNVIDDTFDKTVNDAISYFFKLLNLKLVDSTKKSFKNFKEPEALFSHWEDLKNVGCHIDGANEVVPTGFVSLTLRLLNKLHAYILKEQNSVTEKVSKAECEKWIMVTLENIGLFKRKMNRFSNVLTKALQNSANYRINDIRLLLQNLKDTGHFLIYTGGYLEDSGTYLFASKELLGYSGTDILRIVKGMEVGSDLIPEVSITNSLSVYTAIEQGVCSDPIFVQEERPDGLSYYHVQSECNKRHIGKSRGKIIHSYDSFYGSETEGSELYELERKLKSLGYLVAVCPDEPILWEGEMYNLSYEKQLNAEDFPVNITPGMLTLMAQGSTYSMEYQCDKFQHFAGNSVVFTEKRCSIVPAEQTLQKINKAYFRITYHTLAHHHKLVSTIQRKFRGFESLNTVFIFCRDFAKNFLRSNVASYETKSVIIMQMLKVSIGWLTFLIDDCDPNDPKTFRWCVLAMEFAMQMTSGWNILGISGEQFKTLKDKISGCMALLISHFDIMGVRSREAENTVMPQVRAIMDFETDDEETVQQLNTKMRLKAINELEQNTVNTRRQVGKVLDATDKDNQYLLTLASSLSNVSIKWQKRSFIGGGSFGSVYSAVNLDTGDILAVKEIKFNDRKTIKQVFPSIRDEMTVLEMLNHPNVVQYYGVEVHRDRVNIFMEYCEGGSLASLLAHGRIEDEMVTQVYSLQMLEGLAYLHESGVDHRDIKPENILLDFNGIIKYVDFGAAKVLASNGSKKLNLEQHMEGEKMIGTPMYMSPEAISGTGYGKFGSDDIWSLGCVILEMVTGRRPWANLDNQWAIIYQVAAGQIPMFPSKNEMSQAGIKFLSRCLIQDPNQRSTAVELLMDPWIIEIRTIAFGDDTVEPVSKERPLNS

SEQ ID NO: 35166 - protein, 56 aa, Zea mays
  misc_feature (16)..(16): Xaa can be any naturally occurring amino acid
MKTFDPWPFFFRQEWXRNWPFLTGICITCFIITKMTANFTDDDLMNSKFVQEHTKL

SEQ ID NO: 35167 - protein, 380 aa, Physcomitrella patens subsp. patens
MTVNGGPHLERCILVTGGAGYIGTHTSLQLLLDGYKVVILDNLANSSEEGLRRVVDLAGKQGEKLVFYKADLCDKDAIEAVFDKHRFDAVIHFAGLKAVGESCAKPLPYYINNILGTLNLLDVMNVYNCKKLVFSSSATVYGQPESVPVTEESRLFVLNPYGRTKLQVEEMMRDITAADPDWRCIVLRYFNPVGAHPSGRLGEDPQGFPNNLMPFVQQVAVGRRKELTVFGTDYNTKDGTGVRDYIHVQDLATGHSAALHKLFTTPDIGCTAYNLGTGKGTSVLEIVAAFEKAAGLKIPLRIAGRRPGDCSVVYTATEKARKELGWKAQNGIDEMCRDQWKWASNNPDGYRSSQEKSPANDSKPLANGNHEAVLNTDTAT

SEQ ID NO: 35168 - protein, 546 aa, Pseudomonas putida KT2440
MSELIRVPDIGSGEGEIIELFVKVGDRIEADQSLLTLESDKASMEIPAPKAGVIKELKVKLGDRLKEGDELLVLEAEGAAAAAPEAPAAAAAPAAAPAPAAEAAPAAPAAAPAAASVQDIHVPDIGSSGKAKIIEVLVKVGDTVEADQSLITLESDKASMEIPSPAAGVVEEVLCKLEDEVGTGDLIFKLKVAGAAPAAAPAPAAAPAPAKAEAAPAAAPAAAAPAAAPAPAATAPAAGSNAKVHAGPAVRQLAREFGVELGAVAATGPHGRILKEDVQVYVKAMMQKAKEAPAAAGATGGAGIPPIPAVDFSKFGEVEEVALTRLMQVGAANLHRSWLNVPHVTQFDSADITELEAFRVAQKAVAEKAGVKLTVLPLLLKACAFLLKELPDFNSSLAPSGKAIIRKKYVHIGFAVDTPDGLLVPVIKNVDQKSLLQLAAEAAALAEKARTKKLSADEMQGACFTISSLGHIGGTGFTPIVNAPEVAILGVSKATMQPVWDGKAFQPKLMLPLSLSYDHRVINGAAAARFTKRLGDVLGDIRTMLL

SEQ ID NO: 35169 - protein, 413 aa, Herbaspirillum seropedicae
MAQIEVKVPQLSESVAEATLLQWHKKVGEPVSRDENLIDIETDKVVLELPSPDAGVITQIIKADGATVVAGEVIAILDTDASAQVAPTEVKAAPAPQATNEPTPVAAPELASKGDVAMPAAAKLLADNNLSTSQVTGTGKDGRVTKGDVLGALSAPAAAPAAAAKPALAQVAAPVKAGLESRPEQRVPMSRLRARVAERLVQSQSTNAILTTFNEINMQPVIDLRNKYKDKFEKEHGVKLGFMSFFVKAVVHALKKYPIVNASVDGNDIVYHGYFDIGVAVGSPRGLVVPILRDADQMSIADIEKKIGEFGQKAKDGKLSIEELSGGTFTVSNGGTFGSMLSTPIINPPQSAILGIHATKERAVVENGQVVVRPINYFALSYDHRIIDGREAVLSLVAIKEALEDPARLLLDL

SEQ ID NO: 35170 - protein, 753 aa, Archaeoglobus fulgidus DSM 4304
MPVLWLADVDKNDIPLVGGKGANLGELLRAEIPVPDGFVVDARTFREFIQKTGIAEKIYSLLRELDVEDTEKLDAVSREIREIIEKTEMPEDIEREIREAYRKLCEEEGKEVYVAVRSSATAEDLPDASFAGQQETYLNVVGEDEVVEKVKKCWGSLFTPRAIYYRVQKGFRHEDVSIAVVVQKMVNSEKSGVMFTSHPVSGEKKCIIEAVFGLGEAIVSGLVTPDTYVYDRVKRKIEEVKIGEKKFMLTRKDGKTVKVELPPEKANERVLSDEEIEKLVTLGELIEDHYGKPQDVEWAIEGGKIYIVQSRPITTIRKEKKEAEEEVSEEAEGKILLKGLGASPGIASGKVKVIFSEKEISKVEEGDILVTTMTTPDMVPAMKRAAAIVTDEGGMTCHAAIVSRELGVPAVVGTKVATKVLKDGMVVTVDGEKGIVYEGRIEKKEEPKPVVASAPIITATEVKVNISIPDVAERVARETNADGVGLFRIEHMVLGLEKHPMKFIRDGEIDRYIDLLYQEMKKVVKAFYPKPVWIRTIDAPTDEFRAMEGGEDEPIEANPMLGFRGIRRDLAEEEHFRAEMRAIKKLVDEGYTNVGVMLPLITSPEEVKRAKEIAISEGLPLDKIEFGVMVETPAAALILEDIIKEGIDFVSLGTNDLTQYTLAVDRNNENVAYLYNETHPAVLKLIERTIKVCKEHGVKSSICGQAGSYPHVVEKLVEFGIDSVSANPDAVQRIREVVARAEKRIILEKLRKI

SEQ ID NO: 35171 - protein, 227 aa, Neisseria meningitidis MC58
MELVFIRHGQSEWNAKNLFTGWRDVKLSEQGLAEAAAAGKKLKENGYEFDIAFTSVLTRAIKTCNIVLEESDQLFVPQIKTWRLNERHYGQLQGLDKKQTAEQYGDEQVRIWRRSYDTLPPLLDKDDEFSAHKDRRYAHLPADVVPDGENLKVTLERVLPFWEDQIAPAILSGKRVLVAAHGNSLRALAKHIEGISDEDIMGLEIPTGQPLVYKLDDNLKVIEKFYL

SEQ ID NO: 35172 - protein, 151 aa, Mycoplasma pneumoniae M129
MSKYQKKSDGELKRTLTKLQYDVTQNAHTEPPYTNEYNRHYEKGIYVDITSGEPLFISTDKFKSGCGWPAFTKPISQDLIANYRDESHGMIRTEVRAKNSNSHLGHVFRDGPEEHGGLRYCINSAALKFIPFAEMESAGYGEYLKLFKESN

SEQ ID NO: 35173 - protein, 510 aa, Ustilago maydis 521
MTVVHSNPASRQQSTEPGTINGRYDAKRRKLASSDLAKESTVEANMSTDLSDESAELTGVEAVEPTANGEDALQEAKKGAANESKSAVCASADADTAEFGQTKVKAEEAVDLEEAMQPAPKSAASAVEEGVAQKKERPAVIEERTGLIQFRVVTNDDDHESMILLTGLKNIFQRQLPKMPREYISRLVFDRNHQSVAIVKRGLQVVGGITYRPFKQRKFAEIVFCAITSTEQVKGYGSHLMNHVKDHVKASSPVMHFLTYADNYAIGYFKKQGFTKEISLDRSIWVGYIKDYEGGTLMQCSMVPRVKYLEVSDMLAAQKEAILAKIRSISRSHVVHKGLQAMHDRDRLIKLKGLIENPDGTVAKPERAAKRDQNHGEEDPTATFLVNPSEVPGLKESGWTPEMDELSRRPKRGPHFAVMRHILVELNGHGSAWPFVNPVNGDEVTDYYDVIKNPMDLSTMEAKLENNQYANLIFDNCRSYNPASSPYAKSATKLEKFLKETLLPKVQSSL

SEQ ID NO: 35174 - protein, 138 aa, Deinococcus radiodurans
MERTFAMIKPDGVRRGLTPEILARIHNKGYRVVGLKQMMMPRETAEQHYGEHRERPFFGELVDFITGGPVVAIALEGENAIAGWRAMMGATNPANAAPGTIRADFATSTGENVTHGSDSPESAERELALFFGDGELLS

SEQ ID NO: 35175 - protein, 322 aa, Deinococcus radiodurans
MPASLPRLALIHTGGTIASRPSPDGRGLTPQTPPALPGLEGVQVSEHQPFNLPSPHVTPAHMQQLAHLIEQLAGGHDAVVVTHGTDTLEETAFFLHLCLPAGLPVVLTGSMRHAEEVSWDGPGNLLDAAQVALCPQTAGRGPLVVFGGDIFDARTVTKVHTSAVDAFGGYPGPIGRIDRTAAGPQVHYFARPEPRPTFRPVTLERRVEILYAYAGWQGEGYAGALERADGLVIAALGTGNLPPELLPLIAATDKPVVLATRTHAGPILPVYGYAGGGATLVEAGAIPASFLNAHKARLLLLVLLNLGASREDIRRVFTQGVF

SEQ ID NO: 35176 - protein, 366 aa, Bacillus sp. SG-1
MALTAGIVGLPNVGKSTLFNAITKAGAESANYPFCTIDPNVGIVEVPDYRLDKLTELVQPKKTVPTAFEFTDIAGIVKGASKGEGLGNKFLSHIRQVDAICQVVRCFADDNITHVSGKVNPLDDIEVINLELILADLESVDKRIARVQKLAKQKDKEAAYEHEILLKLKEAFEEGRPARTVEFTEEQMKVVKGLHLLTIKPVLYVANVSEDDIADPSDNEYVQQVREFAKGDNAEVIVVCAKIESEIAELDDEEKAMFLEELGIEESGLDQLIRAAYDLLGLATYFTAGVQEVRAWTFRTGMKAPECAGIIHTDFEKGFIRAETVSYDDLVANGTMGAAREAGKVRLEGKEYIVKDGDVIHFRFNV

SEQ ID NO: 35177 - protein, 465 aa, Burkholderia sp. 383
MNAVDVNLDADLQAIGKRHLLMHFTHADAYRDHALTVFDRGEGCWLVDRNGKRYFDGLAGLYCVQVGYSHGAEIGDAIREQMVRLPFATNWGVGHEPAIKLAHKLAALAPEGLNRVFFTSSGSESNESAIKLVRQYHQSRGEPQRRKFIARRVAYHGTSFGALALNGMTNFRKHFEPLMSGVRHVGNTKRYGRPVGETEAQFTRHLLDEIESLIVQEGPDTVAALVVEPLQNAGGSLTPPAGYAAGLRDICDRHGVLLVADEVICGFGRLGEYFGSARYGLKPDIITFAKGIASGYVPLGGVIASDTVVDTVLNGPQQMFLHGATYGGHPVACTAALANLAIMEREGVLENVRSNEAVFRQTLDGLLELPCVGDVRGDGYHYSLELVTDKAARRWAAGVSAQAFVSTLLAPAIFDAGLLCRAGVDHEGTPIVQFSPPLVMSRDEIVWFVAKIRDILVDTYARATR

SEQ ID NO: 35178 - protein, 291 aa, Mycoplasma pneumoniae M129
MPKIRKAVIPAAGLGTRLLPATKAIPKEMLPLVNKPTIQYIVEEAVASGIKEILVIVSSKKEAIIDHFDYDFILENALLQKHKDQEHQEIKDIANLAHIYFVRQKHQHGLGDAILHAKSFVGNEDFAVLLGDDVVFGEQPALAQCIQAYEQTDCQVIGVQEVPHDQVNKYGIVTPEANWQKQALVKILGMVEKPAVNEAKSNLAILSRYILKPSIFTALKQVPFGVGGELQLTDGLNYCLQQGEPFFAKHFGGTRFDVGTKNGFIKANLYTALKTDAITKDEVLAILKEFA

SEQ ID NO: 35179 - protein, 178 aa, Helicobacter pylori
MLTIKDIHALEVMDSRGNPTIQASVILSDNTKASAIVPSGASTGKREALELRDNDKTRFLGKGVLRACENVNSVIKHHLIGLEATNQAFVDERLRALDGTPNYANLGANAVLGVSMALARASAKALNLPLYRYLGGANALTLPVPMLNIINGGTHANNSIDFQEYMIMPLGFESFKEA

SEQ ID NO: 35180 - protein, 463 aa, Burkholderia sp. 383
MDNDSPGRYASAAATHDFGAHAMRGDADERRKPHLLGLATLVIFGLAYMLPMTVFTTYGIVTSETNGHLTAAYAVTLVAMLFTARSYGHMARLMPSAGSAYTFASRNFGTSAGFMVGWALLMDYLFIPMISYLAIGIYMKQIFPGVPAGVWIVGSIVLITGLNIVGIRLVNRVNLILIASQLVFIAIFFVASARVAAGEGLSMAVALPSSGDARAIFAGSAILCLSFLGFDAVTTLSEETREPKRTVPRAILLCTLASGVLFMLVAYVGQVVFPDWHAFKDLDSASLELMRRIGGGTLSAFFVAVYVAGCFASAMAGQASVTRVLFAMGRDRVLPERVFGHLHARLRTPVRATLAVGIVSLSALFITLDLASTMISFGALVAFAVVNLCVMRSYLCRPEHRRFAGWITFGVMPAIGFAMNVWLWSGLSRQTFYVGTGWLVLGLCQLVWLTRGFTRPAPTLSMN

SEQ ID NO: 35181 - protein, 360 aa, Rhodobacter sphaeroides 2.4.1
MDIRTHRIAAIPGDGIGIEVVAAGLEVLEALADRDGGFRFDVESFDWGTDRYRRTGAFMPEDGADRLRGFDAILFGAVGAPDVADHLTLWGLRLAICQPLDQYANVRPTRMLPGIRSPLRHVGESELDWVIVRENSEGEYAGQGGRSHPGLPLEVATDVSIFTRAGVERIMRFAFRLAQSRPRKLLTVVTKSNAQRHGMVLWDQIAGEVAREFPDVRWDKMLVDAMTVRMVQKPASLDTIVATNLHADILSDLAAALAGSIGVAPTANLNPERDTPSMFEPIHGSAFDITGRGIANPVATFWTAAMMLEHLGEAEAAGRLMTAVGRVTADEDLHTPDLGGRATTRQVTDALIAALRGRNA

SEQ ID NO: 35182 - protein, 357 aa, Rhodobacter sphaeroides 2.4.1
MADNHLKIAVIAGDGIGKEVVPEGLRVLEAVAGRHRIDLRFEEFDFASCDYYARHGQMMPEDWQERIGGHDALFFGAVGWPATVPDHVSLWGSLIQFRRQFDQYVNLRPARLMPGVPSPLAGRGPGDIDMWIVRENTEGEYSAIGGRMYPGTEREIVLQETVMSRHGIDRVLRYAFELANRRERRRLTSATKSNGISITMPYWDERVEAMAQDYPDVAWDKYHIDILAAHFVLNPDRFDVVVASNLFGDILSDLGPACTGTIGIAPSGNINPERAFPSLFEPVHGSAPDIAGQGIANPVGQIWAGAMMLDHLGHGEAAAEIMAAIERVLADPRLRTRDLAGAADTVTCGKAIVEALG

SEQ ID NO: 35183 - protein, 288 aa, Picea abies
MEGKEEDVRLGANKYSERQPLGTAAQTREKDYKDSGPAPLFEPGELASWSFWRAGIAEFMATFLFLYITILTVMGVKRSDDVCTGSVGIQGIAWAFGGMIFCLVYCTAGISGGHINPAVTFGLFLARKLSLPRAVFYMICQCLGAICGAGVVKGFMESEYEMDGGGANSVAHGYTKGDGLGAEIVGTFVLVYTVFSATDAKRSARDSHVPMLAPLPIGFAVFLVHLATIPITGTGINPARSLGAAIIYNKSHAWDDHWIFWVGPFLGAGLAAFYHQMIIRAIPFKTRS

SEQ ID NO: 35184 - protein, 513 aa, Picea abies
MAGGMAVSRPKQGRAELYEGHITAYVILACIVAATGGSLFGYDLGVSGGVTSMDDFLKKFFRHVYERKQHHLRETDYCKYDNQLLTLFTSSLYLSGLVATFGASYITRSKGRRVSIIIGGLSFLLGAILNAAAKNLGMLIVGRILLGAGVGFSNQSVPLYLSEMAPAKVRGGTNNLFQLKTCLGIFVTNVINYFTNKLHPWGWRLSLGLAVIPALLMSIGGYFLPETPNSLVEQGRLQEGRQILEKIRGTKNVQAEFDDLVEASDVARAVKHPFRNLLQRRNRPQLVMGTCIPAFQQLTGNNSFLFYAPVIFQSLGMGNDASLYSAIMTGAVITFGALVSMFTVDRVGRRFLFMEGGTQMIVCHVIISILLKSNFGKGEKIPTGYGVGIVLLICIFYLLAYGWLWGPLSWLVCSEIFPMESLVVCVNLFFTAVIAQSFLALLCHLKYGIFLLFGGLVFIMSVVIYFFLPETKNVPIEEMRFQWAKHWYWKRFMDEYMDNDDENEKGNMTKAAA

SEQ ID NO: 35185 - protein, 516 aa, Arabidopsis thaliana
MAYASRIINHSKKLKDVSTLLRRENAATIRYYSNTNRAPLNREVTGVHYFFNYEIKSKQCNGKANIWKRIFMVQSHSLTLCGGYLPPHQEIGMPSLSPTMTEGNIARWLKKEGDKVAPGEVLCEVETDKATVEMECMEEGYLAKIVKAEGSKEIQVGEVIAITVEDEEDIGKFKDYTPSSTADAAPTKAEPTPAPPKEEKVKQPSSPPEPKASKPSTPPTGDRVFASPLARKLAEDNNVPLSDIEGTGPEGRIVKADIDEYLASSGKGATAKPSKSTDSKAPALDYVDIPHSQIRKVTASRLAFSKQTIPHYYLTVDTCVDKLMALRSQLNSFKEASGGKRISVNDLVVKAAALALRKVPQCNSSWTDDYIRQFKNVNINVAVQTENGLYVPVVKDADRKGLSTIGEEVRLLAQKAKENSLKPEDYEGGTFTVSNLGGPFGIKQFCAVVNPPQAAILAVGSAEKRVVPGNGPDQFNFASYMPVTLSCDHRVVDGAIGAEWLKAFKGYIENPKSMLL

SEQ ID NO: 35186 - protein, 521 aa, Rhizobium leguminosarum bv. viciae 3841
METVFPLTTFADLGLSQKVLSAVTDAGYTIPTPIQAGAIPFALERRDICGIAQTGTGKTASFVLPMLSLLEKGRARARMPRTLILEPTRELAAQVAENFEKYGKNHRLNVALLIGGVSFEDQDRKLERGADVLICTPGRLLDHFERGKLLMSGVEILVIDEADRMLDMGFIPDIERIAKMIPFTRQTLFFSATMPSEIQKLADRFLQNPERIEVAKPASAAATVTQRFVASHGKDYEKRAVLRELVRAQTELKNAIIFCNRKKDVADLFRSLERHGFSVGALHGDMDQRSRTMTLQSFRDGNLQLLVASDVAARGLDIPDVSHVFNFDVPIHSEDYVHRIGRTGRAGRSGAAFTLVTKRDTKFVDAIEKLIGQKVEWLSGDLTSLPPPAEDSRDSERPRRNSRERGARDGAGRDRAPRENGDKDRGRGRGNRAAASHKSDIDIQDNGVDVIEAAPVKADIVKNERKAEQKPQNNARNNRPYPANDDSRDRRRHRDHDDGPTPVGFGDDIPAFMLIAGSAKV

SEQ ID NO: 35187 - protein, 384 aa, Nostoc punctiforme PCC 73102
MNDKLMLMIPGPTPVPEAALLALAKHPIGHRTSEFSNILAEVTENLKWLHQTQTDVLTLNVSGTGAVEAGIINFLSPGDRILVGSNGKFGERWVEVGQAYGLNVEEVKVEWGKPLDPAVFAEKLQADTQKQIKAVIITHSETSTGVLNDLESINRHVKAHGEALIIVDAVTSLGAFNLPVDAWGLDIVASGSQKGYMIPPGLGFVSVSPKAWEAYKTAKLPKYYLDLGKYRKATAKNTTPFTPPVNLIVALHTTLRIMKEEGLESIFARHERLKNATRAAIQGLNLPLFAADSSASPAITAVAPQGIESDKIRSLMKKRFDIALAGGQDHLSNKIFRIGHLGFVSDRDILSCIASLEVTLTELGYEDFTPGSGIAAAVKVFSQS

SEQ ID NO: 35188 - protein, 225 aa, Rhizobium leguminosarum bv. viciae 3841
MTLPIRIAPSILAADFARLGEEVRDVTAAGADWIHLDVMDGHFVPNISFGPDVIKSLRSYTSATFDCHLMISPVDDYLEAFAKAGCDRITVHAEAGPHLHRSLQTIRNLGKKVGVTINPATPLSAIENVLDDVDLILIMSVNPGFGGQKFIPAMAKKIAAAKSLIGDRPIELEVDGGVTVETAPDIARAGGNVLVAGSAIFKGDTVEDYRRTVADLRQAAEGARA

SEQ ID NO: 35189 - protein, 403 aa, Pseudomonas syringae pv. phaseolicola 1448A
MDTSFWKAGHKPTLFAAFLYFDLSFMVWYLLGPLAVQIATDLHLTTQQRGLMVATPILAGAVLRFFMGLLADQLSPKTAGIIGQVIVIGALLAAWQLGIHTYGQVLLLGLFLGMAGASFAVALPLASQWYPPQHQGKAMGIAGAGNSGTVLAALIAPVLAASFGWGNVFGLALIPLVLTLIAFTLMARNAPERSKPKSMADYLKALGDRDSWWFMFFYSVTFGGFIGLASALPGYFNDQYGLSPITAGYYTAACVFGGSLMRPLGGALADRFGGIRTLTVMYAVAAIGIAAVGFNLPSSWAALALFVAAMLGLGAGNGAVFQLVPQRFRKEIGVMTGLIGMAGGIGGFLLAAGLGTIKQNTGDYQLGLWLFAGLAVLAWFGLLNVKRRWRTTWGSAAVTAARV

SEQ ID NO: 35190 - protein, 187 aa, Mesoplasma florum L1
MSKNNVLDMIVEIPKGSSNKYEVDAKTGRIILDRVLYGANFYPGEYGMVENTLDWDGDPLDVISLCTYPTMPGVQVSVRILGSIKMIDAGEIDTKLFGVFNDDPRFSSYEKLEDVPQHLRDEIENFFLQYKALQKKSVKINGWGTLEEAIEELHECKERFAEYKDRLEAGERDLILAEWKEKGIGQG

SEQ ID NO: 35191 - protein, 466 aa, Herbaspirillum seropedicae
MADGKIVQCIGAVVDVEFPRDAMPKVYDALKLEGSDLTLEVQQQLGDGVVRTIALGSSDGLRRGLTISNTGKPITVPVGTATLGRIMDVLGNPIDECGPVSHEQTASIHRKAPAYDELSPSQELLETGIKVIDLVCPFAKGGKVGLFGGAGVGKTVNMMELINNIAKAHSGLSVFAGVGERTREGNDFYHEMAEAKVVDLENPTNSKVAMVYGQMNEPPGNRLRVALTGLTIAEGFRDEGKDVLFFVDNIYRYTLAGTEVSALLGRMPSAVGYQPTLAEEMGRLQERITSTKTGSITSIQAVYVPADDLTDPSPATTFAHLDSTVVLSRDIASLGIYPAVDPLDSTSRQLDPQVVGQEHYETARAVQGTLQRYKELRDIIAILGMDELAPEDKLIVARARKMQRFLSQPFHVAEVFTGSPGKYVSLKDTIKGFKMIASGELDHLPEQAFYMVGTIDEAIEKAKKIN

SEQ ID NO: 35192 - protein, 310 aa, Orobanche ramosa
MVITLNNGFKMPIIGLGVWRTEGKDLKNLIINAIKIGYRHFDCAADYKNEAEVGEALEEALQTGLVKREDLFITTKLWNSDHGHVVEACTDSLKKLRLEYLDLYLVHFPVATKHTGVGTTDSALGDDGILDIDTTISLETTWHAMEDLVSLGLARSIGISNYDIFLTRDCLAYSKIKPAVNQIETHPYFQRESLVKFCQKHGICVTAHTPLGGALANTEWFGTVSCLDDPVIKGLTEKYKKKTVAQIALRWGIQRNTVVIPKTSKQDRLIENFQVFDFELSNEDMELLKTMERKYRTNQPAKFWGIDLFA

SEQ ID NO: 35193 - protein, 383 aa, Glycine max
  misc_feature (77)..(77): Xaa can be any naturally occurring amino acid
MSQTKKLTPNLDQQSTKVLNLTVLQRIDPFIEEILFTAAHVSFYDFNIESNQWVRSFLSFSSLLPTFFSHLLFYSFXSRKDVEGSLFVVKRNSQPRFQFIVMNRRNTDNLVENLLDFEYELKKPYLLYRNAAQEVNGIWFYNPDECEEVANLFNRILNAYPKTAPTTVLPVNISESEELQPVSIMPESPLESSSATASAIDAVEDPANTNFLSTLKVTGNYASNMENFRQHSATVTSAPSGLFSTAPAVQIPSASHSTSSISGFPLDSLETAKSGNQIINLVKPSTFFASTSSSSLLVPPISSSVQPSAAVQHSLNLPRQYGTPVLQPFPPPNPPLSLTPISSSTPNRPVFSRDNVRDALLSLVQEDQFIDMMFQALLKVSHS

SEQ ID NO: 35194 - protein, 424 aa, Nocardioides sp. JS614
MSAVVIEKTSTPGLREGAFGNATALSCRECGHQVELGPHYACPECFGPLEIAYDFPRVTREEIEAGPRNIWRYKALLPVPADIEDSPNTEPGFTRLLRAGNLAAELGIANLWVKDDSTNPTNSFKDRVVACALSAAREFGSKVFACPSTGNLANAVAAAGARAGIKTVVFIPSNLEQPKQVNSAVFTDSLVAVNGNYDDVNRLASEIAGEEEGWAFVNVNVRPYYAEGSKTLGYEIAEQLGWRLPDQIVIPVASGSQLTKVHKAFQELIRLGLVEDKPYRVYGAQAAGCSPVSVAYKAGVDAIRPVKPDTIAKSLAIGNPADGIYVLDICRETGGAVEDVTDDEIRAGIVLLARTEGIFTETAGGTTVAVLKKLVETGQLDTSLETVVINTGHGLKTLDAVSGTVAPAATIDPSYPAFAATGLA

SEQ ID NO: 35195 - protein, 856 aa, Kluyveromyces lactis NRRL Y-1140
MSVPSARLLMSTKGLNPSRLSKVASILARCSPSIPKRVGYSKRFVSSANGVGSTGTRSTVIQLLNNIGSKREVEQYLKYFTSVSQQQFAVIKVGGAIISDNLQELASCLAFLYHVGLYPIVLHGTGPQVNGRLEAQGIEPDYIDGIRITDDHTMAVVRQCFLEQNLKLVTALEQLGVRARPITSGVFTAEYLDKDKYKLVGDITSVARDPIEASIKAGVLPILTSLAETPSGQMLNVNADVAAGELARVFEPLKIVYLNEKGGIINGSTGEKVSVINLDEEYDELMKQSWVKFGTKLKIKEIKDLLDFLPRSSSVAIINVQDLQKELFTDSGAGTLIRRGYKLIRRSTLQEFPSSDALRDILQSDPDIQSGAQSVASYLRDLNESDFTSYADEPLDVLAIVKKDSVVAKLDKFLCSQTGWLNNVTDNVFKALKRDFPALQWVINEDDANIAWHFNKSDGSYLKNGKVLFWYGVKDLNTVSELISEFIKTSPESGTAPSFSGSSSGVFSSGQSSRSYSTRARSAPKVEGTNKSPAKVALIGARGYTGQNLISLIDSHPFLELSHVSSRQNAGKKLEGYNKSEIIYSNLQIDDIKKLESEGAVDVWVMALPNKVCEPFVEAIESVANGKSKIVDLSADHRFVPETEWSYGLPELNNREAIANAKKIANPGCYATGAQVAIAPLSEYITGLPTVFGVSGYSGAGTTPSPKNDPKFLNNNLIPYSLTNHIHEREISTRLGLEVAFVPHVAQWFQGISHTISIPIKKNSLSSEQIKALYTEFYANEKLVHVADDIPLVKDVSGTHGVVVGGFKVNDAKDRVVVCATIDNLLKGAATQCLQNINLALSYGEYDGIPDNKIIQ

SEQ ID NO: 35196 - protein, 195 aa, Leptospira interrogans serovar Lai str. 56601
MEIMFLLIDNYDSFTYNLYQYFSQIGNEIEVYRNDKITLDEIKHLSPKAIILSPGPGRPEDSKVCLDVIRELGGKLPILGVCLGHQAIGLVHGGKIVSAPSIMHGKISLVEHDGKDIYKGISSPFVATRYHSLVIQPESLPKELEIASKTPDGVIMGVRHKTKKHLYGVQFHPESIMTGAGLDLIRNFSSIVQEL

SEQ ID NO: 35197 - protein, 166 aa, Haemophilus influenzae Rd KW20
MSNIEKQVGELQEKLIAVNRVSKTVKGGRIMSFTALTVVGDGNGRVGFGYGKAREVPAAIQKAMEKARRNMINVALNEGTLQHPVKGVHTGSRVFMQPASEGTGIIAGGAMRAVLEVAGVRNVLSKAYGSTNPINVVRATIDALANMKSPEMVAAKRGKTVDEILG

SEQ ID NO: 35198 - protein, 113 aa, Triticum aestivum
MATATRRLLPALLRTLAPAGARGLSTEKAVGAAAVVGSHTAKWMQDTSKKSPMELINEVPPIKVDGRIAVCEGASEGVGLGHPIRVHLPWIWEAPNVCKYCGLRYVQVHHPLN

SEQ ID NO: 35199 - protein, 318 aa, Saccharomyces cerevisiae YJM789
MWLKSLLLCLYSLVLCQVHAAPSSGKQITSKDVDLQKKYEPSPPATHRGIITIEYFDPVSKSMKEADLTFELYGTVVPKTVNNFAMLAHGVKAVIEGKDPNDIHTYSYRKTKIDKVYPNKYIQGGVVVPDVGPFTVYGPKFDDENFYLKHDRPGRLAMAYFGPDSNTSEFIITTKADGNEELDGKSVVFGQITSGLDQLMDAIQYTETDEYGKPQHELRFLYFVLEILKISNILDLHAAYTEKVEKFRNGDVSVGSTLENIFRNDKAYTPLTTSTGTTAYDLNHPISRALMCLTVLGLCFIAYKGMHEKPHTVSLRHK

SEQ ID NO: 35200 - protein, 260 aa, Arabidopsis thaliana
MSYLPKSQGAAAKKCGTMVMLGVLQLPCRLHHSLFYSSSQIASSRPQGVAKVVLKKGKTQLFKDGSPMVYSGAVDRIIGKPPPQTGDVVIVADGTENPIGWGLYNSVSMFCVRLMQLQHESTRDPSCALNIEKLLQTRIAEAVQLRKSLALPSANTNAYRLVNSEGDRLSGLIVDVFGDIAVVASSAAWLEKYRIEVESCLRSIDGINHINWRPSLDVLKEDGFDISSLKQTQSSTLPQRSMVRCVVPLIRSFSLLQISS

SEQ ID NO: 35201 - protein, 227 aa, Chlamydomonas reinhardtii
MTLRLKGAGSQHVFGRFALPYLSSGGCSDWAPLSFPQDDYTQLRQIGKGAFGTAHIVEHKVTGERSVLKRVRLARQSAKERQCSVRELLLLSNLRHRNVLDFKGCWVEGGCNLCLLVELCESGDLFTQIKLRSGVHFSEEHLQEMAVQLLSAVAYLHRSSIAHRDLKSSNVLITGEGCLKIADFGLSTVLHDDGAGHLLTKTVVGTPNYMSPCVLQEKPYGMPNDIW

SEQ ID NO: 35202 - protein, 1330 aa, Saccharomyces cerevisiae YJM789
MMDILNTQQQKAAEGGRVLAPHTISSKLVKRLSSDSSHKLSRSDLKALGGSETISDGPSQLTFKDRYVFNESLYLKKLKKTALDDYYTRGIKLTNRYEEDDGDDEIIRLSNGDRIDEDLHSGVKFFSTTPYCRKMRSDSDELAWNEIATERFKWQSMLARVLKGDIVKGEKTRIANQVKKPGLNKELSDEIWLELKAWLNGRTMQEMEQSLTYLRDSSDSVFEEIMKFQIPQGKILSLDALEAILQDLMNRYHSVVSYWPNLKKMYKDKPITNTAEFTARIDVMNSWLNFKTNLTLRRQELDDWINRFSPISSSDNFQEDFDGVPQWNCKMKILAEQLMKEKNIESIFQKKIFYPLSPWMFKLKLHFIVYRETLTKMNIKYPYERLRSLLAFPVYLIKEVILTRLSYARKLKNPTMMMIDQMIDDFNAFIRLSVQLKYTLTKYCSNLPFDVDFDPTFENTVIEAIRYLFFLLNLKLIDSSKQNFKAPDLLLKYWDHLKNTGHYINGAETVIPNEFLKLTLRLVHKLQFYLLKQQNFPPTFANASEAEKWLSSIFENLGAMKRKLNRFSNILVKAFQNSAVYQINHNAQLVKKLKDAHYFLVYSGNTFESSGVYMFAAPELLGCDNDTILRILRNKSIGCDLVPKLDIGNNLNVYDITTKETDLNILVSKGEDSKGIPYYRVVANSSSDLDRHAHQSKKKNFSTDPFDQHLDEKNNEVFELEVALSSLGALVVLYPGEPVVWDGPVYKLPGNNLFASNEMDLGKIGNPNTLILLNQGSNYALTYQIDKFNQTVGDSVSFIEKRCSLNSIESSLQKINKAYYKLTYTVLNNYKGILGSFMKQCPGNELLNSIFMFGRDFGRSFLKYNAFSSKRKYVIIFLMVKLGMNWLKFLVEECDPTDQRTFRWCVLAMDFAMQMTSGYNILALNVKQFQELKERVSVCMSLLISHFDVMGARATEAENGMQQARLNIDTEENIDEEATLEINSRLRLEAIKTLEKTMKRNPRQMGKVLDATDQGNKYLLSLASSLSNVSMRWQKRSFIGGGIFGQVYSAINLENGEILAVKEIKIHDTTTMKKIFPLIKEEMTVLEMLNHPNIVQYYGVEVHRDKVNIFMEYCEGGSLASLLDHGRIEDEMVTQVYTFELLEGLAYLHQSGVVHRDIKPENILLDFNGIIKYVDFGTARTVVGSRTRTVRNAAVQDFGVETKSLNEMMGTPMYMAPETISGSAVKGKLGADDVWALGCVVLEMATGRRPWSNLDNEWAIMYHVAAGRIPQLPNRDEMTAAGRAFLERCLVQDPTMRATAVELLIDPWMIQIREIAFGNSEKDQVPILSS

SEQ ID NO: 35203 - protein, 477 aa, Arabidopsis thaliana
MALTTKPHHLQRSFLSPSRVSGERYLESAPSCLRFRRSGVQCSVVAKECRVKGVKARQIIDSRGNPTVEVDLITDDLYRSAVPSGASTGIYEALELRDGDKSVYGGKGVLQAIKNINELVAPKLIGVDVRNQADVDALMLELDGTPNKSKLGANAILGVSLSVCRAGAGAKGVPLYKHIQETSGTKELVMPVPAFNVINGGSHAGNSLAMQEFMILPVGATSFSEAFQMGSEVYHTLKGIIKTKYGQDACNVGDEGGFAPNVQDNREGLVLLIDAIEKAGYTGKIKIGMDVAASEFFMKDGRYDLNFKKQPNDGAHVLSAESLADLYREFIKDFPIVSIEDPFDQDDWSSWASLQSSVDIQLVGDDLLVTNPKRIAEAIKKQSCNALLLKVNQIGTVTESIQAALDSKAAGWGVMVSHRSGETEDNFIADLSVGLASGQIKTGAPCRSERLSKYNQLLRIEEELGNVRYAGEAFRSP

SEQ ID NO: 35204 - protein, 184 aa, Rhizobium leguminosarum bv. viciae 3841
MMKARLETEVSKYMSYVLRHAPDAAGLTLDSGGWVSFDELEKALASKYDVSRAEIIEIVENNPKKRFTLAHNRIRANQGHSVDIDLALNQAEPPAALFHGTSLTNWQSIEREGLKKMQRHHVHLSADVETAKIVAARRKGEHIILRVDAARMFSEGHSFFVSDNGVWLAESVPVQYLSRNAGTP

SEQ ID NO: 35205 - protein, 139 aa, Physcomitrella patens subsp. patens
MACCCREEGTQVPKTRDRIMLRGMLFHGYHGVYEEENKLGQKFLVDVDAWMDLTKAGETDAMEQSVSYADMYKQIKTIVEGPPFKLVEAVASAIARTLLTAHPMISDVRVKVCKPHVAVEGIVDHLGVEIFRSSEGNKS

SEQ ID NO: 35206 - protein, 252 aa, Zea mays
  misc_feature (194)..(194): Xaa can be any naturally occurring amino acid
  misc_feature (220)..(220): Xaa can be any naturally occurring amino acid
MANPPAAGGKSFLQAMSTVTEEAAVPLRVVQMEGLAVLKIIKHCEEFAPALVTGQLLGLDVGSVLEVTNCFPFPIREDDEEADADGANYQLEMMRCLREVNVDNNTVGWYQSCLLGSFQTVELIETFMNYQENIRRCVCIVYDPSRSSQGVLALKALKLTDSFMDLYRNNGLTGEKLREKKLSWVDIFEEIPIXVSNSALVSAFMKELEPESPVSQCDFXRLKLSTAPFMERNLEFMIGCMDGPFSEQNKFP

SEQ ID NO: 35207 - protein, 189 aa, Pyrococcus horikoshii OT3
MMIVIMDNGGQYVHRIWRTLRYLGVETKIIPNTTPLEEIKAMNPKGIIFSGGPSLENTGNCEKVLEHYDEFNVPILGICLGHQLIAKFFGGKVGRGEKAEYSLVEIEIIDEDEIFKGLPKRLKVWESHMDEVKELPPKFKILARSETCPIEAMKHEELPIYGVQFHPEVAHTEKGEEILRNFAKLCGEL

SEQ ID NO: 35208 - protein, 308 aa, Pyrococcus horikoshii OT3
MDWGRFVEEKVREIRETVGDSKAIIALSGGVDSSTAAVLAHKAIGDRLHAVFVNTGFLRKGEPEFVVKTFRDEFGMNLHYVDAQDRFFSALKGVTDPEEKRKIIGRVFIEVFEEVAKKIGAEYLIQGTIAPDWIESQGKIKSHHNVGGLPEKLNLKLIEPLRDLYKDEVRELAKFLGLPEKIYNRMPFPGPGLAVRVIGEVTPEKIRIVREANAIVEEEVERAGLRPWQAFAVLLGVKTVGVQGDIRAYKETIAVRIVESIDGMTANAMNVPWEVLQRIAFRITSEIPEVGRVLYDITNKPPATIEFE

SEQ ID NO: 35209 - protein, 416 aa, Escherichia coli
MESKVVVPAQGKKITLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRDLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMDGAKLLKCSEFGDAIIENM

SEQ ID NO: 35210 - protein, 689 aa, Mesorhizobium loti MAFF303099
MSNSVSAVNDNGVAIVTIDNSPVNALSFHVRAPLMQALVDLRDDASVTAIVIACAGRTFVAGADITEFGKPVQQPDLRAIVAMLETIAKPTVAAIHGTALGGGLELALGCHFRVADAGAKLGLPEVKLGLLPGGGGTVRLPRLVGAVKALKMIVSGTPIGADEAHEAGLVDAVFEGDLTTHAVNFAGEIARKGGPFTPVRDRDERLGETDLAAFDAEAADLARKARGLEAPVACAQAVRNAVTLPFDEALAAERALFVKLVASDQSRAQRHLFFAEREAAKLPAKDTYKRRIARVGVIGAGTMGGGIAMAFANGGFSVTLLETSAEALQRGLGTIEKNYAVSVSRGSLAEDAKHQRLAQFKGSTDYADLAECDLIIEAVFEDMAVKKEVFGKLDAVAKPGAILATNTSYLDINEIAGSISRPQDVLGLHFFSPANVMKLLEIVRADKTAPDALATVIDLARRIGKVAVVVGVCHGFVGNRMLAARGSESEALLLEGATPSQIDKAFTDFGWPMGPFQMGDLAGLDIGWRNRKARGLTAVIADTLCEQGRFGQKTGRGFYLYEAGARAGIPDPEVEALIRDKAAERGIAPRAISADEIIERTLYPLVNEGAKILEEKIAARASDIDVVWVNGYGFPIGKGGPMFWAGLEGAAKIVQRLDHWHQRTGKDVFKPAPLLKRMAETGSWEGVEA

SEQ ID NO: 35211 - protein, 476 aa, Nostoc punctiforme PCC 73102
MSQGFDYDLVIIGAGVGGHGAALHAVSCGLKTAIIEAGDMGGTCVNRGCIPSKALLAASGRVRELRNAHHLKSLGIQIGSVEFDRQAIANHANNLVSKIQGDLTNSLKRLGVDIIRGWGKIAGAQKVAVTGDGAEKIITAKDIILSPGSIPFVPPGIEVDGKTVFTSDQGVKLESLPDWVAIIGSGYIGLEFSDVYSALGCEITLIEALDQLMPGFDRDIAKLAERVLITPRDIETKVGIYAKKVTPGSPVVIELANFKTKEDVDVIEVDACLVATGRIPATKNLGLESVGIELDRRNFIPVDDRMAVLSAGEVVPNVWAIGDANGKMMLAHAASAQGIIAVENIVGRERIVDYRSIPAAAFTHPEVSYVGLTETAAKELGQTEGFEIATSRSYFKGNSKALAENEADGIAKVIYRKDTGEVLGVHIFGLHASDLIHEASAAIANRQSVQSLAHLVHAHPTLSEVLDEAYKRAIAI

SEQ ID NO: 35212 - protein, 893 aa, Blastopirellula marina DSM 3645
MAKKKAAAKSAKMVYYFGKTKTEGKGVSKAILGGKGLNLAGMTNIGLPVPPGFTITTEVCDLYYKGGEKLPKAMQEEVAKNIATLEKELKKKLGDDKNPLLVSVRSGAAVSMPGMMNTILNLGLTDASVVGLANATNNERFAYDAYRRLINMFGDVVMGMDHHDFEEAFSKIKMKYGAALDTDVPAQGMIELCEAYKAVYKKATGEDFPQDPLKQLELSIEAVFKSWNTSRAVRYREVENIRGLLGTAVNVQSMVYGNMGDDSGTGVAFTRNPSNGENKFYGEFLINAQGEDVVAGIRTPQPVSEMSKWNRAVYKQLIEIKDTLETHYKDVQDIEFTIERGELFMLQTRNGKRTGAAAVKIACDMVKEGLIDEMTALERIPANDLTQLLLPSFDAAGKASATVLTRGLPASPGAAVGALAFSAEEAVERTHAGEKVLLVRKETSPEDIDGMHSAAGILTSTGGMTSHAAVVARGWGRCCVAGAGEIEIDAKAKKIKVGGKTYGPKDILSLDGSTGEVMLGSVSTSEPKLSGDFSKVMKWADEYRTLGIRTNADTPADSQRARDFGAEGIGLCRTEHMFFEDERIGLMREMILAEDEATRRKALGKLLPFQRKDFVGIFTAMKGLPVTVRLLDPPLHEFLPHDKKAQAEIAKEIGVSADKVRSRVAQLHESNPMLGHRGCRLSVTYPEILEMQVTAIVEAAIECKKKRIDAQPEIMIPLVGTAAELKLLRGMAEATIEKVKADANFTGELPILIGTMIEIPRAALTADEVAEHAEFFSFGTNDLTQMTFGFSRDDINTFLPDYLHRELLPVDPFQSLDTSGVGQLVEMGVTKGRSTSKKLKVGICGEHGGDPASIDFCHRVGLDYVSCSPFRVPIARLAAAQAAIRNGGKKKKK

SEQ ID NO: 35213 - protein, 538 aa, Pseudomonas aeruginosa PAO1
MPAIQSELDVNGEDFARNREAMLAAVAGFRELEQKVLDKAAEARPKFEKRGQLLPRERLALLLDPGAPFLELSSLAGYKLHDDKDGTQAGGGIIAGIGYIAGVRCLVSASNSAIKGGTISPTGLKKTLRLQQIAMENKLPVVTLTESGGANLNYAAEIFVEGARGFANQARISAMGIPQVTVVHGSSTAGGAYQPGLSDYVVVVRGKAKMFLAGPPLLKAATGEIASDEELGGAELHAQVAGTAEYLAENDADGVRLAREIVGMLPWNAQLPARPARSWREPLYPVEELLGVVPADPKKPYDVREIVARIADGSEFLDFKNEFDGQTVCGHLRIEGHACGLIGNNGPITPQGAAKAAQFIQLCEQSNTPLLFLHNTTGFMVGTESERQGVIKHGSKMIQAVANARVPKLTLVVGGSYGAGNYAMCGRGLDPRFIFAWPNSRTAVMGGAQAGKVLRIVTEEKHAKEGKEADPKMLEMLETVTAQKLDSQSTALYGTASLWDDGLVDPRDSRRLLGYLLDICAEAEARPLKGNSFGVARF

SEQ ID NO: 35214 - protein, 516 aa, Nocardioides sp. JS614
MSDAATDRDEAMGPDQALGRDDALARLRAMQAADLPVHGGRTLAYVYDSGLPDVDRIGRAAVAAYAGSNGLDPTAFPSLLQMENELVGFAADLLDAPGTCVGTVTSGGTESVLLAVQGARDSRPDLARPRMVLPATAHAAFHKAAHYFGVEAVLVPVGPDFRADPAAMAAAIDEDPDRTVLVVASAPSYAHGVVDPVTEVAAAAAARGIRCHVDACIGGWVLPYATRLGRSVPAWTFAVEGVTSISVDLHKYGYAPKGTSVLLHRTAGLRRPQYFASAAWPGYTMLNSTLQSTKSGGPLAGAWAVVQSLGDTGYELLSRETFEAVDAIVAGLADIPALVLAAVPDSTLVAIATDDSCDAFTVCDEMATRGWYVQPQLSYAGHPPTIHLSVSAATNAHVDDFLAALAASVAAAQAAGPVSVDPGIAEFIGALDPATLSDADFDGLLAAAGLVGGDAAAGLDLPERMAEVNAMLDLASPAMREALLVAFLDRLARPRRQGQGQRVAVDPAKASTESSE

SEQ ID NO: 35215 - protein, 394 aa, Xanthomonas campestris pv. vesicatoria str. 85-10
MDSTLPYAGGYSRRSQDIAPFHVMSLLARANALEQAGHDVIHLEIGEPDFTTAAPIVAAGQAALAAGHTRYTAARGLPALREAIAGFYAQRYACNLDPERILVTPGGSGALLLASSLLVDPGKHWLLADPGYPCNRHFLRLVEGAAQLVPVGPDSDYQLTPALVESAWNADSVGALVASPANPTGSVLSRTQLAALSQALHARGGHLVVDEIYHGLTYGLDAHSVLEVDDGAFVLNSFSKYFGMTGWRLGWLIAPPDAVPELEKLAQNLYISASTIAQHAALACFTPESIAIFEARRGEFQQRRDYLLPALRALGFEIAVEPQGAFYLYADISGFSDDAQAFCAHFLETEHVAFTPGIDFGHYRANQHVRIAYTQSLPRLQQAVERIARGLKRL

SEQ ID NO: 35216 - protein, 308 aa, Nocardioides sp. JS614
MKIATVGVHVLDTHVLGIESIPARSDGQLVETIRMSPAGTAGGTAVVLSRLGAEVRSFGAVGADPIGSTLLALLEREGVDVTGLVRKPDQQTSASVLPVRPNGDRPAWHCIGANGAFTLDDLDLAALDGCTHVHLGGPEFLGGEAAGKLLEHARSLGATTSLDLLAPGDPDLLAWVADALPHTDYLLPNDEQVLGFTGASSIADGARALVAAGAGCVAVTQGSRGALVVTADEVVEVPAYAIEVVDTTGCGDAFSAGFLRGLSLGRDLRDAAELGCATAAQVAQGLGTDAGDYSLDSVLAFAGSTATR

SEQ ID NO: 35217 - protein, 345 aa, Triticum aestivum
  misc_feature (23)..(23): Xaa can be any naturally occurring amino acid
  misc_feature (66)..(66): Xaa can be any naturally occurring amino acid
  misc_feature (85)..(85): Xaa can be any naturally occurring amino acid
  misc_feature (127)..(127): Xaa can be any naturally occurring amino acid
  misc_feature (146)..(146): Xaa can be any naturally occurring amino acid
  misc_feature (153)..(153): Xaa can be any naturally occurring amino acid
  misc_feature (159)..(159): Xaa can be any naturally occurring amino acid
TAKTIVSPGTGILAMDESNATCXGKRLASIGLENTEANRQAYRTLLVTPPGLGNYISGAILFEETXSTSRLLMERRLLTSLSSRXIVPGIKVDKGLVPLVGSNDESWCQGLDGLASREAAYYQQGAXFAKWRTVVSIPNGPSELGXKEAAWGXLARYAXAISQDNGLVPIVEPEIMLDGEHGIERTFEVAQKVWAETFYYMAQNNVMFEGILLKPSMVTPGAECKDRATPEEVASYTLKLLQRRIPPSVPGIMFLSGGQSEVEATLNLNAMNQAPNPWHVSFSYARALQNTCLKTWGGRPENVAAAQEALLLRAKANSLAQLGKYTSDGEAAEASENMFVKNYSY

SEQ ID NO: 35218 - protein, 364 aa, Bacillus sp. SG-1
MMKRQLILDDGTVFTGEGFGAETSSVGEVVFNTGMTGYQEILSDPSYCGQIITLTYPLIGNYGINRDDFESISPAIKGFIVREEADFPSNWRSESTLNDLLKAKGIPGLAEIDTRMLTRKIREHGTMKGMICSIEVDKEEVLHKIRATELPTNQVKQVSTKTAYPSPGRGFRVVLVDFGMKHGILRELNKRDCDVIVVPYNTTAEEIQALNPDGIMLSNGPGDPKDVPEAIEMINETLGKIPLFGICLGHQLFALASGGDTFKMKFGHRGSNHPVKDLATGKVAITSQNHGYSVDEDSLIETRLEVTHIGLNDGTIEGLKHLDLPAFTVQYHPEASPGPEDANGLFDQFMTMMEAEKRKEISHA

SEQ ID NO: 35219 - protein, 303 aa, Streptococcus thermophilus LMG 18311
MLIHSISELIGHTPLIDLQINIPNHSHIYAKLEMFNPGGSIKDRLGQYMIQDAINRGQVTEGVTTIIEPTAGNTGIGIALAAQQHHLPTILVVPEKFSFEKQQLMKALGAKIINTPSDQGIKGAIEKAEALHNQTPNSFVPMQFKNPANPDTYYHTLAQELLDDLNDPIDAFVAGAGSGGTFAGVARYLKEHNPATQTIVVEPEGSILNGGPAHPHRTEGIGVEFVPPFFKDVQIDKTLTIADADAFHQVKELAKKQGLFIGSSSGAALAASLKVAKALPENSTIVTIFPDSSERYMSENIYD

SEQ ID NO: 35220 - protein, 84 aa, Triticum aestivum
MVANGDAPARGSAAAAASLRRRRTTGGGAAAGGGGGGASTMLQFYTDEAAGRKMSPNAVLIMSIGFIAVVAVLHVFGKLYRTPN

SEQ ID NO: 35221 - protein, 193 aa, Streptococcus thermophilus LMG 18311
MSLRGARKIFQTERSILKRDPVAHSLLEVLLTYPGIRVLFWYRIAHFMAFHRLYTIAGFLSQHAAKVTGISISPEAKIGKRIFIDHGIGVVIGATAMIEDDVTILHGVTLGARRAVEGRRHPYVKKGTFIDANAQLLGTITLGAFSKVGAGAIVLNNVADKTTVVGNPALTVNKLPAKVINVTFTTNTSTTKN

SEQ ID NO: 35222 - protein, 434 aa, Novosphingobium aromaticivorans DSM 12444
MKIAMVGSGYVGLVSGACFADFGHDVVCIDKDEGKIESLRQGVMPIYEPGLAELVAANVKAGRLSFSTDLAASIEDAQAIFIAVGTPSRRGDGHADLSYVYAVAQELAENLKTPAVIVTKSTVPVGTGDEVERIIRESGTAVRFEVVSNPEFLREGAAIGDFKRPDRIVIGAEDEWAQGVMKEVYRPLFLNRAPILFTSRRSSELIKYAANAFLATKITFINEMADLCEKVGADVQDVSRGIGLDNRIGAKFLHAGPGYGGSCFPKDTLALLKTAEDYNSPVRLVEAVVKVNDSRKRAMGRKAIEALGGEARGKRVALLGLTFKPNTDDMRDAPSIAIVQTLLDAGAEVVAYDPEGMEAAAAIMPEVTMAPNAYAAIEGADAIVLVTEWDAFRALDFARIRRLANAPVMVDLRNVYDPAEVRAAGFEYTSVGRP

SEQ ID NO: 35223 - protein, 339 aa, Brassica napus
  misc_feature (8)..(8): Xaa can be any naturally occurring amino acid
  misc_feature (11)..(11): Xaa can be any naturally occurring amino acid
  misc_feature (13)..(13): Xaa can be any naturally occurring amino acid
  misc_feature (115)..(115): Xaa can be any naturally occurring amino acid
  misc_feature (122)..(122): Xaa can be any naturally occurring amino acid
  misc_feature (165)..(165): Xaa can be any naturally occurring amino acid
MAGGKIKXGIXGXGRIGRLVARVVLQRDDVELVAVNDPFITTEYMTYMFKYDSVHGQWKHNELKVKDEKTLLFGEKPVTVFGIRNPEDIPWGEAGADFVVESTGVFTDKDKAAAXLKGGAKXVVISAPSKDAPMFVVGVNEHEYKSNLDIVSNASCTTNCLAPLXAKVINDRFGIVEGLMTTVHSITATQKTVDGPSMKDWRGGRAASFNIIPSSTGAAKAVGKVLPQLNGKLTGMSFRVPTVDVSVVDLTVRLEKAATYDDIKKAIKEGSEGKLKGILGYTEDDVVSTDFVGDSRSSIFDAKAGIALSDNFVKLVSWYDNEWGYSTRVVDLIIHMSKA

SEQ ID NO: 35224 - protein, 294 aa, Physcomitrella patens subsp. patens
MALPLVASLACHPSSVLLPQGQKWGQHRMTENNLCSSRTKLGSSFAIPLNFGKSLPCNHLQRIDMDDRMHTIRALSSGEASSNKSEDANVDSVFDKTREELKKLVMQSVTNTNRGKTATNEQRLYIFSLLQELESQNPTIDPVNSPLFSGRWALLYTAPVDEKTSDKYAGTEEGPFLSRVKPASFGTVRQSRSFQVIDAVRGTAENIAEFTFLGTQGSLIIFGSVTKSPATEKGAVRVDVTFDSFVVKLGSVTFPSVSLNWISPKGWIETTFLDENFRIGRGDKGSIFVAVRAK

SEQ ID NO: 35225 - protein, 713 aa, Saccharomyces cerevisiae YJM789
MTASVSNTQNKLNELLDAIRQEFLQVSQEANTYRLQNQKDYDFKMNQQLAEMQQIRNTVYELELTHRKMKDAYEEEIKHLKLGLEQRDHQIASLTVQQQRQQQQQQQVQQHLQQQQQQLAAASASVPVAQQPPATTSATATPAANTTTGSPSAFPVQASRPNLVGSQLPTTTLPVVSSNAQQQLPQQQLQQQQLQQQQPPPQVSVAPLSNTAINGSPTSKETTTLPSVKVPESTLKETEPENNNTSKINDTGSATTATTTTATETEIKPKEEDATPASLHQDHYLVPYNQRANHSKPIPPFLLDLDSQSVPDALKKQTNDYYILYNPALPREIDVELHKSLDHTSVVCCVKFSNDGEYLATGCNKTTQVYRVSDGSLVARLSDDSAANNHRNSITENNTTTSTDNNTMTTTTTTTITTTAMTSAAELAKDVENLNTSSSPSSDLYIRSVCFSPDGKFLATGAEDRLIRIWDIENRKIVMILQGHEQDIYSLDYFPSGDKLVSGSGDRTVRIWDLRTGQCSLTLSIEDGVTTVAVSPGDGKYIAAGSLDRAVRVWDSETGFLVERLDSENESGTGHKDSVYSVVFTRDGQSVVSGSLDRSVKLWNLQNANNKSDSKTPNSGTCEVTYIGHKDFVLSVATTQNDEYILSGSKDRGVLFWDKKSGNPLLMLQGHRNSVISVAVANGSPLGPEYNVFATGSGDCKARIWKYKKIAPN

SEQ ID NO: 35226 - protein, 452 aa, Populus trichocarpa
MGSLQHFLNSPISVPFSPNLNHRRSFFLRACLNLDVHAPDSVKPKTHLKSREVMEMEGKVLVGTYARNPVVISSGKGCKLYDPEGREYLDCTSGIAVNALGHGDPDWVKAVVEQANLLTHVSNVFYSVPQVELARRLVACSFADRVFFTNSGTEANEAAIKFARKYQRFTNPDEKQQVTEFISFSNSFHGRTMGALALTSKEQYRFPFEPVMPGVNFLEYGDVQAATELIKSGRIAAVFVEPIQGEGGIYSATKEFLQSLRSACDDAGSLLVFDEVQCGLGRTGYLWAHEAYGVVPDIMTLAKPLAGGLPIGAALVSEKVAAAIKYGDHGSTFAGGPLVCNAAIAVLDKISKPGFLASVSEKGQYFKELLIHKLGGNSHVREVRGLGLIIGIELDVSASPLVDACRDSSLLILTAGKGNVVRLVPPLIISEQELERAAEIILECLPALDKTS

SEQ ID NO: 35227 - protein, 520 aa, Chlamydomonas reinhardtii
ASTVAASGGVVSGDAETGDSADPSSSSPEQWVLRSGPPIEDDYALGRVLGQGSYGVVRLATRLSTGEPVAVKTIQKTGLVSNPTSLSALRREVEILHHLAGHPHIGQLYGAYEDCKCLHLVMELYEGGDLYDAVVGVGRHSERAAADVMRAVLTAIGYCHAMGVAHRDIKPENFMLSAPTQQQKVEAEAAPMASVSGAHADESTLRDAVGTSYYVAPEVLEANGYGRAADVWSAGIILHVLLARGHGFWAGGLSIFVINVLTSRALVGVPDSTGDPLWTSLSPAAVDTLAAMLDRNPATRATADQVLSSPWLGRTAAECTAPSTPLPGVVSERLRKFAKLNSTQTGNLLDWVLQEARRLVATAMRSEEVAGLRAAFKALDLDGDGKLSAEELRVSEALGRCRRAGAPLQDAVRCWSWGCHRSDLDGDGMLDESEFLASPSVHGGSLAAPGRARSHNPLAAAFAALDKDGSGFITADEIEAVLAAHHPNGRAHGPDVQAMLAAADTDADGRISYEEFLAML

SEQ ID NO: 35228 - protein, 235 aa, Glycine max
SARVPLLGGLLSVWYSDFFQAQTHLVAPFDQYLHRFPAYLQQLSMESNGKTITSDGSSAKYTTGPILFGEPCTNAQHSFFQLVHQGTKLIPTDFILAAKSHNPVSDNLHQKMLASNYFAQAEALMVGKTDDQVRAEGTPEELVPHKRFLGNRPTTSILVGGAIGPAELGALIVYYEHLTFTEGAIWDINSFDQWGVELGKVLAKKILKELDEAGNGEGPHASTGGLIGAFKKYGN

SEQ ID NO: 35229 - protein, 309 aa, Rhizobium leguminosarum bv. viciae 3841
MADLQATLDSIYADIQPRIGEGKVADYIPELAKVDPQQFGMAIVTVDGKVYRVGNADTAFSIQSISKVFMLTLALGKVGEGLWKRVGREPSGSAFNSIVQLEHESGIPRNPFINAGAIAVSDVVMAGHAPREAIGELLRFVRYLADDESITIDDKVARSETQTGYRNFALANFMRAYRNLDHPVDHVLGVYFHQCALSMSCEQLARAGLFLAARGSNPTTGHSVVSPKRARRINALMLTCGHYDGSGDFAYHVGLPGKSGVGGGIFAVAPGIASIAVWSPGLNKVGNSQLGAAALEMLAARTGWSVFGD

SEQ ID NO: 35230 - protein, 475 aa, Mesorhizobium loti MAFF303099
MSKSRRPASDATAGDARMSQERSDTLVLFGATGDLAHKKIFPALYQMVAKGTLTEPVIGVAFDAWDIKQLQARARDGIVNALGKIDEKVFAKFASLLRYVSGDYRDPATFEKLKTALGTAQRPLHYMAVPPTMFETVVQGLEQSGTARGARLMVEKPFGHDLQSARWLNRVLHLVFDEQSIFRIDHYLGKEAIQNLLYFRFANSFLEPIWNRNFVESVQITMAEDFGVEGRGRFYDDVGCIRDVIENHLLNILLLLAMEPPVGRSADDLIDEKVQVLRAIRTLTKDDVVRGQFTGYLAEPGVAPNSPVETFAAVRFFVDTWRWQDVPFFIRAGKNMPVHVTEVVVRLKRPPLDVFDPIKPADQNYVRFRIDPQVVIAIGAQRKAPGDDMVGEQVELTALDDSKADMPPYERLIGDAMNGNGQLFTRQDAAELAWRIVGPVLGDTTPPHLYEPKTWGPAHAMAGFGPPNGWIDPVA

SEQ ID NO: 35231 - protein, 426 aa, Ashbya gossypii ATCC 10895
MLTAMDGNNRDKRVAIVGAGPAGLAAARVLLANTKLQVTVFEQAPQIGGVWYYNDGDKESAMYDHLETNLPKQIMAYSGFPFPDYDSVFPPRTRVLEYLLLYYRAFVEGRAQMCFNTQVTSLEKIIDKNKWQVITSMGKKSTFDYVVVANGHFRTPNLPDDIPGWAEWAQLAPHASIHSTQYTNCAEFRDKTVVVVGNGSSGVDIANQISSVAGTVYHSVRDPSKASWPPESPIRVVGAIQNMDAARRTLYFQHGQVVPDVDQVIWATGFRFHFPFLKSYRGVLFPEDSPSGVTRICGLWEHLIFAEDPTLAFPLLNQGVVTFPLAESHACLIAQVFSGRIPREQMPPVETSAGKSVMSPDDVLYYRHINEILLAHGGEQDPFRPVIWDDKMLKLRIDGKEAKTRRNFELVHRSLNLRKLGLPYSL

SEQ ID NO: 35232 - protein, 437 aa, Ashbya gossypii ATCC 10895
MAISKVYARSVYDSRGNPTVEVEVTTENGTFRSIVPSGASTGVHEALELRDGDKSKWLGKGVTKAVSNVNDIIAPALLSANVDVKDQKAVDALMLTLDGTPNKSKLGANAILGVSMAVAKAAAAEKKVPLYQHLADLAGSSTTPFVLPVPFLNVLNGGSHAGGALALQEFMIAPTGAESFSEALRMGSEVYHNLKSLTKKRYGASAGNVGDEGGVAPNIQTAEEALDLIVDAIKAAGYEGKIDIALDCASSEFFKDGKYDLDFKNPESDSSKWLSGQELADLYKKLVEKYPIVSIEDPFAEDDWEAWSHFYKNAGVQIVADDLTVTNPTRIATAIQKKAADALLLKVNQIGSLTESIQAAKDSFDATWGVMVSHRSGETEDTFIADLVVGLRTGQIKTGAPARSERLAKLNQLLRIEEELGSKAIYAGKKFHNANKL

SEQ ID NO: 35233 - protein, 427 aa, Ustilago maydis 521
MSSTIYQATCSAPVNIAVIKYWGKKDTTLILPTNDSLSVTLDQDHLRSVTTARADASFGSQDRLWLNGEEEAIKADGRLRRCIDEMRKLRQAKESKDSNLAKLSEWAVHVCSENNFPTAAGLASSASGFAALIASLAALYELQPEVSSSELSRIARQGSGSACRSLFGGYVAWQGGEHPSGQDSLAVQVAPQSHWPDLQALICVVSDAKKGTPSTAGMQRTVQTSPLLQHRIKEVVPQRMIKISEAIQKQDFNTFAEITMADSNNFHACCLDTAPPIFYMNDVSRAIVQLVEELNRANEADGKGKLVAYTYDAGPNAVLYAPKDNMPRILQTIRHYFPNADFDDTFDLLGKGVNASHRGAQEARGLPESLPSSFHANVIPVHEAGAVRRLIHTQVGDGPRVLERGVGKESLLNENGEPIRLQRAKRA

SEQ ID NO: 35234 - protein, 295 aa, Haemophilus influenzae Rd KW20
MKAVIPVAGLGTRMLPATKAIPKEMLTLVDKPLIQYVVNECVAAGIKEIVLVTHSSKNAIENHFDTSFELETMLEKRVKRQLLEEVRSICPKNVTIMHVRQGNAKGLGHAVLCGRPLVGNESFAVMLPDVLLAEFSADQKKENLAAMIQRFNETGASQIMVTPVPQENVSSYGVADCGGIELNGGESAKINSIVEKPSIEDAPSNLAVVGRYVFSAAIWDLLEKTPIGVGDEIQLTDAIDMLIEKETVEAFHMTGETFDCGDKIGYMEAFVEYGIRHEKLGKEFKSFIKNLAKTL

SEQ ID NO: 35235 - protein, 318 aa, Blastopirellula marina DSM 3645
MAILITGGAGFIGSHLIERLLVQSSDDLICLDNFNDYYDPALKRANAALFDDQPRVTQIEADFCDSNAMESLFTQHQIKSVVHLGAYAGVRVSVAQPQLYQQTNVGGTLNLLETVRRHPVQRFLLASSSTVYGRGAAIPFAEDAPHGVPASPYGATKRAAELLGLTYAELHQTPVVCLRPFSVYGPRLRPDLALTIFAKAIHTGATIPLFGDGTIRRDFTHVSDICDGLIAALTAENVIGETINLGHSEPIEMRGLIALLENAFGKKANIERLPERPEDLPVTFANLQKAQRLLNYEPQVPIEVGIRDYVAWFQSWYA

SEQ ID NO: 35236 - protein, 1153 aa, Physcomitrella patens
MESMSTVAPAPSTAATEEVGPEVAILFVGVALFLGMVSRHLFKGSRIPYTVVLLLLGIGIGGLEYGVKNLGVLGDSIRMWSNIDPDLILFLFLPALLFESSFAMDFHQIKRCFFQMLLLAAPGVLISTFLLGVATVKVFPYNWNWSTGLLLGGLLSATDPVAVVALLKELGASKKLSTLIEGESLMNDGTAIVVFRLFLQMVLGKHFSAGDVVSFLSRVVFGAVALGLLFGIVSVIWVGRVFNDTVIEITLTLTASYMAFFVAEESASVSGVLTVMTVGIFFTAFARTAFTGESAQSMHHFWEMISYIANTLVFLLSGVVIAESILRSQDKIQGRDWGYLLLLYLFVQISRAMVVGLLYPGLKYFGYGINWKEAIVLIWAGLRGAVALSLSLSVAQVGQHDPTQNTYLSKLTEARFVFFTGGVVLLTLIINGSTTQFLLLFLKMDTITETKSRMLEFAKYEMYSKALEAFGELGDDEELGPADWNTIRKYVSCLSYEENKPTHPHGPPSFALPDGEYAKQQMTDTRTRFLNGLQAAYWNMLDEGRITQTAALILMQSIDEALDKVKHHTALQDWEGLRPHIHFPGYLKYFSWRSTSVLPRRASTYFLIQQLELACYIAAAFLRAHRMTRNHLRDFIGESEVTEAVIQESEAQAQHARLFLEDVRLSFPQVLRAVKAKQVTHAILLHLTTYVESLENAGLFESKEAVHLHDAVQIDLKKLLRDPPIVEMPSAEQTLQNQPFIGAMPTSVQKPLLDVSKEYMKLQGSVIYREDMKSDGIWLITNGVVKWSKKAVGGQRLRQPTFSFGSTLGLYEVLTGKPYLCDVVADSVVHCFFVERSRILFIQKERADLEDFLWQESALAVAKIVLGPQFDMATLQDIRALVMEGSSMRIFLRGEVFELRHKEMGLLLEGFVRQENSTELITAPAGLTAKILLPSPTGSWSNISLQQPTVFHAEARSRVLLFESSKVGEILSQGSSQLLAVPRKTSRSMLRLSSKTSTNTRTKVDRHSSHNEIRIASDHSIPIAQAWGSGSSCVPDKYTAKALEISVFGSEVDVRDKRRADEIPLDAQSRFTQSHSNLVKRVSLMMQERFDNKQTSMPKRKIASQENMTVPMSLLPHQSEPKPDDSSDDSDKEEHIVRIDSPSFLFHNSRREL

SEQ ID NO: 35237 - protein, 131 aa, Haemophilus influenzae
DFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKAAKDESAVAKHFAALSTNAKDVEKFGIDTNN

SEQ ID NO: 35238 - protein, 269 aa, Xanthomonas campestris pv. vesicatoria str. 85-10
MVRLRSWRRQQCDNPAMSESPYTSGTTHFGFRDVAAKDKQKLVGEVFTSVARNYDLMNDLMSLGVHRAWKRYFVATAQVKPGDCVLDLAGGTGDIAVLLKERVGNEGAVVLGDINAGMLSVGRDRLTNRGLVSGFDYVQCNAEALPFPDQSFDLVTISFGLRNVTDKDAALREMYRVLKVGGQARVLEFSEVTAEWFKPIYDFHSFKILPKLGQLFARDADSYQYLAESIRKHPPQESLKGMMGEAGFARCHFKNLTGGIVAIHSGYKI

SEQ ID NO: 35239 - protein, 131 aa, Haemophilus aegyptius
DFCQRIISGEWKGYTGKAITDVVNIGIGGSDLGPYMVTEALRPYKNHLNMHFVSNVDGTHIAETLKKINPETTLFLVASKTFTTQETMTNAQSARDWLLKAAKDESAVAKHFAALSTNAKDVEKFGIDTNN

SEQ ID NO: 35240 - protein, 480 aa, Chromobacterium violaceum ATCC 12472
MIPCILSGGAGTRLWPVSRMELPKPFIRMADGHSLLQKTFQRAARLPGVRRVMAVTNQQAMFRTLEECSEVNERQLALELLLEPAGRNTAPAIAAAALDMLERQEGSEAILLVLPADHLVTDEEAFAAAVQEAWELAEAGRIVAFGLKPSRPETGFGYIEQGEPLAGKGFEVARFVEKPDAAAAQAYLDDGRYWWNSGMLCFSALVMCDALARLAPEVLDGVEACLRASPCLSGAGRRQRELDKASFALCPDISIDYAVMEKTDNAAVVPCDLGWSDIGNWDSLMGEFPADGNGNSSSGEVLLCDTRRSFVQSRGRLIATLGVDDLLIIDTPDALLVADRKRSQDVRDIVAELKRRGHPAYLQHRTSQRPWGHYTVLEDGPRYKIKRIVVKPGATLSLQMHHHRSEHWVVVSGTALVVNGEDEKLVHCNESTFIPAGVRHRVANPGVIDLVMIEVQSGDYLGEDDIVRFSDHYGRSESAG

SEQ ID NO: 35241 - protein, 228 aa, Novosphingobium aromaticivorans DSM 12444
MPRLILIRHGQSQWNLENRFTGWWDVDVTEKGAAEAFAAGKLLKDKGVLPTLAFTSLQTRAIKTLHLALEAAGRLWVQEDKDWRLNERHYGGLTGLDKAETAAKHGDEQVKVWRRSFDVPPPPLEAGSEFDLASDPRYDGIAVPATESLKDTIARVLPCWEEKIAPALRAGETVIVSAHGNSLRALVKHLSGISDEDITGLEIPTGQPIVYELDNDLAQVERYYLSER

SEQ ID NO: 35242 - protein, 892 aa, Oryza sativa
MAFHVACPITCRRVCDCELGFGAAGRGRGGGLAEAAAALEGFLADPWLLRPAAAGEGVGVEEEGGVATVQVEVPPVEAAEEGEEEAGRAAVLRQAAAAEDYARRLEGAAAAAYGSQEEGDEEDWGQEDVGNAAVKVMCRICFSGENEGSTKAAKMLPCKLCNKKYHRSCLKNWGEHRDLFHWSSWVCPSCRSCEVCRRPGDPNKLMFCKRCDGAYHCYCQQPSHKNVTHGPYLCPKHTRCHSCGSGVPGSGHSTRWFLGYTCCDACGRLFVKGNYCPVCLKVYRDSEVIPMVCCDVCEKWVHIECDGISEEKYQQFQSDQNLQYTCGACRGECSQIRDTEDAVRELWKRRDVVDHDLMASLRAAAALPSLEDVSPSHPNSDDEKLGAYVMKNDGRNTLKFSFKSNSTKPALDSSEQEKNAIKSSGSNKKHSKKKGNQNNKTVSEQDEIFLEKRNETKSLGSLGDQIADVTRDKSSFKNDADAFVLSSAQSAEKALKLQSAKAAAHNADMIPKVKIKGTKVPSLHFKDVGEENAAKSDTGKGTKLVIHIGSRHKSRSGSPKSEMSNSQKEQELVSMHGGKVDVTSQFKSSRSEIKEKSVMKLVRETGVQQNSLLGDLGASKKHATGKRSNAIVSAMENASESGTRSRSFGQKQSVNHLTENQGNASFSVNNSPDSLKPSLLKLKFKRPIFEQPSTQSSQPEEPGTWASPQEELNVAKGQRSKRKRPSLDKMDGSESKAPAAKRHEQSTGEEAMDANWILRKLGKDAIGKRIEVQLASDGKWHQGVVSNVINGTLCLQLDNGRSENIELGKRAIRLIAQSQLPATRVVSRPLQAPAFGSSQSLIHGRLGGLKRIGFILTSGSVGTNNWEGFLGATLDVEEMPDDGHVHVAVAAE

SEQ ID NO: 35243 - protein, 873 aa, Arabidopsis thaliana
MGLNLNPILRQELANLDKDTESRKSAMKALKSYVKDLDSKAIPGFLAQVFETKETNSLSGEYTISLYEILARVHGPNIVPQIDTIMSTIVKTLASSAGSFPLQQACSKVIPAIARYGIDPTTTEDKKRVIIHSLCKPLTDSLLASQESLTSGAALCLKALVDSDNWRFASDEMVNRVCQNVVVALDSNSNQTHLQMGLVMSLAKHNPLIVEAYARLLIHTGLRILGFGVSEGNSQKRLSAVQMLNFLMKCLDPRSIYSEVELIIKEMERCQSDQMAYVRGAAYEAMMTSKRIAAELESKMEKGCRSVTGSNFSRRNCSSIVPDYSLSPESQTLGSFSGYDSPVESSPISHTSCNSEFDRRSVNRKLWRRDENGGVVDISLKDGLFSRVTKGSTTVSDSPLVPYDTCENGDEFEGFLMESLRNTTPSPQRQRSRRINAEDFNIFSTPRKLISSLQYPDDVDLDHSDIQSPILRGEREKTIGSRKNPKLRKQFPTMVETMSSTITVSEDTAQTQMITGKKKKKKMSYAKLVIAISFVVVALFATVILMNRFKVDNFFRFNQTGSSNLLASRKGTIYSLVKGFAHIRLMMTNSDSDHCTPAKTSISGDGLEKESDFKKQLNSEIDPQASSSQNDAITMEDGAVSVNNRDLQEIKESSFSKGSEQYRVDGALEESLNFEEKEQESEAQRLLEAEKRRLLAEIELGSIFRKSVDVDTLPKIEETMDNDVDKIELVDHTALVDVVHHPKRPGTAQNEKDTPRKLKKIGDKRNVIEGSGVENNGKQFRRLYTRKQLESMRFAHIVNQKNLWSEMYSRILPEVVTEYESLVYVKNYKSSKSNRVRGRTESGNGNLDNLADALFVSYSLHSSPDCFVFLVVG

SEQ ID NO: 35244 - protein, 454 aa, Streptococcus pneumoniae R6
MKVVKFGGSSLASASQLEKVLNIVKSDSERRFVVVSAPGKRNAEDTKVTDALIKYYRDYVAGNDISKSQSWIIDRYAAMVSELGLKPAVLEKISKSIHALATLPIEENEFLYDTFLAAGENNNAKLIAAYFNQNGIDARYMHPREAGIVVTSEPGHARIIPSSYDKIEELTNTNEVLVIPGFFGVTKENQICTFSRGGSDITGSIIAAGVKADLYENFTDVDGIFAAHPGIIHQPHSIPELTYREMRELAYAGFSVLHDEALLPAYRGKIPLVIKNTNNPDHPGTRIVLKHSNDEFPVVGIAGDSGFVSINMSKYLMNREVGFGRKVLQILEELNIGWEHMPTGIDDLSIILRSRQLTPIKEEEILRQLVQKAKVDHAEIEHDLSIIMIVGEKMKSHIGVTATATRALSENKINIQMMSQGSSEVSIMFVVNKDQEKAAIKALYNAFFGESKED

SEQ ID NO: 35245 - protein, 511 aa, Populus trichocarpa
METLPFLLTLAAATSVYLLWFYLLARKLTGPKVWPIVGSLPLLFVNRRNFHDWLAANLRATGGAGTYQTCTIALPFFARKQGFYTVTCHPKNMEHILRTKFDNYPKGPEWQTAFHDLLGQGIFNSDGETWLIQRKTAALEFTTRTLRQAMARWVNQTIKNRLWNILDKAVTEKHSVDLQELLLRLTFDNICGLTFGKDPETLSPEMPENPFAIAFDTATEATLQRLLYPGILWRVEKLLGIGAERRLKKSLEVVETYMDDAIAARKENPSDDLLSRFMKKRDVEGNHFPISVLQRIALNFVLAGRDTSSVALSWFFWLVMNHPEVEAKIIKEISAILTETRGNDRQKWLDEPLVFDEADKLVYLKAALAETLRLYPSVPQDFKYVVENDVLPDGTHVPAGSTITYSIYSVGRMKSIWGEDCMEFKPERWLSPEEDKFEPPKDGYKFVAFNAGPRTCLGKDLAYLQMKSVASAVLLRYRLSLVPGHRVEQKMSLTLFMKNGLHVLLHPRTLA

SEQ ID NO: 35246 - protein, 300 aa, Arabidopsis thaliana
MIISSEENLGTEEGTEDPEDYTDDNDDYNSILRPAFEVDGEPDFSTGPPEDGLEYLRRVRWEAKGIPNVRVAKIDESTYIKKEQSVYMPLIPEIPKCPEYLLPMKEWEDSLLLDFVHLRQTLTQSANSCEDEIISSQCVEDLLVEMFNKHLHTEEDESFGEVVTDIQGMDSVTRVSKLKKRICLVEKESGLQSSDCKWVVALCASLETPLDADTCACLRGLLRKCASVRAETSLEVGDEEVITMANMLITIAGRYFGQMGHVPFVMSSVMFGIIVFVRSKLFFFGILLRLLRSSQLPWIG

SEQ ID NO: 35247 - protein, 380 aa, Oryza sativa Japonica Group
MAASSARLLAAAARGRAATTFRHAPTVSSSLSFPPNPHHRPSLRGRAGISFSSTSISLPSGSPHGASAPFNLFPPDSDPFIQWDPPPPDAASPLGAGAAGREAPGDLTLVVLLGWLGARQKHLRRYADLYRDRGVGSVRFVVPVRELLGLDLGRRVERRVADLAAEIAAWCDADHRRTLLFHTFSNTGWLAYGAILENLQSRADIIERIRGCIVDSAPVLEIRPEVWAAGFSAAMLKKSSSMTGPSVESPDGYTSNGTLNNLSSDVTRPTWGENILLSTLQKFFEIVLHLPDVNKRLEKVHSVLSEKQPTCPQFYLYSSADRVIPAECVERFIDMQKSLGQSVFAHNFVSSPHVDHYRSFPHVYAAKIDEFLKICSIARV

SEQ ID NO: 35248 - protein, 382 aa, Physcomitrella patens subsp. patens
MVTPKTHSIRVVHAALVIVQLGYAGLQMFSRVALDAGLNQFILSMYRNIIAFAILGPVAYYYEREKRPPTSWKIFGWLNLLSLTGVVGSQQLFLAGLQYTTPLMAAVSQNMIPVATFLLAAALGLEDVNLRRREGIAKVVGTVVCISGAVIMSVYKGLALFGGGNDTPDAGITRPFENLGAFLHPDIVQFSVKKFHLGIFYLIMNCVSWAVYLTCQAPVMKMYPALLSMTAGTYFFGWIQVGILGVISAGKLHFANFRLTSMAQIIGVLYAALIASTLNLLLQSWCVQKGGPFIVSLYVPLQMLMVAVLSVMLLNDTLYMGIILGGLLTVAGFYFVVYGQRLERRRKRLVFARKIEPHHDVLKIDIRQMSLDLKKHLLDDDN

SEQ ID NO: 35249 - protein, 65 aa, Physcomitrella patens subsp. patens
NKKSPMELIQEVPPIDVDARIAACEGGTDPALGHPIEYISLDGVGPHVCKYCGLRYNQRNAHGHH

SEQ ID NO: 35250 - protein, 451 aa, Physcomitrella patens subsp. patens
MVLPEVGRKVLNPHPCDGYTVPPPPADPKRTGPRPCPVCYLDEEGALSQLPVEGKYDSPVLKRLSFMSDPAAAKRPSSGAPGSAFGGYPSLEERAASFDVREEMKVHCGFVKGPTPGLGTGYDIDEENREAMLACRGVVVASAIFGNYDQLQQPKNITDESKRSVCFFMFVDEETEASLNDYDNFKSSKQVGLWRVVVVHNLPYRDARRTGKIPKLLLHRLFPNVRFSIWVDGKLELVQDPYKILERFLWRTNETFAISQHYKRFDVFMEAEANKAAAKYNNKSIDSQIDFYKKEGLTPYSAAKLPITSDVPEGCVIIREHTPIANLMSCLWFNEVDRFTSRDQLSFGIVRDKLMAAVPWRVSMFKDCERRNFVVQGYHRDLLVKRGLLPVANSSGVAEVKEIKTKPGAVVSKPMTKDQVPSENQSSSSRQRVKDESRRIGLRRLAHYMDI

SEQ ID NO: 35251 - protein, 262 aa, Oryza sativa Indica Group
MALFLKIIVTEKVPNELLYGRAGYLWACLFLNTHLGEKTIPHEHITSVAKDIIDEGRKLAKKGNCPLMYEWHGKKYWGAAHGLAGIMHVLMHTELKLDEKDDVKNTLLYMIRNRYPTGNYPSSEGSESDRLVHWCHGAPGVALTLAKAYQVFHDEHFKQTAAEAAEVVWNRGLLKRVGICHGVSGNAYVFLSLYRLTGNVEYLYRAKAFACFLLEKADQLIADGAMHGGDHPFSLFEGRAGMAYLLLDMVSPSESKFPAYEL

SEQ ID NO: 35252 - protein, 487 aa, Photobacterium sp. SKA34
MKSLQQLVFNNTYSQLPSLFGTFVTPQPLSNPYLMSVNPHIAKLLELDINAIQSDDFINIFSGNDTLAGFDPIAMKYTGHQFGQYNPDLGDGRGLLLGEVQTSQGKKWDIHLKGSGLTPYSRMGDGRAVIRSSIREYLASAAMAGLGIPTSHALAVIGSDTHVYREKQEFGATLIRVSESHIRFGHFEYLFYTQQHDQLRLLADYVIQHHFPECQQVEKPYAALFEQVCENTAKMIAHWQAVGFAHGVMNTDNMSILGLTFDYGPYGFLDDYNPGYICNHSDYSGRYAFNQQPSIGLWNLSALGYALAPIIDKSDIEHALEIYQHQLQMHYSKLMRQKLGLFDSQEQDNELFQQLFNLLKQQSIDYTQFFRTLSTLSQDELDNTSSHFSSLTANTTPIDEWLADYKKRISNTDDQQRLALMLKSNPKYILRNYLAQLAIDGAEQGNFTFIENLLTVLHDPFGEHPNFEDLADLPPKWGKELEISCSS

SEQ ID NO: 35253 - protein, 389 aa, Pyrococcus horikoshii OT3
MALSDRLELVSASEIRKLFDIAAGMKDVISLGIGEPDFDTPQHIKEYAKEALDKGLTHYGPNIGLLELREAIAEKLKKQNGIEADPKTEIMVLLGANQAFLMGLSAFLKDGEEVLIPTPAFVSYAPAVILAGGKPVEVPTYEEDEFRLNVDELKKYVTDKTRALIINSPCNPTGAVLTKKDLEEIADFVVEHDLIVISDEVYEHFIYDDARHYSIASLDGMFERTITVNGFSKTFAMTGWRLGFVAAPSWIIERMVKFQMYNATCPVTFIQYAAAKALKDERSWKAVEEMRKEYDRRRKLVWKRLNEMGLPTVKPKGAFYIFPRIRDTGLTSKKFSELMLKEARVAVVPGSAFGKAGEGYVRISYATAYEKLEEAMDRMERVLKERKLV

SEQ ID NO: 35254 - protein, 230 aa, Photobacterium sp. SKA34
MKNTRIVLLRHGQSVWNKENRFTGWANVSLSELGETEARNAGIKLKENGFNFNFCYTSMLDRAIKTSNLALEQLDSLWIPVEHDWQLNERHYGDLQGLNKTETAEEFGDEQVHIWRRSYDIEPPQVSEDSFFYPGNDRRYQELQHSQLPHGESLKDTYDRVIPFWNENIVPNVKQGSDILIAAHGNSLRALIKYLDNIPDDKITELEIPTGAPLVYEFNKQMKPVQSYYL

SEQ ID NO: 35255 - protein, 343 aa, Mesorhizobium loti MAFF303099
MTGEAVSGQDVSNPGKSSWRVTVLGGGAWGTALALAMLRAGHKVRLFARDPQTVAAIGQGQNPRYLPGIAIAPGIEATSDIAAALSGADCVLAVTPAQSLRATLAVAKDNMPDGIPLVLCAKGIERDTGALLSAIVEEILPRNPVAALSGPSFATDVARGLPTAVVVAARDEALAADLAARFSAQNLRCYSSDDLIGVEIGGALKNVFAIAAGAVTGAGLGASAQAAMVTRGFVELRRIGAAFGARPETLMGLSGLGDLLLTCSSAQSRNFAYGLTLGQGKALAGLPLAEGVPTAAIAARIAVERGIDAPIIAAVAAILDGAITISQAVTALMTRPLKTETND

SEQ ID NO: 35256 - protein, 404 aa, Mesoplasma florum L1
MNYNLKKTLKDINVKGKKVLVRVDFNVPLKDGVITDDNRIQAALPTIKYLVENGAKVILFSHLSRIKSEDDKKTKSLAPVAKRLEEVLAQSVNFVNQTRGTELETAINALNEKEVLLFENTRFEDVKDGEVVKAESKNDPELGKYWASLGDVFINDAFGTAHRAHASNVGIASNISESALGFLVQNEIEMLGKGIDAPERPFVAILGGAKVSDKIGVIDNLLTKVDKILIGGGMTYTFHKAMGLEIGNSLLEADKVELAKEYLEKANGKIMLPVDSLCAPEYADVAPTLCGENVPAGMMGLDIGPKTIEMYEKELANAKTVVWNGPMGVSEFENFKAGTVAVCEAAAKRKADGGFTLIGGGDSAAAAIKLGFKDEFSWISTGGGASLEYMEGKELPGIAAIQNK

SEQ ID NO: 35257 - protein, 229 aa, Pyrococcus horikoshii OT3
MNVEEMKKIAAKEALKFIEDDMVIGLGTGSTTAYFIKLLGEKLKRGEISDIVGVPTSYQAKLLAIEHDIPIASLDQVDAIDVAVDGADEVDPNLNLIKGRGAALTMEKIIEYRAGTFIVLVDERKLVDYLCQKMPVPIEVIPQAWKAIIEELSIFNAKAELRMGVNKDGPVITDNGNFIIDAKFPRIDDPLDMEIELNTIPGVIENGIFADIADIVIVGTREGVKKLER

SEQ ID NO: 35258 - protein, 337 aa, Mesoplasma florum L1
MSKKVAINGFGRIGRLTFRQLFNQGVEIVAVNDLTDTKTLAYLLEFDSAQGKFQEGKISYTDNSIIVNGKEIKIFAERNAADLPWGKLGIDLVIESTGFYTDKEKASAHLTAGAKKVIISAPATGEMKTIVYGVNHKNLSAEDVIISGASCTTNCLSPVAKIMDEKFGIVKGKMVTVHAVTNDQKLLDLPHGDLRRGRAAAWNIVPSTTGAAKAVSLVLPNLKGKLDGYALRVPTITGSITDVTLQLSKKTTVEEINATVEAAIKADAELSKAIKFNTQQIVSGDTIGSSFGSIFDATLTKITEVDGEQLVTVCAWYDNESSYVSQLVRTTIYFMGL

SEQ ID NO: 35259 - protein, 131 aa, Haemophilus parainfluenzae
AFCYRVISGEWKGYTGKAITDVVNIGIGGSDLGPYMVTEALRPYKNHLNMHFVSNVDGTHIAETLKKVNPETTLFLVASKTFTTQETMTNANSARDWLLAAAKDNSAVAKHFAALSTNGKAVAEFGIDTNN

SEQ ID NO: 35260 - protein, 289 aa, Physcomitrella patens subsp. patens
MNQDKDDDIALGTNKYGDRSALGTHAPVPEKDYTEPSVTPFFDGSEFRRWSFWRAGIAEFIATLLFLYITIQTVMGHKRSADPCLGVGIQGIAWAFGGMIFALVYCTAGISGGHINPAVTFGLFLARKVSLNRALFYMIMQCLGAMCGAEIVKGFQPNFYQEQGGGSNSVAHGYTKGDGLGAEIVGTFVLVYTVFSATDAKRNARDSHVPVLAPLPIGFAVFLVHLATIPITGTGINPARSLGAAVVFNKQNNAWADHWIFWIGPMLGAALAAAYHTLVIRALPFRKRV

SEQ ID NO: 35261 - protein, 131 aa, Haemophilus parainfluenzae
AFCDRVISGEWKGYTGKAITDVVNIGIGGSDLGPYMVTEALRPYKNHLNMHFVSNVDGTHIAETLKKVNPETTLFLVASKTFTTQETMTNANSARDWLLAAAKDSSAVAKHFAALSTNGKAVAEFGIDTNN

SEQ ID NO: 35262 - protein, 131 aa, Haemophilus parainfluenzae
AFCERVISGEWKGYTGKAITDVVNIGIGGSDLGPYMVTEALRPYKNHLNMHFVSNVDGTHIAETLKKVNPENTLFLVASKTFTTQETMTNANSARDWLLAAAKDNSAVAKHFAALSTNGKAVAEFGIDTNN

SEQ ID NO: 35263 - protein, 660 aa, Bacillus sp. SG-1
MLNGKRISGRYKILEMIGGGGMANVYLARDMILDREVAIKMLRLDFANEEEFIKRFQREAQSATSLAHPNIVSIYDVGEEDDIYYIVMEYVDGLTLKQYIQKHSPISIEKTIDIMRQLISAIANAHQNHIVHRDIKPQNILIDHDGTVKITDFGIAMALSATSITQTNSVLGSVHYLSPEQARGGMATRKSDIYSLGIVMFELLTGRLPFSGESAVSIALKHLQSETPSLRRWNKDIPQSVENIVLKATAKDPFQRYDTVEEIEDDLRTALDPGRLDEPRFSIEEDMDATKAIPVITDDRPYSNNENTIVHDNNGADTAGTIPNNKANEGLPGKKKKKKWPAIIIGVFFFLALLGVLAVTVLPDMLGPKEVILPDVTGKSQEEAVEILALEGFLIGDYLDQANEEVPANQVIKTNPPAGATVKEGSEINLYVSTGKKRIKMKDYTEEAYEEAATELNELGFANIEKDPRYSEFEPGTILDQDPPEGSEVIPGETVVKFTVSAGLETFPLTDLKGYTENSLKDYGEFRGINININREFSEDVPEGMVISQKPEAGVKLVKGDSVDVVLSKGKEPQPPRTVKKEISIPYEPTEEGKPQNVEIYIEDQTRNIDEAEAIFAISEDYKETFELTIVEGETGHIRVVVDGEVVENIPVPYPENEEE

SEQ ID NO: 35264 - protein, 174 aa, Triticum aestivum
  misc_feature (23)..(23): Xaa can be any naturally occurring amino acid
MAPTVMASSATSGTPFQGLKSTXAGLPISRRSSSAGLSSVSNGGRIRCMQVWPIEGIKKFETLSYLPPLSTEALLKQVDYLIRSKWVPCLEFSKVGFVFREHNSCHGYYDGRYWTMWKLPMVWCTDATQVLNEVEEVKKEYPDAYVRVISIDNLRQVQCVSFIAFMPPGCEESG

SEQ ID NO: 35265 - protein, 368 aa, Xanthomonas campestris pv. vesicatoria str. 85-10
MKTRAAVAWGPHQPLTIEEVDLQPPRPGEVLVRLVATGICHGDAHALAHGHAGSFPAILGQEGAGVVEDVGIGVTSVRAGDHVIPLYMPECGVCKFCRSGRTNLCQAIRSSQERGLMPDGSSRFSLHRRPVLHHMGTSTFSEYTVLPEIAVARIHPDAPLEQACLLGCTVTTGVGAVLNSTHVRPGDCVAVFGLGGIGLSVIQGAVLAQAGRIIAVDIDPAKFALARKLGATDCLDPRDYGAPIQQVIVDLTDGGADHSFECIGDVGAMRAALECCHKGWGESVILGVAEDTQEISTRPFQLVTGRVWRGSAFGGVKGRSELPGYVERYLHGDIQLAPLITRTLALVDINQALADLRAARGIKSIVVY

SEQ ID NO: 35266 - protein, 311 aa, Arabidopsis thaliana
MASSTATMLKASPVKSDWVKGQSLLLRQPSSVSAIRSHVAPSALTVRAASAYADELVKTAKTIASPGHGIMAMDESNATCGKRLASIGLENTEANRQAYRTLLVSAPGLGQYISGAILFEETLYQSTTDGKKMVDVLVEQNIVPGIKVDKGLVPLVGSYDESWCQGLDGLASRTAAYYQQGARFAKWRTVVSIPNGPSALAVKEAAWGLARYAAISQDSGLVPIVEPEIMLDGEHGIDRTYDVAEKVWAEVFFYLAQNNVMFEGILLKPSMVTPGAEATDRATPEQVASYTLKLLRNRIPPAVPGIMASFL

SEQ ID NO: 35267 - protein, 282 aa, Novosphingobium aromaticivorans DSM 12444
MGKMLIFGMGYTAQVLARALRATGWEVHGTGSAGDIAFADRAAVEAALAGASHVLSSVPPAREGGDPVLDSYGPAIAASGVEWIGYLSSTGVYGDAGGAWVDESAPVGTGRRSARTAADLAWQALSPEVRVFRLPGIYGPGRSALDRVAAGRAHRIDLPEQVFSRVHVEDIASGVIASFDGPPGVYNLADDLPCGQNAVIEEAARLLGVPPPPMLTLEQANLSPMALAFYAENRRVANGRARRLLGWKPAFPTYREGLRDLRASTRPTIASAAPASASTDQR

SEQ ID NO: 35268 - protein, 333 aa, Novosphingobium aromaticivorans DSM 12444
MTRVPVLVTGGAGYIGSHAVLALKDAGWAVSVIDNLTTGFRFAVPEGVPFYEGDIEDAGLLARIIAEQGIKAVMHFAGSIIVPESVENPLKYYHNNTAKSRALIEAAVKGGVPHFIFSSTAATYGIPEVSPVTEDSPRRPINPYGMSKLMTETMLADVAAAHPLNFCVLRYFNVAGADPQARTGQSTAGATHLIKVAVEAALGKRASVGVYGTDYATPDGTGVRDYIHVSDLAAAHVLALEALIAAPDESLTMNCGYGRGFSVLEVLDAVDRVTNRRIAREMQGRRAGDPDSLISDNRRIRSTLPWVPQYADLDTIVAHALAWERKLDGIRGQ

SEQ ID NO: 35269 - protein, 348 aa, Chlamydomonas reinhardtii
MAAATGKARTALDETSKTGEFKRTDAGFRNQIAPGTRFEPEAGRYHLYVSLACPWACRCLAVLHMKGLTDAIGVSVTHPTWQRTRPEDPADEHTGWVFRAPGDAPLSSATGFGAFPCTGCVPDSINGATTVRQLYDMANDTTGKYSVPVLWDKKEKTIVNNESSEIIRMFNTAFNDVAKNPGLDLYPEALRAAIDDLNAWTYPAINNGVYRCGFATSQAAYEAAFEELFSALDRVEGILSRQRYLAGEVLTEADVRLFQTLIRFDEVYVVYFKTNKRFLREYPNIAGYVRELYQESGMKPAVDMYHIKTHYFTSHPKLNYYAVVPRGGEAWWEQPHDRAAKFPAAGKL

SEQ ID NO: 35270 - protein, 476 aa, Nostoc punctiforme PCC 73102
MTLQSFGVIGLAVMGENIALNVERNGFPIAVYNRSREKTDAFMAQRATGRNVKAAFTLEEFVALLERPRKILVMVQAGKPVDAVIAQLKPLLEEGDIIIDGGNSWFEDTERRTQELEPAGLRYLGMGVSGGEEGALNGPSLMPGGTTSSYEFLSPIFNKIAAQVDDGPCVTYIGPGGSGHYVKMVHNGIEYGDMQLIAEAYDLLKNVAGLNPSQLHDVFAEWNTTDELDSFLIEITKNIFPYIDPETNKPLVDLIVDAAGQKGTGRWTVQTALELGVAIPTITAAVNARIISSIKDERVAASKVLTGPSGKYDGQTKDFINKVRDALYCSKICSYAQGMALLSTASKTYNWNLDLGEMARIWKGGCIIRARFLNKIKKAFSENPALPNLLLAPEFKQTILDRQTAWREVIATAATVGIPVPAFSASLDYFDSYRRDRLPQNLTQAQRDYFGAHTYLRLDKPGSFHTEWVPIAEAGK

SEQ ID NO: 35271 - protein, 300 aa, Physcomitrella patens subsp. patens
MGEGSPFKDTVLKGKVALITGGGSGIGLEISTQFGLHGASVAIMGRRRHVLDEAVASLQSLGIQQAMALEGDVRKKEDARRVVETVVNAMGRLDILVNGAAGNFLVAPEDLSPNGFKTVMDIDTLGTFTMCHAAVEYLKKGGKGKDPAEIGGLIISISALLHYGANWYQIHVAAAKAAVDSLTRSLALEWGTDYNIRCNAIAPGPIADTPGMDKLNPKESELSAEQLGIPLRRVGEKWDIAMSAVYLAAETGKYVNGHVLVVDGGSWLAKPRPISKGQLRQFGRAIEQRSRTTKLPSSKL

SEQ ID NO: 35272 - protein, 217 aa, Oryza sativa
MQVVVSPPFVFLPQVKGLLRPDFSVAAQNCWVRKGGAFTGEISAEMLVNLQVPWVILGHSERRALMGESSDFVADKIAYALSQGIKVIACIGETLEQREAGTTMEVVAAQTKAIAEKISDWTNVVLAYEPVWAIGTGKVATPAQAQEVHDGLRKWLVTNVSPAVAESTRIIYRGSVNGANCKELAAKPDVDGFLVGGASLKPEFVDIIKSATVKSSA

SEQ ID NO: 35273 - protein, 245 aa, Triticum aestivum
  misc_feature (15)..(15): Xaa can be any naturally occurring amino acid
  misc_feature (18)..(18): Xaa can be any naturally occurring amino acid
  misc_feature (22)..(22): Xaa can be any naturally occurring amino acid
  misc_feature (40)..(40): Xaa can be any naturally occurring amino acid
  misc_feature (71)..(71): Xaa can be any naturally occurring amino acid
  misc_feature (101)..(101): Xaa can be any naturally occurring amino acid
KCRIGVDDRAPYEEXCTXVDKXVCKSPSRHFIIHARKALXSGLSPAENRKVPPLKYEYYYALLRDFPEVHXTLNGGLTTIEQVSASIRQGAHQVMVGRAAXYNNPWNMLGHVDSEIYGMPTRCSSRRQILESYQVYGDSIIGQYGISRPNVRQLVKPLLHLFHSEPGNSLWKRKADSTLRHCKTLVQFLEETLDAIPDSVLDAPVLMEPSREQDYFAHVDSLLPPRYTKLANGSYESPALVTASS

SEQ ID NO: 35274 - protein, 142 aa, Glycine max
  misc_feature (127)..(127): Xaa can be any naturally occurring amino acid
KSFVSEYPIVSIEDPFDQDDWVHYAKMTVEIGEQVQIVGDDLLVTNPTRVAKAIKEKSCNALLLKVNQIGSVTESIEAVKMSKRAGWGVMTSHRSGETEDTFIADLAVGLSTGQIKTGATCRSERLXKYNQLLRIEEELGAI

SEQ ID NO: 35275 - protein, 373 aa, Nostoc punctiforme PCC 73102
MNDTLNPKEQMSTKNIILFVLLLFIPVSLVAHFLEWGELIVFITAGLAILPLAAWMGTATEEIAVVVGPSLGGLLNATFGNATELIIALVALNAGLIDVVKASITGSIISNLLLVMGFSMLLGGLRYKEQTFQPIVARVNAASMNLAVIAILMPTAMNYTSQGINEQTLQNLSIAVAVVLILVYALTLLFSMKTHSYLYDVGVAEIEEEEAPHAKPNMMLWVSVLLVCTLLVALESEMLVDSLEVATSQLGLTALFTGVILVPIVGNAAEHATAVTVAMKDKMDLSLSVAVGSSMQIALFVAPVLVIAGRVLGQPMDLDFKPFELVAVVVSVLIANSISSDGKSNWLEGTLLLAAYTVLGFAFYFHPVMESMG

SEQ ID NO: 35276 - protein, 147 aa, Triticum aestivum
  misc_feature (46)..(46): Xaa can be any naturally occurring amino acid
  misc_feature (54)..(54): Xaa can be any naturally occurring amino acid
  misc_feature (60)..(60): Xaa can be any naturally occurring amino acid
  misc_feature (70)..(70): Xaa can be any naturally occurring amino acid
  misc_feature (75)..(75): Xaa can be any naturally occurring amino acid
  misc_feature (92)..(92): Xaa can be any naturally occurring amino acid
  misc_feature (102)..(102): Xaa can be any naturally occurring amino acid
  misc_feature (115)..(116): Xaa can be any naturally occurring amino acid
  misc_feature (135)..(135): Xaa can be any naturally occurring amino acid
  misc_feature (139)..(140): Xaa can be any naturally occurring amino acid
  misc_feature (144)..(145): Xaa can be any naturally occurring amino acid
MAPTVMASSATSVAPFQGLKSTAGLPVSRRSNGASLGSVSNGGRIXRCMQVWPXEGIKEXRALSYLPPLXTEASXKQVRLPDSAPKWVPCLXFSKVGFTFRXHNASPGYYDGRYXXLELPISRCTDPHKLFNEVXGGKXXYLDXXSA

SEQ ID NO: 35277 - protein, 332 aa, Oryza sativa Indica Group
MAASNIGMMDGAYFVGRNEILAWINTTLQLGLSKVEEAASGAVACQLMDAAHPGAVPMHKVNFDAKTEYEMIQNYKVLQDVFNKLKITKHIEVNKLTKGRPLDNLEFMQWMKRYCDSVNGGFMNSYNASERRESSKGGKETNRRTSVPSQAPAKSSSATHKAQALSHGAKKANGHAPNAPPSRSAKPSPANSAGPAYDEQITELKLLVDSLEKERDFYFSKLRDVEILCQSPEVEHLPIVNAIHKVLYAAEDDPSMVAEAQAMISQQQQSEQPMLSPILEASEERPAKQEAHKRKSISDLELEEFGMASSSRQRLSDISDVQLCGSPLTSFT

SEQ ID NO: 35278 - protein, 348 aa, Salmonella enterica subsp. enterica serovar Paratyphi B str.
MTVRIAINGFGRIGRNVVRALYESGRRAEITVVAINELADAAGMAHLLKYDTSHGRFAWEVRHEREQLFVGDDVIRILHERTLADLPWRELGVDVVLDCTGVYGNREHGEAHIAAGAKKVLFSHPGSNDLDATVVFGVNQNQLRAEHRIVSNASCTTNCIIPVIKLLDDAYGIESGTVTTIHSAMNDQQVIDAYHSDLRRTRAASQSIIPVDTKLAAGITRIFPQFNDRFEAIAVRVPTINVTAIDLSVTVKKTVKASEVNQLLQKAAQGAFHGIVDYTESPLVSIDFNHDPHSAIVDGTQTRVSGAHLIKTLVWCDNEWGFANRMLDTTLAMAAVGFRLDASASTKL

SEQ ID NO: 35279 - protein, 266 aa, Leptospira interrogans serovar Lai str. 56601
MQRASLHNLKIIGSEKETIVFSHGFGCDQSTWNKLIPNLKDHYRLVLFDTIGSGKTDPSLFSADRYSNLYSYAEDLILLMDELKIRNSLYVGHSVSGMIGLITSIRRPELFSKLAFISASPRYLNDTNYKGGFEQTDLDQLFAAMETNFFSWAGGFAPLAMGNPDRPELAQSFAESLREIRPDIGLTVSRTIFQSDHRKDLNQCKQPVLILQPSSDIAVPIEVGKYLSANIPQAIFKSIPATGHLPHFSSPESVLQEIKSFFKSLN

SEQ ID NO: 35280 - protein, 513 aa, Hordeum vulgare
MAMAAAASPSKILIPPHRASAVTAAASTSCDSLRLLCAPRGRRQRPRGLVARPVPRRPFFFSPRAVSDSKSSQTCLDPDASTNVLGIILGGGAGTRLYPLTKKRAKPAVPLGANYRLIDIPVSNCLNSNISKIYVLTQFNSASLNRHLSRAYGSNIGGYKNEGFVEVLAAQQSPDNPDWFQGTADAVRQYLWPFEEHNVMEYLILAGDHLYRMDYEKFIQAHRETDADITVAALPMDEERAAFGLMKIDEEGRIIEFAEKPKGEQLKAMMVDTTILGLEDARAKEMPYIASMGIYVISKHVMLQLLREQFPGANDFGSEVIPGATSTGMRVQAYLYDGYWEDIGTIEAFYNANLGITKKPIPDFSFYDRSAPIYTQPRHLPPSKVLDADVTDSVIGVGCVIKNCKIHHSVVGLRSCISEGAIIEDTLLMGADYYETEADKKLLAEKGGIPIGIGKNSHIKRAIIDKNARIGDNVMIINVDNVQEAARETDGYFIKSGIVTVIKDALLPSGTVI

SEQ ID NO: 35281 - protein, 810 aa, Oryza sativa Japonica Group
MKLRLRSMDQRGGAGGAAETHRVQLPDTATLSDVKAFLATKLSAAQPVPAESVRLTLNRSEELLTPDPSATLPALGLASGDLLYFTLSPLPSPSPPPQPQPQAQPLPRNPNPDVPSIAGAADPTKSPVESGSSSSMPQALCTNPGLPVASDPHHPPPDVVMAEAFAVIKSKSSLVVGDTKREMENVGGADGTVICRLVVALHAALLDAGFLYANPVGSCLQLPQNWASGSFVPVSMKYTLPELVEALPVVEEGMVAVLNYSLMGNFMMVYGHVPGATSGVRRLCLELPELAPLLYLDSDEVSTAEEREIHELWRVLKDEMCLPLMISLCQLNNLSLPPCLMALPGDVKAKVLEFVPGVDLARVQCTCKELRDLAADDNLWKKKCEMEFNTQDTCGCMMCKCIYSDQRKDIVLADKYTCGNYMQKPVTQPGRWLIILVYHSLLCQYITIGLSLLWYHLVDLVQDAPAAGIHFDCIIPLPINPYQLPPSAGACCSTTQASASAKDGGNMYSPPCSAAASSQGHCFAVGANQLASLDLAMDFDEPILFPVHNASLQEGIQFYNPTGDTQLSRNMSIDKCLKGSKRKGSGEGSSSLHSQEETGEMPQRELSMEHAGEKAGDADASREEYVHVRAKRGQATNSHSLAERFRREKINERMKLLQDLVPGCNKITGKAMMLDEIINYVQSLQRQVEFLSMKLSTISPELNSDLDLQDILCSQDARSAFLGCSPQLSNAHPNLYRAAQQCLSPPGLYGSVCVPNPADVHLARAGHLASFPQQRGLIWNEELRNIAPAGFASDAAGTSSLENSDSMKVE

SEQ ID NO: 35282 - protein, 131 aa, Haemophilus parainfluenzae
AFCDRVISGEWKGYTGKAITDVVNIGIGGSDLGPYMVTEALRPYKNHLNMHFVSNVDGTHIAETLKKVNPETTLFLVASKTFTTQETMTNANSARDWLLAAAKDNSAVAKHFAALSTNGKAVAEFGIDTNN

SEQ ID NO: 35283 - protein, 164 aa, Nocardioides sp. JS614
MDLLPRVGIGTDVHRLVDGVPLHLAGLHWPDEPQGLEGHSDADVAAHAACDALFSAAGLGDLGSNFGTADPAWAGASGAALLEETARRVRAAGFEIGNVAVQVIGNRPRLGGRRAEAETALSAAVGAPVSVSATTADGLGLTGRGEGVAAIATALVTPRHHGSA

SEQ ID NO: 35284 - protein, 218 aa, Bacillus sp. SG-1
MVKIAPSILSADFANLAKEIKDVESGGADYIHVDVMDGHFVPNITLGPMIVKAVRPITDLPLDVHLMIENPDQYIEAFAEAGSDYITVHAEATPHLHRTIQLIKSRGIKAGAVLNPGTPVDMIKHVIEDLDMVLLMTVNPGFGGQSFIQSVVPKIREVHELAQQFNPSMEIEVDGGITAETAKVCADAGATVFVAGSAIYNKEDREQAISAIREAAEK

SEQ ID NO: 35285 - protein, 363 aa, Pseudomonas fluorescens PfO-1
MFTILKQESFLLLAVIATCVAYPLEHWLLHSGQIVALTAGLVLIAFIVAASMRVAHQAELLAEKVGDPYGTMILTLAAVLVEVVILAIMMSNEASPTLVRDTIYSAVMLDINGILGLAALMGGIKHGEQSYNDDSARSYSVMILTAMGVSMVVPEFIPEANWKIYSAFTIGAMVVLYALFLRMQVGPHSYFFSYSYPDKRRRKEPVEQEPKPVSLALSIGILVFGVVVIGALAEVMSKTLDLGLEGTGAPPVITAILVAAISAAPEILTALRAALANRMQSVVNIAMGASLSTVILTVPVMEAMALYTGQPFQMAMTPVQTVMIFITLIVSAINLNDGETNAIEGMTHFVLFATFIMLSLLGL

SEQ ID NO: 35286 - protein, 131 aa, Haemophilus pittmaniae
AFCERVISGEWKGYTGKAIRDVINIGIGGSDLGPYMVTEALRPYKNHLNMHFVSNVDGTHIAETLKKVDPETTLVLVASKTFTTQETMTNALTARDWLLAAAKDQAAVAKHFAALSTNAKAVAEFGIDTDN

SEQ ID NO: 35287 - protein, 552 aa, Ralstonia eutropha JMP134
MTPDTSLEKTSQSTDGGDDCPLRWFDADLGAFESLERLIAEHPADFFAGKSFEPVGACHTREAVFASVELPETPTSPQAHADHLLHDVFRHVMPVASPTFVGHMTSSLPSFMPSLAKVVAALNQNVVKLETSGALTGLERQVVGMLHKLVFSQDSAFYGRWLHDADHALGAICSGGTVANLTALWASRNKLLGARDGFAGIHRAGMVAALRHYGYDGLAIVVSERGHYSLGKAADVLGIGRDNLVPVEVDAEGRMRIDLLRDTMRDLQQRNIRPMAIVGIAGTTETGSVDPLDAIADIAQEAGCHFHVDAAWGGATLLSERERWRFAGIERADSVVIDAHKQFYVPMGAGMVLFRSPAWTQEIIQHANYIVRKGSVDLGRHTLEGSRGAAAVMLYANLHLLGRKGLAQLIDRSIDNAHYFASLIAQQPDFELVSHPQLCLLTYRYLPETVRAALATASEDKREKILDALDALTVSIQEMQRDAGRSFVSRTQLTSTQFAGRPIAVFRVVLANPDTTHAILQDILDEQRMLAAASPCMAALMALVEASGRLQR

SEQ ID NO: 35288 - protein, 71 aa, Arabidopsis thaliana
MVNAIKGVFVSCDIPMTQFIVNMNNSMPPSQKFIIHVLDSTHLFVQPHVEQMIRSAISDFRDQNSYEKPTS

SEQ ID NO: 35289 - protein, 98 aa, Anabaena sp.
ATFKVTLINEAEGTKHEIEVPDDEYILDAAEEQGYDLPFSCRAGACSTCAGKLVSGTVDQSDQSFLDDDQIEAGYVLTCVAYPTSDVVIQTHKEEDLY

SEQ ID NO: 35290 - protein, 288 aa, Zea mays
CDGYMKERSTIAVIGLSVHTAPVEMREKLAVAEELWPRAIQELTSLNHIEEAAVLSTCNRMEIYVVALSWNRGIREVVDWMSKKSGIPASELREHLFILRSSDATRHLFEVSAGLDSLVLGEGQILAQVKQVVRSGQNSGGLGKNIDRMFKDAITAGKRVRSETNISSGAVSVSSAAGELALMKLPRSEALSARMLLMGAGKMGKLVIKHLVAKGCKKMRRAIEELSTGIVNKLLHGPLQHLRCDGSDSRTLDETLENMHALNRMFSLDMEKAIIEQKIKAKVEKTQN

SEQ ID NO: 35291 - protein, 131 aa, Haemophilus parahaemolyticus
DFCERVISGEWKGYTGKVITDVINIGIGGSDLGPYMVTEALRPYKNHLTMHFVSNVDGTHIAETLKKVNPETTLVLVASKTFTTQETMTNAHSARDWLLAAAKDESAVAKHFAALSTNAKEVEKFGIDTNN

SEQ ID NO: 35292 - protein, 386 aa, Erwinia carotovora subsp. atroseptica SCRI1043
MTDNPLLVLRERISALDLQLIELLAQRRELALGVARSKLHSHRPIRDKERERDLLDKLTAAGKKHHLDGHYITRLFQLIIEDSVLTQQALLQHHLNQTTSHSARVAFLGPKGSYSHLAARQYSARHFEQFIECGCQKFQDIFNMVETGQADYAVLPIENTSSGSINDVYDLLQHTSLSIVGELTNPINHCVLVATDTSLAQIETVYSHPQPFQQCSHFINRFPHWKIEYCESTAAAMEKVAALNSPKAAALGSEAGGQLYQLQMLEHNLANQSQNITRFIVLARKPIDVTEQVPAKTTLIMATGQQSGALVEALLVLRDNGIVMTKLESRPINGNPWEEMFYLDVQANLRGDAMQKALKGLAPITRSLKVLGCYPSENVVPVDVNE

SEQ ID NO: 35293 - protein, 96 aa, Aphanothece sacrum
ASYKVTLKTPDGDNVITVPDDEYILDVAEEEGLDLPYSCRAGACSTCAGKLVSGPAPDEDQSFLDDDQIQAGYILTCVAYPTGDCVIETHKEEALY

SEQ ID NO: 35294 - protein, 520 aa, Alteromonadales bacterium TW-7
MAKDFILPDIGEGIVECEVVEWLVKEGDSVCEDQPICDVMTDKALVQIPAVHDGVITKLYHQKGEIAKVHAPLFAMDVAGEAADVETQEHDSAPQNNNTAEQLEDFILPDIGEGIVECEIVDWLVAEGDEIEEDQAVCDVMTDKALVQIPAKYTGTVQKLYYQKGEIAKVHSPLFQMTIAGSAPKQNIDVNQAVVKAQTNAAEQAAPVKVNQTAKVVNTKAVASPAVRRKARELDVDLTQVPGSGKNGRIYKQDIEEFIKGEVPNSIDTSPLNSSAVNTQSKTQSSGVRVEPIKGIKAAMAKQMVASVSTIPHFTFCDEIDLTDLIALRASMKEQYKAQGVKLTMMPFFVKALSLAMKEFPVLNSKVNEDCSELTYFDDHNIGIAVDSKIGLLVPNIKSCQSKNIVDVANELTRLTESAREGRVPPEDLKGGTISISNIGAIGGTIATPIINKPEVAIVALGKLQHLPRFDENGHVVSKAIMQVSWSGDHRVIDGGTIARFNNLWKSYLENPSAMMMAMS

SEQ ID NO: 35295 - protein, 506 aa, Oryza sativa Japonica Group
MEFFTEYGEASQYQIQEVVGKGSYGVVAAAVDTHTGERVAIKKINDVFEHVSDAIRILREIKVLRLLRHPDIVVIKHIMLPPTRREFRDIYVVFELMESDLHQVIEANHDLSPEHHRFFLYQLLCALKYIHSANVFHRDLKPKNILANSDCKLKICDFGLARVAFNDSPSTIFWTDYVATRWYRAPELCGSFFSKYTPAIDIWSIGCIFAEILTGRPLFPGRNVVHQLDLITDLLGTPSSETLSRIRNENARGYLTGMQRKHPIPFSHKFHNADPLALRLLERLLAFDPKDRPTAEEALADPYFRGISKLSREPSRLPVSKFEFEFERRKLTKDDVREMIYREILEYHPQMLQEYIRGGEQISFLYPSGVDRFKRQFAHLEENYSRGERSTPLRRQHASLPRERVCSSVDSNNQDSDNEERRAISSIARTMISPPRSQEKGKNRASAYPNGIINLNSNPKIYLKSASISASTCIIRGNKGPKENGISEDMEEVVYELSDNVTRMLS

SEQ ID NO: 35296 - protein, 304 aa, Escherichia coli
MSAKVWVLGDAVVDLLPESDGRLLPCPGGAPANVAVGIARLGGTSGFIGRVGDDPFGALMQRTLLTEGVDITYLKQDEWHRTSTVLVDLNDQGERSFTFMVRPSADLFLETTDLPCWRHGEWLHLCSIALSAEPSRTSAFTAMTAIRHAGGFVSFDPNIREDLWQDEHLLRLCLRQALQLADVVKLSEEEWRLISGKTQNDQDICALAKEYEIAMLLVTKGAEGVVVCYRGQVHHFAGMSVNCVDSTGAGDAFVAGLLTGLSSTGLSTDEREMRRIIDLAQRCGALAVTAKGAMTALPCRQELE

SEQ ID NO: 35297 - protein, 145 aa, Zea mays
  misc_feature (41)..(41): Xaa can be any naturally occurring amino acid
MACPALPLCPLAQTEAERGILPILKRIRAVFNKVGIKDSEXSVVVRITGCPNGCARPYMAELGFVGDGPKSYQIWLGGTPNQSTLAESFMDKVKLDDIEKVLEPLFPYWNGPPQEGGFFGSFPNRTGFAKLKGVVNKWAGSPSPP

SEQ ID NO: 35298 - protein, 167 aa, Physcomitrella patens subsp. patens
MTASEEKWQDLEALQARHEELVNSMYREELLNYRFSELQELQDAENPNFVEEIITGHMEECASCIEELEKALKTDPVDYHFCSPVWSYGCQIGNSNASIGAHQVAIWCGKFRDCVSREDKQGCLDALEKVKEAFDILRPKLLTMLEFEREIAATGGTVYYMNCNNHV

SEQ ID NO: 35299 - protein, 355 aa, Oryza sativa
  misc_feature (121)..(121): Xaa can be any naturally occurring amino acid
MAATDMSPKAGKPLVENDAGSYLAWSGKDQPAVAGEKLGCGLLVLKPLGFALPHYADSGKFGYVLGGSAVVGVLPAGVDARERVVRLEAGDVIAMRAGEVTWWYNDTDGEDVTIVFMGDTXAGAVSPGDISYFVLAGPMGVLGGLDAGLLAKASGLTSPEQAATAFRSQPAALLTRLNGKLHGVRPREHDRHGLVVNAARVPADSNTGGAAAGTKTVTAAHLPVLAQLGFSVGLTRLDAGAAVRGPWVLRDAAAQAVYVARGSGRVQVAGAGGASTLLDAEVAAGSLLVVPRYGVSLAAADDAGGMELVSLIKSPRPATEHFTGKGSVIGGLTAEIVQAALNVSPEFVEQLRTKY

SEQ ID NO: 35300 - protein, 256 aa, Nicotiana tabacum
MGSGKLGESGMIELTAKIMMVVIIFLFLVVVFIFFLHLYTKWFWRYRQEDTGNPNGGTRRRRRRRFNFAGGYQEVNVLRRGLDPSVLKTIPVVPFNMKDFKDGLECSVCLSEVSEGENTRVLPKCNHGFHVDCIDMWFHSHSTCPLCRNPVSEQSAESISETIGSSVEEGSASTETQNIPTNVLFWGDETSTTSSASTSNRPEGILVIDIARQNTEQEEEEGQKTPTSTRLRSLTRLFSRVNPCNVDVEQGSRSQS

SEQ ID NO: 35301 - protein, 121 aa, Rhizobium leguminosarum bv. viciae 3841
MTTYTITLQNCAFFARHGVHDEEEFLGQRFFVDAELDVVAGEALESDSINDTVNYGIAFTVIEQIVTGKRRYLIESLALDIAKGLCETFPQIRRAKITVRKPNAPVPGVLDFVQVSVEHFA

SEQ ID NO: 35302 - protein, 298 aa, Nostoc punctiforme PCC 73102
MTDNDSEYIRQTEATRVRVLSEALPYIQQFAGRTVVVKYGGAAMKDSTLKDKVIRDIVFLSCVGLRPIVVHGGGPEINSWLDKLGIEPQFKNGLRVTDAATMDVVEMVLVGRVNKEIVALINQAGGLAVGLCGKDGNLFTARPQGQEGIGFVGEVSNVNIKILDTLASNGYIPVVSSVAADETGQAYNINADTVAGEIAAALGAEKLILLTDTSGILKDYKDQSTLIPKVDIREARELIVNGIVTGGMIPKVNCCVRSLAQGVRAAHIIDGRIPHALLLEIFTDVGIGTMILGSQFTS

SEQ ID NO: 35303 - protein, 119 aa, marine gamma proteobacterium HTCC2080
MSKCHCGSVELELTLPNGLENLRRCNCSICSRRNAVVASVTIDNLKVVKGSAELKQYTFNTHTAKHYFCSICGIYTHHQRRSVPSEYGFNIACVEGIKIEDYLNIEYLDGRDAHPKDIQ

SEQ ID NO: 35304 - protein, 525 aa, marine gamma proteobacterium HTCC2080
MTADIHQHRILILDFGSQYTQLIARRVREAGVYSEIYAWDITEADIRAFNPSGIVLSGGPESVTEADSPRAPEVVFELEVPVLGICYGMQTMAVQMGGEVQGSETSEFGYAQIRRSADGGLLQDISDHHDDSGQALLDVWMSHGDKVVSLPPNFQCIAETDSCPLAGIAHNAKPWFGIQFHPEVTHTTQGERIFEHFVLEICGCEALWTPANIVEDAIQRVRTQVGTDRVLLGLSGGVDSSVVAAMLHRAIGDQLTCVFVDNGLLRLDEGEQVMAMFAQNMGVRVIRANAEARFLGKLKGVSDPEAKRKAIGNTFIEVFDEEATKITGVKWLAQGTIYPDVIESAGSKTGKAHVIKSHHNVGGLPDDMALELVEPLRELFKDEVRRIGLELGLPKDMVFRHPFPGPGLGVRILGEVKKEYADLLRQADAIFIEELHRSGWYDKTSQAFAVFLPVKSVGVVGDGRRYEYVIAIRAVQTVDFMTARWAHLPYELLEVVSNRIINEISGISRVTYDISGKPPATIEWE

SEQ ID NO: 35305 - protein, 128 aa, Arabidopsis thaliana
RSAPALQTTFVSSTNFLKHSSSWGSSSPNNVILPKNKRSSTSVVVAAVGDVSSDGTIYLIGGAIAVALVGTAFPILFKRKDTCPECDGAGFVRKGGVTLRANAARKDLPQIVCANCNGLGKLNQIDKS

SEQ ID NO: 35306 - protein, 430 aa, Mycobacterium tuberculosis H37Rv
MRYPLGEALLALYRWRGPLINAGVGGHGYTYLLGAEANRFVFANADAFSWSQTFESLVPVDGPTALIVSDGADHRRRRSVVAPGLRHHHVQRYVATMVSNIDTVIDGWQPGQRLDIYQELRSAVRRSTAESLFGQRLAVHSDFLGEQLQPLLDLTRRPPQVMRLQQRVNSPGWRRAMAARKRIDDLIDAQIADARTAPRPDDHMLTTLISGCSEEGTTLSDNEIRDSIVSLITAGYETTSGALAWAIYALLTVPGTWESAASEVARVLGGRVPAADDLSALTYLNGVVHETLRLYSPGVISARRVLRDLWFDGHRIRAGRLLIFSAYVTHRLPEIWPEPTEFRPLRWDPNAADYRKPAPHEFIPFSGGLHRCIGAVMATTEMTVILARLVARAMLQLPAQRTHRIRAANFAALRPWPGLTVEIRKSAPAQ

SEQ ID NO: 35307 - protein, 119 aa, Archaeoglobus fulgidus DSM 4304
MYVRFEVPEDMQNEALSLLEKVRESGKVKKGTNETTKAVERGLAKLVYIAEDVDPPEIVAHLPLLCEEKNVPYIYVKSKNDLGRAVGIEVPCASAAIINEGELRKELGSLVEKIKGLQK

SEQ ID NO: 35308 - protein, 181 aa, Fagus sylvatica
MASSMISSATVATVSRATPAQATMVAPFTGLKSTAAFPATQKSNNDITSLASNGGRVQCMKVWPPLGLQKFETLSYLPPLSLESLAKQIEYLILKGWIPCLEFELEHPFVYRENNRSPGYYDGRYWVMWKLPMFGCTDATQVLAELQEASKTYPTSHIRIIGFDNKRQVQCISFIAYKPPK

SEQ ID NO: 35309 - protein, 482 aa, marine gamma proteobacterium HTCC2080
MVKHSNTEDPWALKVLAAVAELGPQRYYDPVITSEVVKNDLVSLIRASQKLKEKVAIASPEARHDRRNIIGAIRGYSEMLLEDSEVLPAAVRAHLLQILAAAKNEPKPASESATPTKSVTLLPSEEPGVILAVDDLPENRELVSRLLQKTGHTVISAESGEEALELLDTMGVDVVLLDLVMPGIGGAEVLKRLKEDERLRATPVVMISGQQDMDQIVMCIEAGADDYLLKPFNPVLLQARISAGIERKRWHDREELYREQLERREQFIRATFGRYLSDDIVDEILERPEGLELGGDLREVTIMMSDIRGFTTLVEHLPPQQVVTLLNRYLGRMTEIILEFGGTIDEFLGDAVLAVFGAPRRNDDDPDRAVRCALVMQEAMADINIANSADGLPEVEMAIALNTGSVVAGNIGSERRSKYGFVGHAMNVTSRIEDVAKPGEILISQTTYEKLESDYKFGNSRSLSVKGIEAELRVHAVLGGIQ

SEQ ID NO: 35310 - protein, 151 aa, Archaeoglobus fulgidus DSM 4304
MERTFVMVKPDGVQRGLVGEVIGRLERKGLKIVAMKMLWIAREMAENHYAEHREKPFFSALVDYITSGPVVAMVVEGKNAIKVVRTLVGATNPAEAAPGTIRGDFGLDVGRNVVHASDSPQSAEREISLFFSDDEIVNWEKADEDWIYEER

SEQ ID NO: 35311 - protein, 104 aa, Glycine max
  misc_feature (14)..(14): Xaa can be any naturally occurring amino acid
  misc_feature (69)..(69): Xaa can be any naturally occurring amino acid
  misc_feature (85)..(85): Xaa can be any naturally occurring amino acid
GSLEKIARYFEVGXCIISEREYSCYRMDPKLERANIDQNTMGEFVIRGITYTGHYEPVEGMCDILDAFXKETGDDIAIHVDAACXGFIALFTHSEAGKKWHSEL

SEQ ID NO: 35312 - protein, 131 aa, Haemophilus parahaemolyticus
DFCERVISGKWKGYTGKAITDVINIGIGGSDLGPYMVTEALRPYKNHLTMHFVSNVDGTHIAETLKKVNPETTLVLVASKTFTTQETMTNAHTARDWLLAAAKDESAVAKHFAALSTNAKEVEKFGIDTNN

SEQ ID NO: 35313 - protein, 724 aa, Blastopirellula marina DSM 3645
MLPTATITLSFPQAGFALLTFNDPSKGANILSRSVMDELAAHLDEIDGCEDIYGLVITSGKPGIFIAGADIREFVASVGASKEEIAAMSQRGQQIFARLSSSRYMSVAAIDGVCVGGGAELAVWCDRRILSTGPKTELGFPEVKLGIFPGWGGTVRLPRIVGLSNAVEMITGGESVSAANAAKMGLADDFTSPDDLVAAAIRMIEQDQESKSYLQDREVRSAAIEMSETELGFLGATASAYIQGQTKGQYPAPMAALETLLGGAMVDAESALTMEAEGLAGLFGTPVNAALMNVFFLTDRNKKDDGVDQDDVEKTKIESVSVIGAGIMGAGIAAASIRRGILTTLSDANAEALRRGVAGVLEEAAYDRDAGKKTIAKAVEGAAMLNASISDSEVAASKLVIEAIVENLEVKRKIYARLEPQLADDAILASNTSTLPITQLAANLAKPERFVGIHFFNPVRKMKLVEVIRGAQTSDATVASAVAFAKRLGKFPIVVNDGPGFLVNRLLFPYMNEALALLQEGVSMERVDKCAKKFGMPLGPITLYDMVGIDTAFYAGRTMYDAFPDRTLASPILPALVKAGRLGQKSGLGFYSYENRKRRAQPDPAAAKYIDPYIKGMPRDETDAQVIDRLFLPMLLEATRAMEANIVRDVRDIDLGLIFGLGFPPFKGGLMFWADTIGAKQLVERLKPWEEFGVRYKPTELLLEMAKSGKKFYDLESRSISAGQ

SEQ ID NO: 35314 - protein, 210 aa, Physcomitrella patens subsp. patens
KSIHEIERERQNLQNQEKKLIVEIKMSAKQGQMQLLPCLQENMSAAVCNIARYHGAVVVRPTPWVRKLLKSTQAMEDAMKGVTKAMGQMNKQMNLPALQKIMMEFERQNEKMEMTTEAMGDAIDNALDGDEEGEETEELVSQVLDEIGIDLDSQLLTAPAHATAAPERATPSKISQPQGARDPASDDGKIDSDLQARLDNLRKMCSQLGE

SEQ ID NO: 35315 - protein, 399 aa, Glycine max
RFNNGPLASATLLKSSPVLDKCEWVKGQTLRQPLVRCNPSSASALTIKAASYADELVKTAKTVASPGRGILAMDESNATCGKRLASIGLENTEANRQAYRTLLVTVPGLGEYISGAILFEETLYQSTVDGRKIVDVLVDQNIVPGIKVDKGLVPLAGSNDESWCQGLDGLASRSAAYYQQGARFAKWRTVVSIPNGPSALAVKEAAWGLARYAAISQENGLVPIVEPEILLDGEHGIDRTFEVAQKVWSEVFFYLAENNVLLEGILLKPSMVTPGAESKDKATPLQVADYTLKLLHRRIPPAVPGIMFLSGGQSEVEATLNLNAMNQSPNPWHVSFSYARALQNTCLKTWGGLPENVKAAQDALLFRAKSNSLAQLGKYTAEGESEEATRGMFVKGYSY

SEQ ID NO: 35316 - protein, 131 aa, Haemophilus paraphrohaemolyticus
DFCERVISGEWKGYTGKAITDVINIGIGGSDLGPYMVTEALRPYKNHLTMHFVSNVDGTHIAETLKKVNPETTLVLVASKTFTTQETMTNAHTARDWLLAAAIDESAVAKHFAALSTNAKEVEKFGIDTNN

SEQ ID NO: 35317 - protein, 449 aa, Pseudomonas fluorescens PfO-1
MNMPENAPSPLASQLKLDAHWMPYTANRNFQRDPRLIVGAEGSWLIDDKGRKVYDSLSGLWTCGAGHTRKEIQEAVAKQLGTLDYSPGFQYGHPLSFQLAEKITDLTPGNLNHVFFTDSGSECADTAVKMVRAYWRLKGQSTKTKMIGRARGYHGVNIAGTSLGGVNGNRKLFGQAMMDVDHLPHTLLASNAFSRGMPEQGGIALADELLKLIELHDASNIAAVFVEPMAGSAGVLVPPQGYLKRLREICDQHNILLVFDEVITGFGRTGTMFGATTFGVTPDLMCIAKQVTNGAIPMGAVIASSEIYQTFMNQPTPEYAVEFPHGYTYSAHPVACAAGLAALDLLQKENLVQSVAEVAPHFENALHGLKGAKNVIDIRNFGLAGAIQIAGRDGDAIVRPFEAGMALWKAGFYVRFGGDTLQFGPTFNSKPQDLDRLFDAVGEVLNKLD

SEQ ID NO: 35318 - protein, 497 aa, Pseudomonas fluorescens PfO-1
MSVIPHLINGELVTENGRAVDVFNPSTGQAIHKLPLASRETIQHAIDAAKAAFPAWRNTPPAKRAQVMFRFKQLLEQNEARIAQLISEEHGKTLEDAAGELKRGIENVEFACAAPEILKGEYSRNVGPNIDAWSDFQPLGVVAGITPFNFPAMVPLWMYPLAIVCGNCFILKPSERDPSSTLLIAQLLLEAGLPKGVLSVVHGDKTAVDALIEAPEVKALSFVGSTPIAEYIYAEGTKRGKRVQALGGAKNHAVLMPDADLDNAVSALMGAAYGSCGERCMAISVAVCVGDQVADALVAKLVPQIKALKIGAGTSCGLDMGPLVTGQARDKVSGYVEDGVAAGATLVVDGRGLSVAGHEEGFFLGGCLFDNVTPEMRIYKEEIFGPVLCVVRVNSLEEAMQLINDHEYGNGTCIFTRDGEAARLFCDEIEVGMVGVNVPLPVPVAYHSFGGWKRSLFGDLHAYGPDGVRFYTRRKAITQRWPQRASHEASQFAFPSL

SEQ ID NO: 35319 - protein, 131 aa, Haemophilus paraphrohaemolyticus
DFCERVISGEWKGYTGKAITDVINIGIGGSDLGPYMVTEALRPYKNHLTMHFVSNVDGTHIAETLKKVNPEATLVLVASKTFTTQETMTNAHTARDWLLNAAKDESAVAKHFAALSTNAKEVEKFGIDTNN

SEQ ID NO: 35320 - protein, 175 aa, Oryza sativa
WHPSSSAQETGRWSLAGATALVTGGSKGIGRAIVEELASFGATVHTCARNEATLNSCLEEWSAKKLSITSSVCDVSARADREALAGRVTAMFDGKLDILVNNVGFLFLKPAVNVTPEELSRVMATNLESCFHLSQLMHPLLKTSGKGNVVNISGISTVTGFPSLPICAFCAAKGN

SEQ ID NO: 35321 - protein, 131 aa, Actinobacillus lignieresii
DFCERVISGSWKGYTGKAITDVINIGIGGSDLGPYMVTEALRPYKNHLNMHFVSNVDGTHIAEVLKKVNPETTLVLVASKTFTTQETMTNALTAREWLLAAAKDESAVAKHFAALSTNATEVAKFGIDTAN

SEQ ID NO: 35322 - protein, 334 aa, Geobacillus stearothermophilus
AVKVGINGFGRIGRNVFRAALKNPDIEVVAVNDLTDANTLAHLLKYDSVHGRLDAEVSVNGNNLVVNGKEIIVKAERDPENLAWGEIGVDIVVESTGRFTKREDAAKHLEAGAKKVIISAPAKNEDITIVMGVNQDKYDPKAHHVISNASCTTNCLAPFAKVLHEQFGIVRGMMTTVHSYTNDQRILDLPHKDLRRARAAAESIIPTTTGAAKAVALVLPELKGKLNGMAMRVPTPNVSVVDLVAELEKEVTVEEVNAALKAAAEGELKGILAYSEEPLVSRDYNGSTVSSTIDALSTMVIDGKMVKVVSWYDNETGYSHRVVDLAAYIASKGL

SEQ ID NO: 35323 - protein, 131 aa, Actinobacillus pleuropneumoniae
DFCERVISGGWKGYTGKAITDVINIGIGGSDLGPYMVTEALRPYKNHLNMHFVSNVDGTHIAEVLKKVNPETTLVLVASKTFTTQETMTNALTAREWLLAAAKDESAVAKHFAALSTNATEVAKFGIDTAN

SEQ ID NO: 35324 - protein, 486 aa, Pseudomonas putida GB-1
MKALDQLSFDNRFARLGDAFSTQVLPEPIAEPRLVVASESAMALLDLDPAHAELPVFAELFSGHKLWEEADPRAMVYSGHQFGSYNPRLGDGRGLLLAEVLNDAGEHWDLHLKGAGQTPYSRMGDGRAVLRSSIREFLASEALHALGIPTSRALCVIGSSTPVWRETRESAAMLTRLAQSHVRFGHFEYFYYTKQPEQQRVLIDHVLEQHYPECRDAEQPYLAMFRTIVERNAELIARWQAYGFCHGVMNTDNMSILGITFDFGPYAFLDDFDANFICNHSDDRGRYSYANQVPIAHWNLSALAQALTTVIEVEPLKETLGLFLPLYQAHYLDLMRRRLGLTTAEEDDMALVERLLQCMQRGGVDYSLFFRKLGEQPAADALKVVRDDFIDLAAFDAWGADYLARCDREPGNAEGRRERMHAVNPLYVLRNYLAQKAIEAAEAGDYSEVRRLHQVLSHPFEEQPGMQAYAERPPEWGKHLEISCSS

SEQ ID NO: 35325 - protein, 640 aa, Pseudomonas putida GB-1
MPAKRPAQATHGKAPTAVPFAHLQKRFTCCQFIRLESIGTRPASDTLSSLLPPVVPEYLPLDASTINSLFLIGALLVGASILVSSLSSRLGIPILVIILAVGMVAGVDGGGIIFNNYPTAYLVGNLALAVILLDGGLRTRVASFRVALWPALSLATVGVMITTALTGLVAAWLFNLSLIQGLLIGAIVGSTDAAAVFSLLGGKGLNERVTATLEIESGSNDPMAVFLTVTLIDMIASGQTGLHWSLLGHLLREFGIGGLLGLGGGWLMLQLVNRINLAGGLYPILVVAGGLVVFSLTNALHGSGFLAVYLCGLVLGNKPIRSRHGILHMLDGMAWLAQIGMFLVLGLLVTPHDLLPIALPALGLALWMILVARPLSVVAALLPFKAFHGREKGFISWVGLRGAVPIILAVFPLMAGLPDAQLFFNLAFFIVLVSLLVQGTSLPWMAKLLKVTVPPDPAPISRSALEVHVTSEWELFVYRLGAEKWCIGAALRELKMPEGTRIAALFRNEQLLHPSGSTVLEVGDMLCVIGHEHNLPALGKLFSQAPQRGLDLRFFGDFVLEGDAELGAVAALYGLKLDGLDAKMPLAQFIRQKVGGAPVVGDQVEWHGTIWTVATMDGNKIQKVGVRFPEGTRPGPGLFL

SEQ ID NO: 35326 - protein, 363 aa, Nostoc punctiforme PCC 73102
MESLSKASYRIVAIPGEGIGPEVVEASLKILQHVAKIQGFTLQVDYGWLGATAFEQLGSYFPQATTELCDGADGIVFGAVSQGGLLELRKHFDFFCNLRPIRSVNSLLHKSSLRPEKIQGLDILIVRELVSGIYFGPSGRSSDERGNYGYHTMRYYDEEIRRIARKALEQAQYRRGLLTVAHKENALPHLHWTRLVQEEATKFPNVIVEPMLVDNLAMQMVLNPQRFDVILASNLFGDILSDIGGALVGSIGLLGSASLNANGFGLYEAIHGTAPDIAGLGIANPLGTLGACVLMLQQWGEVQAAQQIIAAQDRILAKGYRTADLFTQGEEILVNTATLVDLLLEELSVVQHSQLGVLHESRK

SEQ ID NO: 35327 - protein, 423 aa, Oryza sativa Japonica Group
MECLAEMPRAPLADRRPRKRQRLGWDVGPEIHQVQIGLCGQEVANVISAVTLGLSSQEIPRFASPPLREDDKDGHFVFAVGDNLTPRYRINAKMGEGTFGQVLECWDRERKEMVAIKIIRGIKKYRDAAMIEIGMLEQLGKYEKSRSSCVQIRNWFDYRNHICIVCEKLGPSLYDFLRKNSYRSFPIALVREVAKQLLECIAFMHELRLIHTDLKPENILLVSPEYIKVPDYKVSSRSPKEGSYFKQLPKSSAIKVIDFGSTTYDQQDQTYVVSTRHYRAPEVILGLGWSYPCDIWSVGCILVELCTGEALFQTHENLEHLAMMERVFGPLPCHMLKRADRHSEKYVRKGRLNWPEGCASRDSMKAVMKLPRLQNLVMQNVDHSGGEFIDLLQGLLRYDPASRLTAQEALRHPFLREQSERRR

SEQ ID NO: 35328 - protein, 155 aa, Nicotiana tabacum
MAASNKTPIWDCGSSLYDSFELKSFERQLDSAIASRSLSMPHLPDRRILIPSSNSQQQQEQQQTQPISKKSSKISRSFQKLLKSLFRQKQNNSPLFSGHKQSIGDGFYVIYDKSGALTTIPEGPECDNLSPEIKSLVRRTGSERFTVASIGISCA

SEQ ID NO: 35329 - protein, 191 aa, Triticum aestivum
  misc_feature (161)..(161): Xaa can be any naturally occurring amino acid
  misc_feature (165)..(165): Xaa can be any naturally occurring amino acid
  misc_feature (170)..(170): Xaa can be any naturally occurring amino acid
  misc_feature (177)..(177): Xaa can be any naturally occurring amino acid
  misc_feature (179)..(179): Xaa can be any naturally occurring amino acid
  misc_feature (182)..(182): Xaa can be any naturally occurring amino acid
  misc_feature (184)..(186): Xaa can be any naturally occurring amino acid
  misc_feature (189)..(190): Xaa can be any naturally occurring amino acid
MSAFVGKYADELIKTAKYIATPGKGILAADESTGTIGKRLASINVENVESNRQALREMLFTAPGALEYLSGVILFEETLYQTAADGTPFVDILKAGAEPSELAVKQNAEGLARYALICQENGLVPIVEPEILTDGPHDIKACAAATERVLAAVYKSLNDHXVLLXGTLLXPNMVTPXSXSPXVXXXVIXXW

SEQ ID NO: 35330 - protein, 56 aa, Zea mays
  misc_feature (14)..(14): Xaa can be any naturally occurring amino acid
  misc_feature (18)..(18): Xaa can be any naturally occurring amino acid
  misc_feature (44)..(44): Xaa can be any naturally occurring amino acid
EPLPKKGPSHPFFXPISXPSPLGGFLVTNQICSFCNHINGGVGXNFDRLYLIKALH

SEQ ID NO: 35331 - protein, 166 aa, Streptococcus pneumoniae R6
MRCWGCSSMRRMLTAKLQNRSGVLNRFTGVLSRRQVNIESISVGATEDPNVSRITIIIDVASHDEVEQIIKQLNRQIDVIRIRDITDKPHLEREVILVKMSAPAEKRAEILAIIQPFRATVVDVAPSSITIQMTGNAEKSEALLRVIRPYGIRNIARTGATGFTRD

SEQ ID NO: 35332 - protein, 374 aa, Arabidopsis thaliana
  misc_feature (141)..(141): Xaa can be any naturally occurring amino acid
  misc_feature (301)..(301): Xaa can be any naturally occurring amino acid
MSNDKDSMNMSDLSTALNEEDRAGLVNALKNKLQNLAGQHSDVLENLTPPVRKRVEFLREIQNQYDEMEAKFFEERAALEAKYQKLYQPLYTKRYEIVNGVVEVEGAAEEVKSEQGEDKSAEEKGVPDFWLIALKNNEITXAEEITERDEGALKYLKDIKWSRVEEPKGFKLEFFFDQNPYFKNTVLTKTYHMIDEDEPILEKALGTEIEWYPGKCLTQKILKKKPKKGSKNTKPITKTEDCESFFNFFSPPQVPDDDEDLDDDMADELQGQMEHDYDIGSTIKEKIISHAVSWFTGEAVXADDLDIEDDDDEIDEDDDEEDEEDDEDDEEDDDEDDDEEEEADQGKKSKKKKAGRSQLAEGQAGERPPECKQQ

SEQ ID NO: 35333 - protein, 334 aa, Oryza sativa Indica Group
MAAALMRRAARAPPAACGLRRFMQEQTAFRPAAVPVVPPERRGFIPLADRIRDLGAAFPRINLDGLVPPAPPQTHPTVAREERASASAVAGLTVEEARKVLRATQMEAARARLRASGAGTVPYAEFLRLCCDAAGAESGASVARALDESGSVIVLGKTVFLRPEMVVKAIEKAIPIPRAQPIALDGPAREELKAMEAQKVEIDRTAALQVRRELWLGLAYLVVQTAGFMRLTFWELSWDVMEPICFYVTSMYFMAGYTFFLRTKKEPSFEGFFESRFAAKQKRLMHARDFDLRRYDELRRACGLPVVRTPTSPCRPSSSSSTQESHCHSYCHCQ

SEQ ID NO: 35334 - protein, 354 aa, Myxococcus xanthus DK 1622
MALYPVIMAGGSGTRFWPLSRQARPKQFLPLASKLPLITDTSARLKGLASVKDTFIVCGPLHAKAAAKLVKGLPKANLLVEPVARNTAPAIALAAVQVAARDPKGVMVVLPSDHHVADVPGFKRTLADAADLAEAGHIVTLGIKPSRPETGYGYIQVGEALEGGGRKVQAFKEKPDLETARGYMSSGDYLWNGGIFVFRVDVILEAFAKHMPEMKKGLDALRKAAGKRTFGAVLKKVFPKLPSTSIDYGVMEKASNIAVLPGDFGWSDVGSFAAIPEVRPADANGNVVSGNLAVVVDCHSCVVLADKRPLSVVGLTDMVVVDSGDAVLVVPKDKSQDVRKVVEALKARKLTKYL

SEQ ID NO: 35335 - protein, 199 aa, Fagus sylvatica
FQDYHGLPEFRQAVAKSMGRARGDRVTFDPNRIVMGGGATGASEIIMFCLANPGDAFLVPSPYYPAFDRDLGWRTGVKLIPVNCDSSNNFTITKAALEAAFEAAHKRAQEEKIEINIKGVIIANPSNPLGTVLDRETLRSLVSFVNEKNIHLVCDEIYSATVFSTPSFISISEIIQEMECNTDLIHIIYSLSKDMGFPG

SEQ ID NO: 35336 - protein, 359 aa, Candida glabrata CBS 138
MSRKFDLKAIADISVLVGTGISLYYLINRLLNDVENGPMSGRSKEAREQQSQKWDKLVELNPDLKKVQLSSYERTILSSVVIAEDIDVTFNDIGGLDNVISDLHESVIYPLTMPEIYTNNPLLKAPSGVLLYGPPGCGKTMLAKALAKESGANFISVRMSTIMDKWYGESNKIVDAMFSLANKLEPCIIFIDEIDSFLRERSSTDHEVTANLKAEFMTLWDGLLNNGRVMIIGATNRINDIDDAFLRRLPKRFLVSLPNIEQRTKILEVLLGNTELDKANFDLSLIAKCSGGLSGSDLKELCREAALNAAKEAMKEKRNLIQKGLEATEVKLRPLTTYDFLINMKTIEAVQMLSQAPQD

SEQ ID NO: 35337 - protein, 389 aa, Nostoc punctiforme PCC 73102
MKAMILAAGKGTRVRPITYTIPKPMIPILQKPVMEFLLELLRQHGFDQIMVNVSHLAEEIENYFRDGQRFGVQIAYSFEGKIDDDGKLVGEAIGSAGGMRRIQDFSPFFDDTFVVLCGDALIDLDLTAAVKWHRAKGSIATIITKSVPQEEVSSYGVVVTDEEGRVKAFQEKPSTEEALSTNINTGIYIFEPEVFNYIPSDVEYDIGSQLFPKLVEIKAPFYAIPMDFEWVDIGKVPDYWRAIRGVLLGEIKNVQIPGHEVAPGIYTGLNVAVNWDKVDITGPVYIGGMTRIEDGAKIVGPAMIGPNCWICSGATVENSVIFEWSRLGPGVRLVDKLVFGRYCVDKTGAAIDVQAAALDWLITDARQIPPSHTPVERQAIEELLGTNAS

SEQ ID NO: 35338 - protein, 338 aa, Salmonella enterica subsp. enterica serovar Paratyphi B str.
MKTLICNNPGNIEYIERDIPHLKDDEVLLKIKAVGICGTDIHAFAGRQPFFAYPRVLGHEICGVAEMLGKSCSTAKVGQRYSVIPCIPCGACAACREGKTNCCENVSLYGVHQDGGFSEYLAVREQNLVELSDNLTDSAGALVECFAISAHAVRRADVKPQQNIVVVGAGPIGLAAAAIAKAKGSRVAVADIDAERRRLVAEKVGVATLDPSSDDYIDALKACFSGELAGTVLDATGNKSSMSRAVDLIRHGGKIVFIGLYIGELVIDDPTFHKKETTLLSSRNATREDFECVIELMAQGAISETMMKNQEFDFYTFGNQYQKNVVENKKLVKGVIKF

SEQ ID NO: 35339 - protein, 256 aa, Zea mays
FPCPPRSLSRCDDCVEYRPRPLTPRRRRPRRLRQVPRDGPFIFVSLFAGRRAPARHIAAECSSKGVCWNCKEPGHMANSCPNEGICRNCGKSGHIARDCTAPPVPPGEVILCFFCYKPGHFREECTNEKACNNCRQSGHLARNCTNDPVCNLCNVAGHLARQCPKSDTLGERGGPPPFRGVGAPFHDVGAPFRGGFSDVVCRACNQIGHTSRDCMAGAFMICHNCGGRGHMAYECPSASLMDRFTPSPVSEGRTIQ

SEQ ID NO: 35340 - protein, 149 aa, Nostoc punctiforme PCC 73102
MERTFLAIKPDGVQRGLVGEIIRRFETKGFTLVGLKFLKVSKELAEQHYGVHRERPFFGSLVEFITSSPVVAMVWEGDGVVASARKIIGATNPLTSEPGTIRGDFGINIGRNLIHGSDAPETAQQEIALWFKDEELVNWQPHITPWLHE

SEQ ID NO: 35341 - protein, 536 aa, Oryza sativa Indica Group
MASTTSATAAGGAFAAAKTRAGSSAAGGGACARVAAGGRRRSGVVVRCDAGVEAQAQAQAVAKAASVAALEQFKISADRYMKERSSIAVIGLSVHTAPVEMREKLAVAEELWPRAISELTSLNHIEEAAVLSTCNRMEIYVVALSWNRGIREVVDWMSKKSGIPASELREHLFMLRDSDATRHLFEVSAGLDSLVLGEGQILAQVKQVVRSGQNSGGLGKNIDRMFKDAITAGKRVRCETNISSGAVSVSSAAVELALMKLPKSECLSARMLLIGAGKMGKLVVKHLIAKGCKKVVVVNRSVERVDAIREEMKDIEIVYRPLTEMYEAAAEADVVFTSTASETPLFTKEHAEALPAISDAMGGVRLFVDISVPRNVSACVSEVGHARVYNVDDLKEVVEANKEDRLRKAMEAQTIITQELKRFEAWRDSLETVPTIKKLRSYADRIRASELEKCLQKIGEDSLTKKMRRSIEELSTGIVNKLLHGPLQHLRCDGSDSRTLDETLENMHALNRMFSLDTEKAIIEQKIKAKVEKSQN

SEQ ID NO: 35342 - protein, 399 aa, marine gamma proteobacterium HTCC2080
MNHNFQRIDRLPPYVFNIIGELKTSARARGEDIIDFGMGNPDQPTPSHIVDKLADTIHRGDTHRYSQSKGIPRLRKAICDWYQRRYDVVLDPNSEAIVTMGSKEGLAHLALATTSTGDSILVPNPSYPIHPYGFVISGADLRHVPMSDEATFFEELERAIRNSYPKPKMLVLNFPSNPTGHCVELSFFEKVIAVAREAGIWVVHDLAYADLCFDGYVAPSILQVEGARDIAVEFFTLSKSYNMPGWRVGFCCGNPELIAALTRIKSYLDYGIFTPVQVAAIAALEGDQQCVSDICDMYRSRRDVLCQGLNEAGWPVTPPKATMFVWAEIPESFRAMGSLEFSKLLLAEAGVAVSPGIGFGEYGEGYVRFGLIENEHRTRQALRGIKKVLRSGPPHSSGV

SEQ ID NO: 35343 - protein, 232 aa, Brucella suis 1330
MDEARKLKIAAAAEALTYVKDGMRLGIGTGSTAEEFVRLLAEKVKGGFRVIGVPTSERTAKLCEELGVALTTLEETPHLDLTIDGADEVDGELSLIKGGGGALLREKIVAAASDSMIVIADQSKVVETLGRFPLPIEVNRFGLGATIRAIEAAAVKCGLAGPLNLRLKDGSPFLTDGGHYIVDASFGRIPDPKTLSDALFAIPGVVEHGLFIGLARAAIIAGTDGIRTMNRS

SEQ ID NO: 35344 - protein, 247 aa, Nocardioides sp. JS614
MTHTLILLRHGESEWNAKNLFTGWVDVNLTEKGRAEAVRGGELMREAGVLPDVVHTSVQRRAINTACLALDAADRHWIPVRRSWRLNERHYGALQGKNKKETLEAYGEEQFMLWRRSFDVPPPPIEEDSEFSQFGLPQYAGLGDDMPHTECLKDVIARFLPYWESDIVPDLRAGHTVLIAAHGNSLRALVKHLDGISDEDIAGLNIPTGMPLVYELDDDFRPTVPHGRYLDPEAAAAAAAAVANQGR

SEQ ID NO: 35345 - protein, 544 aa, Leptospira interrogans serovar Lai str. 56601
MISTSGLTLNFGKKILFENVTVKFKENCRYGLIGANGSGKSTFMKILAGIEQAASGSVSIDAGLKLGYLKQDHYEYENETVLNTVIMGDKELWEVSQERDAIYSKPEMSDEDGIRVSELEEKYGELGGYEAESTAGELLEGLGIPTSSHTQTLAYLTGGFKLRVLLAQVLFQKPDILLLDEPTNHLDIKTIHWLEEFLTNYRGVVIVISHDRHFINSIATHIADLDYQSLTVYPGNYDDFMEASTMARERLLDENKRKKEKIAELQDFVNRFSANASKSKQATSRQKQIEKIKLDDVKPSSRVSPYIRFKMKKTLGKDVILAENISKSYDRPIFKDFTINITKGEKIAIIGTNGVGKTTLLKTLMKQIEPDNGKVAMGDSVTSSIFPQDHREGILEDADTLVDWLYRYADPGTEMEEIRAILGRMLFSGDMAKKPTSVLSGGEKSRLIIGRMIISGDNLLALDEPTNHLDLETIEALNYALSIFEGTVIFVSHDREFVSSLATRVIEVSTEGIRDFKGTYEDFLEREGAEFYKRLSGGPVLAET

SEQ ID NO: 35346 - protein, 131 aa, Aggregatibacter aphrophilus
TFCARVISGEWKGYTGKAITDVINIGIGGSDLGPYMVTEALRPYKNHLTMHFVSNVDGTHIAETLKKVNPETTLILVASKTFTTQETMTNALSARDWFLAAAKDPAHVAKHFAALSTNAKAVAEFGIDTDN

SEQ ID NO: 35347 - protein, 227 aa, Brassica napus
  misc_feature (118)..(118): Xaa can be any naturally occurring amino acid
  misc_feature (174)..(174): Xaa can be any naturally occurring amino acid
  misc_feature (183)..(183): Xaa can be any naturally occurring amino acid
  misc_feature (188)..(188): Xaa can be any naturally occurring amino acid
  misc_feature (192)..(192): Xaa can be any naturally occurring amino acid
  misc_feature (200)..(200): Xaa can be any naturally occurring amino acid
  misc_feature (207)..(207): Xaa can be any naturally occurring amino acid
  misc_feature (213)..(214): Xaa can be any naturally occurring amino acid
MNFSCCLCDTRFSKKNFYQCSRCSFRICIPCARKPLTIHRYKTHEHTLHQILMKISFTCDACGLCSTGYPYICHQCCFIIHRSCIFLPRVICINHHDHRISHVFSLGLGKFICGIRCXWDEKELEGIPEEEESKPLEVIDQNLIIHFNHEHNLMKLSVSSLRHGEVILPHEEGXHCFACTLPXYFKLXYKCXQCDFILHXTCANLPXSKWFFXXYEKLILSPEKKKK

SEQ ID NO: 35348 - protein, 464 aa, Brucella suis 1330
MTGFDYDLFVIGGGSGGVRAGRLAGAIGKKVGLAEEYRMGGTCVIRGCVPKKLFVYASQFPEHFEDSAGYGWSMGEAAFDWKKLIAAKDKEISRLEGLYRKGLENSHVDIFASRAELIDEHTIELKADGRRVTADKILIATGGRPNTHESLPGHEYCISSNEAFHLEELPKSIVIAGGGYIAVEFANIFHGLGVETTLVYRGKEILSRFDHDIRSLLHETMEAKGIRILCGAIFEKVEKKADGKLSVELSNGETLETDQAMLALGRIPNTDGLGLEKAGVKIDKSGAIEVDDYSRTNVENIWAVGDVTNRVQLTPVAIHEAMCFLETAFKDNPTKPDHELIATAVFSQPEIGTVGLSEDEAAKKYPELEIYRALFRPMKNTLSGRSEKTLMKLVVESKSRKVLGAHIMGPDAGEMAQLLGISLKAGATKDDFDRTMAVHPTATEELVTMYKPTYRVVDGKKIEG

SEQ ID NO: 35349 - protein, 131 aa, Aggregatibacter aphrophilus
TFCARVISGEWKGYTGKAITDVINIGIGGSDLGPYMVTEALRPYKNHLTMHFVSNVDGTHIAETLKKVNPETTLILVASKTFTTQETITNALSARNWFLAAAKDPAHVAKHFAALSTNAKAVAEFGIDTDN

SEQ ID NO: 35350 - protein, 508 aa, Pseudomonas fluorescens PfO-1
MNASLTPNETTIQKVKLLIDGEWVESQTTEWHDIVNPATQQVLAKVPFATAAEVDAAVSAAQRAFQTWKLTPIGARMRIMLKLQALIREHSKRIAVVLSAEQGKTIADAEGDIFRGLEVVEHACSIGSLQMGEFAENVAGGVDTYTLRQPIGVCAGITPFNFPAMIPLWMFPMAIACGNTFVLKPSEQDPLSTMLLVELAIEAGIPAGVLNVVHGGKDVVDGLCTHKDIKAVSFVGSTAVGTHVYDLAGKHGKRVQSMMGAKNHAVVLPDANREQALNALVGAGFGAAGQRCMATSVVVLVGAAKQWLPDLKALAQKLKVNAGNEPGTDVGPVISKKAKARILDLIESGIKEGAKLELDGRDISVPGYEKGNFVGPTLFSGVTTDMQIYTQEIFGPVLVVLEVDTLDQAIALVNANPFGNGTGLFTQSGAAARKFQTEIDVGQVGINIPIPVPVPFFSFTGSRGSKLGDLGPYGKQVVQFYTQTKTVTARWFDDDSVNDGVNTTINLR

SEQ ID NO: 35351 - protein, 245 aa, Oryza sativa Japonica Group
MEYVNPLTGFRVDGRRPNEMRQLKGEVGVVARADGSALFEMGNTRVIAAVYGPREVAAHPDYWLVRLISKKAKREGLRGRSRTKVSKSTAKMLWMADFSTGDRRRKPKGDRRSTEISLVIRQTMEASILTHLMPRSQIDIFVQVLQADGGTRAACINAATLALADAGIPMRDIVTSCSADLNYIEDSAGGPDVTVGFLTKMDKVTLLQMDAKLPMDTFETVMDLAIEGCKAIANYIRELSLSNDV

SEQ ID NO: 35352 - protein, 490 aa, Pseudomonas putida GB-1
MARFGTQKLYIDGAYVDAGSDATFEAINPATGEVLAHVQRATEADVEKAVESAERGQKVWAAMTAMQRSRILRRAVDILRERNDELAQLETLDTGKSYSETRYVDIVTGADVLEYYAGLVPAIEGEQIPLRESSFVYTRREPLGVTVGIGAWNYPIQIALWKSAPALAAGNAMIFKPSEVTSLTTLKLAEIYTEAGLPNGVFNVLTGSGREVGTWLTEHPRIEKVSFTGGTTTGKKVMASASSSSLKEVTMELGGKSPLIICADADLDKAADIAMMANFYSSGQVCTNGTRVFIPAEMKAAFEAKIAERVARIRVGNPEDENTNFGPLVSFAHMENVLSYIAKGKEEGARVLCGGERLTEGEFAKGAFVAPTVFTDCSDDMTIVKEEIFGPVMSILSYETEEEVIRRANDTEYGLAAGVCTNDITRAHRIIHKLEAGICWINAWGESPAEMPVGGYKQSGVGRENGVSSLAQYTRIKSVQVELGGYNSVF

SEQ ID NO: 35353 - protein, 131 aa, Aggregatibacter aphrophilus
TFCARVISGEWKGYTGKAITDVINIGIGGSDLGPYMVTEALRPYKNHLTMHFVSNVDGTHIAETLKKVNPETTLVLVASKTFTTQETMTNALSARDWFLAAAKDPAHVAKHFAALSTNAKAVAEFGIDTDN

SEQ ID NO: 35354 - protein, 774 aa, Brucella suis 1330
MTKKPSSPSTRSDFDEAALFFHRYPKPGKLEIQATKPLGNQRDLALAYSPGVAAPCLAIHDDPATAAEYTARGNLVAVVSNGTAVLGLGNIGALASKPVMEGKAVLFKKFADIDVFDIEIDAHEINRIVDVVSALEPTFGGINLEDIKAPECFEVEEQLRERMNIPVFHDDQHGTAIIVASAVLNGLELAGKKIEEAKIVTSGAGAAALACLNLLVNLGAKRENIWVCDIEGVVYDSRNTLMDRWKEVYAQKTDARTLADVIGGADVFLGLSAAGVLKPELLKQMAEKPLIMALANPKPEIMPEEARAARADAMICTGRSDFPNQVNNVLCFPYIFRGALDVGATVINEEMKLAAVRAIASLAREEPSDVAARAYSGDTPTFGPDYIIPSPFDQRLILRIAPAVAKAAMETGVATRPIEDMEAYLDRLNRFVFRSGLIMKPVFAAARTQGAPMRVIYADGEDERVLRAAQVVIEERIAAPILVGRPQVVETRLRRYGLKIRPGTDFELINPEDDPRYRDYVDLYLSYTGRQGVTPEAARTIVRTNSTAIAALAVMRDEADAMICGLEGRFERHLRVVRQIIGKVPGIRDYSALSLLISQRGALFLTDTYVNAEPDANEIAEMAVLAAREISRFGIEPKAALVSHSNFGSKESASAKKMRQAAAILAEKAPDLESDGEMHGDAALSQTLRDRVFPSSRLKGEANLLVFPNLDAANITLNVVKAVTDALHVGPILLGATRPAHILTPSVTSRGVVNMTALAVVEALQKNASNRRQK

SEQ ID NO: 35355 - protein, 131 aa, Aggregatibacter segnis
SFCERVISGEWKGYTGKAITDVINIGIGGSDLGPYMVTEALRPYKNHLTMHFVSNVDGTHIAETLKKVNPETTLILVASKTFTTQETMTNALSARDWFLAAAKDPAHVAKHFAALSTNAKAVAEFGIDTNN

SEQ ID NO: 35356 - protein, 308 aa, Ralstonia eutropha JMP134
MSRPLPRYVVFGEALTDMVLQADGNWLGLPGGSCWNVARVGARLGIDTAFAGAVSQDLFGDTLARATEEAGLDMRFLQRVERSPFLAFVASRHPPQYFFVGDDSADLHFEPSRLPQGWREAAEVIHFGSISLVRQPLAGRLCEEATQAAAAGKRIAFDPNYRSLMSAPGYGETLAHMLRLASYVKISDEDLAGLFPALPLDAALAQVRAIAPNATIMLTRGADGLTLLQSDIVVEQPAFRVEVADTVGCGDAAMGGWMASVLSEPRADLAGQARLAAAAAAVAASHAGAYAPLWRELEGLAAMPRGSA

SEQ ID NO: 35357 - protein, 542 aa, Ralstonia eutropha JMP134
MSTSLSAWQSLREHAAKIRHTHMRDWFTGPQGQARSVRLTVEACGLTLDYAKNRVTEDTLSLLFALARQARVCERRDAMFAGEPVNTTERRAALHMALRAHPGDGYRALGVPVEADVSAVLAQMERFARDVRSGSWTGFDGRAITDVVNIGIGGSDLGPRMVCRALEQDTEPGPRLHFVANVDGYDLARTLARLDAATTLVIVCSKTFTTLETMANARTARDWFLRHGVTHSDLARHFVAVSTNRDAVAAFGIDPVNMFPFWDWVGGRFSLWSAVGLSIAVAIGFDRFRQLLDGARAMDRHFAGAPPEQNLPMILGLLDVWYRSFLGTASRCVAPYCEPLDLLPAFLQQLEMESNGKSVQHDGAALEAGSAAVVWGTTGTNGQHAYFQMVHQGSQLVPVDFIACLQPHSDLPGHHTKLLANCFAQGEALLRGRTADEVRAEGKADEALVPHLVFEGNRPSNTLLLQRLDAFHLGALLAMSEHRTFVQGALWNINPFDQWGVELGKMLARPIERELEGAPPQPHDASTAALIRRAAQFCASTD

SEQ ID NO: 35358 - protein, 252 aa, Zea mays
  misc_feature (96)..(96): Xaa can be any naturally occurring amino acid
MAANFWESSQYKQLLDQEEVDVVQPLDKERGISVEDFKLIKFHMSNHIMKLAQHIKVRQRVVATAITYMRRVYTKKSMVEFEPRLVAIACLYLAFXAEESIVQARNLVFYSKRLYPDEYKYELKDILGMEMRVLEALDYYLVVFHPYRSLSDFLQDAALNDVNMNQFTWGIVNDTYKMDLILVHPPYRIALACIYIASVQREKDITAWLQDLNEDMNLVKDIAMEILDFYENYRTITDEKVSSAFSKLALKP

SEQ ID NO: 35359 - protein, 495 aa, Bacillus sp. SG-1
MVKEDRMTNSHKQDQAGWNLDNSYAKLPDDFYTSQKPTPVESPELVAFNSAVAEELGLDAEVLRSQPAVFAGNELPHGSEPLAQAYAGHQFGHFNMLGDGRAVLLGEQITPEGKRFDIQLKGAGRTPYSRGGDGRAALGPMLREYIISEAMHALGIPTTRSLAVVTTGTDIVREEMLPGAILTRVAASHIRVGTFQFAANFSDEEELKALADYTVDRHYPELKGDENPYLALLKKVMERQAELVTRWQMVGFIHGVMNTDNVTISGETIDYGPCAFMNTFDPATVFSSIDREGRYKYGNQPPITGWNLARFAESLLPLLHEDQEEGLKLAQEAISEFPKLIHSKWLSGMRKKLGLFNEEKQDKELIDILLGKMHEHKADYTNTFAALTFDKPEETVLHDKPEFDRWYAIWKERLGRQEESFEEAQELMRKNNPAIIPRNHRVEEALEAAVENGDLSVMERLLEALSDPYAHSPEQAEYAKLPPESHGPYQTFCGT

SEQ ID NO: 35360 - protein, 511 aa, Pseudomonas putida GB-1
MTSTPKPLVLIILDGFGHSEVPEHNAIFAANTPVYDRLRATLPHGLISGSGMDVGLPDGQMGNSEVGHMNLGAGRVVYQDFTRVTKAIRDGEFFKNPVLTGAVDKAASAGKAVHILGLLSDGGVHSHQDHLVAMAELAAQRGAEKIYLHAFLDGRDTPPRSAQSSIELLDATFAKLGKGRIASLIGRYYAMDRDNRWDRVSAAYNLIVDSAAEYTADTAQAGLEAAYARDESDEFVKATRIGEAVKVEDGDAVVFMNFRADRARELSRAFVEPDFTEFARARLPKMAAYIGLTQYSAKIPAPAAFAPSSLNNVLGEYLAKNGKTQLRIAETEKYAHVTFFFSGGREEPFEGEERILIPSPKVATYDLQPEMNAPQVTDRIVEAIEQQRFDVIVVNYANGDMVGHTGVFEAAVKAVEALDTCVGRIVDALEKVGGEALITADHGNVEQMEDECTGQAHTAHTTEPVPFIYVGKRNLKVRDGGVLADVAPTMLQLLGLEKPVEMTGTSILVDA

SEQ ID NO: 35361 - protein, 92 aa, Arabidopsis halleri subsp. halleri
LTESVPFFREIVTGAFEKFIKVTMKLPLTGQQYSEKVTENCVAIWKSLGIYTDCEAKAVEKFLEIFKEETFPPGSSILFALSPTGSLTVAFS

SEQ ID NO: 35362 - protein, 402 aa, Oryza sativa Indica Group
MATKRSVGTLGEADLRGKKVFVRADLNVPLDDAQKITDDTRIRASVPTVKFLLEKGAKVILASHLGRPKGVTPKYSLKPLVPRLSELLGVDVVMANDCIGEEVEKLAAALPEGGVLLLENVRFYKEEEKNDPEFAKKLAAVADLYVNDAFGTAHRAHASTEGVTKFLKPAVAGFLMQKELDYLVGAVANPKKPFAAIVGGSKVSTKIGVIESLLAKVDVLILGGGMIFTFYKAQGYAVGKSLVEEDKLELATSLIEKAKAKGVSLLLPTDVVVADKFAADAESRTVAASAIPDGWMGLDVGPDAIKTSSEALDTCNTIIWNGPMGVFEFEKFAAGTDAIAKKLADLTTTKGATTIIGGGDSVAAVEKAGLADKMSHISTGGGASLELLEGKTLPGVLALDEA

SEQ ID NO: 35363 - protein, 402 aa, Oryza sativa Indica Group
MATKRSVWTLGEADLRGKKVFVRADLNVPLDDAQKITDDTRIRASVPTVKFLLEKGAKVILASHLGRPKGVTPKYSLKPLVPRLSELLGVDVVMANDCIGEEVEKLAAALPEGGVLLLENVRFYKEEEKNDPEFAKKLAAVADLYVNDAFGTAHRAHASTEGVTKFLKPAVAGFLMQKELDYLVGAVANPKKPFAAIVGGSKVSTKIGVIESLLAKVDVLILGGGMIFTFYKAQGYAVGKSLVEEDKLELATSLIEKAKAKGVSLLLPTDVVVADKFAADAESKTVAASAIPDGWMGLDVGPDAIKTSSEALDTCNTIIWNGPMGVFEFEKLAAGTDAIAKKLADLTTTKGATTIIGGGDSVAAVEKAGLADKMSHISTGGGASLELLEGKTLPGVLALDEA

SEQ ID NO: 35364 - protein, 330 aa, Pyrobaculum aerophilum str. IM2
MKAYVLRNFKELVLSEVDRPKPGPGRAVVKIVAAGVCYRDFLGWQGFQRVKLPLIAGHEFAGVVEEVGEGVSEFKPGDAVAGMMYEYCGECEYCKSGREYLCKNRKIYGEDLPGAFAEYISVDQKSLVKIPPGVSFEAASYAACVLSTVVRGARKIGVSPGRQILVTGAGGGVGVHAVQVVKAYGARVIAVTSPSKAEYVAKFADYVITNKAFSDEVKKLGGADGAIEAVGGPTLEQTLRSLNWGAKVALIGNVDPQPAPIPLGILILKEIDVLPVIQGSKADLQEALRLLASGAVKPVYTVHGFSDIPRLLEETPKASHVGRRVVKMST

SEQ ID NO: 35365 - protein, 181 aa, Triticum aestivum
  misc_feature (44)..(44): Xaa can be any naturally occurring amino acid
AQSVGPYVADIDGYLRSLEVKQLRRPRDDYMVAMQKDISATMRXILVDRLVDVVDEFNLLVDTLYLALSYIDRFLTASVITRDRLQLLGVASLFVAAKYEEIHVPKLDKFSDITDGTYTNQQVVKMEADILKYLNFQMGSPTIRTFLLRFLISCRGGHCASAKRLELMCCYLAEFSLLDYD

SEQ ID NO: 35366 - protein, 852 aa, Caulobacter crescentus CB15
MIVSNLVLTAPLQGWVSALEEAPDAVFAERMLGDGLAIDPLGSTLHAPCDGSVVSVHRARHAVTLRATNGAEILMHVGLETVALNGEGFEVFVEEGQTVKAGDRLIGLDLDLLAQRARSLITPVVITNGEAFQIVRRDQDRQIGVGQFLMELSPIAGASRAAASGAADQITRQIIVPLAHGIHARPAARIAQMAKTFASDLTLATGPRRANARSPVGLMSLAIRHGDTIQLLASGPDAQAAVTALAELIEGGMGEGAPVAAKTSSTKTAPTKTEPSEPPPPAPLPRDGVLKGVPAAPGLAIGKAVRLSTAEIVVREAGEGVAHEEAALAVALETVRARIGKAAETGDKARKAILAAHQAFLDDPELYAGAHRLIAEGKSAGFAWRRAVGGYVQALQALGDRRMAERVDDLIDLERQVLRALSGEEETGAALAPGSILLADELLPSQLMGADPAALAGFATARGGPTSHVAILAAAMGVPALVAVGGALSKVKDGATLILDADAGTLRVAPDAKALEAAQTALAQRQQRKAAAKAAAHEPAVTRDGVRIEVFANTGSVADAQAAVANGAEGSGLLRTEFLFLDRETPPDEDEQARQYQAIAEALDGRPLIIRTLDVGGDKAAPYLPIPAEENPALGLRGVRVSLWRPHLLKAQLRAILRVEPRGQCKIMVPMVASLDELRAVRAVLEEAKRELGITDRVQLGVMIETPAAAVTADLLAAEADFLSIGTNDLTQYVLAMDRGNPELAAGIDALHPAVLRMIDQTCQGAARHHRWVGVCGGLASDLDATPILLGLGVAELSTTASIAPDVKARVRALSLEACRALAAQALEQTSPQAVRALVQGQTNTPLGGLNP

SEQ ID NO: 35367 - protein, 238 aa, Synechococcus sp. WH 7803
MSDLQNQMKQAVADAAVQQFRDGMVVGLGSGSTAALMIKGLGERLAAGQLSDIVGVTTSFQGEVLAAELGIPLRSLNAVDRIDLAIDGADEVDPAFQLIKGGGACHVQEKLVAARADRFIVVVDSTKLVERLNLGFLLPVEVLPGAWVQISQQLKAMGGDAELRMATRKAGPVVTDQGNLVLDVRFEGGIADPASLEKEINNIPGVLENGLFVNLADEVLVGQIDGGVASARSLEKAG

SEQ ID NO: 35368 - protein, 314 aa, Pyrobaculum aerophilum str. IM2
MLDIESLTPREALGKALADLGDLRSDVVVLVADTGETTRAKLFAERHPERFFNVGIAEQSLVGIAAGLALAGFMPYALTFAAFMTRGWEQARNSVDRLALPVRLVGTHAGFADAYDGPSHQALEDIALFRVLPNFTVMAPADSCEVYKAVTASATLKGPAYIRVGRDFHIPVTCGLYDKFEIGKAYVVLDGSDVAIFTTGVVLPFAIEAAQFLKDRGISAAVVHFPTIKPLDYAAVEKYASVTGAVLTVEEHMVYGGFGSAIAEYLSQTRPTKMAIMGLKSYGRTAKSPQELYQYFGLTPENIAARAEELVKLK

SEQ ID NO: 35369 - protein, 211 aa, Listeria monocytogenes str. 4b F2365
MAEGLRTIYFVRHGKTEWNMTGQMQGWGDSPLVAEGIDGAKAVGEVLKDTPIDAVYTSTSKRTQDTAAYILGDREIEIQPLEELKEMGFGTWEGIRVTEIDEQHPEERAKILHSPETYKAEVNGGETYYELAERLLEGVEKIIAENLSGNILVVSHGMSLTLLLYLLQGGTVEDHRKEAPRILNTSISIVEYQNGEFSLKKINEIGHLDLK

SEQ ID NO: 35370 - protein, 398 aa, Candida glabrata CBS 138
MPRTITFNIPKEYKLVDLVGEGSYGIVCSATHLPTGNKVAIKRIRFPDSPPSDDGQGVPRLEEDDEHDNIAKVALIRTIREIKILSHFNNHENIITIFEKIKPMQSINFKEIYLVQELMETDLSRILASSNTLTVDHIQYFLYQILRALKAIHSAKVIHRDLKPSNILLNSNCDLKICDFGLARTYDPDDDASTMNGNNVGFLTEYVATRWYRAPEIMLNFQDYSTAIDIWSCGCVLAEMLFRKPIFPGKDYHHQLLLILDTLGTPSPEDIEAINYGRAKEYILSLPHFPKKDWSQLLGTDNEMLLDILDKLMIFNPKRRITAEQALEHPFLATYHDPKDEPNFPPLNFKGDEFWQLDNCMETSNGYGTDDSNNLRANVTRRKLREILYQEMVTPAPR

SEQ ID NO: 35371 - protein, 568 aa, Candida albicans SC5314
MVLSKHIDALRLESQILKKTPQAQLRKEAFIDAYDSHKNIPQFEIPQNSSNEQLIYKYLSQELALDGIPTLNLASFVNTYVDDTSARLIQDNLTKNLADNDEYPSLIDIQTRCISILSNLWHAPGKVDKVTGNRVTNSIGTATTGSSEAIMLAGLALKKRWQLKRKAEGKSTDNPNILMATCAQVALEKFACYFDVENRLIPVTEESGHLIDVSKIKENIDENTIGIFVIMGSTFTGAFEPVEEISKLLDEVEKERGLDIRIHVDGASGGFVAPFIFPHLKWDFAVPRVDSINTSGHKFGLTSVGLGWVIWKDADLLPKELRFSLDYLGGVEETFGLNFSRPGFPVITQYYNFLSLGRQGYAKIFDGCMTNARLLSRFLEESKYFDVVSVIHHKLSDSEKKAQFTREVDDKKLDSKLYTINEEFKPGLPVVAFRFSKEVRDKYPELPQELLSTLLRKRGYIIPNYHLPPSENDKEILRVVVRNSLSLNLLERLIQDITGATELLIKAADSIADYVSTSGEHTDVENRERIHKLLAAIASGGVAEVKEEKHKKDNHQGSKNKKSYRGTC

SEQ ID NO: 35372 - protein, 290 aa, Arabidopsis thaliana
  misc_feature (94)..(94): Xaa can be any naturally occurring amino acid
  misc_feature (120)..(120): Xaa can be any naturally occurring amino acid
  misc_feature (145)..(145): Xaa can be any naturally occurring amino acid
  misc_feature (217)..(217): Xaa can be any naturally occurring amino acid
MEGKEEDVRVGANKFPERQPIGTSAQSDKDYKEPPPAPLFEPGELASWSFWRAGIAEFIATFLFLYITVLTVMGVKRSPNMCASVGIQGIAWAXFGGMIFALVYCTAGISGGHINPAVTXFGLFLARKLSLTRAVYYIVMQCLGXAICGAGVDKGFQPKQYQALGGGANTIAHGYTKGSGLGAEIIGTFVLVYTVFSATDAKRNARDSHVPILAPLXPIGFAVFLVHLATISITGTGINPARSLGAAIIFNKDNACDDHGVFWVGPFIGAALAALYHVIVIRAIPFKSRS

SEQ ID NO: 35373 - protein, 370 aa, Ostreococcus tauri
  misc_feature (1)..(1): Xaa can be any naturally occurring amino acid
XVRGKGCKLWDAEGREFLDFTAGIAGPRTLGRGRGASDVGAGSNARAHEQSLSSTSFADKVFFCNSGTEANEGALKFARKYAKSRAQANGKSVEDAAYETVSFENGFHGRTMGALSLTWKEGYRAPFAPGLPGNTFTPYGDLEAAKNVIVKGKTCAVFIEPVQGEGGIYPADAEFLRGLRKLCDEADALLVYDEVQCGLGRTGKLWGHQMVQDAEPDILTVAKPLANGLPIGAVLMKDKVASVMAPGDHGSTFAGGPLVCAVANEVFDRVSTPAFLQNVADRGNELKSSLAEKLKGHPHLVEVRGAGLLVGVQFDVPAAPLVKACRDAGLLVITAGKGNILRLVPPLIVTSAECQKAVDVIARCAFDSLK

SEQ ID NO: 35374 - protein, 383 aa, Glycine max
MCVQDGEQAGEDHIEKNVDNSIRVSWPLHCDLLNAHMDNKEKDSSFRTPSDQISVANSSPLESICEDAEIVDKKQNLMNFVPTLRSGEWSDIGDRTSMEDTHICIGDLAEKFGNNELYKEAISFYGVFDGHGGKSAAQFVRDHLPRVIVEDADFPLELEKVVTRSFLEIDAEFARSCSTESSLSSGTTALTAIILGRSLLVANAGDCRAVLSRGGGAIEMSKDHRPLCIKERKRIESLGGYIDDGYLNGQLGVTRALGNWHLQGMKEINGKGGPLSAEPELKLITLTKEDEFLIIGSDGIWDVFRSQNAVDFARRRLQEHNDVKQCCKEVIGEAIKRGATDNLTVVMICFHSEPPAPMVVERPRVRRSISAEGLQNLKCLLEG

SEQ ID NO: 35375 - protein, 268 aa, Oryza sativa
  misc_feature (204)..(204): Xaa can be any naturally occurring amino acid
  misc_feature (227)..(227): Xaa can be any naturally occurring amino acid
MARSPAARKPSAAQTVAVTLALALASAGLLFLLFHLSPSSPTPHPHPHRRLRLRGARASPSPRGQIPFDPVIAGLERRRDDREWERLAAAGLHAPGFEAAPVPEDYIDGGGGFGADPDEDYINDAARFNLTRRVEALFPKIDAVDLHDRDHDGRIAFSEYERPSWAWRFDDHNSSNDGVGWWKEEHFNASDMDGDGFLNLTEFXRLLTSSRYYEPKANKLVVQRRSXRERDKDNDGKLHFQEFFNGIIFLISGFLMKEAFNRRTPNVF

SEQ ID NO: 35376 - protein, 493 aa, Ralstonia eutropha JMP134
MDSSKTGAQAPDFDFVLFGATGDLARRKLLPALFDAHAAGALHPRGRILALGSQPLSHEAYLAMLNDEVLPALAGNAVASSWPSFVERIVYLQVDANAEPGFDALAELVNARAAPVVVYYLATAPHLFVRICEQLSRVGLTDQRSRIVLEKPLGHDLESSEEINSAVARFFAEDQIYRIDHYLGKESVQNLMAVRFGNVLFEPLWRREWVKEVQITIAEELGVERRGNFYDGIGALRDMVQNHLLQLLCMVAMEPPTSLSEDAIRDEKLKILKALKPIRPETVAETVVRGQYCRGAAGGDPVPGYVSEPGIPADSRTETFVAIKAEIANWRWAGVPFYLRTGKRMQSRVAEIVIHFHDVPCALFDRPLGTPAGNRLVITLQPEESIRLYFLTKQPGDTQALVPASLDLQRPGTGTRVRRMGAYERLLLDVIRGRLGLFVRRDEQVQAWRWVAPILKTWQSTNTPPKLYTAGTWGPAASSALLSRDGMAWHEEM

SEQ ID NO: 35377 - protein, 131 aa, Aggregatibacter actinomycetemcomitans
SFCERVISGEWKGYTGKAITDVINIGIGGSDLGPYMVTEALRPYKNHLTMHFVSNVDGTHIAETLKKVNPETTLVLVASKTFTTQETMTNANSARDWFLATAKDEKHVAKHFAALSTNAKEVEKFGIDTDN

SEQ ID NO: 35378 - protein, 287 aa, Arabidopsis thaliana
MEGKEEDVRVGANKFPERQPIGTSAQSTDKDYKEPPPAPLFEPGELSSWSFYRAGIAEFIATFLFLYITVLTVMGVKRAPNMCASVGIQGIAWAFGGMIFALVYCTAGISGGHINPAVTFGLFLARKLSLTRAVFYMIMQCLGAICGAGVVKGFQPTPYQTLGGGANTVAHGYTKGSGLGAEIIGTFVLVYTVFSATDAKRSARDSHVPILAPLPIGFAVFLVHLATIPITGTGINPARSLGAAIIYNKDHSWDDHWIFWVGPFIGAALAALYHQIVIRAIPFKSKS

SEQ ID NO: 35379 - protein, 131 aa, Pasteurella multocida
DFCHRVISGEWKGYTGKAITDVVNIGIGGSDLGPYMVTEALRPYKNHLNLHFVSNVDGTHIAETLKKVNPETTLFLVASKTFTTQETMTNAHSARNWFLTTAKDESHVAKHFAALSTNSKAVAEFGIDTNN

SEQ ID NO: 35380 - protein, 313 aa, Burkholderia vietnamiensis G4
MTNPAIHDHDAPAFVANDASWYEASARQRIDALLDAGSFDEFLGPAERVASPHLPLFGLPQQFDDGMVVGHGRLDGRPVLIAAQEGRFMGGAFGEVHGAKLTGLLRAAREVGKPVLILFDTGGVRLQEANAGELAIAEIMRALVEARATGVAVLGLIGGRAGCYGGGGLLAACCSALAVSEQGRISVSGPEVIETNRGVEEFDAKDRALIWRTMGGKHRRLIGGADRYVADTPAAFRAAALELLGCAPVFDTAMLRAEQARLEARVARFGRCADALDVWRALGADRPEAIPGMPDDAFARLADQLQEPQHDAR

SEQ ID NO: 35381 - protein, 92 aa, Arabidopsis halleri subsp. halleri
LTESVPFFRDIVTGAFEKFIKVTMKLPLTGQQYSEKVTENCVAIWKSLGIYTDCEAKAVEKFLEIFKEETFPPGSSILFALSPTGSLTVAFS

SEQ ID NO: 35382 - protein, 315 aa, Nostoc punctiforme PCC 73102
MAKIIVTGAAGFIGSHLVYILLQQGEEVIGIDEFNDYCDPMLKRKNVAHLHSSPGFTLIEADIQFLDWQELLKDVDVVYHQAAQAGVRASWGKAFRGYTERNINATQVLLEAAKDAKHLKRLVFASSSSVYGDAETLPTHEGICPEPVSPYGITKLAAETLCRLYHKNFGVPYVSLRYFTVYGPKQRPDMAFHKFFKSILQDEAIPIYGDGQQTREFTFVGDIVAANLAAASTPQAVGEIFNIGGGSRVVLAEVLDTIEEIVGKPIKRNHIEKAMGDARHTAADVSKAQKILGYQPQVSLRDGLTQEWRWIKSLY

SEQ ID NO: 35383 - protein, 350 aa, Arabidopsis thaliana
MTKTTMTKIPNLPDDLESEILSRIPAKSLTKLKTTCKRWYVLFRDPKFAKKNLGKSAREVMLVMNQRLHSISVNRKLIRLSDSKDVVVSKIYQCEGLVLCTTYGNNRLVVWNPCTENLRVAEFEIFDFGSDCGRVIDDAITWGIFSAGVSFNGNTYWIGGEKETGFFLMDFDFTTERFGRFPLPYQSYDYEDIAVLSVVKEEKLSLMNQNIHINSSEMKIWVTNKFDEAKYLSWSQFLVVDFDKFTLPNLNSVITFLLDEENKVALCCDTDMEDEERTKIYIVGVDLCKQVFKEVTKGSVLNWPCFVSYAPNLVHIQKDTPKVKKKLRAKEVSLMDHLSFFLLFLVVMFL

SEQ ID NO: 35384 - protein, 137 aa, Shigella flexneri 2a str. 301
MANKPSAEELKKNLSEMQFYVTQNHGTEPPFTGRLLHNKRDGVYHCLICDAPLFHSETKYDSGCGWPSFYEPVSEESIRYIKDLSHGMQRIEIRCGNCDAHLGHVFPDGPQPTGERYCVNSASLRFTDGENGEEING

SEQ ID NO: 35385 - protein, 601 aa, Burkholderia xenovorans LB400
MSESIAAVCRGITQLEEVRVSFTLHGIPVSRGIAIGRAYLIAPAALDVDHYLIEPAQIDGEVERFRAAQQHVHRELDALRADLAADAPSEMGAFINVHSMILNDAMLVQETIDLIRTRRYNVEWALTEQLERLSRHFDDIEDEYLRERKADIEQVVERVLKALAGASVALVDGVHGACDEMIVVAHDIAPADMMQFKTQTFQGFVTDLGGRTSHTAIVARSLGIPAAVGVQHASALIRQDDLIIVDGDHGIVIVDPAPIVLEEYSYRQSEKALEQRKLQRLKFSPTQTLCGTRIELCANIELPEDARAALEAGAMGVGLFRSEFLFMNHKDRLPEEEEQFAAYRRAVELMNGLPVTIRTIDVGADKPLDSMGGGDGYETAANPALGLRAIRWSLSEPQMFLTQLRAILRASAFGTVKILIPMLAHAQEIDQTLDLIREAKRQLDDAGIAYDPNVQVGAMIEIPAAAIALPLFLKRLDFLSIGTNDLIQYTLAIDRADNAVAHLYDPLHPAVLHLIAFTLREAKRAGVPVSVCGEMAGDPALTRLLLGMGLTEFSMHPSQLLVVKQEVLRAHLKTLEKPVADVLASFEPEEVQAALKRVTLA

SEQ ID NO: 35386 - protein, 248 aa, Burkholderia xenovorans LB400
MYKLVLIRHGESTWNKENRFTGWVDVDLTEQGNNEAQQAGVLLKDSGYTFDIAYTSVLKRAIRTLWHVQDKMDLMYLPVVHSWRLNERHYGALSGLNKAETAARFGDEQVLVWRRSYDTPPPALEPTDERAPYNDPRYAKVPREQLPLTECLKDTVARVLPLWNESIAPAIKSGRQVLIAAHGNSIRALVKYLDDISDNDIVGLNIPNGVPLVYELDENLRPIKHYYLGDQEAIAKAQAAVARQGKAG

SEQ ID NO: 35387 - protein, 335 aa, Burkholderia xenovorans LB400
MPAMKVAVLGAGAWGTALAGHLAVRHDTVLWARQPALIADLRASHENARYLAGVALPPALRYETDLNAALDHALADNALCVVATPVAGLRGLFRAMRDAGKVPAHVVWLCKGFEADSQLMPHQVVAAELPEHGSNGVLSGPSFAREVGQGLPVALTIASASAACRERTVAAFHHGAMRIYTGDDVVGVEVGGAVKNVLAIATGIADGLGLGLNARAALITRGLAEMSRLGVTLGGRAETFTGLTGLGDLILTATGDLSRNRTVGLQLAAGRTLDDILGGLGHVAEGVRCAQAVLAIARAHAIEMPITQAVCAVLFDGVAPRDAVSALLRRDSKAE

SEQ ID NO: 35388 - protein, 260 aa, Vibrio cholerae O1 biovar eltor str. N16961
MTDTNVLANSATDNQETTHFGFETVRKDEKVHKVAQVFHSVAAKYDIMNDLMSGGIHRLWKRFTIDCSGARPGQRILDLGGGTGDLTAKFSRIVGEKGHVILADINNSMLNVGRDKLRDSGVVGNVHYVQANAEELPFPDNYFDCITISFCLRNVTDKDKALRSMFRVLKPGGRLLVLEFSKPILEPLSKLYDTYSFHILPKMGQLIANDADSYRYLAESIRMHPDQETLKGMMEEAGFEQTTYYNLTGGIVALHRGYKF

SEQ ID NO: 35389 - protein, 720 aa, Zea mays
MAPSALASLPAPLRSLRLKTKQQELLLRVSALALIYVLAFAVRLFSVLRYESMIHEFDPYFNYRTTLFLTENGFSEFWNWFDSESWYPLGRVVGGTLFPGLMVTAALLHRLLRALSLAVHIREVCVLTAPFFAANTTLVAYAFGREIWDSGAGLVAAALIATVPGYISRSVAGSYDNEGVAIFALLLTFYFFVRAVNTGSLAWALASAFGYFYMVSAWGGYVFIINLVPLYVLVLLVTGRYSQRLYVAYNCMYVLGMLLAMQIRFVGFQHVQSGEHMAAMGVFFLLQVFFFLDWVKYLLNDARLFKSFLRITLTCVITVGTLALGIGTASGYISPWTGRFYSLLDPTYAKDHIPIIASVSEHQPTAWSSFMFDFHILLFLFPAGLYFCFKRLSDATIFIVMYGLTSMYFAGVMVRLILVAAPAVCLISAIAASATIKNLTTLIRTKSRSPQTTSGKTTGSKSAAKGVVDQSLPFQHNAAIGLLLGAFYLLSRYAIHCTWVTSEAYSSPSIVLAARGHNGGRVIFDDYREAYYWLRQNTPPDAKIMSWWDYGYQITAMGNRTVIVDNNTWNNTHIATVGRAMSSYEDEAYEIMQSLDVNYVLVVFGGVTGYSSDDINKFLWMVRIGGGVFPVIKEPDYLVNGEYRIDKGAAPKMLNCLMYKLCYYRFGELTTEYGKPPGYDRVRGVEIGNKDIKLEYLEEAFTTSNWIVRIYKVKPPKNRS

SEQ ID NO: 35390 - protein, 364 aa, Gloeobacter violaceus PCC 7421
MLKTGIVGLPNVGKSTLFNALVENAKAQAANFPFCTIEPNTGVVNVPDERLGILARIVSTSTIIPARIEYVDIAGLVRGASQGEGLGNQFLSHIRQVDALVHVVRCFESTDIIHVEGSVDPVRDISTINLELALSDLGQVDKRLQKIAKQKGTSKDQYAVESSALEKITAVLNEGKPARSCALTDAEKETVVPLELLTFKPVIYAANVSEEELATGNRFTEQVAAIAAEESALMVVISAQLEAELAELEPEERSAYLTDLGVSDSGLQKMIRATYDLLGLQTFFTAGEKEVRAWTITRGTTAPQAAGTIHTDFERGFIRAETVAYPDLVTAGSQVAAREKGQVRSEGKEYIVKDGDVMHFRFNV

SEQ ID NO: 35391 - protein, 268 aa, Bacillus cereus G9241
MKINMIQSGKIYIRGRTVVFMIIRNEQDLEGLRKIGRIVALAREEMKKEAKPGMTTKELDLIGKKVLDEHGAISAPEKEYDFPGVTCISVNEEVAHGIPGDRVLKEGDLVNVDVSAALDGYYADTGISFVLGEDEAKEKLCQAAVDAFWAAMKKVKAGSKQNQIGRAVSNFAHKNGYNVIQNLTGHGIGLSLHEAPNHILSYFDPMDNALLKDGLVIAVEPFISMKADHIIERGDDGWTFVTPDKSLVAQCEHTVVVTRGEPIILTEV

SEQ ID NO: 35392 - protein, 275 aa, Oryza sativa Indica Group
MAASHGNAIFVLLLCTLFLPSLACDSGGVKFGYTGSIGPDFWGNLSADFTRCSNGRQQSPIDIDTNNLVHELNMEPLHRNYTAANATLVDNIFNVALRYEEAAGVLSINGVKYTLKQMHWHSPSEHTINGFRFPLELHMVHTNENGNITVLAFLYRFGRPDPFFEQDKLAALNAEGCKAEKGSPVPAGSVSLLTMRQHVHIYYRYVGSLTTPPCAENVIWNIPAMPREMTPQQAADLMAPLDEGYRRNSRPTQQMNGRTVQLYHRFWGKKRRSSP

SEQ ID NO: 35393 - protein, 216 aa, Staphylococcus xylosus
MFKFLKRIKDDVNMVFEQDPAARTTLEVITSYAGVHAVWSHLIAHELYKKKKYVLARLISQVTRFFTGIEIHPGAQIGRRLFIDHGMGVVIGETCRIGDNVTIYQGVTLGGTGKERGKRHPDIGDNVLIAAGAKVLGNITINANVNIGANSVVLNSVPSYSTVVGIPGHIVKQDGRRIGKTFDHRNLPDPIYEQLKELEKQLEKTRNGEIQDDYII

SEQ ID NO: 35394 - protein, 960 aa, Bifidobacterium longum DJO10A
MALALYRRYRPDTFEGVIGQDQVTVPLMRALDEGKLTHAYLFSGPRGCGKTSSARILARCVNCAKGPTSHPCGECESCKDLATGGPGSIDVVEIDAASHNGVDDARELRERAGFAPARDRYKIFILDEAHMVTQQGFNALLKIVEEPPEHVMFIFATTEPDKVIGTIRSRTHHYPFRLVPQEVMGPYLETICDKEGIKPEPGVLKLAMRAGGGSMRDTLSVLDQLMVGSVEGVITHDAAVALLGFTPEALIGEAVDAVIDHNGEALYGVIQKVVVGGFDPRRFVEDLLARVRDLLVLTLAGDRAESVLSDTAEAEDMDDLHRQAKALGLGALTAMADIINTTLGAMTGAISPRMRLELLAARLLAGSESGFATAAPAPASSGMPPAAASSTSTTSAASGTGASGFAGASRGGFAGASHGGFSGAARNQQAAAPQSTASHESVGGNGPVSDRPADSPSVQPAVATAAAGAGWGAPAASPAVPAQPVASPAASDNRSIDEKWDAAVAALPETIREYVSRDKVPTVKFGPNRKGLPCLSMTFDKSLSQHAFALAVDNSGKKAAAVVMDAVRNEFGANAVIAPSAVAANGERVESVKRMSPEQLAKVKQQIAMAKAGLAASSLGAGLGIHMGSEPKAPKPTETGRAEDTDDSHRAGQSSASTAAKNWSDDDPWAKPAVSNASPQSADGFAPNEPVATPAPEEHHKKHVAVPDISDGVDPWAAPAAPVAPTASVASAGPTGQSTGQPAAASSATAVAGESDDPWNQTQSQAAVSPASQPAEADPWNQPYQQSPHDDPWNQPQGNHAQAAPQPGDDPWNQPQSQTPASSVPQTVSGNMSGDDPWNQPQSVPQPAAGDDPWNQPQAVPQSAPQATPHGDPWNQPQPAQPTPNADPWNSQPQPQPKPQPQVAAEDDEYSMSDQSLGEATAMNLDDLKKLFEVKKVEQFAADDPKNPKNIQPAKKHSDE

SEQ ID NO: 35395 - protein, 336 aa, Pseudomonas putida GB-1
MSRVTLSRYLIEQTRSNNTPADLRFLIEVVARACKEISHHVSKGALGGVLGSMGTENVQGEVQKKLDVISNDILLEANEWGGHLAGMASEEMDNAYQIPGKYPKGAYLLVFDPLDGSSNIDVNVSVGTIFSVLRCPNQYLSQNESLNEEAFLQPGTEQVAAGYAIYGPQTMLILTLGNGVKGFTLDRELGSFVLTHENIQVPATTAEFAINMSNQRHWEAPVQRYVGELLAGETGPLKKNYNMRWIASMVADVHRILTRGGLFMYPRDAREPSKPGKLRLMYEANPMSFIIEQAGGASTNGYDRILDIKPESLHQRVSVILGSKEEVERVTAYHKE

SEQ ID NO: 35396 - protein, 228 aa, Triticum aestivum
  misc_feature (5)..(5): Xaa can be any naturally occurring amino acid
  misc_feature (18)..(18): Xaa can be any naturally occurring amino acid
ESRYXDGRPVTESEIAGXLIGMIFAGQHTSASAAIWTGACLLSHGDGRHLVAAVEEQKQIIARHGRERVDYDVLREIGILRCCIMEALRMHAPANVIIRQANKSFSLQARDGGRYAIPKGHTLVTSPAVNNRLPHIFKDPLVYDPSRFGPGREEDKVGGKFSFTPFSAGRHVCLGEDYAYMQIKVIWSHLLRNFELKIISPFPDEEWEKFIPGPRGKVIVTYKRRPLE

SEQ ID NO: 35397 - protein, 174 aa, Azoarcus sp. EbN1
MAKQQSKRPQAADERDDGLREKMVAINRVTKVVKGGRILGFAALTVVGDGDGGVGMGKGKSREVPVAVQKAMDEARRKLKKISLKNGTLQHAIVGKHGAASVLMQPAPSGTGIIAGGPMRAVFEVMGVTDVTCKCLGSANPYNVVRATLNGLLAINTPAEIAAKRGKSVEEILG

SEQ ID NO: 35398 - protein, 516 aa, Oryza sativa Japonica Group
MDGDSSYSPALAAVAGAVALVAFCSYYLAVTRATGDGEARRRRRRHPPVVGTVFHQLYHVRRLHDYYTALCREHTTFRLLATPGRRNIYTCDPAVVEHILRTNFPSYGKGPLNSEILNDLFGEGIFAVDGEKWKTQRKIASYDFTTRALRDFSSDVFKRNAAKLAGVVSNHAASNQSMDFKGLLTRATMDSIFTIAFGQDLNTLDGSGEGRHFAKAFDDAGEYLLLRYLNPFWKLARLLNVGAEATLKERIKVVDEFVYKLIRARSDELSNTMAQDHRSRDDLLSRFIQATTSDSGTVDYKYLRDIVLNIVIAAKDSTSGSLAWFLYMACKRPEVQEKIFDEVMETTNAGDCASIDEFLTSLTDQALNKMHYLHAALTETLRLYPSVPLENKQCFSDDVLPNGFSVSKGDGVFYMPYAMGRMEFLWGKDAEAFRPERWLDEHGVFQQESPFKFTAFQAGPRICIGKDFAYRQMKIFAAVLIRSFVFKLRDKKDNVSYRTAITLAIDQDLHLTATAR

SEQ ID NO: 35399 - protein, 109 aa, Glycine max
  misc_feature (76)..(76): Xaa can be any naturally occurring amino acid
  misc_feature (103)..(103): Xaa can be any naturally occurring amino acid
MGKAKKGPKFADMKKIVTCKALYSYKEEVLNPEKNTLMNDKLPTNVSTYSSTLLFQYNTALGPPYGELADTNLINXSIQNKSDLDKGTMDCLYAKSTPCITDXVMAELE

SEQ ID NO: 35400 - protein, 481 aa, Zea mays
MVKICCIGAGYVGGPTMAVIALKCPAIEVVVVDISEPRIAGWNSERLPIYEPGLDDVVRQCRGRNLFFSTEVHRHVGDADIVFVSVNTPTKTCGLGAGKAADLTYWESAARMIADVSRSDKIVVEKSTVPVKTAEAIEKILVHNSRGVRYQILSNPEFLAEGTAVQDLFAPDRVLIGGRETPEGRAAVARLRDVYAQWVPGDRIITTNLWSAELSKLAANAFLAQRISSVNAISALCEATGADVTEVAHSVGRDARIGPRFLSASVGFGGSCFQKDILNLVYICECYGLPEVAAYWREVIRINDHQKSRFVNRVVSSMFNTVAGKKIAVLGFAFKKDTGDTRETPAIDVCNGLLGDKAVISIYDPQVTGEQVSRDLAMNKFDWDHPRHLQPLSATDLAKQVAVAPDAYEAARDAHAVCILTEWDEFRTLDYKRMFDAMHKPAFIFDGRNVVDPAKLREIGFVVYAIGKPLDDWLKDMPAVA

SEQ ID NO: 35401 - protein, 427 aa, Aeropyrum pernix K1
MEVRRGDGSVFRGVLMPKHETSHPDTVVIKLGNGYNIGVLVGEGDDIVVKGSLRPGTPGALVPLLEEPLQPAEERVYIIGAGGTIASRVDYETGAVKPYLDASELATTIPELQRYASIEAEQLFSILSEDMKPSMWEAIVDRAARVLEAGYDGVVVAHGTDTMAFTASALSFAFHKGLPSPVILTGSQRSSDRPSSDAAFNLTASVLAASRAPFAEVAVVMHGETGDTYALAHRGVRVKKMHSSRRDAFQSVNDKPLARIYPFEGRVEMLRDDYRRRGESGLEVDNGFEERVALVKHFPGLISEVIDALLDRGFKGIVVEGTGFGHVSSDAIKSIERARDQGVPIVITTQTVFGRVNLNVYSTGRKMLAAGAIPAGDMTSEAAYAKLSWILARTRELEVVRKMFQRNLAGEVSERHILRLYRHIGGV

SEQ ID NO: 35402 - protein, 517 aa, Alteromonadales bacterium TW-7
MVSQELDYFRAIIQANMEPLAKVTEVSEMPDLSAKLGNHVWLKREDQQPVYSFKLRGAYNKLNKLPKGSVVITASAGNHAQGVALSASHLGHKATIVMPVTTPEIKVNAVRALGGEVVLHGHQFDVAKAHALELTEQRNGIFVPPFDDPDVIVGQGTVARELMQQLNELDAVFIPVGGGGLLAGMAVYIKSLRPDIKVIGVEADESACLQAALKAGEPVELDRVGSFADGVAVKIIGKETFRLAQKFCDEVITVTSDEICAAMQDIFVSTRAIAEPSGALATAGLKKWSQQSGLKGLHLAAVLSGANLNFDRLRYVAERTALGEKNEALLAVTIKEEKGSFKQFCASLGGRAITEFNYRYAGPGEAQIFVGIALRQGEQELNELKQDLTKNDYAFCDLSDNELAKLHVRYMVGGKAPEKLHERLLRFEFPEYPGALARFLDTLGNDWNITLFHYRSQGGSMGYVLAGFAIEPEQFETFNEHLNDLGYSVQDETHNPCFTQFLTTQPLSEKTAKLASV

SEQ ID NO: 35403 - protein, 390 aa, Arabidopsis thaliana
MGKARGGRVTFDPERVVMSGGATGANETIMFCLADPGDVFLIPSPYYAAFDRDLRWRTGVEIIPVPCSSSDNFKLTVDAAEWAYKKAQESNKKVKGLILTNPSNPLGTMLDKDTLTNLVRFVTRKNIHLVVDEIYAATVFAGGDFVSVAEVVNDVDISEVNVDLIHIVYSLSKDMGLPGFRVGIVYSFNDSVVSCARKMSSFGLVSSQTQLMLASMLSDDQFVDNFLMESSRRLGIRHKVFTTGIKKADIACLTSNAGLFAWMDLRHLLRDRNSFESEIELWHIIIDRVKLNVSPGSSFRCTEPGWFRICFANMDDDTLHVALGRIQDFVSKNKNKIVEKASENDQVIQNKSAKKLKWTQTNLRLSFRRLYEDGLSSPGIMSPHSPLLRA

SEQ ID NO: 35404 - protein, 348 aa, Salmonella enterica subsp. enterica serovar Paratyphi B str.
MEFFRKTALAALVMGFSGAAFALPNITILATGGTIAGGGDSATKSNYTAGKVGVENLVDAVPQLKDIAVVKGEQVVNIGSQDMNDEVWLTLAKKINTECDSTDGFVITHGTDTMEETAYFLDLTVKCNKPVVLVGAMRPSTSMSADGPFNLYNAVVTAADKQSANRGVLVVMNDTVMDGRDVTKTNTTDVATFKAVNYGPLGYIHNGKIDYQRTPERKHTTSTPFDVSKLTALPKVGIVYNYANASDLPAKALVDAGYDGIVSAGVGNGNLYKTVFDTLATAAHNGTVVVRSSRVPTGATTQDAEVDDAKYGFVASGTLNPQKARVLLQLALTQTKDPKQIQSMFNQY

SEQ ID NO: 35405 - protein, 440 aa, Zea mays
  misc_feature (167)..(167): Xaa can be any naturally occurring amino acid
VNPRLVLLPGSPPSASDTWPTRGNPTVEVDLVAGDGRLHRSAVPSGASTGIYEALELRDGDKAVYGGKGVLQAVRNINEVIAPKLIGVDVRNQSDVDAVMLDIDGTQNKSKLGANAILGVSLSVCRAGAGAKGVPLYKHIQELAGIKELLVMPVPAFNVINRGSRAXGNNLAMQEFMILPVGATTFAEALRMGSEVYHVLKSIIKSKYGQDACNVGDEGGFAPNVQDNREGLILLMDAIEKAGYTGKIKIGMDVAASEFLTKDGNYDLNFKNQPNDGAHILSAQHPGDLYRDFVKDFPIVSIEDPFDQDDWSSWASLQSSVDIQIVGDDLLVTNPKRIADAIDKKACNALLLKVNQIGTVTESIEAALDSKAAGWGVMVSHRSGETEDNFIADLAIGLASGQIKTGAPCRSERLAKYNQLLRIEEELGNVRYAGEAFRSP

SEQ ID NO: 35406 - protein, 302 aa, Neurospora crassa
IRSFATHAQLPISIVNREDDAFLNPNFRFIDHSIIGKNVPVADQSFRVGCSCASDEECMYSTCQCLDEMAPDSDEEADPYTRKKRFAYYSQGAKKGLLRDRVLQSQEPIYECHQGCACSKDCPNRVVERGRTVPLQIFRTKDRGWGVKCPVNIKRGQFVDRYLGEIITSEEADRRRAESTIARRKDVYLFALDKFSDPDSLDPLLAGQPLEVDGEYMSGPTRFINHSCDPNMAIFARVGDHADKHIHDLALFAIKDIPKGTELTFDYVNGLTGLESDAHDPSKISEMTKCLCGTAKCRGYLW

SEQ ID NO: 35407 - protein, 647 aa, Candida glabrata CBS 138
MSSQFFLKTSKDIELFQGYPDFTQSNSAANAKDDQVISSVLSPCGRFFAISTKGNVKVFSGELLEVELLNLTINDVYEIQFSPSGNYMSTWERPSAKDAEHKNVKVWYLNKVFTEGEEQEPVFQYQHKPQNGWFMQFSKLDDYALKMFKNEIRIVKINDANKTNFHFDQPFATLSKTQENDSQPFSTYQVSPADFPTICTFTPEKGGKPAQLSIWSITEGKITKKIASKTFFKADSCQLQWNPQGNAVLCVATTDFDSTNKSYYGENTLYLLSFQGVNGAVGNNSVRVSLAKGPVHDISWSPTSRQFGVISGYMPATIQFFDLRGNVVHSLEKQPKNTILFSPSGRYILIAGFGNLQGSVQILDRHDKFKSLTVFNAANTSVCKWSPGGEFIMTATTSPRLRVDNCIKIWHVSGTLVFAKEFEELLKVDWRNTCKYKTLKDHPHVIKDWTPLNNTDAASLDPQIASPKKDLAIHESAKEYEAKHPKRDAKTGNGSTQSKSASTGGAYKPPHARRAAAVANNRSVPGASPKVQRAIPGLIPGLPVNEGSAAANKNRKRRANKKANSGTGEGAEKAESPAAPSITSTEPAKEASPEEKKIRSLLKKLRAIEMLKEKQAAGEKLQDLQVKKIETEGKFREELAALGWKEE

SEQ ID NO: 35408 - protein, 1292 aa, Oryza sativa Indica Group
MPPHEDTLDAGGGDVLTFRLHPLAVLKLSDRIREFQYQAAAAARGSYSSSSSSSSGTAAPEDPPPPPTRMSGCVIGVRRGGTVDVSDILDILILHGPDPATFDRTLLEKDQEIYKKAFPDLSVLGWYSIGTNVHATDMGIHHGDYTDMQIHQTTLSARLWPRRRLCGVHAGSRSGGEGPGARESGGGDVRIGRGEEEEEGGLDGGRFPQEVLLRLPTPPGRAETDDDDGENLYPGAGSGSRRRFFEELRLKADRIVKILLQDGPGFNTRQALDEMRPRVSTALVVVEKRLMRDRNLSRHDLGRDKFLLEVLQWKDQHGGTILKQLRTLGASLDWSRECFTMDEKRSKAVTEAFIRLHKEGLIYRDNRIVNWDCSLRTAISDIEVDYCELTEETLLEVPGCSTLVQFGVIINFAYPLEEGLGRGHRHAPQAHYLKELVVELATTWRRRQQGELVAGAPVAVATAVRGPRRRRRQSLAGAPTGGAVGGGGCRRWPRYPERPRRLTAGLGVAGCWSASNVYWRQRRRCGRGSWRRRLLAAWWWRATAQRRFAEAVARVCGSGDGGHDCGGGGDVGSGDGDGEVAERSAAVAAVVVTVSAVIRGMAASDGLPRAWETAATGRRGIVWWRGRRPAWRREAQPMAAEAGSAREARAVEMEAGLAREARPMEGGRIGAGDASGRGGWPGADRCGRRWRRRPRCEEELPCAFTSISHHLFDKMVIPKQPDPEEATSPPATAVGTGVAHGTRPAQERRQWHCRRREGGELMDANGTAFYLLLNPAINFSQKDIPVTIYERGDSGRERRDCVWLGTFTGEAEAGHAYDVAAQQFHGRDTVTKLPPLVKSDSKAAVELCFFASRSKAEVIDMLRKHTYLKELVVELATTWRRRQQGELVAGAPVAVATAVRGPRRRRRQSLAGAPRGGAVGGGGCRRRPRYPERPRRLTAGLGVAGCWSASNVYWRQRRRCGRGSWRQRLLAAWWWRATAQRRFAEAVARVGGSGDGGHDCGGGGDVGSGDGDGEVAERSAAAAAVVVTVSADIWSSFTDPRTAHQAVRTIGFIEVGNKSLVWDKDIGPGEDLEQFILKFPITKSLVVPNAQLKFVIEKKLNIGCWFNGRIVPELIWGLNYALDEFVPQEKGNLSNECHFPLSKQLHEQLKAYGFSISPQLINREFITSFGYLNYLERTSKNISRDLHQKFDRFFCGLEMSERVFVKVVADRLRSMEEVASTPGRREALSNAEFLLTVPKKYNTLSRLKRMEAEIMEAEVRGSGLGHPWVCVAVFAVALGVMEGLRIAMKRAN

SEQ ID NO: 35409 - protein, 582 aa, Candida glabrata CBS 138
MTDNKRSFLSQLNVFNKDNYQISSKKSEEGVYSNETEEASDVETGQQFTTELDQGEKRLGLFSCIGLICNRMLGTGVFAVSSTIYTLSGSIGLALILWAVGAIIAISGLYVYMEFGTAIPKNGGEKNYLEAIVKKPKFFITCMYASYVFFLGWAAGNSVNTAVMFLTAADAEITKWNQRGIGVAVVFFCFAVNAISVKAGLYLQNLLGIFKVGIVLFISVTGWVALGGGLKHGYQSHNFHNAFEGTNKATAYGVVNALYNVIWSFVGYSNVNYALGEVKDPVRTLKIAGPTSMVCLAIIYIFVNIAYFAVVPKEKLISSKLILAADFFDICFGGHSKRVAAALVGLSALGNVMSVIFSQGRIIQQLGREGVLPFSNFFASSKPFNSPMVGLFQHFIICMITIIAPPPGDAYNIILNLISYPMNIVNFVVSAGLLWIYWQRRQGKIEWNPPIKAGVFVTTFFMLSNIYLIVAPYVPPTHGESVYEHAPYWIHCVVAWGIFAFGGFYWFVWVKVLPKWGNYRLETKDILGEDGFWRVQVIKVPNETDKDHQEQSDESGTERADTFELDYIHLEPSKDTAKSHLD

SEQ ID NO: 35410 - protein, 157 aa, Ostreococcus tauri
MRGTMTDDDAHAIVRANRPDGVQRGLVAEIIARFARKGFTLRAMKMMNVTKEHAEKHYADLSSKPFFGGLVSYMCSGPVVAMVWEGKDVVKTGRKIIGATNPAASEPGTIRGDFCIEVGRNVIHGSDAVESANHEIGLWFPEGVCEYEPCAKAWIYE

SEQ ID NO: 35411 - protein, 556 aa, Mycobacterium tuberculosis H37Rv
MPDDIAAADPTDTQPHLRRDLANRHIQLIAIGGAIGTGLFMGSGRTISLAGPAVMVVYGIIGFFVFFVLRAMGELLLSNLNYKSFVDFAADLRGPAAGFFVGWSYWFAWVVTGIADLVAITGYARFWWPGLPIWVPALVTVALILAVNLFSVRHFGELEFWFALIKVAAIVCLIAVGAILVATNFVSPHGVHATIENLWNDNGFFPTGFLGVVSGFQIAFFAYIGVELVGTAAAETADPRRTLPRAINAVPLRVAVFYIGALLAILAVVPWRQFASGESPFVTMFSLAGLAAAASVVNFVVVTAAASSANSGFFSTGRMLFGLADEGHAPAAFHQLNRGGVPAPALLLTAPLLLTSIPLLYAGRSVIGAFTLVTTVSSLLFMFVWAMIIISYLVYRRRHPQRHTDSVYKMPGGVVMCWAVLVFFAFVIWTLTTETETATALAWFPLWFVLLAVGWLVTQRRQSRRSFGFHCQVVGVRQQLGRGMARLAMKIHARPKLRSAVVVEPVSAGEPGARRSAKSVRKLASDDSQSAHCPVAVVGLADGGRDPQYHHDGPDR

SEQ ID NO: 35412 - protein, 393 aa, Listeria monocytogenes str. 4b F2365
MKISKRLQNLPDQFFSSLVEKVGKKVAEGHDVINLGQGNPDQPTPKHIVEAMKTASEKPLNHKYSLFRGKHELKQAAADFYAREYNVTIDPNTEVAILFGTKTGLVELPMCLMDPGDTMLLPDPGYPDYLSGVVLGEVQFEKMPLIAANNFLPDFTKIPEDIAEKAELMYLNYPNNPTGAVATADFFEETVAFAKNHNIVVAHDFAYGGIGFDGKKPISFLETNGAKEVGIELYTLSKTYNMAGWRVGFAVGNSEVIEAINLIQDHMYVSLFPGIQDAAIEALTGDQTCVGELTARYESRRDAFISACKKIGWEAVAPAGSFFAWMPVPENFTSSEFADYLLEEVSVAVADGSGFGEFGEGYVRVGLLMDEERLEEAVTRVSKLHLFDKVTQQ

SEQ ID NO: 35413 - protein, 363 aa, Candida albicans SC5314
MNRSNLHLHFFVQKRWNSIDYLLKSIPQSPRTTNIYQSSKSSKSKKSKNLPSERQLKSYRNSIVSPLRLNEIYSPSWRTSYKENDLVKSRQFFGNARVELDWTLADYDEIPDVKYAKLAKEREEKLSSIDPYSRNETTESMLNSRKTFGIRPELLRALPEVLFMGHTNVGKSSLINGLLVKNKSITGPTQLAYVSARAGFTKTINCFNFSKKLRIIDSPGYGEYGDLKQGKVVVDYISRRHQLKKVYVLIDSVEGFREEDSYIFNLLIDEGVPFDIIFTKVDNVVSKYIPKNAFEANNCYDLIQTCNDRVVEHYGKLITSSGLQDIAMTPTFLFSNANTNKFLPKPAGMNEIQSNILDSCNLL

SEQ ID NO: 35414 - protein, 329 aa, Synechococcus sp. WH 7803
MALPPLVVATAREGWRWQWRQLMQGLGPADAEGRYLRPASDRMDVVIPDQSELQLRCEAQRPRLVIGRSCPWAHRTWLMHRLRRLEGTLTLLMATADHRAGRWSLVPAWLDCDSLLALYRHCGTPPHHRATVPALIDPGREAGLTPQLLGNDSAALTETLNQWPGGEGAMDLAPAALAPGIQRWMQLLQPAVNDGVYRCGFARTQKAYDEASAALFSALNAVEAALQHQGPWLCGVQPTIADVCLFPTLIRWELVYAPLFGCNAQPLWMFPALWRWRQAFYALPGVAETCAGEAWRADYFGALFPLNPGGIIPAGPDLCTLIGSSPALP

SEQ ID NO: 35415 - protein, 536 aa, Ostreococcus tauri
  misc_feature (536)..(536): Xaa can be any naturally occurring amino acid
MNRRRGERATDSDASTDDASTSDRALRRALSRVDILFLGVGGIVGAGVFVLTGEVASRRAGPGVAASYALAAMTSAITGLAYAEFATMMPEAGSSYSYAYAAFGEFGGVITGGNLVLELLIASAAIARGWTSYAAALVGCERGGGAVERHRGRRRRGRRRGIGRGAMTACSSRGAKETARFNFAVTCASLLVIALVVVAGSTKIDVANWSPFAPYGVGGIISGAAVVIFSFVGFDTVATCAEEVADPSVDLPIGILGSLGICASLYVIMCLVITGMISYADIDVNAPFAVAFTNFGMSWVASFVSVGALAAITTSLLLSMMGQPRIFMVMARDGLLPPWFSRVSERFGTPANATIFSGIVTGVMAVLLDINLLAQLVSIGTLSVFCCVNLGILIVRCTPEDADWSRRTPPLRRALGLLLSSLAFGLDYRQRGSAVSWFGVLCLALVVVSTLSFLTLPVVAKSGSRKTFRAPMVPFLPAVGVLLTCVLIGGLGAMAWIRYIVYTLACTAAYVTFAWRQYEHQKASSSASSGIELAEX

SEQ ID NO: 35416 - protein, 636 aa, Synechococcus sp. WH 7803
MSLISLVDASKDFGIRTLFEDLTLHVREGDRLGLIGPNGAGKSTLLKVLAGVEPLGSGERRCSARLRVELVGQDSQVNPGLTVLEQVFAGCGAKRDLLLRFSEVSEAVAQAPDDTALMGELGALSERMDEEEAWALEQQCQEVLQRLGITDLHRPVEDLSGGYRKRVGLASALVACPDVLLLDEPTNHLDAAAVEWLQSWLDRYPGAVVLVTHDRYVLDQVTRRIVEVERGVASSIDGNYSAYLQRKADQEVANAAEAARFKSVMRRELAWLRQGPKARSTKQRARIERIEALKASPVKQAKQELAMSSVSRRIGKVVIEAEELSVTADGQPGSPSLLRDFTYSFSPEDRVGIIGPNGSGKSTLLDLIAGRRQATSGSLRLGDTVHLGYLDQHTDALSEGRGLERKVIEFVEEAASRIDLGGEQLSASQLLERFLFPPAQQHSPLNKLSGGERRRLSLCRMLIQAPNVLLLDEPTNDLDVQTLSVLEDLLEDFRGCVVVVSHDRYFLDRTVDRLFCFDDGRLQRFEGNYSAFLDHKRALEKSSSTPSSVAKESASPKKKPAKSTDSGPRRRSFKESRELETLEQTLPDLEKRKADLEAAIGSGQGDLTVLSHDLAALLEQLQDSEERWLELSELAP

SEQ ID NO: 35417 - protein, 337 aa, Zea mays
MGKIKIGINGFGRIGRLVARVALQSEDVELVAVNDPFITTDYMTYMFKYDTVHGQWKHSDITLKDSKTLLFGEKPVTVFGIRNPEEIPWGEAGAEYVVESTGVFTDKDKAAAHLKGGAKKVVISAPSKDAPMFVVGVNEDKYTSDVNIVSNASCTTNCLAPLAKVIHDNFGIIEGLMTTVHAITATQKTVDGPSAKDWRGGRAASFNIIPSSTGAAKAVGKVLPELNGKLTGMSFRVPTVDVSVVDLTVRIEKGASYEEIKKAIKAASEGPLKGIMGYVEEDLVSTDFTGDSRSSIFDAKAGIALNDHFIKLVSWYDNEWGYSNRVVDLIRHMFKTQ

SEQ ID NO: 35418 - protein, 514 aa, Arabidopsis thaliana
MNVDFQNCLILILLCLLSFLCYSFFFKKPKDGFNLPPSPPSLPIIGHLHHLLSLFMHRSLQKLSSKYGPLLYLHVFNVPILLVSSPSIAYEIFRTQDVNVSSRDFPTNEGSLLFGSFGFGTAPSSGLKHSRGHKKSVQRSYYLNLLDKAVKKESVEIAEEAMKLVNNTVCQMIMGRSCSEENGEAERVRGLVTKTDALTKKFILAGILRKPLQKIGISLFKKELMDASCKFNEVLEKILVEYKEKVEEHHQGTDMMDKLLEVYGDEKAEYKITRDHIKSLFVDLFFAGTDTWTHAIQWIMAEIINNSYILERLREEIDSVVGKTRLIQETDLPNLPCLQATVKEGLRLHPPVPLVLRTFKEGCTIGGFYVPEKTTLVVNGYAMMRDPEYWEDPQEFKPERFLASSRSSQNDEIRDELLKYLPFGNGRRACPGANLAYISVGTAIGVMVQCFDWEIKGDKINMDEAPGKITLTMAHPLNCTLVPRTLIPVTSTVQIPSSFCLENRRREGQHERGC

SEQ ID NO: 35419 - protein, 445 aa, Vitis vinifera
MADVGGTMSEVSAPVRRVLLISAGASHSVALLSGNVVCSWGRGEDGQLGHGDAEDRLSPTYLSALDGHEVVSVTCGADHTTAYSESFTQVYSWGWGDFGRLGHGNSSDLFTPQPIKALHGLRIKQIACGDSHCLAVTMDGEVQSWGRNQNGQLGLGTTEDSLVPQKIQAFQGVSVKMVAAGAEHTAAVTEDGELYGWGWGRYGNLGLGDRNDRLVPEKVSTVEGVKMVKVACGWRHTISVSSSGGLYTYGWSKYGQLGHGDFEDHLTPHKLEALQENLISEISGGWRHTMALTSDGKLYGWGWNKFGQVGVGDNVDHCSPVQVKFPHEQKVVHISCGWRHTLAVTERQNVFSWGRGTNGQLGHGESIDRNIPKMIEVLSADGSGGQQIETSKVDPSTGRIWVSPSERYAVVPDETGSTQTGVSVKGNGNDASVPESDVKRIRLAE

SEQ ID NO: 35420 - protein, 467 aa, Pseudomonas putida GB-1
MQQAQGLKRGLSARHIRFMALGSAIGTGLFYGSASAIQMAGPAVLLAYLIGGAAVFMVMRALGEMAVHNPVAGSFGHYASTYLGPMAGFILGWTYAFEMVIVAIADVTAFGIYMGFWFPEVARWIWVLGIVFIIGGLNLCNVKVFGEMEFWLSLLKVGAIVAMILAGLGIMAFGFSQVGTGHAVGMSNLFDHGGFMPNGIGGLIASFAVVMFAFGGIEIIGVTAGEAKDPQRVIPKAINAVPLRILLFYVLTLFVLMCLYPWPQIGSQGSPFVQIFSNLGIGSAAAVLNVVVISAAISAINSDIFGAGRMMYGLAHQGHAPRSFGKLSKHGVPWMTVVVMGAALLIGVLLNYLIPENVFLLIASIATFATVWVWLMILLTQVAMRRSMSREEVAQLKFPVPFWPYGPAMAIAFMVFIFGVLGYFPDTQAALIVGVIWVVFLVASYLLWCKPRAGQGQPAVEPAELHR

SEQ ID NO: 35421 - protein, 215 aa, Zea mays
MAGATTPASGALVRLCLPSLLLFLYRQSRSYFGAAFWGALYAVAVQAYKAARLVCCRCEAVEMERTLAMIKPDGLSGKYTEAIKEVILDSGFHIVKETEVQLDAERASVFYAEHSQRSFFDSLVKYITSGPVLAMVLERPDAVAQWRTLIGPTDAKKAKTSHPNSTLCHFSIRAMCGLDSEKNCVHGSDSPESADREISFFFGEAESVTVEHDEL

SEQ ID NO: 35422 - protein, 381 aa, Burkholderia vietnamiensis G4
MLPSFSPALLALADGTVFRGYSIGAEGHTIGEVVFNTAITGYQEILTDPSYARQIVTLTYPHIGNVGVNAEDVEATKVHAAGLIIRDLPTLASNFRKERTLGDYLRDEGVVAIAGIDTRKLTRILRDKGAQNGCILAGSDDEAKAVELARSFPGLAGMDLAKVVSTAKPFEWKQTEWRLGSGYGMQQAPKYRVVAYDFGVKYNILRMLAERGCHVTVLPAQASAADALALNPDGIFLSNGPGDPEPCDYAIAAAREFIERGVPTFGICLGHQIMGLAVGAKTLKMKTGHHGANHPVKDLGDGRVVITSQNHGFAVDADSLPANARVTHVSLFDGTLQGFELTDKPAFCFQGHPEASPGPHDIAYLFDRFTALMDAAKQRSA

SEQ ID NO: 35423 - protein, 339 aa, Azoarcus sp. EbN1
MGVVLVTGGAGYIGSHTCVELLQSGHDVVVVDNLCNSKSEALARVEQIAGRRLAGFHEIDVRESDGLKAVFGAYRVDAVIHFAALKAVGESVREPLEYYDNNIGGTIALTRAMAEAGVYRLVFSSSATVYGDPRSMPIAESAPAAPTNPYGRTKWMTEQVLSDVAASDPRWQVVLLRYFNPVGAHRSGRIGEDPHGIPNNLMPYISQVAVGRLPQLQVFGGDYATPDGTGVRDYIHVVDLARGHVQAVERIEGLPGVTCLNLGTGRGYSVLEVIRSFEAASGRRVPYRIVDRRPGDIAACWADAGRAEKVLGWKPEHDLDAMCRDAWRWQTGNPEGYPG

SEQ ID NO: 35424 - protein, 388 aa, Shigella flexneri 2a str. 301
MIQFRVVWVDDRNQIQVNRAWRVQFSSAIGPYKGGMRFHPSVNLSILKFLGFEQTFKNALTTLPMGGGKGGSDFDPKGKSEGKVMRFCQTLMTELYRHLGADTDVPAGDIGVGGREVGFMAGMMKKLSNNTACVFTGKGLSFGGSLIRPEATGYGLVYFTEAMLKRHGMGFEGMSVSVSGSGNVAQYAIEKAMEFGARVITASDSSGTVVDESGFTKEKLARLIEIKASRDGRAADYAKEFGLVYLEGQQPWSVPVDIALPCATQNELDVDAAHQLIANGVKAVAEGANMPTTIEATELFQQAGVLFAPGKAANAGGVATSGLEMAQNAARLGWKAEKVDARLHHIMLDIHHACVEHGGEGEQTNYVQGANIAGFVKVADAMLAQGVI

SEQ ID NO: 35425 - protein, 563 aa, Sorghum bicolor
MESSIRLADTLRPSSLPAPASAHLRRRHLYLHRLPRTSSSSSLFFSPSHHHRLCPTPRHDLLQPLAAAASGAAKLVPASPAPADSSPEPKPSGAKLVPLVISLAVGLAVRFLAPRPAEVSPRAWQLLSIFLSTIAGLVLGPLPVGAWAFLGLTAAVATHTLPFAAAFAAFTNEIIWLIVISFFFARGFVKTGLGDRVATYFVKWLGKSTLGLSYGLALGEACIAPAMPSTAARAGGIFLPIIKSLSLSAGSKPNHPSSRKLGTYLVMSQFQAASSSSALFLTAGAQNLLCLNLAEKFGVIIANPWVTWFKAASLPAIVSLLATPYLLYKIFPPEIKDTPEAPALAAEKQKQMGPVTKNEWAMIGTMILAVALWIFGDAIGVSSVVAAMLGLSILLLLGVLDWADILNEKSAWDTLAWFSVLVGMAAQLTSLGIVSWMSSCIANLLQSFSLSWPAAFCVLQASYLVIHYLFASQTGHVGALYSAFLAMHVAAGVPSVLSALALAFNTDLFGGITHYSSGQAAVYFGAGYLDLPDVFRIGFISTLINTLIWGGIGTFWWKFLGLY

SEQ ID NO: 35426 - protein, 324 aa, Thermobifida fusca YX
MRIAVTGSIATDHLMTFEGRFADQLIADQLTQVSLSFLVDELEVRRGGVAANISFGLGCLGLNPILVGAVGADFADYAAWLERHGVDTSGVHVSEMRHTARFVCTTDRDHNQIASFYAGAMAEARNIELWPLAQRLGGIDLVVVGANDPEAMIRHSEECRVRGINFAADPSQQLARMEGPEVRSLVEGAQYLFANEYEKALTEQKTGWSDAEVLARVGTRVTTLGAKGVRIDQAGEPSLHIPAAHVSEAVDPTGAGDAFRAGFLAALSWGLDLDRCAQVGNATAAHCLEVSGPQEYRLTKESLLERMARSYGDDAAAEVADRMS

SEQ ID NO: 35427 - protein, 563 aa, Flaveria bidentis
MEASALFSTALCLPSLHLRSRLLHNKSPPHIARTNKPHLPPLLRSPPPLLTTTTTTTFRPSIFTHLSRHIKPISASSASATSITEPKKAQLQGAKIVPLTLSIAIGLLVRFVVPKPVEVTPQAWQLLSIFISTIAGLVLSPLPVGAWALLGLTTTIITKTLPFTTAFSAFTNEVIWLIVISFFFARGFVKTGLGDRIATYFVKWLGKSTLGLSYGLTLSEALIAPAMPSTTARAGGVFLPIIKSLSLSAGSKPNDPSSRKLGSYLIQTQFQCAGNSSALFLTAAAQNLLCLKLAEELGLVIASPWVSWFKAASLPAFISLLLTPYILYKIYPPETKDTPDAPAIAAKRLQAMGPVTTNEWVMIATMVLAVSLWVFGDAIGIPSVVTAMLGLSILLLLGVLEWDDCLSEKSAWDTLAWFAVLVGMAGQLTNLGIVTWMSNCVAKFLQSFSLSWPAAFGVLQGAYFLIHYMFASQTGHVGALYSAFLAMNLAAGVPGVLAALALAYNTNLFGALTHYSSGQAAVYFGAGYVELPDVFRIGFIMACINAVIWAVVGGAWWKFLGLY

SEQ ID NO: 35428 - protein, 532 aa, Trichodesmium erythraeum IMS101
MKNGSISPVVLIILDGWGYREEKYGNAIAVGKTPNIDSLWQAYPRTLIQASGKAVGLPEGQMGNSEVGHLNIGAGRVVPQELVRISDAIEDGLIVQNQAIKKICQDVIERNSKLHLVGLCSSGGVHSHVNHLLGLLDVAKAKGISDVCVHAITDGRDTNPKSGLHVLKQIEYHTNQIGIGRIATVSGRYYAMDRDKRWDRIQKAYEVMTQDGYGTGCSASDLLQKSYAEGITDEFVLPVRVAPGAVEPGDGVIFFNFRPDRARQLTQAFVAPDFNGFERQTIQPLTFLTFTQYDSSFPVLVAFEPQNFNNILGQVISQHGLRQFRTAETEKYAHVTYFFNGGLEQPFEGEDRELVQSPMVSHYDEAPEMSAEDLTEVAIAAVKKQIYSLIVINYANPDMVGHTGAMDAAVNAVQTVDHCLGKLLQGISKVGGTAIIIADHGNAEYMWDEDGNPWTAHTTNLVPFILIEGEVSKIPGHGTKVPLRENGCLADIAPTILEILNLPQPAEMTGKSIIKKAEYELKPNRTPVRVGL

SEQ ID NO: 35429 - protein, 190 aa, Arabidopsis lyrata subsp. petraea
HFLSFLLIPIMAIVAVELLRMGPEEILNVWNSLQFDLVQVLCSSFFVIFISTVYFMSKPRTIYLVDYSCYKPPVTCRVPFATFMEHSRLNLKDNPKSVEFQMRILERSGLGEETCLPPAIHYIPPTPTMDAARSEAQMVIFTAMDDLFKKTGLKPKDVDILIVNCSLFSPTPSLSAMVINKYKLRSNIKS

SEQ ID NO: 35430 - protein, 398 aa, Streptococcus pneumoniae R6
MAKLTVKDVDLKGKKVLVRVDFNVPLKDGVITNDNRITAALPTIKYIIEQGGRAILFSHLGRVKEESDKAGKSLAPVAADLAAKLGQDVVFPGVTRGAELEAAINALEDGQVLLVENTRYEDVDGKKESKNDPELGKYWASLGDGIFVNDAFGTAHRAHASNVGISANVEKAVAGFLLENEIAYIQEAVETPERPFVAILGGSKVSDKIGVIENLLEKADKVLIGGGMTYTFYKAQGIEIGNSLVEEDKLDVAKALLEKANGKLILPVDSKEANAFAGYTEVRDTEGEAVSEGFLGLDIGPKSIAKFDEALTGAKTVVWNGPMGVFENPDFQAGTIGVMDAIVKQPGVKSIIGGGDSAAAAINLGRADKFSWISTGGGASMELLEGKVLPGLAALTEK

SEQ ID NO: 35431 - protein, 497 aa, Ustilago maydis 521
MPTLNLDLPNGIKSTIQADLFINNKFVPALDGKTFATINPSTGKEIGQVAEASAKDVDLAVKAAREAFETTWGENTPGDARGRLLIKLAELVEANIDELAAIESLDNGKAFSIAKSFDVAAVAANLRYYGGWADKNHGKVMEVDTKRLNYTRHEPIGVCGQIIPWNFPLLMFAWKLGPALATGNTIVLKTAEQTPLSAIKMCELIVEAGFPPGVVNVISGFGPVAGAAISQHMDIDKIAFTGSTLVGRNIMKAAASTNLKKVTLELGGKSPNIIFKDADLDQAVRWSAFGIMFNHGQCCCAGSRVYVEESIYDAFMEKMTAHCKALQVGDPFSANTFQGPQVSQLQYDRIMEYIESGKKDANLALGGVRKGNEGYFIEPTIFTDVPHDAKIAKEEIFGPVVVVSKFKDEKDLIRIANDSIYGLAAAVFSRDISRAIETAHKLKAGTVWVNCYNQLIPQVPFGGYKASGIGRELGEYALSNYTNIKAVHVNLSQPAPI

SEQ ID NO: 35432 - protein, 366 aa, Caulobacter crescentus CB15
MALKVAIVGLPNVGKSTLFNALTQTASAQAANYPFCTIEPNTGDVAVPEPRLNALAKIAGSKEIIPARINFVDVAGLVRGASKGEGLGNQFLANIRDCDAVAFVARCFEDSDITHVEGRIDPISDLEIIEMELMLADLESLEKRLPNVEKRAKSGGDKDMIQTLRLINLALEQLRAGRPARAAQVDKEDAKAWAMLQLLTSLPALYVCNVEEASADKGNKFSDLVAERAARDNAKSVVISAQIESEIALLDEEERTEFLETLGLAEPGLNRLIREAYSLLGLQTYFTVGPKEARAWTIPVGATGPQAAGVIHTDFEKGFIRAETIAFDDYVKLGGENGAKEAGKMRSEGKEYVVKDGDVMHFRFNV

SEQ ID NO: 35433 - protein, 159 aa, Listeria monocytogenes str. 4b F2365
MNIQIVTVGKLKEKYLVQGIAEYLKRLSAYAKVTIVEVPDEKAPEVLSDAEMKQVKDKEGARILAKIPDDAHVIALAIDGKMKSSEEFAADLDKLATYGKSKVTFVIGGSLGLSEAVLKRSNERISFGRLTLPHQLMRLVLVEQVYRAFRIVRGEPYHK

SEQ ID NO: 35434 - protein, 308 aa, Candida glabrata CBS 138
MSAVFNNATLTDLVREDTYFKTLANIGKFQPQLNFMEQYWAAWYTYMNNDVLATGLMFFLLHEFMYFFRCLPWFIIDQIPYFRKWKLQPTKIPSTKEQLYCLKAVLLSHFLVEAIPIWTFHPMCEKLGITVEVPFPSIKKMSLEIALFFVLEDMWHYWAHRLFHYGVFYKYIHKQHHRYAAPFGLSAEYAHPLETMSLGFGTVGMPILYVMYTGNLHLFTLCVWITLRLFQAVDSHSGYDFPWSLNKFLPFWAGAEHHDLHHHYFIGNYASSFRWWDYCLDTESGPEAKVAREERMKSKAEQKAKKTN

SEQ ID NO: 35435 - protein, 546 aa, Synechococcus sp. WH 7803
MNQRRHAVIHGFSWSHWRGDLSGGLTAAVVALPLALAFGNAALGPGGAIYGLYGAIVTGFLAALLGGTPAQVSGPTGPMSVTVAGVVGSLAAVGVSRELSSGELLPLVMAAVVIGGLFQILMGALRLGRYITLVPYSVVSGFMTGIGVIILCLQIGPLLGINSRGGVLQSLQMVLTEFSPQPAALLVGATTLLVVFGCPRRLSQVIPSPLMALVLITPLSLWLFPDQLPRIGSIPEGGLSFTLPNWQEHLPVVLRAGLVLALLGAIDSLLTSLVADNISHTRHRSDRELVGQGVANSVAGLFGGLPGAGATMRTVINIQSGGRTPLSGMTHSIVLLVLLLGAGPLAEGIPTALLAGILIKVGVDIIDWGFLRRAHRLSFKTALVMWGVLLMTVFWDLIGAVLVGMFVANLLTIESLTAHQLGTMNQHQEPLNAEEQTLLKRCGDDLMLFRLQGPLSFGAAKGISERMMLVRQYRILLLDITDVPHLGVTASLAIERMVQEAAQHDRQVLVAGAAGKVKRRLELFGIPALVDTRLEALRVAEQRLNS

SEQ ID NO: 35436 - protein, 564 aa, Spinacia oleracea
MESLALLPTLSLSTTTTTSKATAFLRSSTTSLHHRRPHLSLSLSSTPKPTLTFSSHSHSHSLSSKPLLALKPLNATASSSSSPATTSPPPTKSGAKLIPLILSVSVGLLLRFAVPKPAELTPQAWQLLAIFLSTVAGLVLSPLPVGAWAFLGVTASVVTKTLPFPTAFCAFTNEVIWLIVISFFFARGFVKTGLGDRIATYFVKWLGKSTLGLSYGLTISEALVAPAMPSTTARAGGIFLPIIKSLSISSGSLPGGESRKKLGTYLIMTQFQSAGNSSALFLTAAAQNLLCLKLAEELGVKIASPWVFWLKAASLPAFVALLLTPLILYKLYPPELKDTPEAPALAAEKLKNMGPVTKNEWVMVGTMLLAVSLWVFGEKIGVSSVVAAMLGLSVLLLLGVLDWNDCLNEKSAWDTLAWFAVLVGMASQLTNLGIVSWMSGCVARSLKTMNLSWPAAFGILQAAYFFVHYLFASQTGHVGALYSAFLAMNIASGVPGVLAALALAYNTNLFGALTHYSSGQAAVYYGAGYVDLPDVFKMGFIMAVINATIWTVVGGVWWKILGIY

SEQ ID NO: 35437 - protein, 583 aa, Nicotiana tabacum
MESLALYSPSSATSAATTSFSRLSFHHHHLRSRPSSISAAALRPVSSLRSPPSGPGFNLSGPRFNLFHPKPFIFNPLSKPTSKNSPSHKPINASSSPDPDKVVTIDAKPKPQGAKLIPLIISVSIGLIVRFFVPKPPEVSPQAWQLLSIFLSTIAGLVLSPLPVGAWAFLGLTTSVLTKTLTFTAAFNAFTNEVIWLIVISFFFARGFVKTGLGDRIATYFVKWLGKSTLGLSYGLTLSEALIAPAMPSTTARAGGVFLPIIKSLSLSAGSKPGDPSSRKLGSYLIQSQFQSAGNSSALFLTAAAQNLLCLKLAEELGVVISNPWVSWFKAASLPAFISLLATPFILYKLFPPETKDTPDAPAMAAKKLDLMGPVTKNEWVMIGTMLLAVSLWVFGDALGIASVVAAMLGLSILLLLGVLDWDDCLSEKSAWDTLAWFAVLVGMAGQLTNLGIVGWMSSCVAKSLQALSLSWPAAFGVLQAAYFFIHYLFASQTGHVGALYSAFLAMHLASGVPGVLAALALAYNTNLFGALTHYSSGQAAVYFGAGYVDLPDVFKMGFIMALVNATIWGVVGTFWWKFLGLY

SEQ ID NO: 35438 - protein, 147 aa, Zea mays
FILLGPHNIGVAMATTHGLVVPNIKKVQSLSILEITKELARLHEMASQNRLSAADIEGGTITLSNIGAIGGKFGSPLLNLPEVAIIALGRIQKLPRFDDDENVYPSSIINVTVGADHRVVDGATVARFCNEWKSLVEKPELLLLHMR

SEQ ID NO: 35439 - protein, 273 aa, Azoarcus sp. EbN1
MSAPITSTFPDVDRERRFGGIARLYGNDALPRLDLARVCVVGIGGVGSWAAEALARSGVGHLTLIDLDHVAESNINRQSHALDATLGQAKVLAMAERLRAINPLVNVAIVEDFIGEDNAAALLRDFDVVIDAIDNVRAKVAIVLACRARRIPLIVAGGAGGKTDPSRIRVDDLSRTEQDPLLAKVRKRLRSEHGFPRNPKRPFGIEAVYSSEALRLDGAACDLPHGPQGLACAGYGSSMMMTASVGLFAAARALERLLARRAGDVPDAPEDQA

SEQ ID NO: 35440 - protein, 212 aa, Arabidopsis lyrata subsp. petraea
VVIDNLTNVWARLYVPMMTTTKSSVSKLLPLIVYFHGGGFCVGSTSWSCYHEFLARLSSRSRCMVMSVDYRLAPENPLPAAYEDGVNAILWLNKARNDNLWTKLCDFGRIFLAGDSAGGNIADQVAARLASTEDLTLKIEGTILIQPFYGGEERTESEKRVGNNKSSVRTLEGSDAWWRLSLPRGADREHPYCKPVKINSSTVIRTLVCVAE

SEQ ID NO: 35441 - protein, 175 aa, Zea mays
MESAVNPKAYPLADAQLTIGIIDIIQQAANYKQLKKGANEATKTLNRGISEFVVMAADTEPLEILLHLPLLAEDKNVPYVFVPSKQALGRACGVTRPVIACSVTSNEGSQLKQQIQGLKDGMRRDDPSNRVVWFRVRGWDRTIPVLSPVIPQNWRDERERQGTSLSWLSRNQTHQ

SEQ ID NO: 35442 - protein, 316 aa, Rhodothermus marinus
MAQAVKDYYEILGVPENATEEEIKKAYRKLAREWHPDRNPDKPNAEERFKEIQEAYSVLSDPEKRRQYDMMRKNPFGAFGGFGPGNGSRFYRTPEGTYVHFETSGNLEDLLDEEFGFGGLGDIFSRFFGGFGRTGTRHDPFARARRPRDVEVRVQLPFEQALRGGKTDITLPDGQKVRINIPKGVRPGFKIRLKDGGPTIAGVPQGNVYIIFEVEPHPRFRREGDDLYTTITINPLEAMLGTTREIVDAYGRRIKVRIPPGTQPGERLRIRGHGVETDTHTGDLYVEVQLEIPRNLSAEQQRILREAAEKAGLIRS

SEQ ID NO: 35443 - protein, 173 aa, Agaricus bisporus
TVEEFWGLYNNIVPPSQLPQKANYYLFKEGIIPAWEDEANKYGGKWSIQLPKDKNRANVDKMWLYTMLAAIGEMFDPTPDNAEGPLSQSLITGVIVSIRPQFYRISIWTRLAPAPTEEDRLRERIETVGRYFKMNVLGYAEGARLAGPLATEVEFLSHKDSEKKGKSAKKIVV

SEQ ID NO: 35444 - protein, 224 aa, Zea mays
MASSDSNPTDAFEYMLLEKDPDLYRTVFSGPSQTSPWINPSVLKLKHRIGRGPFGDVWIATHHQRTEDFDQYHEVAVKMLHPIKEDQLQIFSARFHEIFSKCQGLGNVCFLHGISTQNGRICIAMKFYEGSIGNKMARLKGGKLPLSEVLSVLEMLTGIQPWRGKSADEIYQLVVLKKEKQIFPCSLPPDIENVLSGCFEYDFRNRPLMKDILHAFERFYLNFH

SEQ ID NO: 35445 - protein, 225 aa, Alteromonadales bacterium TW-7
MLKSRIKYNTASFVTSAPDITKLPADTGIEVAFAGRSNAGKSSALNALTDQKLARTSKTPGRTQLINTFELADVDNMRLIDLPGYGFAKVPIEMKKKWQKSLGEYLQKRQSLKGIVVLMDIRHPLKDLDRDLINWAIGSEIPVLALLTKADKLKQGARKAQVLQVRRELSELDGDITVHAFSSLKGTGLPEVAKKLDEWYLGPVIAVPPVEKVSDESSSDTNTAS

SEQ ID NO: 35446 - protein, 392 aa, Trichodesmium erythraeum IMS101
MYSINPAKRVQALPPYVFARLDELKARAREQGLDLIDLGMGNPDGATPKPVVEAAIAALQDSTNHGYPPFEGTASFRKAITDWYFRRYSVKLDPDGEALPLLGSKEGLTHLALAYINPGNLVLAPNPAYPAHFRGPLIAGGKVHSILLKPENDWIIDLADIPDSVAEQAKVFYFNYPSNPTGATAPREFFQDIVTFAKKYEILLVHDLCYAELAFDGYQPTSLLQIPGGKDIGVEFHTMSKTYNMAGWRIGFVVGNSNVIQGLRTLKTNMDYGVFSALQLAAKTALQLPDEYLSQVQERYRQRRDFLIQGLGKLGWNVQKTMATMYLWVPCPPGIGSTDFALSVLQKTGVVVTPGNAFGSGGEGYVRISLIAECKRLDEALNRFKKAGIYYQ

SEQ ID NO: 35447 - protein, 854 aa, Burkholderia xenovorans LB400
MSHSEGHIVLLAPMTGPVVPLANVPDPVFSGGMFGDGIGIDPLEGRLVAPCDGTVTHLARTGHAVTLATAEGAEILLHIGIDTVALNGKGFAPMVAQGAHVRAGQVLIEFDQDQVALNAPSLVSVVAIANSDAFEIVERVQGGLLKAGETPLLVLRARGGAAAEASRQASATNVAEEARQQVTLVHAGGLHARPAARAREAARGFDARVEVRYEGRKAAIESVVGLLGLGAGEGATVELLGIGPQARAAIEAIAHELTREAQGEAEEKPARESSPAPQAVGHAADEALAPNTLAGVCAAPGVAVGKLVRWDDADIDPPEKAAGTSAAESRLLDKAIATVDADLGTTVRDASQRGAVGEAGIFAVHRVLLEDPTLLDAARDLISLGKSAGFAWRAAIRAQIAILAKIEDALLAERAADLRDIEKRVLRALGYTNAASRTLPEEAVLAAEEFTPSDLSTLDRSRVTALVMARGGATSHAAILARQAGIPALVAVGDALHAIPEGTQVVVNATTGRLEFAPTELDVERARLERSRLAGVREANRRTSQQAAVTSDGRAIEVAANIATLDDAKTAVENGADSVGLLRTELLFIHRAAAPTTDEHRQSYQAIVDALSGRTAIIRTLDVGADKEVDYLTLPPEPNPALGLRGIRLAQVRPDLLDDQLRGLLAVRPLGAVRILLPMVTDVGELIRIRKRIDEFARESGRTEPIEVGVMIEVPSAALLADQLAQHADFLSIGTNDLTQYTLAMDRCQADLAAQADGLHPAVLRLIAATVQGAGKHGKWVGVCGALAGDPLAMPLLIGLGVTELSVDPVSVPGIKARVRNLDYQLCRQRAQDALALESAQAVRAASRETWPLD

SEQ ID NO: 35448 - protein, 857 aa, Brassica oleracea var. alboglabra
MKDVRIYHHSFLLVFVVVILFHPALSIYFNILSSTATLTISSNRTLVSPGDVFELGFFKTTSSSRWYLGIWYKKLYFGSIKNYVWVANRDSPLFNAIGTLKISNMNLVLLDQSNKSVWSTNLTRGNERSPVVAELLANGNFVMRDSNNKDASGFLWQSFDYPTDTLLPEMKLGYDHKTGLNRFLTSWRSSDDPSSGEISYKLDTQSGMPEFYLLINGSPDHRSGPWNGVQFSGIPEDQKLSYMVYNFIENTEEVAYTFRMTNNSIYSRLTISSKGILERWTWTPTSFSWNLFWSLPVDLKCDLYMACGAYSYCDVNTSPECNCMQGFMPFNMQQWALRDGSGGCIRRTRLSCSSDGFTRMKKMKLPETRMAIVDPSIGLKECRKRCLSDCNCTAFANADIRNGGTGCVIWTGELEDIMTYFAADLGQDIYVRLAAADIVKKRNADGKIITLIVGVSVLLLMIMFCLWKRKQKRAKAMATTIVNRQRNQNLLMKLMTQSNKRQLSRENKTEEFELPFIELEAVVKATENFSNCNELGQGGFGIVYKGMLDGQEVAVKRLSKTSLQGIDEFMNEVRLIARLQHINLVRILGCCIEADEKILIYEYLENSSLDYFLFGKKRSSNLNWKDRFAIINGVARGLLYLHQDSRFRIIHRDMKPSNILLDKYMIPKISDFGMARIFARDETEANTENAVGTYGYMSPEYAMDGVISEKTDVFSFGVIVLEIVSGKRNRGFYQLNPENNLLSYAWSHWAEGRALEIVDPVIVDSFSSLPSTFQPKEVLKCIQIGLLCIQERAEDRPTMSSVVWMLGSEATDIPQPKPPIYCLITSYYANNPSSSRQFEDDESWTVNKYTCSVIDAR

SEQ ID NO: 35449 - protein, 312 aa, Caulobacter crescentus CB15
MKLLSGNSNRPLSQAIAEYLDMPLTRAQVRRFADLEVFVTIDENVRGEDVFVIQSTSYPANDNLMELLICIDALKRASGKRITAVIPYFGYARQDRKTGGRTPISAKLVANLITRSGADRVLTMDLHAGQIQGFFDIPTDNLLPSRLMAEDIRRHYPMGDDLMVVSPDVGGVVRARALAKRLDDADLAIVDKRRSGPGQSEVMNIIGDVKDRRCILFDDIADSAGTLCNAAQALMAHGAKSVSAYITHGVLSGAAADRVANSVLTELVVTDSIEASDPAKACPKIRYVSCAPLIGEAIRRIANEESVSKLFD

SEQ ID NO: 35450 - protein, 220 aa, Vibrio cholerae O1 biovar eltor str. N16961
MSVKIHYQNTHFITSAPDIRHLPEDEGIEIAFAGRSNAGKSSSLNRLTNQKNLAKTSKTPGRTQLINLFKVADGCHIVDLPGYGFAQVPLEMKLKWQRALGEYLQKRQSLKGLVVLMDIRHPMKDLDQQLIIWAVECGIPVQVMLTKADKLKSGARKAQVLKVREEAKTFGGDVAVDAFSSLSGIGVDTLRAKLDEWYAPMLAALAEQEEGEQPESSTDQ

SEQ ID NO: 35451 - protein, 126 aa, Picea sitchensis
MLKFLSKVKIEFNAYDTRSASALEFLAQCNSIKAKESNPNCQITVKRRTDDHHPQITVTFSNGVEEVIDGSKTAAQAIRKTILEKGQALETQQMFKEAGQSWPVVIPEEELHQTAKPTKARKAQDK

SEQ ID NO: 35452 - protein, 276 aa, Triticum aestivum
  misc_feature (95)..(95): Xaa can be any naturally occurring amino acid
  misc_feature (107)..(107): Xaa can be any naturally occurring amino acid
MAQAQATRGDPMKAQQEQPEPIQYGHVFAVTGDLAVQAIAPRDAEAMRTAEESVQGVQVPQASGGGFSAAVAMETAAAYNQAVGAVRPGQASEAXATKQGITVTQTXVPGGRIVTEFVAGQVVGQYSVADQAMMQQQQQQVEEDASKVTIGEAMEAAALSAGDRPLEEADAAAIRAAETQAQGADTVMPGGLADQAWAAASANAWAERDEDKITVGDVLSDATTKLADDKPAATEDAARVVQAETYSDAGARTKAGGVGAAVTTAARLNQEDDDDA

SEQ ID NO: 35453 - protein, 200 aa, Oryza sativa
SVAVFVYGDIGRSPRMQNHAVELSKSYEVYLMGYLETSPRSNVTENPNIKLVDLQLRSLQSIRAFSYYLYVLIRIILQILQIFYVLGWKYRGIKFVLVQNPPSIPNLLAIWMVSLVSRFKFCIDFHNYGYTILSLNVSSKFIVKAATVYEKVIAKRASKFFCVSEEMKKDLQANWGINAITLYDRPRQKRQLAGDKKYFF

SEQ ID NO: 35454 - protein, 260 aa, Caulobacter crescentus CB15
MTPILLLGAGRMGGALIQGWQAAGAFDAADLIIRDPHVDAAAFAGAVVNPPLETLGAAKTVLLAVKPQIWREAIADVVPHLAPDAVIVSIAAGVRAADISQAFGGRRVARVMPTTAVAIGQGAASLYADDAEALARARALFAPLAAVAELASEDLMHAATAVSGSAPAYLYAFIEALEAAGAAQGLDPAQSARLARATIIGAAALMAQSGEEPAELRKQVTSPGGTTAAALSVLMGAGGFGDLLPKALDAAVARSKELGG

SEQ ID NO: 35455 - protein, 88 aa, Brassica juncea
MASQQEKKQLDERAKKGETVVQGGTGGKSFEAQQHLAEGRSRGGNTRKEQLGTEGYQQMGRKGGTRTGKADDEDEGEEMDEPTSRTRT

SEQ ID NO: 35456 - protein, 88 aa, Brassica carinata
MASQQEKKQLDERAKKGETVVQGGTGGKSFEAQQHLAEGRSRGGTTRKEQLGTEGYQQMGRKGGTRTGKADDEDEGEEVDEPTSRTRT

SEQ ID NO: 35457 - protein, 256 aa, Pseudomonas putida GB-1
MNDQRKGDHAEPTTHFGYQDVPESQKAKKVAEVFHSVAAKYDLMNDVLSGGMHRLWKRFTIELSGVRSGNRVLDIAGGTGDLAAKFSRLVGPTGQVVLADINDSMLKVGRDRLLDRGVAGNIEFVQADAEKLPFPDNHFDCVTIAFGLRNVTHKDEAIRSMLRVLKPGGRLLILEFSKPTNKLMSRAYDAYSFAFMPLAGKLITNDAESYRYLAESIRMHPDQETLKSMMVEAGFDRVTYHNMTSGIVAVHRGIKP

SEQ ID NO: 35458 - protein, 163 aa, Oryza sativa Indica Group
MACAFSVSSAAAPLASPKGDLPLVGNKAPDFEAEAMFDQGFIKVSFFSFLKSKCMFVSSAEITAFSDRYEEFEKINTEVLGVSIDSVGIALRGLFIIDKEGVIQHSTINNLAIGRSVDETLRTLQALQYVQENPDEVCPAGWKPGEKSMKPDPKDSKEYFASI

SEQ ID NO: 35459 - protein, 81 aa, Zea mays
MDEAVPALATGQASTDGVTEQPVNVYIWDMDETLILLKSLLDGSYAGAFDGLKDHEKSTEIGKRWENLILELCDEHFFYEE

SEQ ID NO: 35460 - protein, 385 aa, Azoarcus sp. EbN1
MPTFPARIDSRLPQVGTTIFTVMSRLAQECGAINLSQGFPDFNADDVLFERVAHWMRAGFNQYAPLAGVAPLREAIAHKVAALYGTAYDAETEITVTAGATQALFTAVAALVHPGDEVIVFEPVYDSYAPAIELQGGRVVRLQLAAPDYRPDWDAVAAAITPRTRMIMINSPHNPTATVWSADDLAHLAALTRGTGIVIVSDEVYEHIVFDGTRHESCARDAELAARSVIVSSFGKTYHITGWKVGYVVAPRELMAEFRKVHQFNVFTVNTPVQLALADYMADASRHEGLAAFYQAKRDFFRTALGGSRFELLPSAGTYFQLARYRAICDEPDTAFVERLTRDSGVAAIPVSAFFADGRDERVIRFCFAKNEATLAAACERLCRV

SEQ ID NO: 35461 - protein, 243 aa, Oryza sativa Japonica Group
MAEELKLLGSLSGVSPYVIRAQMALAVKGLAHDYLPEDLTRKSKLLLDSNPVHKSVPVLIHNGKPVCDSLVIVEYVDEAFPGGAAALLPADPYHRAVARFWAAFIDSKVFPPCLAILKTAAAEAEEEKAAKVKETVEALQLVEGAFGECSKRKPFFGGDAVGYLDVVLGCYLCWFEGVSEIAGGVSPPLLDASRTPQLAAWAARFRSAADAVGCSVPRVDKVEAYLNNVLKPKWSAAAAASSH

SEQ ID NO: 35462 - protein, 617 aa, Trichodesmium erythraeum IMS101
MRCLNCHTDGIPLETKICYNCGAYLPSLIRGLLTPGTQLGDKPYQIDYPLGRGGFGVTYRGHHTLLKQIVAIKEYYPQNYALRHPTTGGFTIPRNQQEIFQQGLRRFLQEGKILAQLNHPHVVRVIDLFEENETAYLVMELVRGKSLRKELDSQPEKKFPPQKVKEIITDLVSALSAVHQQGIFHLDIKPDNILLTPEGRLVLTDFGSAKQTFGTSMGTSSTESFAESYAAPEVLARGEVGVESDIFEVGMMVYEMLSGQLPPNVLERSLSKEKSWEPEGLESSWQKLLMSALVLAKEGRPGNIEEWWEMNFHKKSTERTQESGWKTKEFKNRKKDISSPPRQKFGFEVIKVNSRGKEIDRRSYEAEFLAENLDSGLVLEMVYIPGGSFLMGSPEYEDERFDSESPQHQVNIKPFLMSKYPITQDQYQAIMGDNPSYFKGGKRPVERVSWHDATKFCEKLSSKTGKIYRLPSESQWEYACRAGTSTPFYFGETMTSELVNYDGNYPYGNAPFGEYREQTTDVGSFLPNAFGLYDMHGNVSEWCLDAWHHNYYGAPTNGSAWKTGGSNRKRVLRGGCWDSYSTNCRSAWRFYYNADDLYYYRGFRVVSSSPVVSAFNS

SEQ ID NO: 35463 - protein, 257 aa, Listeria monocytogenes str. 4b H7858
MKKYVVITGASSGIGYATAKGFAKRKNNLILIARREANLLKLKNEIEKEVPEIEVLIKAIDLTKIDRLEKLFSELDPYFIETWINNAGLGYYSEVKNQSLTKTLQLLHLNIEALTVLSVLYVRKYHDQSGTQLINVSSAGGYTMVPAAATYCASKFYVSSFTEALSLELRESCSPLQAKVLAPAATKTEFGQKANDVSDYDYDKKFNNYHTSDEMAQFLLDLYDSDKIVGMIDRKAFSFTLTENLFSYANQASSNQK

SEQ ID NO: 35464 - protein, 220 aa, Lentisphaera araneosa HTCC2155
MKISAFKPQEIIVSPSILAADFANLAPEVSGAHEAGAQFIHLDVMDGHFVPNISFGPGVIGKLRAHSEALFDAHLMISHPQKYIEEFAQAGCDHVTFHIESDCDTQEVIDQIHSYGMSAGLTLKPGTDIETLLPFVDKIEMVLIMTVEPGFGGQSFMHDMVERITIIREANPKLHIQVDGGVNKETSKIVRDAGANVLVAGTAFFRHPRGMKSAQLELSQ

SEQ ID NO: 35465 - protein, 84 aa, Triticum aestivum
  misc_feature (14)..(14): Xaa can be any naturally occurring amino acid
  misc_feature (50)..(50): Xaa can be any naturally occurring amino acid
  misc_feature (63)..(63): Xaa can be any naturally occurring amino acid
  misc_feature (71)..(71): Xaa can be any naturally occurring amino acid
MSEESGRPLPKFGXEWDVNDPASADGFTVIFNKARDEKKAGNGQDTESPXKDARTERVESYAXPRANSKKXWFCCVDTKVLHNL

SEQ ID NO: 35466 - protein, 96 aa, Triticum aestivum
PRSTRVYYQFNSFGTRLSPAKMSTVTRAYLDQRLAAAKRCSREAAMAGAKAAAVATVAAAVPTLASVRMLPWAKAHLNPTGQALIITTSRTPPSTN

SEQ ID NO: 35467 - protein, 121 aa, Listeria monocytogenes str. 4b H7858
MTKEKVLWGYDEKTGPEMWGHICSDFEIAHTGKAQSPVDIEQADVVKLKPSTMKFYYKETDYTIRRIEQSVHVFPHDKEQGLRFNGEYYPLVSFHAHIPAEHLLDGYVYPIEWHFVHEKPD

SEQ ID NO: 35468 - protein, 1157 aa, Ostreococcus tauri
MNRAMHGDVVAVEVAPESEWCASMINTVLEDEGVRESDLSASVSSSPKTRTGKIVGILRREVMDVVACLDSIDEEEITRNPHAKRNGALCVPMDGKIVKIKLLTRRANELVGKRFVVRVDRWRENQRYPNGHLIRVLGDVGDVDGEMAALLARHEIPAEPFGARALAELPREGTNWVVPREELETRRDLRHHRACSIDPPGCTDVDDALSVRAVPQSERGANGGAFEIGVHIADVSYFVQPGTTLDHEAQTRGTTVYLVDRRLDMLPSLLSENLASLLEKRDRLAMSCVWTLDENLDVVDVWFGRTVIHSRHQMTYYQAQAIYDGKPPPVDGSTVFEGEDDIAVVREDLKTLVAFANKTNAIRVAHGAVELESAELRFETDAQTKSPTEVIQKSEVPMMRVVAELMILANSAAARATHSVFPSCALLRRHAPPRQDGFAELSRLAATKGVKLDCSSGEALNASLARIANECDPEVTTLFKGLATRAMSEAQYVSSGSISATESSFGHYGLALTYYTHFTSPIRRYADIVVHRQLIAAVEATEMEKKATEDATRRGLDSLAEHLNERNRASKRAQSRCGEIYLLWLLRENPMIEPAVVHEIRDDGLMVFLPSFHIKAPVRLVDDDGNTVEELRESDLVDVSPGYNSSESVTKWVQASPVVGVAGTRLRRSDDVLEVVRSSDGVVLRSYSLLQTVWVQMTCKPGRAQGPKLELRILDVEAHAGAREARLVARRAAPPPAPASLSAALKNTSQRAVQATPRPACGFTRRARAHGRCLHHRRRQPHGCSPRRVRSATRCVRRLGQIRLHAFRRSCRPRAKRPSFPKTRGRPRPRRRRQARPKFTFIVKSVVSRSPRAHSENPSPHRYLTPDTPVPRLCALTPRRTHLSKMSKKRPSAHVFTSEDAELDADDASALKFRTYYCKFCGEHVLTTTANLELAPRRRTDDALIIDRTRYATKTAKTIDREVIAIKRKDGTMERRRRLRCGDVPVGYVEATTGTRKTNDDDDAKVLDDGGTLYVHPGALSAFDYADYEREVGDGRDGEDAGPPPPCVGTAGAGATQIDLEIKPRSQSRAVSKITASAVVVDVTNAAHACDSELMEFLAKVLDLRLAQMSLLKSHAPHRRTLLAKGVTPRKAYAALRREFADARARANKLQKLAHRE

SEQ ID NO: 35469 - protein, 560 aa, Mycobacterium tuberculosis H37Rv
MIPTMTSAGWAPGVVQFREYQRRWLRGDVLAGLTVAAYLIPQAMAYATVAGLPPAAGLWASIAPLAIYALLGSSRQLSIGPESATALMTAAVLAPMAAGDLRRYAVLAATLGLLVGLICLLAGTARLGFLASLRSRPVLVGYMAGIALVMISSQLGTITGTSVEGNEFFSEVHSFATSVTRVHWPTFVLAMSVLALLTMLTRWAPRAPGPIIAVLAATMLVAVMSLDAKGIAIVGRIPSGLPTPGVPPVSVEDLRALIIPAAGIAIVTFTDGVLTARAFAARRGQEVNANAELRAVGACNIAAGLTHGFPVSSSSSRTALADVVGGRTQLYSLIALGLVVIVMVFASGLLAMFPIAALGALVVYAALRLIDLSEFRRLARFRRSELMLALATTAAVLGLGVFYGVLAAVALSILELLRRVAHPHDSVLGFVPGIAGMHDIDDYPQAKRVPGLVVYRYDAPLCFANAEDFRRRALTVVDQDPGQVEWFVLNAESNVEVDLTALDALDQLRTELLRRGIVFAMARVKQDLRESLRAASLLDKIGEDHIFMTLPTAVQAFRRR

SEQ ID NO: 35470 - protein, 166 aa, Brassica napus
  misc_feature (12)..(12): Xaa can be any naturally occurring amino acid
  misc_feature (16)..(16): Xaa can be any naturally occurring amino acid
  misc_feature (27)..(28): Xaa can be any naturally occurring amino acid
  misc_feature (36)..(36): Xaa can be any naturally occurring amino acid
  misc_feature (40)..(40): Xaa can be any naturally occurring amino acid
  misc_feature (48)..(48): Xaa can be any naturally occurring amino acid
  misc_feature (50)..(50): Xaa can be any naturally occurring amino acid
  misc_feature (53)..(54): Xaa can be any naturally occurring amino acid
  misc_feature (60)..(61): Xaa can be any naturally occurring amino acid
  misc_feature (64)..(64): Xaa can be any naturally occurring amino acid
  misc_feature (66)..(66): Xaa can be any naturally occurring amino acid
  misc_feature (80)..(80): Xaa can be any naturally occurring amino acid
  misc_feature (84)..(84): Xaa can be any naturally occurring amino acid
  misc_feature (86)..(86): Xaa can be any naturally occurring amino acid
  misc_feature (88)..(88): Xaa can be any naturally occurring amino acid
  misc_feature (92)..(92): Xaa can be any naturally occurring amino acid
  misc_feature (94)..(95): Xaa can be any naturally occurring amino acid
  misc_feature (98)..(98): Xaa can be any naturally occurring amino acid
  misc_feature (103)..(103): Xaa can be any naturally occurring amino acid
  misc_feature (106)..(106): Xaa can be any naturally occurring amino acid
  misc_feature (111)..(111): Xaa can be any naturally occurring amino acid
  misc_feature (113)..(114): Xaa can be any naturally occurring amino acid
  misc_feature (117)..(117): Xaa can be any naturally occurring amino acid
  misc_feature (121)..(122): Xaa can be any naturally occurring amino acid
  misc_feature (127)..(128): Xaa can be any naturally occurring amino acid
  misc_feature (135)..(136): Xaa can be any naturally occurring amino acid
  misc_feature (145)..(146): Xaa can be any naturally occurring amino acid
  misc_feature (156)..(156): Xaa can be any naturally occurring amino acid
  misc_feature (159)..(159): Xaa can be any naturally occurring amino acid
  misc_feature (163)..(163): Xaa can be any naturally occurring amino acid
MSSSMLSSAAVXTSPXAHATMVAPFTXXKSSAAFPXTRTXDNDVTSIXSXGGXXSCMKVXXPVXKXKFETLSYLPDLTEXELGXEXDXLLRXKXXPCXEFEVXHGXFVYRXEXXSTXGHYXXRYWDXXEASPCSXXTDSAQVLKXXPRVAKREYPXAFXRTIXFRQ

SEQ ID NO: 35471 - protein, 507 aa, Bifidobacterium longum DJO10A
MADTNVNGGTQQATGKLKSVESLDQTNEMERGLSNRHVQFIAIGGTIGTGLFLGSGKSISLTGPSIIFVYILVGVIMFFLMRAIGEMMYRDPSQHTFINFITRYLGNGWGHFAGWTYWAALVLLGMTEITAVSTYFITFFDTFGIDLTHWKWLIELCFLVSLVSINLIAVKVFGEVEFWFSMIKITLICAMIATAVVMIVIGYHYPAVQIHGVDHVSPAGHAGFDNLFAIFSFAPNGWMAFLMSFQMVFFAYEMIEFVGVTVSETKNPRKVLPKAINEIIVRVLIFYVGALVAIMCIVPWTSFKPNEDGSFASPFIMVFQYAGLNWASALVFFVVITAASSALNSLLYSAGRHLYQLSEVSPNPTLNKLGKVSDRKVPARAILVSAALILLSPIVNAIPGISGAFVLFSSASSAVFLFIYILTLLAHRRYRRSADFIADGFVMPAWKVLNTVAIVFFVFIYLTLFLADDTRNSAIAGLVWLVGFGGFSMLRERYRSRDLKAALEHKE

SEQ ID NO: 35472 - protein, 471 aa, Symbiobacterium thermophilum IAM 14863
MSHSFDVVVIGGGPGGYVAAIRGAQLGLRVALVEQDKVGGTCLHRGCIPTKAYLRSAEVLHTLRQSREYGVLTGGVDLDFAAVRSRKDKVVSNLHKGIQGLLKKNGVAVFQGRGALVPPSIFSPNGLVSVMVGDQQELLEFNKVIIATGSRPKTLGIPVDGAHVMTSDEALARPDLPASVIIIGAGVIGMEWASLYADFGVRVTVLEFLDRILPTEDEAVAAELHKLMTRRKVEIVTGAAVLPESVQAEGGQVRVQARVGEQVREFQAEALLIAVGREPVTRGFGLENRERVTYGPGGFIQVDGFGRTGDPAIYAIGDVAGGGLAHVASHQGIIAMEHIAGLNPEPFAPVRVPRCVYTRPEVASVGLTEAQAREQGREVRVGTFPWRGIGKALVHGSVDGFAKIVADAATGDVLGVHLIGPDATNLIAEAGLALTLNASAWELGQVIHPHPTLAEIFGEAALAVEGRAIHM

SEQ ID NO: 35473 - protein, 323 aa, Brucella melitensis 16M
MQIRSARRCDIMANDNGIKHFIDLSTVPATELRAILEDAKARKARLKAGEVERPYAGKVLAMIFEKLSTRTRVSFDVGMRQLGGETIMLTGSEMQLGRSETIADTAKVLSRYVDAIMIRTTAHERMLELAEYATVPVINALTDDTHPCQIMADVLTYEEHRGPIKGKTFAWMGDGNNVLHSLVEAAARFDFNVNIATPKGSEPKSQYIDWARANGAGIMSTTDPEKAASGADCIVTDTWVSMGQEDHARGHNVFIPYQVNANLMAKADPKALFMHCLPAHRGEEVTDEVIDGPQSVVFDEAENRLHAQKAILAWCLQDRGLGA

SEQ ID NO: 35474 - protein, 345 aa, Symbiobacterium thermophilum IAM 14863
MKANVAINGFGRIGRMVCRRLLRHPDLNLVAVNASYPAETLAHLLKYDTVHGRLDAQVVAGDGEIVVDGHVVRLVSERDASRLPWRELGIDIVIDATGKHKERERAALHLHSGARKVIITTATKDPDVTVVMGVNEGAYRPAEHHIIAAASCTTNCLAPVAKVLHETFGIRTGLMTTVHAYTNDQNMLDNPHRDLRRARAATASIIPTTTGAAKAVAQVLPELKGRLNGFALRVPTPDVSVVDLVVQLERPATREEINDALRSAAQGPLRGILAYSDEPLVSADFIGDPHSAIVDGTLTMVGPDNLAKVIAWYDNEWGYSCRVVDLAALVARQLALEPPLEGVAD

SEQ ID NO: 35475 - protein, 386 aa, Ralstonia eutropha JMP134
MEQLLVDSVVFLAAALIAVPLSVRAGFGSVLGYLIAGVVIGPWVLRLVTDVDSILDISELGIVLMMFIIGIEMDLKKLWAMRRAIFGYGGIQVALCAALLAAIFTIFGAPWRVGVAAGFALSLSSTAMVIAILEQNREMDTPVGQTCFGILLFQDIAAIPMIALLPLLAPAPIEDNDPSGWLMTARALAMLAAVVFGGRFILQHALRIIQRSGTREIFTIFALLWVIGIALLMHVVHLSMSLGAFVAGMLLAGSESRHEIEADMAPFKGILLGLFFIAVGMSIDFRVLAERPWLVAILVVVLVGGKLLALMFLASKINLPREQRIYFAILLSQGGEFAFVVTAAAQAARLLDNEQLSIVTVVVALSMATTPLLLLAFRKLMAVQPA

SEQ ID NO: 35476 - protein, 947 aa, Miscanthus x giganteus
MAASVSGATICLQKPGSKGRRARDATSFARRSVAAPRSPHAAKASVIRSDAGAGRGQHCSPLRAVVDAAPIATKKRVFYFGKGKSEGDKSMKELLGGKGANLAEMSSIGLSVPPGFTVSTEACKQYQDAGSILPAGLWAEILDGLQFVEEYMGATLGDPQRPLLLSVRSGAAVSMPGMMDTVLNLGLNDEVAAGLAAKSGERFAYDSFRRFLDMFGNVVMDIPRSLFEEKLEHMKESKGVKNDTDLTAADLKELVGQYKEVYLTAKGEPFPSDPKKQLELAVRAVFNSWESPRAKKYRSINQITGLVGTAVNVQSMVFGNMGNTSGTGVLFTRNPNTGEKKLYGEFLINAQGEDVVAGIRTPEDLDAMKDVMPQAYEELVENCNILESHYKEMQDIEFTVQENRLWMLQCRTGKRTGTGAVKIAVDMVSEGLVERRQAIKMVEPGHLDQLLHPQFENPAAYKDQVIATGLPASPGAAVGQIVFTAEDAEAWHAQGKAAILVRAETSPEDVGGMHAAAGILTERGGMTSHAAVVARGWGKCCVSGCSAIRVNDAEKTVAIGDHVLSEGEWISLNGSTGEVILGKQPLSPPALSGDLGTFMSWVDEVRKLKVLANADTPEDALAARNNGAQGIGLCRTEHMFFASDERIKAVRQMIMAPTVELRQQALDRLLPYQRSDFEGIFRAMDGLSVTIRLLDPPLHEFLPEGNVEEIVRELCAETGANEEEALERVEKLAEVNPMLGFRGCRLGISYPELTEMQARAIFEAAIAMSNQGVEVFPEIMVPLVGTPQELGHQVNVIKQVAEKVFTSMGKTIGYKIGTMIEIPRAALVADQIAEQAEFFSFGTNDLTQMTFGYSRDDVGKFIPIYLAQGILQHDPFEVLDQRGVGELVKFATERGRQTRPNLKVGICGEHGGEPSSVAFFAKAGLDYVSCSPFRVPIARLAAAQVLV

SEQ ID NO: 35477 - protein, 947 aa, Miscanthus x giganteus
MAASVSGATICLQKPGSKGRRARDATSFPRRSVAAPRSPHAAKASVIRSDAGAGRGQHCSPLRAVVDAAPIATKKRVFYFGKGKSEGDKSMKELLGGKGANLAEMSSIGLSVPPGFTVSTEACKQYQDAGSILPAGLWAEILDGLQFVEEYMGATLGDPQRPLLLSVRSGAAVSMPGMMDTVLNLGLNDEVAAGLAAKSGERFAYDSFRRFLDMFGNVVLDIPRSLFEEKLEHMKESKGVKNDTDLTAADLKELVGQYKEVYLTAKGEPFPSDPKKQLELAVRAVFNSWESPRAKKYRSINQIIGLVGTAVNVQSMVFGNMGNTSGTGVLFTRNPNTGEKKLYGEFLINAQGEDVVAGIRTPEDLDAMKDVMPQAYEELVENCNILESHYKEMQDIEFTVQENRLWMLQCRTGKRTGAGAVKIAVDMVSEGLVERRQAIKMVEPGHLDQLLHPQFENPAAYKDQVIATGLPASPGAAVGQIVFTAEDAEAWHAQGKAAILVRAETSPEDVGGMHAAAGILTERGGMTSHAAVVARGWGKCCVSGCSAIRVNDAEKTVAIGDHVLSEGEWISLNGSTGEVILGKQPLSPPALSGDLGTFMSWVDEVRKLKVLANADTPEDALAARNNGAQGIGLCRTEHMFFASDERIKAVRQMIMAPTVELRQQALDRLLPYQRSDFEGIFRAMDGLSVTIRLLDPPLHEFLPEGNVEEIVRELCAETGANEEEALERVEKLAEVNPMLGFRGCRLGISYPELTEMQARAIFEAAIAMSNQGVEVFPEIMVPLVGTPQELGHQVNVIKQVAEKVFTSMGKTIGYKIGTMIEIPRAALVADQIAEQAEFFSFGTNDLTQMTFGYSRDDVGKFIPIYLAQGILQHDPFEVLDQRGVGELVKFATERGRQTRPNLKVGICGEHGGEPSSVAFFAKAGLDYVSCSPFRVPIARLAAAQVLV

SEQ ID NO: 35478 - protein, 130 aa, Hordeum vulgare
MGKSWALLTHLHSVAGPSITLLYPLYASVCAMESPSKVDDEQWLAYWILYSFITLLEMVAEPVLYWIPVWYPVKLLFVAWLALPQFKGASFIYDKVVREQLRKYRGRNRNGDADHKVHILKAEADHGRVH

SEQ ID NO: 35479 - protein, 187 aa, Miscanthus x giganteus
MAASVSGATICLQKPGSKGRRARDATSFARRSVAAPRSPHAAKASVIRSDAGAGRGQHCSPLRAVVDAAPIATKKLGGKGANLAEMSSIGLSVPPGFTVSTEACKQYQDAGSILPAGLWAEILDGLQFVEEYMGATLGDPQRPLLLSVRSGAAVSMPGMMDTVLNLGLNDEVAAGLAAKSGERFDYD

SEQ ID NO: 35480 - protein, 404 aa, Burkholderia sp. 383
MQTVTLKPSKEKSLLRRHPWIYANAIDRVDGKPAPGATVIVRAHDGRFLARGAYSPQSQIRVRVWSFDENEPIDHAFFKRRVQRAVSHRTTMVSGTGAVRLVFGEADGLPGLIVDYYVADTAEAGATPRGQLVCQFMAAGVEAWKDAIVKALVGATDCPNVYERSDVSIRDKEGLEQTTGVLAGDAPPATLISNENGVRYHVDVPNGHKTGFYVDQRDNRALVAQYAADRDVLNCFCYTGGFSLAALKGGAKRVVSIDSSGDALALAQQNVVANGFDAERATWLDADAFKTLRRLVDEGERFDLIVLDPPKFAPTRDSVDRAARAYKDINLSGFKLLRPGGLLFTYSCSGAIDMDLFQKIVAGAAADAKVDARILKRLGAGVDHPLLAAFPEGEYLKGLLLQIV

SEQ ID NO: 35481 - protein, 272 aa, Magnaporthe grisea 70-15
MTGRLANKVAIITGASSGIGRATALLMAREGAAVVCSDIRQGPPTDSNSSSSISTHEEIQRLGGRATFVSCDTSDSAQVQALVKSAVAEFGRLDIMFNNAGVGKEGDNYPDTMIWQYDEDDFDLTMAVNVKGVFLGCKYAAAQMKDQEPLVPGGDRGWIVNTGSILGVNAIKGVTAYAASKHAVLGITKAAALDCAPFNIHVNAVNPGFVKTVMTKNMLEDSVGSEALAARHPFKGIGNVEDIAKTVLFLVSDDASWITGTSLCVDGGYTTM

SEQ ID NO: 35482 - protein, 131 aa, Glycine max
MASKAALLLCLNVLFFTVVSSTYVPCNPPPKTPKHPPVPKPPSPKLASCPKDTIKFGVCADVLGLINVQLGKPPKTPCCNLIQGLADLEAAVCLCTALKANVLGINLNVPVNLSLLLNYCGKGVPKGFVCY

SEQ ID NO: 35483 - protein, 157 aa, Zea mays
FTVYCLSFCFAEKISDWTNIVLAYEPVWAIGTGKVATPAQAQEVHGGLRKWLHSNVSPAVAELTRIIYGGSVNGANCKELAAQPDVDGFLVCGASLKVNRDRYNDGSIKHSLLKQSSLDLLTIETPGLKKNDSFSRWMSKELEEVVDLGIKSTSDAF

SEQ ID NO: 35484 - protein, 381 aa, Synechococcus sp. WH 7803
MSLSSSSNDPLANVPSDRLWLRSELMGTQVITRDTGRRLGVVGEVIVDIDGREVVALGLRDNPLTRFLPGLPRWMPLDRIRQVGDVILVDSADSLSEAFSPERYSRVINCQVITESGQQLGRVLGFSFDIETGELTTLVTGAVGVPLLGEGVLSTWEIPVEEIVSSGADRIIVYEGAEDKLKQLNSGFLEKLGVGGPSWEEQERERYRVNVVPVENQLSSGQSAEDTPRQLEASSSQRFDADQAELEYVELEQPRQDEVRRRRYLDELPLEEESGRYEPQERYQPQERYQPQERYESEERYEPQERYEQPRNDPPRDVDQDRDFDRRPSQFDETPPQPRPDRRPRPASRRPIERPGEPLDVEPMDQEPQPRSPREPMDDPW

SEQ ID NO: 35485 - protein, 173 aa, Escherichia coli B
EVGPGVTSLKPGDRASVAWFYEGCGHCEYCNSGNETLCRSVKNAGYSVDGGMAEECIVVADYAVKVPDGLDSAAASSITCAGVTTYKAVKLSKIRPGQWIAIYGLGGLGNLALQYAKNVFNAKVIAIDVNDEQLKLATEMGADLAINSHTEDAAKIVQEKTGGAHAAVVTAVA

SEQ ID NO: 35486 - protein, 397 aa, Pseudomonas fluorescens PfO-1
MGLNEFGEAQEGFAERPQEYEELMAKRDYYEVLGVERGSSEADLKKAYRRLAMKHHPDRNPGDKASEDLFKEANEAYEVLSDSSKRAAYDQYGHAGVDPSMGGGGAGFGGQNFSDIFGDVFSDFFGGGRGGSRGGAQRGSDLRYTLELNLEEAVRGTTVNIRVPTLVNCKPCDGSGAKKGSSPSTCPTCGGIGQVRMQQGFFSVQQTCPRCHGQGKIISDPCDSCHGDGRVEEYKTLSVKVPAGVDTGDRIRLSGEGEAGTQGGPTGDLYVVINVREHDIFQRDGKHLFCEVPISFVDAALGGELEIPTLDGRVKLKIPEGTQTGKQFRVRGKGVAPVRGGGAGDLMCRVAVETPVNLTRRQRELLEEFRSSLADDNSHSPKTTGWFDGVKRFFGDL

SEQ ID NO: 35487 - protein, 267 aa, Brassica napus
  misc_feature (195)..(195): Xaa can be any naturally occurring amino acid
MSCFKSKYADELIANAAYIGSPGKGILAADESTGTIGKRFASINVENVELNRRALRELLFTTPGALQYISGIILFEETLYQKTASGKPFVDVMKEAKVLPGIKVDKGTVELAGTNGETTTIGLDGLGDRCKKYYEAGARFAKWRAVLKIGANEPSELAIHENAYGLARYAVICQENGLVPIVEPGILVDGSHDIXEKCAYVTERVLAACYKALNDHHAILEGTLLKPNMVTPGSDSKSRAEPKVIAEHTVRALQRTVPAAVPAVVFL

SEQ ID NO: 35488 - protein, 386 aa, Pseudomonas fluorescens PfO-1
MRYLREVFLTKPAILALADGSIFRGEAIGADGQTVGEVVFNTAMTGYQEILTDPSYAQQIVTLTYPHIGNTGTTPEDAESDRVWSAGLVIRDLPLVASNWRNTMSLSDYLKANNVVAIAGIDTRRLTRILREKGAQNGCIMAGDNISEEAAIAAAQGFPGLKGMDLAKVVSTKTQYEWRSTVWDLKTDSHATIEASELPYHVVAYDYGVKVNILRMLVERGCRVTVVPAQTPAADVLALKPDGVFLSNGPGDPEPCDYAIQAIKEVLETEIPVFGICLGHQLLALASGAKTLKMGHGHHGANHPVQDLDTGVVMITSQNHGFAVDEETLPANVRAIHKSLFDGTLQGIERTDKSAFSFQGHPEASPGPNDVAPLFDRFINEMAKRR

SEQ ID NO: 35489 - protein, 444 aa, Vitis vinifera
MSCSSSSASEEEDEGTDSYRKGGYHAVRVGDPFSGGRYIAQRKLGWGEFSTVWLAYDTRSSKYVALKIQKSAVQFAQAALHEIEVLSAIANGDPSNSKCVVRLIDHFKHTGPNGQHVCMVLEFLGDSILRLIKYNRYKGLEFNKVREICKCILTGLDYMHRELGIIHTDLKPENILLFSTIDPAKDPIRSGLTPILERPEGNPTGGVTINSIEKKLKARARRAVAKISGKRASMGGETPKAERSLDGIDVRCKIVDFGNACWADRQFTGEIQTRQYRAPEVVLQAGYSTSVDMWSFACTAFELATGDMLFAPKNGQGYSEDEDHLALMMELLGKIPRKVAIGGARSKDLFDRHGDLKRIRRLKFWPLDRILVDRYKFSESDAREFADFLVPLLDFAPEKRPTAQQCLQHPWLNLTNLAANETKSKSNMEKLDVGMSKLQIEVGK

SEQ ID NO: 35490 - protein, 807 aa, Oryza sativa Indica Group
MTILLVILGLHLCSLHLPAISAAADTLSPGQSIAGDDRLVSSNGKFALGFFNTGSKSSGNDTLSYWYLGIWFNKVPNKTHVWIANRGSPVTDATSSHLTISPDGNLAIVSRADSSIVWSSQANITSNNTVAVLLDTGNLVLQSSSNSSHILWESFDHPTDVFLPSAKIGLNKITGLNRRIFSRRDLVDQAPSVYSMEFGPKGGYQLVWNSSVEYWSSGEWNGRYFSRIPEMVVKSPHYTPFIFQIEYVNNDQEVYFTYRIHDDTIPLYTVLEVTGQRKALAWLNDTQGWQAVFTHPNDQCEVAATCGPFTICNDNTFPSCSCMEGFSIESPDSWELGDRTGGCRRNIPLDCVSSRSDIFNAVPATRLPYNAHAVESVTTAGECESICLGKCSCTAYSFGNYSGCSIWHGKLVNVKQQTDDSTSANGETLHIRLAARELQARKSNKGLVVGVVVSASLSALGILTLVLLLIMIRRHRKKLHCQALNSIYAGTGVIPFRYSDLHRATKNFSEQIGAGGFGSVFKGLLNGSTAIAVKRLVSYCQVEKQFRAEVSSIGVIHHTNLVKLIGFSCKGDERLLVYEYMSNGSLDTHLFRSNNSVTLNWSTRYQIALGVARGLAYLHESCRDCIIHCDIKPQNILLDDSFVPKIADFGMAKLLGRDFSRVMTTARGTIGYLAPEWFSGVAVTPKVDVYAYGMVLLEIISGKMNSHRESNSYADHIVCFPLEVAHKLLEGDVLSLVDGKLNGDVNVEEAERACKLACWCIQENELDRPTMGKVVQILEGLLELDLPPMPRLLQSIVQSSWKTETQH

SEQ ID NO: 35491 - protein, 809 aa, Oryza sativa Indica Group
MHSIVALIIIIVFELFLLSQLHIPSCHAATLDALSPGQELAGSDKLVSSNGRFALGFFQTDSNKSSSNSTPNIYLGIWFNTVPKFTPVWVANGENPVADLASCKLLVSSDGNLAVVATTQAKNSSMVWSSKANIPTNTTLAVLLDDGNLVLRSTSTTNASSTILWQSFDHPTDTVLQGGKIGWNNATGVNRRLVSRKNTADQAPGMYSFELLGHNGPTSMVSTFNSSNPYWSSGDWNSRYFSNIPETVGQTWLSLNFTSNEQEKYIEYAIADPTVLSRTILDVSGQLKALVWFEGSWDWQTIFTAPKSQCDVYAFCGPFSVCNDITFPSCTCMKGFSVQSPEDWELDDRTGGCVRNTPLLCNSNKTAAGTADKFYPMTSVQLPDKAQSIGAATSADECAAACLSSCSCTAYSYGEGGCSVWHDKLLNVRQQGNGVLYLRLSAKEVLESRRNNRWGVILGASIGASTAALGLIFLLMIGIRKGKRYNLTMDNVQGGMGIIAFRYVDLQHATKNFSEKLGAGSFGSVFKGSLSDSTIIAVKRLDGARQGEKQFRAEVSSIGIIQHVNLVKLIGFCCEGDRRLLVYEHMPNSSLDAHLFPSSGAVLSWTIRYQIALGVARGLAYLHSSCRDCIIHCDIKPENILLDSSFTPKVADFGMAKFLGRDFSHVVTTMRGTIGYLAPEWISGTAITSKVDVYSYGMVLLEIISGSRNSSKQSSRDGVHEACFPVQVARNLLNRDIDSLVDANLHGEVKLEQVERVCKVACWCIQDNEFDRPTMSEVLQFLEGLSEVETPPMPRLLHTLAGGLDSKIM

SEQ ID NO: 35492 - protein, 128 aa, Triticum aestivum
MAASEAAAAAATPVTPTEGTVIAIHSLEEWSIQIEEANSAKKLVVIDFTATWCPPCRAMAPIFADMAKKSPNVVFLKVDVDEMKTIAEQFSVEAMPTFLFMREGDVKDRVVGAAKEELARKLELHMAS

SEQ ID NO: 35493 - protein, 831 aa, Triticum aestivum
  misc_feature (484)..(484): Xaa can be any naturally occurring amino acid
  misc_feature (486)..(486): Xaa can be any naturally occurring amino acid
IDLSLILKPAAEIRPGAAQYCVEKQDHGLDMALDNKLIALSRAALEKEVRVFIETPIKNTNRAVGTTLSHEVTKRYHMKGLDPGTIHVKLTGSAGQSFGAFLCPGITLELEGDSNDYVGKGLSGGKIVVYPPRNSTFSAEDNIVIGNVALYGATKGEAYFNGMAAERFCVRNSGARTVVEGIGDHGCEYMTGGTVVILGKTGRNFAAGMSGGIAYVYDVDGTFSVRCNNELVDLYHVEEEDDVTTLKMMIEHHRLRTESVLAKDILSKFDTLLPKFVKVYPRDYKRVLEEMKAEKAAARPTKEPKVANGVSVTTKKIQTEKSSSRPTRVANAKKYRGFVTYEREGVSYRDPIERVKDWNEVAIESVPGPLLNTQSARCMDCGTPFCHQESSGAGCPLGNKIPEFNELVHQNRWREALDRLLETNNFPEFTGRVCPAPCEGSCVLGIIENPVSIKSIECSIIDKGFEEGWMVPRPPLQRTGKRIXLXSWQWSLADGLAAADQLNKMGHFVTVFERSDRIGGLMMYGVPNMKTDKIGVVQRRVNLMAEEGVTFVVNANVGSDPLYSIERLRSENNAVILACGATKPRDLSIPGRELAGVHFAMEFLHANTKSLLDSNLEDGRYISAQGKKVVVIGGGDTGTDCIGTSVRHGCSSIVNLELLTKPPSKRAADNPWPQWPRVFRVDYGHQEASTKFGNDPRTYEVLTKRFIGDENGKLKALEVVRVKWEKVDGRFQFKEIEGSQEIIEADLVLLAMGFLGPEENIADKLGLEKDNRSNFKAQFGHFGTSVDGVFAAGDCRRGQSLVVWAITEGREAAAAVDKYLSRDEQNVAGLT

SEQ ID NO: 35494 - protein, 299 aa, Burkholderia sp. 383
MSEPIDLSQIAPTLKAEILAEALPYIRRYHGKTVVIKYGGNAMTEERLKQGFARDVILLKLVGINPVIVHGGGPQIDHALKKIGKAGTFIQGMRVTDEETMEVVEWVLGGEVQQDIVMLINHFGGHAVGLTGKDGGLIHARKLLMPDRDNPGQYIDIGQVGEVEAINPAVVKALQDDAFIPVISPIGFGEDGLSYNINADLVAGKLATVLNAEKLLMMTNIPGVMDKDGNLLTDLSAREIDALFEDGTISGGMLPKISSALDAAKSGVKSVHIVDGRIEHSVLLEILTEQPFGTMIRSH

SEQ ID NO: 35495 - protein, 574 aa, Trichodesmium erythraeum IMS101
MATQVFNKIHFRNLQGDIFGGLTAAVIALPMALAFGVASGAGPAAGLYGSVLVGLFAALFGGTPTLISEPTGPMTVVMTAVIANLTATNPENGMTMAFTVVMLAGLFQISFGFLKLGKYITMMPYNVISGFMSGIGLILIILQIGPFLGQASPKGGVIATIENLPQLLNNINPIETGLAVLTVVILFSMPTKLKKIFPAPLVALVIGTIISIVFFSDIDIRRIGEIPSGLPSLQLPYFTAGQLQLMVVDAIVLAMLGCIDALLTSVVADSLTRTQHDSDKELIGQGLGNLASGLFGGIPGAGATMGTVVNINTGARTALSSITRAVILMVVVLGAASLTAQIPMAVLAGIAFQVGIKIIDWGFLKRAHRISWKSAIIMYAVIGLTVFVDLITAVGIGVFIANVLTIDRLTQLKSEDVKAITDADDAIILDNDEKELLDRAEGRILLFHLSGPMIFGISKAISRQHTHLNNYEVLIVDLSEVPHMGVTSALAIENVIQETIDTGRNVFLVGAAGSVKLRLEKLGVLNIVPSENMLMDRKQALVKAVALVTSDVNINDPIQNGAKGIQSGIDNIIK

SEQ ID NO: 35496 - protein, 500 aa, Beta vulgaris subsp. vulgaris
MSMPIPSRQLFIDGEWREPIKKNRIPIINPSNEEIIGDIPAGSSEDIEVAVAAARRALKRNKGREWAATSGAHRARYLRAIAAKVTERKDHFVKLETIDSGKPFDEAVLDIDDVATCFEYFAGQAEAMDAKQKAPVTLPMERFKSHVLRQPIGVVGLITPWNYPLLMATWKIAPALAAGCTAVLKPSELASITCLEFGEVCNEVGLPPGVLNIVTGLGPDAGAPLAAHPDVDKVAFTGSSATGSKVMASAAQLVKPVTLELGGKSPIIVFEDVDIDQVVEWTMFGCFWTNGQICSATSRLLVHESIAAEFIDRLVKWTKNIKISDPFEEGCRLGPVISKGQYDKIMKFISTAKSEGATILCGGSRPEHLKKGYFIEPTIISDISTSMQIWREEVFGPVLCVKTFSSEDEALDLANDTEYGLASAVFSKDLERCERVSKLLESGAVWVNCSQPCFVHAPWGGIKRSGFGRELGEWGIENYLNIKQVTSDISNEPWGWYKSP

SEQ ID NO: 35497 - protein, 550 aa, Trichodesmium erythraeum IMS101
MQLVNSLHFNNLRGDLLGGLTAAIVALPLALAFGVSSGAGAITGLYGAIFVGFFAALCGGTPSQITGPTGPMTVLMATVFTTLLADNPDAGLEMAFTVVMLGGIFQILFGVLQLGKYIVLIPYAVISGFMSGVGVIIIIIQIGPFLGHPASASVAQSIKKIPEFLINLNPAAVGLGILTIVILLFTPRKVTAIIPSPLLALLTGTLISVFFLSDSNLILIGEIPTGLPKLHLPVFTFNQLQNMLVDGLVLGTLGSIDSLLTSLVADNITRSNHDSDHELIGQGIGNIMSGLFGGLPGAGATMRTVVNVHAGGKTPLSGIVHSIILLLILLWAGKLTEAIPQAILAGILLKVGVDIIDWGFLKRAHNLSLKAAGIMYSVLILTVFVNLVTAVAVGIFIANLLTVKRLSDMQINDIKAIVEPNDEIPLRDQEKQLLKECRGHLLLLHLGGPMSFGAAKALSRHMGMVQQYDVLILDLSDVSYLGITMSLALENMVTEASRKHREVFIVGASGGVKTRLGKLKIWNFVPRQNLVGTRIKALQQTLNLLVERKI

SEQ ID NO: 35498 - protein, 388 aa, Ruegeria sp. PR1b
MKIAVAGLGYVGLSNAVLLAQNNEVTAVDVSETRVQMVNGGQCPIVDAELEDFLSHRDLRLSATTNASAAYADAAYVIVATPTNYDPKTNYFDTSSVEAVVKDVIAVNPGATIVIKSTIPVGYVRDLRRRLETDQVIFSPEFLREGQALYDNLHPSRIIVGERSERARIFADLLLQGAEETEVEILFTDPDEAEAIKLFANTYLAMRVAFFNELDSYAMAGGMDSRQIIEGISLDPRIGSHYNNPSFGYGGYCLPKDTKQLLANYNHVPQNLIRAIVDANRTRKDFLSDQILMRGARVVGIHRLVMKAGSDNFRQSSIQGIMKRLKAKGVEVIVYEPVLEEDHFFHSRVIRDLEAFKAEAELIVANRLSDEIADVADKVFTRDLFGAD

SEQ ID NO: 35499 - protein, 384 aa, Thermotoga maritima
MRVYFDNNATTRVDDRVLEEMIVFYREKYGNPNSAHGMGIEANLHMEKAREKVAKVLGVSPSEIFFTSCATESINWILKTVAETFEKRKRTIITTPIEHKAVLETMKYLSMKGFKVKYVPVDSRGVVKLEELEKLVDEDTFLVSIMAANNEVGTIQPVEDVTRIVKKKNKETLVHVDAVQTIGKIPFSLEKLEVDYASFSAHKFHGPKGVGITYIRKGVPIRPLIHGGGQERGLRSGTQNVPGIVGAARAMEIAVEELSEAAKHMEKLRSKLVSGLMNLGAHIITPLEISLPNTLSVSFPNIRGSTLQNLLSGYGIYVSTSSACTSKDERLRHVLDAMGVDRRIAQGAIRISLCKYNTEEEVDYFLKKIEEILSFLDLTGNNRR

SEQ ID NO: 35500 - protein, 488 aa, Ruegeria sp. PR1b
MTRTGETPKTVQMITPVLLCGGSGTRLWPLSRKSYPKQFVPLMGEETLFQASAKRLAGVAEGLSFGAPLVLTNSDFRFIVTEQLQAVGIDPGAILIEPEGRNTAPAVLAAALRAQAEDPEAVLLVAPSDHVVPDVAAFHAAISQGLAAVAEGQMVTFGITPTHAETAYGYLELAAAPDADGAPLALKQFVEKPDAARAAEMLAAGNFKWNAGIFLFAARDIIAAFTAHAPALVAPVQAALDQAQVDLGFLRLAPEPWAQAEDISIDYAVMEKARNLSVVPFDAAWSDLGGWDAVWRELGPDDNGVVTSAGATAIDCHDTLLRSDSEGLEVVGIGLEGIMAVAMNDAVLVADKSRAQDVKLAVSALKAKGAAQATAFPKDHRPWGWFESLVVGERFQVKRILVHPGASLSLQSHFHRSEHWIVVEGTAKVTVDDEVRLVTENQSVYIPLGAVHRMENPGKLPMVLIEVQTGAYVGEDDIVRYEDIYARS

SEQ ID NO: 35501 - protein, 387 aa, Glycine max
METGIACYTRGPFLPSVSSKHSPPSISPSFGLRSLKSSSLFGESLRVASKSTLKVSKTKNTSLVTRCEIGDSLEEFLTKATPDKGLIRLLVSMGEALRTISFKVKTASCGGTQCVNTFGDEQLAVDLLANQLLFEALNYSHFCKYACSEENPELLDMGGPVEGGFSVAFDPLDGSSIVDTNFTVGTIFGVWPGDKLTGITGRDQVAAAMGVLGPRTTYVLALKDFPGTHEFLLLDEGKWQHVKETTEIGEGKLFSPGNLRATSDNPDYAKLIDYYVNEKYTLRYTGGMVPDVNQIIVKEKGIFTNVSSPSAKAKLRLLFEVAPLGFLIEKAGGYSSDGHQSVLDKVISNIDDRTQVAYGSKNEIIRFEETLYGKSRLKGGVAVGAAA

SEQ ID NO: 35502 - protein, 929 aa, Ustilago maydis 521
MQAVTASRPNADSASASHRIPSQPNASNPPSASLRPPDQQMPTTAASLMREGPRDFTVIKDVGDGSFGTVCLADWKSPLPSGTMLSPMQHPTTRPEYIGKRLVAIKKMKKPFPSWQECMKLKELRSLLTIPPHPNIIPLYDAFLMPTTKELHFVFECMEGNLYQLTKSRKGRPLAAGLVASIYEQIVLGLDHIHQHGYFHRDMKPENLLITTTGLADYPNLQPALAAERDVLVIVKLADFGLARETLSKPPYTEYVSTRWYRAPEVLLRSRDYSNPVDMWALGTILAELVNLKPLFPGHSEVDQVLQICDILGDPSHSYGHDSRNRRNGGGPWDRGIRMARAVGFTFPIRKPAKFSRFFSDRVPQNLIDCIEDLLRYDPQARLTSKDCLQHDYMRLDAPRLRPPQAKPLVSATAPLRPQQNASRPLPSSHSTLLSSNHARPPFGAADSNLKPLAVLRQPDGSPIVRVNAAATSDPSLANGTTPASPMQEDATEVHWAPPVVSSSRDVSLSGYPAFPDSASLYAASSSTHPDGPPSGAPSSDATMVMSDAQLTDSTLKHTDPRHAQALQAHQYEQYQRQYRHDAGQSQSPGYDAHAAAAYDRDAALRGAAFVPFVASYPGSAATGQLAAATSSGELSQKNDSNASNETISSRDKERRRSKVWGLNISSKFGGSGSSGTLAGSSSGGAANATGTHLYAVGNAAAGRLPPNGPMQESRVSLEPTPAQRIAAEHSNATLATLPNGAPAKTADSKKARKEAEKAAREAEKAKREAQQKAARDRARAVMQKRNQLLASSNSKDPVEWLAGAIQSDEPYRSSPSEKARGKQPAIPGSQLSPSMPSFASGEFPRSPLQQPIHGLSPDYGMNANPAVMGSMAWRGVGAARYSRSNKARRREHDDDHSMASMQSYQTGDSDPGPGTAPSTTSSSPIWKG

SEQ ID NO: 35503 - protein, 323 aa, Ostreococcus tauri
MLDRLLRQLDVLRDVLLQRWNCRRLPHRAIDIVDVSVRGKTFVVTGPTSGIGVTTAHALAKRGARVILACRTVKKGEDLLAQWITESEALRTERPNCRVMQLDLDSLESVREFAKEFVRSEGRLDVLINNAGIFDMSGSYVKTRDGREQHLQANFLAPALLTMSLLDVLRSTGAKTGDARVVFVSSKLHELSTGLVLDDMDFNKRPYAAAAAYGSSKLAEVMFVRALDKRLRVHAPGTRALVLHPGNIVTGVVRTLPWIIQFLYRIIMSHILLTPDQGARASLYCATQQEAVSSDTNGPYLTSECVENPPSKYALDEEATERL

SEQ ID NO: 35504 - protein, 725 aa, Ostreococcus tauri
MRGPRSLFHVDDHSRERAGIIYPLLGIGANIAQACSGMFMKFITTSWHPAGVSPENMWQEKLKLFMFVVMSCGGAIMACHKYICDRERKDPNSAMSEKLREHESRERVRLAQESAPESSTSPKKKKSQGLAASLSYVFESPEVACLAVMAIAQGLSSIIFQVAWKTQLRILRPDPTSYAAYMGDVQTYSGMVTGIFMVAAPFLFKYLGWKGTLSVTPKTVIALGWVFFGTSIYALRHGALTQSSHLLPILVFGGAVIYIVERAAKFSLFKPAEEMVYITLDEDSRTKGKAAVDVLGSQIGKTGGSFMQQGLIFTYGSIIGALPVLVCCHSAIAVCWLVAVNALAARRAQQLDSEIAEDFLNARRASIFQTSHPFARARELRAPRPSVPTPPRATPRTMDVPDDAFAGVLVRAPPASTSAPGAVDRREHRHRYYQDRNKRWAFACDDRGATLLERLFARGRSAIDVIDAAIASAAPDVTWSQEEYRHLGLQREYTWACLERGMYGGFLRRAERGGTIRCASLGGGPGFELVAFQEFFKAHYPTVELDLISLDLEESWRASSEALGLRFARWDMRDGGVADACGVPKIDFAIASYVFKMYMCEDVVADWLATELTGIEALFVINRDENLRDGCALMERRGVDVTKLLPQANGRDDRQLVFSRGQDFPRPSGGMENAEPSGGFTFPNVPYMEHKSSSNHQRGGGWRGHGSHHDHDRRSRPDDRRRDRW

SEQ ID NO: 35505 - protein, 421 aa, Zea mays
MGGRKIALLVGINYPGTKAELKGCYNDVDRMRRCLVDRFGFDEADIRVLTDADRSAPQPTGANIRRALARLVGDARPGDFLFFHYSGHGTRLPAETGQHDDTGYDECIVPCDMNLITDQDFRELVQKVPEGCLFTIVSDSCHSGGLLDSAKEQIGNSTKQNKTQSREPDEPRHSGSGSGFRSFLKETVRDVFESEGIHIPHSRRHGDDDQDDGYAQPTGNGRTKNRSLPLSTLIEMLKEQTGKDDIDVGSIRMTLFNIFGDDASPKIKKFMKVMLGKFHQGQSGEQGSGGGGVFGMVGALAQEFLKAKLEGKEEEAFKPALEQEVHSVDEVYAGSKAWAPNNGILISGCQTNQTSADATTPQGVSFGALSNAIQTILADKHGKVTNKDLVMKARELLSKQGYTQQPGLYCSDEHVHVAFIC

SEQ ID NO: 35506 - protein, 153 aa, Oryza sativa Japonica Group
MVSREQKRASLHEKLQILRTLTHSHAVNKMSIISDASTYIKDLKQKIAALNKELGCAKNMNICEEPSPVVRVQVLDKGFLINVFMDKSSPGLLSSILQAFDELGLTVIEARASCSNSFRLEAVGGEHEEADGGIDANAVELAVMQAIKSTPGK

SEQ ID NO: 35507 - protein, 393 aa, Aeropyrum pernix K1
MACGSKYPSSPRLFTCPKCGGLLEPFYIDGGSPRGRGVWRYRDLLPRPRRIVTMGEGSTPLVKLENLSRAMGVEVYGKLEFLNPTGSFKDRGMTVGVSIASSFSYRLVVAASTGNTAASMAAYARRAGLNPVILIPKGGIASGKLSQIAALGAWVLEVEGSFDDALDAARAAAEKGLAYSLNSINPYRLEGQKTIAFEILEDVDRVDHVVVPVGNAGNISAIWKGFKEAGLLGLPSMRPRMVGVQAEGASPLYRAWVEKMDSVERVRNPSTIASAIRIGNPVNAAKALAAVRESDGLIISVSDAEILKAAATLAENEGMLVEPASAASLAGLIKLRNQGIIASGSSVVLILTGHGLKDPRALEFIASSAGVRRAYASTAEEALLKLEEIAVGG

SEQ ID NO: 35508 - protein, 175 aa, marine gamma proteobacterium HTCC2080
MNRSVPKTSFQTRVRDESIGGENPFRWETLSSDAIFKGRTVALFSLPGAFTPTCSTSHLPRYEELCEEFYAAGVDEVVCLSVNDAFVMYKWGREQGAEKVRLLPDGNGEFTRKMGMLVDKSNLGFGMRSWRYSMLVRDGVIEKLFEEPGFADNFEEDPFTVSDADTLLGYVKAGQ

SEQ ID NO: 35509 - protein, 783 aa, Oryza sativa Indica Group
MALLIFVVLLFALSIPASSATIDTISIGTALAKNDKLVSENRRYALGFFETQRKASQKTSKWYLGIWFNQVPKLTPAWIANRDKPIDDPTSVELTIFHDGNLAILNQSTKSIVWSTQANITAHNTVATLLNSGNLILTNFSNSLEVFWQSFDYPTDTFFPGAKLGWDKYLLLPLNSSTPYWSTGAWNGDYFSSIPEMKSHTIFNSSFVDNDQEKYFRYDLLDERTVSRQILDIGGQEKMFLWLQDSKDWTLIYAQPKAPCDVYAICGPFTVCIDNELPHCNCIKGFTVTSLEDWELEDRTDGCSRNTPMDCINNKTTTHSNDMFYSMPCVRLPPNAHNVESVKSSSECMQVCLTNCSCTAYSFINGGCSIWHNELLNIRKDQCSENSNTDGEALYLRLATKEFYSAGVDSRGMVIGLAIFASFALLCLLPLILLLVRRSKTKFSGDRLKDSQFCNGIISFEYIDLQRATTNFMERLGGGSFGSVFRGSLSDSTTIAVKRLDHACQIPQGDKQFRAEVSSIGTIQHINLVKLIGFCCEGGRRLLVYEHMSNRSLDLQLFQSNTTISWNTRYQIAIGIARGLSYLHESCQDCIIHCDIKPENILLDDLFIPKIADFGMAKLLGRDFSRVLTTVRGTAGYLAPEWISGVPITPKVDVYSYGIVLLEIISGRRNSYTSSPCVGDHDDYFPVLVVRKLLDGDICGLVDYRLHGDINIKEAETACKVACWCIQDNEFNRPTMDEVVHILEGLVEIDIPPMPRLLEAIVAESSNPTCTSSSFFGSIRESL

SEQ ID NO: 35510 - protein, 233 aa, Oryza sativa Japonica Group
MAGKDDDVKVLGVVVSPFAIRVRIALNIKGVSYEYVEEDIFNKSELLLTSNPVHKKVPVLIHGGKPISESLVIVQYVDEVWAAAPSVLPADPYDRAVARFWAAYVDNNMFPGMAGVLFAATEEERAAKAEETLAALAQLEKAFAECAGGKAFFGGDSIGYVDLALGSNLHWFEALRRLFGVALLDAGKTPLLAAWAKRFVEAEAAKGVVPDAGVAVELGKKLQARAAAASTAA

SEQ ID NO: 35511 - protein, 808 aa, Oryza sativa Indica Group
MALLIYVVLLFSLCISANAAMTDTISVGNALGRKDKLVSKNGRYALGFFETERVEVSQKSSKWYLGIWFNQVPKITPAWVANRDNPINDPTSLELTIFHDGNLVILNRSAKTIIWSSQANITNNNTSAMLLSSGNLILTNPSNSSEVFWQSFDYPTDTLFPGAKLGWDKVTGLNRRIISRKNSKDLAAGVYCKELDPSGVDQSLLTPLNSFTPYWSSGPWNGDYFAAVPEMASHTVFNSTFVHNDQERYFTYTLVDERTVSRHIVDVGGKAKMFLWYEDLQDWVMNYAQPKSQCDVYAVCGPYTICIDNELPNCNCIKGFTITSHEDWELEDQTGGCSRNTPIDCTNNKNTTHSSDKFYSMTCVKLPQNEQNIENVKSSSECAQVCLNNCSCTAYSFSNGGCSIWHNELLNIRKSQCSDSSNTDGEALHIRLAAEELYSKKANKRVMVIGVVISASFALLGLLPLILLLLRRRSKTKFFGDTLKDSQFCNGIIAFGYINLQRATKNFSEKLGGGNFGSVFKGSLSDSTTIAVKRLDHACQGEKQFRSEVSSIGIIQHINLVKLIGFCCEAGKRLLVYEHMPNRSLDLQLFQSKTTITWNIRYQIAIGIARGLAYLHENCQDCIIHCDIKLENILLDASFIPKIADFGMAKLLGRDFSRVLTMVRGTAGYLAPKWISGVPITLKVDVYSYGMVLLEIISGRRNSRTSCSCGGDHDVYFPVLVARKLLDGDMGGLVDYRLDGEIDIKEAEIACKVACWCIQDNEFNRPTMGGVVQILEGLVEINMPPMPRLLEAIAAGSSNLTCSLASFV

SEQ ID NO: 35512 - protein, 129 aa, Haloarcula japonica
MPTVEYLNYEVVDDNGWDMYDDDVFAEASDMDLDGEDYGSLEVNEGEYILEAAEAQGYDWPFSCRAGACANCAAIVLEGDIDMDMQQILSDEEVEDKNVRLTCIGSPDADEVKIVYNAKHLDYLQNRVI

SEQ ID NO: 35513 - protein, 808 aa, Oryza sativa Indica Group
MSLLIFIVLLFSLCIPESSATTDTISAGQTLAKDDKLVSKNGRYAFGFFKTDTKASGKTNKWYLGIWFNQVPTLTPVWVANRDKPIDDPTLLELTIFRDGNLAILNRSTNAILWSTRANITTNNTIVILLSSGNLILTNPSNSSEVFWESFDYPTDTFFPGAKLGWNKITGLNRRIISKKNLVDPATGMYCEELDPTGVNQVFLALVNSSTPYWSSGAWNGEYLSSIPKMASHNFFIPSFVNNDQEKYFTYNLANENIVSRQILDVGGQSKTFLWLEGSKDWVMVNAQPKAPCDVYSICGPFTVCTDNELPNCNCIKGFTITSLEDWVLEDRTGGCSRNTPIDCISNKTITRSSDKFYSMPCVRLPPNAQNVGSVDSSSECAQVCLNNCSCTAYSFSNGGCSVWHNELLNIRKNQCTGSSNTDGETFHIRLAAQELYSQEVNKRGMVIGVLSACFALFGLLLVILLLVKWRNKTKLSGGTRKDYQFCNGIIPFGYIDLQHATNNFTEKLGGGSFGSVFKGFLSDYTIVAVKRLDHACQGEKQFRAKVSSIGIIQHINLVKLIGFCCEGGRRLLVYEHMPNRSLDHQLFQTNTTLTWNIRYELAIGIARGLAYLHENCQDCIIHCDIKPENILLDHSFSPKIADFGMAKLLGRDFSRVLTTTRGTAGYLAPEWISGVPITTKVDVYSYGMVLLEIISGKRNSYASCPCGGDHDVYFPVLVACKLLDGDMGGLVDYKLHGGIDKKEVEKAFKVACWCIQDDEFSRPTMGGVVQILESLVEVDMPPMPRRLQAIAGSSNSTCSLYSLPANI

SEQ ID NO: 35514 - protein, 798 aa, Oryza sativa Indica Group
MALPITVLFLLFTLHIPASCKVTDTISAGETLAGNDRLVSSNGKFALGFFPTSSKSSHNASNWYLGIWFNQVPKLTPAWVANGDEPVTGPTSPEATISGDGNLVILDQATKSIIWSTQADITANTTMVKLLDNGNLVLQNTSNSSVVLWQSFDYPTNTHLAGAKLGRNKVTGLNRRLVSRKNSVDPASGMYSYELTDNNGSARFILAALNSSIPYWSSGEWNGHYFGSIPEMTGQRLIDFTFVNNDEEVYFTYTLLDNATIMRFMLDISGQTKIFLWVEHVQDWVPTYTNPKQCDVYGICGAFTACEESKLPICKCMKGFSVRSPNDWELDDRTGGCVRNTPLDCGINRNTSMQDRFHPMPCVGLPSNGQIIEDVTSAGGCAQVCLSNCTCTAYYYGNTGCSVWNDELINVKQLKCGDIANTDGATLYLRLAAKEVQSIKSSGRSIIIGVAVTASVASFALALFLIAKIPRNKSWLLGHRRKNFHSGSGVIAFRHADLQHATKNFSDKLGAGGFGSVFKGLLNESTVIAVKRLDGARQGEKQFRAEVGSIGIIQHINLVKLIGFCCEGDRRLLVYEHMPNLSLDTHLFHSDATVLKWSIRYQIALGVARGLAYLHDSCQDCIIHCDIKPENILLDASFVPKIADFGMAKFLGREFTQVLTTMRGTIGYLAPEWISGTVITSKVDVYSYGMVLLEIISGTRNSSKEFATRDDYEYFPVLVAHKLLDGDAGSLVDQNLHGDVDLEQVERAFRVACWCIQDNELDRPTMSEVVQYLEGLLEVGIPPVPRLLQAIAGNPYSK

SEQ ID NO: 35515 - protein, 241 aa, Vitis vinifera
MDRYQRVEKPRTETPINENEIRITTQGRMRNYITYATTLLQEKGSNEIVLKAMGRAINKTVMISELIKRRIVGLHQNTSIGSTDITDMWEPLEDGLLPLETTRHVSMITITLSKKELDTSSTGYQPPIPVDQVKPLNELEYEGDSPGMRGRGRGRGRGRGRGIVHGGEYNNGDGWDGGQVEAVEEDVVSVVEEEAMVSGGYYDYGDSEVPAQGRGRGRSRGRGRGRGRNFRTEGPPQAIAA

SEQ ID NO: 35516 - protein, 475 aa, Debaryomyces hansenii CBS767
MTTLQNGLRIVTDSTPGHFSALGAYVDAGSRFENPEKPGLSHIFDRLAWKSTDQYTGIEMMENLSKLGGNYMCSAQRESMIYQASVFNKDVDKMFDCIAQTIRAPRITDQELVETLQTADYEVSEIALKHDMFLPEVLHCAAYSNNTLGLPLFCPPERIPMISKDEVLNYHKTFYQPQNIVVAMVGVRHDHAVRLAQSQFGDWKSSSLQRPDLGTVNYTGGEIALPHQPPLAGNLPELYHMQIGFETTGLLNDDLYALATLQKLLGGGSSFSAGGPGKGMFSRLYTRVLNQYAFVENCMSFNHAYINSGLFGITISCSPNAAHVMSQIICFELSKLLEKDPSEGGLTDREVKRAKNQLISSLLMNVESKLAALEDLGRQIQCQGKLTTIDEMIDKIEKITVEDLRKVAEKILTGNVVTKGVSSGKPSVVMQGDRAAFGDVEFVLRHFGLGKFDGPPLTEPRDFSSGLGNKISKWF

SEQ ID NO: 35517 - protein, 504 aa, Pericallis cruenta
MSILTLICTFITGLMFYGLVNLLSRRASRLPPGPTPWPIIGNLMHLGKLPHHSLADLAKKYGPLIHVRLGSVDVVVASSASVAGQFLKVHDANFANRPPNSGAKHMAYNYHDMVFAPYGPRWRMLRKMCSMHLFSAKALADFRQVRQEEVMILTRVLAGTEQSAVKLDQQLNVCFANTLSRMMLDRRVFGDGDPKADDYKDMVVELMTLAGQFNIGDYIPWLDLLDLQGIVKRMKKVHSQFDSFLDTIIDEHTIGTGRHVDMLSTMISLKDNADGEGGKLSFIEIKALLLNLFSAGTDTSSSTVEWGIAELIRHPQLMKQAQEEMDIVIGKNRLVTEMDISQLTFLQAIVKETFRLHPATPLSLPRIASESCEVKGYHVPKGSILFVNVWAIARQSELWTDPLEFRPGRFLIPGEKPNVEVKPNDFEIVPFGGGRRICAGMSLGLRMVNLLIATLVQAFDWELANGLELEKLNMEEVFGISLQRVQPLLVHPRPRLARHVYGTG

SEQ ID NO: 35518 - protein, 556 aa, Synechococcus sp. WH 8102
MTLGRIVLNRINATNLKGDVFGGLTAAVIALPMALAFGIASGAGAAAGLWGAVIIGLVASLFGGTPTLISEPTGPMTVVFTSVIISFTATADSPEQALAMAFSVGVLAGIFQILFGLFRLGRYVTMMPYTVISGFMSGIGIILVLLQLGPFLGQATPKGGVMGTLLEMPALVQGTQPMELLLALITLAILWFTPSAVKKVCPPQLLALVVGTVLALSLFSGAGLRTIPEFSAALPSFQLPTFSSGQLRLMVIDAAVLGMLGCIDALLTSVVADSLTRTEHNSNKELIGQGLANVVSGLFGAMPGAGATMGTVVNIQSGGRTALSGIVRAMVLMLVVLLAAPLASRIPLAVLAGIAVKVGIDIMDWDFLQRAHHLSVKAAVITYGVIALTVLVDLIAAVGIGVFVANVLTIDRMSTLQSKKVKTISTTDDDVELSDEEQQLLDRASGMVLLFQLAGPMIFGVAKAISREHNAIGNCQAVVFDLSEVSHLGVTAAIALENAVKEAMEVGRDVFMVGVSGSTENRLRKLKLLERLPEGHLTSDRLSALRLAVAGLPAHG

SEQ ID NO: 35519 - protein, 386 aa, Physcomitrella patens subsp. patens
MSLRSSTTLKGEFCGAAVRQSVAAPKAANVAFAVRAGQYDDELVKTANTIATKGKGILAMDESNATCGKRLESIGLENTEANRQAYRQLLVTTPDLGDYISGAILFEETLYQSTTDGRTMVDCLNANGILPGIKVDKGLVPLTGSNNESWCQGLDGLASRTAAYYKQGARFAKWRTVVSIPNGPSELAVTEAAWGLARYASICQDNGLSPIVEPEILLDGEHGIDRTLEVASKVWSKVFYFLAENNVLFEGILLKPSMVTPGAECKDRATPEQVAEYTLNMLKRRVPPAVPGIMFLSGGQSEVEATLNLNAMNQSPNPWHVSFSYARALQNSVLKTWKGQPENVEAAQKALLVRAKANSLAQLGKYSAEGEAEEAKQGMFVKGYTY

SEQ ID NO: 35520 - protein, 505 aa, Hordeum vulgare
MAAPPAIPRRGLFIGGGWREPTLGRHIPVINPATEDTIGDIPAATAEDVELAVAAGGPVLARRREPWARASGATRAKYLNAIAAKITGKIAYLALLETVDSGKPKDEAVADMDDVAACFEYYAALAEALDGKQHAPISLPMEEFKTYVLKEPIGVVGLITPWNYPLLMATWKVAPALAAGCTAVLKPSELASLTCLELGAICEEIGLPSGVLNIITGLGPDAGAPIASHPHVDKIAFTGSTATGKTIMTAAAQMVKPVSLELGGKSPLVTFDDVADIDKAVEWPMLGCFFNGGQVCSATSRLLLHEKIAEPFLDRLVEWAKNIKISDPLEEGCRLGSVISKGQYEQIKKFISTARSEGATILHGGDRPKHLGKGFFIEPTINTGVSTSMQIWREEVFGPVICVKVFKTESEAVELANDTHYGLAGGVISDDLERCERIAKVIHSGIVWKNCSQPTLVQAPWGGNKRSGFGRELGEWGLENYLSVKQVTRYCKDELYGWYQRPSKL

SEQ ID NO: 35521 - protein, 416 aa, Thermobifida fusca YX
MSTSHHAPAAVRLPTAAADAQRQSDQTTTMPAEGNKNVQVPAILVLEDGRVFHGVSFGAEGETFGEIVFHTGMTGYQEVLTDPSYHRQIVVMTAPHIGNTGVNDDDAESHRIWVSGYVVREPSRIVSNWRAQRTLEEELRRQGVVGIALSGTRALTRHLRDKGVMRAAISTVETDPDKLRERVLASPQMVGANLAGEVTTAEPYTVRPPDGVPVRFTVAAVDLGIKAMTPQRLAERGCEVRVLPAHTTAEQILALNPDGVFFSNGPGDPAAADAVVETMRGILDAGTPLLGICFGNQILGRALGLETYKLPFGHRGANHPVRETRTGRVYITSQNHGFAVRAPLDGPFDTPYGRAEVSYIGLNDGVVEGLRLLDRPALSTQFHPEAASGPHDAADVFDTFVEMMTAHRQAREAARA

SEQ ID NO: 35522 - protein, 407 aa, Physcomitrella patens subsp. patens
MEDRYFPNTLSDYVAPLLGGNGNPHSQCEPGRTPEGSFSEPSVVLKAAIALRDEVLEATWIRHGPRVSDPTMYVGMLGTAFLCFKVHQTTGSIEDLDICCNIVDSCAVAAESMKQYVTFLCGQSGIYALGAAAAKCKGDQKRLDWYLSLFNAGGLGMPYELMYGRAGFLWAALFVNKYVGEETIPWSVTGPVVDAVMAAGRAGASHTQCPLMYQWQGTRYWGAAHGLAGIMHVLMHFPLNHEDMKDVKGTLRYMIKGRFSSGNYPSSEGSTRDRLVHWCYGAPGMALTLCKAAQVYPECKDFKLAAIEAGEVVWKRGLLRRLGLCHGISGNAYVFLALYRLCGEKKHLFRAHQFGKFLHKNAKQLIRNGEMHGGDHGYSLYEGWAGTACLWLDLAGADASRFPGYEF

SEQ ID NO: 35523 - protein, 178 aa, Fulvimarina pelagi HTCC2506
MRVEAISRGKNPPDEINVIIEVPMGGEPVKYELDKESGALFVDRILFTPMRYPGNYGFVPHTLSDDGDPIDVLVLNDRPFVPGCVLPCRPIGVLVMEDDAGQDEKVVAVPTSKMTRQYENVKTATDMPEILLKQVEHFFEHYKDLEPGKWVKIHNWGDVEHARKMIRDAVERYDNDKK

SEQ ID NO: 35524 - protein, 113 aa, Oryza sativa
MKTTGGGGSPKEAVVPSAASGDTTLGRHLAHRLVQVGVSNVFTMPGDLKLTLLDHLIAEPGLHIVGCCNELNAGYAADGYAWAHGVGACTVTFTIRGQLLHGRRRAAIGSGIR

SEQ ID NO: 35525 - protein, 144 aa, Zea mays
MSAANQLAALVSNMYATGLLDDQFQQLQLLQDPSAPDFVSEVVTLFCQDGERIIEELAKLLEKPNVDFDRVDAFVHQLKGSSANIGAQKVKNTCIQFREFCQQKSRDGCLKVLETMRINFYELRGKFQTMLQLERQVNGFPPNK

SEQ ID NO: 35526 - protein, 502 aa, Trichodesmium erythraeum IMS101
MLTKLWSFRGRYRILHLTWFAFFLSFVVWFNLAPLATALKEDLGLETSQIRTIAICNVALTVPARIIIGMLLDKYGPRITYSLLLMYAAIPCIGFALAQNFSHLVISRLALSIVGGGFVIGIRMVAEWFPPKEIGLAEGIYGGWGNFGSAGAAFTLPTIAAWLTFGSGDVLNWRVSIALTGIIAALYGVFYFFNVLDTPPGKTYQKPKCARGLEVTTPKDFLFLVLMNIPLTGVLCLLGWRLSKVGFLSTSQLYIVWLVLLGLYAFQTYNCWITNKELIAQEKHYPPSDRYKFSQVAILELTYFVNFGSELAVVSMLPAFFENTFGLSKTMAGMIAASYAFMNLVSRPGGGLISDKLGSRKLTMTVLTVGMAIGYLTMGNVKGSWWLPAAVLLTMLCSFFVQAAEGSTFAIVPLIKRRVTGQIAGNVGAYGNVGAVLYLTLYSFLPEGAIGDKIFFEVIGVTSMIVAFICAFFLKEPEGSFAEHHEGEEEVQIESHTLFAEE

SEQ ID NO: 35527 - protein, 478 aa, Shigella flexneri 2a str. 301
MTLSFITRWRDELPETYTALSPTPLNNARLIWHNTELANTLSIPSSLFKNAAGVWGGETLLPGMSPLAQVYSGHQFVVWAGQLGDGRGILLGEQLLADGTTMDWHLKGAGLTPYSRMGDGRAVLRSTIRESLASEAMHYLGIPTTRALSIVTSDSPVYRETVEPGAMLMRVAPSHLRFGHFEHFYYRREPEKVRQLADFAIRHYWSHLEDDEDKYRLWFNDVVARTASLIAQWQTVGFAHGVMNTDNMSLLGLTLDYGPFGFLDDYEPGFICNHSDHQGRYSFDNQPAVALWNLQRLAQTLSPFVAVDALNEALDSYQQVLLTHYGQRMRQKLGFMTEQKEDNALLNELFSLMARERSDYTRTFRMLSLTEQHSAASPLREEFIDRAAFDDWFARYRGRLQQDEVSDSERQQLMQSVNPALVLRNWLAQRAIEAAEKGDMMELHRLHEALRNPFSDRDDDYVSRPPDWGKRLEVSCSS

SEQ ID NO: 35528 - protein, 592 aa, Cryptococcus neoformans var. neoformans B-3501A
MAPTPGVIPVPAARPAASHLSKSPPTTNEYTSTAPIPALPPQHTDEGVPSHLYQGLPAHLLIDDAQGQKVPDYLRMILMSKVYAAPLNLKETPLTYAANLSARLGNEIWIKREDLQPVFSFKIRGAYNMMASLSDEEKKKGVITCSAGNHAQGVALSGHALNIPAIVVMPVSTPSIKWRNVQRLGATVLLHGRDFDEAKAECLRLEKEKGLTFVPPYDNPYVVAGQGTVAMEICRQVTDADQIDGIFASVGGGGLAAGIAAYMKRVAKPSVGIYGVETVDGDAMDRSLKAGKRVLLDEVGPFADGTAVRLVGEEPFRVCKNFLDDVVLVNNDEICAAIKDVFEETRSVPEPSGALALAGLKAHIIRNNLQGAGKRFVAVISGGNMNFGRLRFVAERADVGERREVLMSVRVPEKPGSFLKFHSLLGSRAVTEFSYRHSNNSTGYIICSFLLSSSSSSSSGPSPEARANEIHEMVESFKQHGIEAVDLSEDEFAKSHVRHLVGGRSAVEHERIFRFEFPERPGALGNFLKGMKVEWNISMFHYRNHGADVGKVLIGVQVPSQDNPAFDEFLEKLGYPYVEETHNEVYTMFLRS

SEQ ID NO: 35529 - protein, 667 aa, Ostreococcus tauri
MGGGKRKRVNATGKVIPKSVLKAKRGTTKGASTRYVTRNQALARLQLKLGDFRRLCILKGVHPREPKKKAQGQGKTYYHVKDIAFLHHEPLLEKFRELRAYARKLKRAKAKQNYVALDRLRENTPKYELSHLVLERYPRFRDALGDLDDPMCMCALFAVLPTVNRHNIAPEIVEKSEKLSREFKSFCVRTHALRKVFISVKGIYYEAEIQGEKITWVEPHALAQTMPEDVDYRVMLTFLEFYHDLMTFVNFKLYKDAGLRYPPTLNEEMDDAAAGLAAVVHQMVKAADAANASALPANSDAARAVESRAQSLKEKLAQIAEHQDEEEDDDEAMALDEDDDDGMTPEHRECAKLFDGLMFFINREVPRDMMIFIIKSFGGEVCWEGEGSPYDPDDPRITHVVIDRPTTNMKLNPKVVYIQPQWVCDCANWRVLIPPTDYAPEKECPPHLSPFIGANDDGYTPEYAKTLLKLQEEARAIRNGASTVKMLENAEEEMTEEEQAAAEEKQYRKELEAEMKGVSYSEAMAKKDDDDENDEDDDDDDDDDDEDDEDEDSEENDSEEDGSEEDEDAEPKSRLTFDMALSEKDKIMRDKLAEGTEEEQMKKLSYMLLPRKKRELYKAMQIGIAKKEKRAAELTRLAEEHKEKKRRAAEGEKDKPAAKKGKKGGKK

SEQ ID NO: 35530 - protein, 292 aa, Rhodobacter sphaeroides
MSKKYPIISVVGSSGAGTSTVKNTFEQIFRREGVKSVSIEGDAFHRFNRADMKAELERRYAAGDATFSHFSYEANELKELERVFREYGETGRGRTRTYVHDDAEAARTGVAPGNFTQWAPFEDNSDLLFYEGLHGCVVNDEVNLVRHADLKLGVAPVINLEWIQKIHRDRAQRGYTTEAVTDVILRRMYAYVHCIVPQFSETDINFQRVPVVDTSNPFIARWIPTPDESLIVIRFKNPRGIDCPYLTSMIAGSWMSRANSIVVPGNKQDLAMQLILTPLIERMVREARRARA

SEQ ID NO: 35531 - protein, 466 aa, Vibrio cholerae O1 biovar eltor str. N16961
MGQKNHFDVIVIGSGPGGEGAAMGLTKGGKNVAIIEKESSVGGGCTHWGTIPSKALRHAVSRIIEFNSNPLFCKNNSSIHATFSTILSHAKSVIDKQTRLRQGFYDRNQCTLIFGAAHFIDAHTVAVKKADGSIDTYSADKFVIATGSRPYHPKDVDFGHPRIYDSDSILNLEHDPRHIIIYGAGVIGCEYASIFRGLDVKTDLINTRDRLLSFLDNEVSDALSYHFWNSGVVIRNDETYDKVEGTSDGVIVHLKSGKKMRADCLLYANGRTGNTDKLNLESVGLQADSRGQLVVNANYQTQVEHIYAVGDVIGYPSLASAAYDQGRFVAQAIIHGQAAHLLTEDIPTGIYTIPEISSVGRTEQELTAAKVPYEVGRASFKHLARAQIAGKDIGSLKILFHRETKEILGIHCFGERAAEIIHIGQAIMEQKGEANTIEYFVNTTFNYPTMAEAFRVAALNGLNRLF

SEQ ID NO: 35532 - protein, 463 aa, Zea mays
  misc_feature (351)..(351): Xaa can be any naturally occurring amino acid
  misc_feature (392)..(392): Xaa can be any naturally occurring amino acid
CAFRRIGLHACATGTMWTASAHIITAVIGSGVLSLGWAIAQLGWVAGPVVMLLFSLVTYYTSSLLADCYRSGDPSTGKRNYTYMDAVNANLSGIKVQICGFLQYANIVGVAIGYTIAASISMLAIRRANCFHQKGHGNPCKISSTPYMIIFGVAEIFFSQIPDFDQISWLSILAAVMSFTYSSIGLGLGVVQVIANRGVQGSLTGITIGVVTPMDKVWRSLQAFGDVAFAYSYSLILIEIQDTIRAPPPSESTVMKRATVVSVAVTTLFYMLCGCMGYAAFGDGAPGNLLTGFGFYEPFWLLDVANAAIVVHLVGAYQVYCQPLFAFVEKWAAQRWPDSAYITGEVEVPLXPGQAGGRCCKVNLFRATWRTAFVVATTVVSMLLPFFNDVVXGFLGALGFWPLTVYFPVEMYVVQKKVPRWSSRWVCLQMLSLGCLVISIAAAAGSIAGIASDLKVYRPFKSY

SEQ ID NO: 35533 - protein, 416 aa, Aeropyrum pernix K1
MIDRLAMIGVNVKTASREHVARLEKEWEKHLDTIGYASRGTVIIATCNRFEVYLDSPSRLVEDLASSIASPGGEGLVRLQGIDAARHLFRVASGLESQIIGDHEVLGQVRRAWLKSREKGFTTPLLDEVFHRALKTGARVRSESAISSGGVGYSSAAVSLAASLLGGGLDGARVGIVGAGMAAVGIARALCTRWRPRVVAVFNRTPERGWEVAGKCRGVESLVLPLDELAKLINELDALFVAIAGSTNILERGRVERGVSPRVIVDISNPPVTPKVAGRVFHMPEVEEEAKRMMEERLRWIPAAEAIIEEELEALLDALSRRRARESSRSVMRALSILAEREYERTLAGLRNGVDPREAVELALNSYTKKVGGALRRLLEEASDRGQLSLEDIEAILVSEFARIAENSGFKNGSTG

SEQ ID NO: 35534 - protein, 434 aa, Debaryomyces hansenii CBS767
MSDLHELCGFQTRPIGPKYIEDLKFYLKNGIPATYTIEEAYNYTNNIEEEPTTTTTPLHIICSHIPNDASNDEIDIINQMVEILLEYGAGWCLTDINDDTPGCILIRRKLNNTPIYNQVVAAGVRAELLLRKVSEYDMEIIEDTDDLNHEQFEGIQGEETTEEERKEEEPSNTSDIIDEQKVEQPKEDLKEDPSSNQETYLKTKLEYKDGALVTKDRKDGVMMSWETDLMRMGCDSLFKGASIDGEIDDEVNILNIGFGMGIIDTMINNKNPTKQYICEAHPDVLAKLRLDGWYEKQNVVILEGRWQEQLNKLLSEGNVFFNGIYYDTYSEHYEDMLELFDIVVGILKPHGVFSFFNGLGADRQVVYEVYKQLVEMDLANYGLICKFEQIEVPESTLQLEVQNSTDNKSVWDDIKRAYWTCPTYYHPEARFMDV

SEQ ID NO: 35535 - protein, 584 aa, Caulobacter crescentus CB15
MRIRMRRLASLLALSAALQLSLAPVAALAESIPLAMPTPRPAATSTPAKGMVAAANPLAVEAGLRVLRDGGSAVDAAVAIQAVLSLVEPQSSGLGGGAFLMAYDAKTGKITAYDGRETAPSAATPDMFMGPEGKPLSFVKVLLSGRSSGVPGAVAMLAQAQKDHGKVAWSTLFKDAETLAADGFVVSPRLAGMINSPRAPQASQPDAVKYFTKPDGTRYKAGDVLKNPAYAETVRRIAAEGPSALYEGPIAQAIVERLREGELPGSMTLEDLKRYKPRAGAPLCRPWKVYTVCVPNPQSSGLAIIQALQMLEHTDIGKRGPTDPVAWTLLAQAERVMYADRDRYVGDPDFVTVPVAGLLDPKYVAQRAKLITDKAGPAPSFGQPKGAPKVGVDATHEPGGTTHFVVADTQGNVVSMTTTVESIFGNGRMVGGFFLNNQLTDFSFSPVEKDGAPAANAIAGGKRPRSSMAPLIVLDKKGKFLAAVGSPGGNAILSYNLKAMVGLFYWNLNMQQAVSLPNLVARGENFSGDADLFGPEMLAALNARGVTVKVGQLETSGLQGVIVRPGNVLEGGADPRREGVAKGL

SEQ ID NO: 35536 - protein, 422 aa, Synechococcus sp. WH 7803
MTTLSRDVGVTLAERTRSDFPILDQLDSQGGPLVYLDHAATSQKPQAVLDALRGYYSNDNANVHRGAHQLSARATEAFEGARAAVARFVGAAGPDEVVFTRNATEAINLVARTWGDANLQAGDEVLLSVMEHHSNLVPWQQLAQRTGCVLRHVGITESGELDLDDLRQQLNKRTRLVSLVHISNTLGCRNPVEEIAALAHGVGALMLVDACQSLAHQSTDVNQLGVDFLVGSSHKLCGPTGMGFLWARKDLLDAMPPFLGGGEMIQDVFLDHSTWAALPHKFEAGTPAIGEAVGMGAAITYLEALGLEQIAAWEAQLTRYLFQQLDSIEGLRILGPTPEQQPGRGALATFLVDGVHANDIASMLDLAGICIRSGHHCCQPLHRHFKVTGSARASLSFTTTFEEIDRFAAELQGVIAFFREHG

SEQ ID NO: 35537 - protein, 254 aa, Listeria monocytogenes str. 4b F2365
MRKPLVGINMKNYINTRAQTSEWLEATIPLLKNFSDVDTFIFPSMGTLETTANLLAGTSFGFGPQNMAPEKSGPLTGEFSVESIIDLNANYVEIGHAERKNLFHEKTSEIAKKIKLALDEKITPVVCVGEEVRANDTNELKNALKKQIEALFQTINLAQWENVVLAYEPEWAIGKASSAETNYIESAHQALREIIRELGGDETLVRIIYGGSVSKENAAEIVRQKNVDGLFVGRFGHKPQNFADIVSIVSKTKG

SEQ ID NO: 35538 - protein, 286 aa, Arabidopsis thaliana
  misc_feature (62)..(62): Xaa can be any naturally occurring amino acid
MAERGGERGVERGGERGDFGRGFGGRGGRGDRGGRGRGGRGGRRGGRASEEEKWVPVTKLGXVSLAAGHIKQIEQIYLHSLPVKEYQIIDMLIGPTLKDEVMKIMPVQKQTRAGQRTRFKAFVVVGDGNGHVGLGVKCSKEVATAIRGAIILAKLSVVPVRRGYWGNKIGKPHTVPCKVTGKCGSVTVRMVPAPRGSGIVAARVPKKVLQFAGIDDVFTSSRGSTKTLGNFVKATFDCLQKTYGFLTPEFWKETRFSRSPYQEHTDFLASKALSTSKPDPVVEDQA

SEQ ID NO: 35539 - protein, 438 aa, Alicyclobacillus vulcanalis
  misc_feature (238)..(238): Xaa can be any naturally occurring amino acid
KVAMVERGTIGGTCVNIGCVPSKTLLRAGEINRLAMQHPFQGLATSAGRVDLGQLVNQKNELVERLRQNKYIDLIDEYGFMMIRGEARFVDPRTVEVNGNRISARFFLIATGASPDVPDIPGLRDVDYLVSTTALELREVPKRLAVIGSGYIAMELGQWLHNLGSEVVLMQRGQRVLKSYDSEISEAITRAFTEQGIEIITGATFQRVEQKGNVKRVYITVDGEEKVIEAEALLVATXRKPNTDSLNLQAANVQLGPRGEVLVDEYLQTSNPYIYAAGDVTMGPQFVYVAAYQGAIAAENALSGNRRRADLSVVPAVTFTHPSVATVGMTEEQAKRAGYEVLTSVLPLDAVPRALANRETNGVFKLVADATSRKLLGAHVVAENAGDVIYAALLAVKFGLTIEDLNSTLAPYLTMAEGLKLATLTFDKDVAKLSCCAG

SEQ ID NO: 35540 - protein, 523 aa, Debaryomyces hansenii CBS767
MALADYSIALYNYFTSLAIVQQASIIILFPFIYNLLWQFFYSFRKDRVPLVFHWMPWVGSAVVYGMQPYEFFENCRTKYGDVFAFVLLGKVMTVYLGPKGHEFVLNSKLQDVSAEEAYTHLTTPVFGKGVIYDCSNSRLMEQKKFAKYALTKDSFRKYVPKIKEEVLSYFTDSENFNMKGKSSGVVNVMESQPEITIFTASRSLMGDEMRKKFDASFAQLYTDLDKGFTPINFVFPHLPLPQYRKRDAAQQKISSTYMSLISKRRDTGDIDPSRDLIDSLMTHSTYKDGVRMTDQEIANLLIGVLMGGQHTSASTSAWFLLHLAENPSLQDEVYEEILSVLKQKNGSFNDLDYDDLQNMPLLNNIIKETLRMHMPLHSIFRKVKNPLLVPNTQYVVPKGHHVLVSPGYAMTNEKWFPEAAKFKPHRWDETAKATGNEDTVDYGFGAITKGVASPYLPFGGGRHRCIGEQFAYVQLGTILSTYVYNMKWSLKDGKMPEIDYASMVTLPMEPADICWEKRENCVI

SEQ ID NO: 35541 - protein, 245 aa, Porphyromonas gingivalis W83
MQSPERITPYDTECPKNEQVEAMFNHIAGHYDRLNHLFSWGMDRVWRQKAIRMIEPFAPHTVLDVATGTGDLAIEICRHIPSVKQVTGVDLSLEMMRIGEQKVRSENLDNRITFMQKDCLDLPFADHSFDAVTVAFGLRNFQNIKLGLEEMYRVLNEGAPLMILELSRPVSFPWKQGYNFYASHVIPVVGRFLSQDAEAYTYLPESIAAMPQREELADLMLSVGFREAYYRSLSLEVATVYMGLK

SEQ ID NO: 35542 - protein, 807 aa, Oryza sativa Indica Group
MLLPCHVLLGLLLLSLYTPASYAAATDTVSPGHSLAGSDRLVSNNSKFALGFFKPGNESSSYTNHNSYLGIWFNKVSKLTPLWTANGENPVVDPTSPELAISGDGNLAILDHATKSIIWSTRANITTNDTIAVLLNNGNLVLRSSSNSSNIFWQSFDYPTDTLFAGAKIGWDKVTGLNRRLVSRKSSVDQAPGIFSLELGLNGEGHLLWNSTVAYWSSGDWNGRYFGLAPEMIGDVMPNFTFVHNDQEAYFTYTLYDDTAIVHAGLDVFGIGFVGMWLEGNQEWFKNYRQPVVHCDVYAVCGPFTICDDNKDLFCDCMKGFSVRSPKDWELDDQTGGCIRNTPLSCGSSKDRTSLTDKFYPMQSIRLPNNAENVQAATSGDECSQVCLSNCSCTAYSYGKGGCSVWHDELYNVKQLSDSSSDGNGGVLYIRLAARELQSLEMKKSGKITGVAIGASTGGALLLIILLLIVWRRKGKWFTLTLEKPEVGVGIIAFRYIDLQRATKNFSEKLGGGSFGSVFKGYLSDSTIAVKRLDGARQGEKQFRAEVNSIGIIQHINLVKLVGFCCEGDNRLLAYEYMPNSSLDVCLFKANDIVLDWTTRYQIAIGVARGLAYLHTSCRDCIIHCDIKPENILLDASYVPKIADFGMAKILGREFSRAMTTMRGTIGYLAPEWISGTVVTSKVDVYSYGMVLFEIISGRRNSSHENFRDGDYSFFFPMQAARKLLDGDIGSLVDASLEGGVNLVEVERACKIACWCIQDNEFDRPTMGEVVQSLEGLLELDMPPLPRLLNAITGGSHPVTPQYFDSL

SEQ ID NO: 35543 - protein, 455 aa, Synechococcus sp. WH 8102
MAIESTFDLIVLGAGSGGLAAAKRAARHGAKVAIVEGDRVGGTCVIRGCVPKKLLVYGAQARHQLNDAPAYGLTLGSVESSVAELFRRVRAEVDRLNHLHLGFLEKAGVARIDGWGRFLSDQCIGIATERGGPIQRELSAAHYLVAVGGRPVRPDIPGIEHTWISDDMFNLEQLPKEVVVVGAGFIACEFACILRGLGVEVTQVVRGSGLLRGFDRELADAVLEGLREQGIHVLLERTVSAVSGQPGDLTVQMSDGLALPCGGVLMATGRRPWLEGLGLDAAGVAVEQGRINVDADSRTSVAHIYAVGDVTDRVNLTPVAIDEGRAFADSTFGTRPRQVNHDLLASAVFSDPELATVGLSEEAAIDRHGVDGVVIHRARFRSMSRALPATGPRCLLKLVVETSTDRVIGCHMVGEHAAEIIQMAAIAVGMGATKADFDRTMALHPSVSEEFVTMG

SEQ ID NO: 35544 - protein, 99 aa, Triticum aestivum
VNYRTSLYKKAGWYRSGIPGISSTHASGPGLATGVLNLAIVAPQIVVSLGAGPWDKLLGGGNVPAFALASVFSLAAGVFAVIKLPKLSNNYQSAGFHMG

SEQ ID NO: 35545 - protein, 272 aa, Bradyrhizobium sp. BTAi1
MLMIEANGARIPALGLGTWELRGRTCARIVEQALTLGYRHIDTAQVYENEQEVGEGLRASRVRRSELFLTTKVWTTHFAPNDLERSTKESLVRLRVSDVDLLLLHWPNSHVPLAETLGALAHAKTLGLTRHIGVSNFTVALLDEAVALSPEPLVCNQVEYHPYLEQTKIREACARHGIAMVAYSPIAKGKIRNDPTLTRIGHAHGKSPAQICLRWLVQQNVVAIPRTSKIERLSENLDVFDFELSEQDMTDIFAMGSAGGRMTDFAFAPKWD

SEQ ID NO: 35546 - protein, 224 aa, Oryza sativa Indica Group
MAAASVLLLLPSPFLRPSSPAHRARCCIATTTTTSTSGRRGLFLFASRCRPGPRRRAASAAVPPEHGLSQPQPQARAVGSYEAALGNAKDALYAALEGMNRGIFGMTSEKRSEIHALVELLESKNPTPEPTDKLQDKVDGCWRLVYSTISILGKKRTKLGLRDFISLGDFFQMIDVKEKVDITLDSSTITPDQLMNIFQKNYDMLLAIFNPEGWLEITYPFRLM

SEQ ID NO: 35547 - protein, 199 aa, Triticum aestivum
  misc_feature (30)..(30): Xaa can be any naturally occurring amino acid
  misc_feature (67)..(67): Xaa can be any naturally occurring amino acid
LVSGSEARSPATPVYGMGSTAHVAALTHGXRTVSSEENASWIASVRSKAPGLESYHVVYDTRLTEAXELIALRDHPGCTAQPDLAAAAEASCRLALRGLPAAFHEVEWDLVMVDAPTGWVPEAPGRMGAIYTAGMVARARRPGDGATDVFVHDVDRTVEDRFSKAFLCDAYLAEQVGRIRHFVIPSHREKPGTPFCPQN

SEQ ID NO: 35548 - protein, 230 aa, Glycine max
MGEVVIMSGEKKSVRVEGVEKEDSGGSGSKAGEFKGLMRWEKFLPKMVLRVLLVEADDSTRQIIAALLRKCSYKVAAVPDGLKAWELLKGRPHNVDLILTEVDLPSVSGYALLTLIMEHEICKNIPVIMMSSQDSISTVYKCMLRGAADYLVKPIRKNELRNLWQHVWRRQSSTTGINGPQDESVAQQKVGTPAENNAASNRSSGDAACIQRNMELIEKGSDAQVSFPDL

SEQ ID NO: 35549 - protein, 499 aa, Photobacterium profundum SS9
MVQPENNAIVIFGASGDLTHRKLIPAFYHLYANGLLPEDFAILGVSRTEYSDQDFREKLKISLTETEKVNEETLIKFCEHLYYQALNTSEVAEYALLKQRLGDLNDKHHTQGNTIYYLATPPSLYGVIPECLGAHGLNDETHGWKNLIVEKPFGYDLASANELDERIHAHFKEQQIYRIDHYLGKETVQNLLVFRFANGMFEPLWNRNFIEYVEITAAESLGVEERGGYYDGAGAVRDMFQNHLLQVLAMVGMESPAAINADSIRDEVVKVMQSFQPLSDKDLEKNLVLGQYTDSTVRGDHLPGYREEHGVADDSRTETYVGMKMFIQNWRWNGVPFYVRTGKRLPTRVTEVVIHFKKTPHPVFGTNAPENKLIIRIQPDEGILMSFGLKKPGAGFEAEEVSMDFHYGDLEETNMLTAYERLLLDCMKGDATLFARTDAVKACWKFVQPILEYKENPDHLFGYAAGTWGPKEADELLQGDERNWRFPCKNLTNTDYCEL

SEQ ID NO: 35550 - protein, 499 aa, Photobacterium profundum SS9
MVFRFRRSQSASVKESMMKGDIGVIGLAVMGQNLILNMNDHGFKVVAFNRTVAKVDEFLAGPAKDTNIIGATSLEDLVANLEAPRKVMLMVRAGDVVDHFIDSLVPLLDKGDIIIDGGNSNYPDTNRRVADLEAKGIYFVGTGVSGGEEGARFGPSIMPGGSPEAWPHVKPIFQVISAKTDQGEACCDWVGKDGSGHFVKMVHNGIEYGDMQLISEAYHFMKEGLGLSYDEMQAIFKEWNDTELNSYLVEITADILGYRDEDGEPLLEKILDTAGQKGTGKWTGINALDLGIPLTLITESVFARCLSAIKDQRVEAEALFGKTIQPIDGDKKEWVDALRQALLASKIISYAQGFMLIREASEENNWSLNYGNVALMWRGGCIIRSAFLGNIRDAYEATPDIKFLGTDPYFKDILVDSLPAWRKVAAKAMEVGLPMPTMTSALTFLDGYTTGRLPANMIQAQRDYFGAHTYERLDQPRGQFFHTNWTGTGGDTASTTYDV

SEQ ID NO: 35551 - protein, 465 aa, Oryza sativa
MLRACGGASPAAAAAAVPALVRARLAKQASSAAHAAATATASASSSLSALGEVAAGRKGLARVVLKKGKTQIFRDGSPMVYSGAVDRIIGRPPPKTGDVVLVADGAEKPIGWGLYNSVSMFCVRLMQLEEEAKRDPTCALNMERLLEARILSAVDLRRSLGLPSVHTNAYRLINSEGDRLSGLIVDIFADVAVVASSAAWVEKYRHEIQFLVNKVSDVNHIKWRSSTDILKEEGLDVSEQKDPESSSHCGTVEVMENDVLYLVSLEGQKTGFYADQRENRHFISTLSKDQRVLDLCCYSGGFALNAAKGGANNVIGIDSSASALDLANKNIILNKLDTQRISFVKEDATAFMKGAISRNEVWDLVILDPPKLAPRKKVLQSASGMYRSLNALAMQVVKPGGLLMTCSCSGAMTQSGLFLRTIQGAASMTGRKVTVLRQAGAACDHPVDPAYPEGRYLSNYLLRVT

SEQ ID NO: 35552 - protein, 356 aa, Ustilago maydis 521
MGACLSAEQSHDTPEYKRSKALDRRIKEDEKNLSREVKLLLLGAGESGKSTILKSMRIIHHIPFTDEERENFRRLVFLNLVQGMKTILDVMEEWSIDFQDDSNIDHLLLFVSYPDISEDEPFPTNYLVALKDLWLDQGVQSVYRRGNEAAVPDNMSYYYTDLDRLFSPSYIPSEDDILRCRNKTTGIIETTFPLQDHVYRIFDVGGQRSERKKWIHCFENVTAVLFCVALSGYDSCLVEDKDSNQMQEALMLFDSICNSKWFARTSMILFLNKVDVFRQKIAYSSIKHYFPDYDGDDQDFNAARSYFKARFCRLNRSVNKEIYPSFTNATDVSLLKIVMASVTDIILTNNLRDIVL

SEQ ID NO: 35553 - protein, 1051 aa, Oryza sativa Japonica Group
MLWARPKLATQQASGGAAAFALNSGGRRNSGGEDGAGGATEVDAARGWIQRKRNARRSRRSFISILPFPRPEISAPLLVASIGVPLPRIRPTFYLRVKFKKIYMAFGANDIVLHIKRLMLCPSLFNFLLSSSPVFLLTALLLGALLSYGEPAVLVLGENQQTLSFKSKISITDCSIDKVETVAVEEHLDKTTTSNEVYVRERNFEGNIHDTHWEEKNGTYMTVDTALNEEIHTKDGTSDYDLQDTHREGKGITSVETDTVPCVAPSSFAYSGVTVETEDVGENSKKNDELQELGSINPESDNNKVQYQYQLGEFMSSCWEPVMRQEPQDACSDSESDLTESSPDASMTDIIPMLEELHPLIDLQTGHPSLVSRDNLNTSSDDDEDDLEEEDASTDENQLEGKIDDFANWKDVIDLNYLDMDNNSKLEGMMDLQRAKNILKFELDRRLMDLQAADAVQKMEEASRFRVQVPSISTGRQNPFDSSNGSDEIIELPHVPDSAPSCLLPRKNLFDLAVNQNMAHDSPLQETWTPLSYFSARRHRKHGNLYVRHSTSLHHNSFKLEKDEISENDAHKSHNSQSDGDAKQERNNSTLFGSLEAHIGEEIKILGMAISEVGVLEVNSGMVSSNQNADFSDDISSSPFQKPRQSTFEAKDTVHAGIEQLTSCSPYKVNNFEAHIVEADSIDEFNSLFKCRMEEVLVQSISKSSISQPLTVKLEDELSEPLSPDSGTGTHFIDGSSVEDSDPRFAQLNDEALVSSTSNATCRNESIEEKSSEALLAGNEDYSELPNELLKSGDPQTADSSEIQVQEQQCDTVEHQLQFLGLTVKKQSLHKSPTTTTTRTRGKSVMSHRDATLFSSDVASLAAPNFLLDGVINFVMAHMTTELGDESLLLVSPSVASLLANLQDYEPETVADTAQALLLASRRMVLFPVNNSERLDKADDGSHWSLLVLDNITGRFVHHDSMDGANLPAATRLADALRPLLPAPPQGPPISGPTPQQSNGYDCGVYLLAVALAICRWWKKHPRTEEAAPCWFESVMDQVTCERFTRLCIKE

SEQ ID NO: 35554 - protein, 878 aa, Caulobacter crescentus CB15
MQKWPCQMVLKWNVVRSAGWTLAERGIQMSALVLTAPLQGWVSALEEAPDAVFAERMLGDGLAIDPLGSTLHAPCDGSVVSVHRARHAVTLRATNGAEILMHVGLETVALNGEGFEVFVEEGQTVKAGDRLIGLDLDLLAQRARSLITPVVITNGEAFQIVRRDQDRQIGVGQFLMELSPIAGASRAAASGAADQITRQIIVPLAHGIHARPAARIAQMAKTFASDLTLATGPRRANARSPVGLMSLAIRHGDTIQLLASGPDAQAAVTALAELIEGGMGEGAPVAAKTSSTKTAPTKTEPSEPPPPAPLPRDGVLKGVPAAPGLAIGKAVRLSTAEIVVREAGEGVAHEEAALAVALETVRARIGKAAETGDKARKAILAAHQAFLDDPELYAGAHRLIAEGKSAGFAWRRAVGGYVQALQALGDRRMAERVDDLIDLERQVLRALSGEEETGAALAPGSILLADELLPSQLMGADPAALAGFATARGGPTSHVAILAAAMGVPALVAVGGALSKVKDGATLILDADAGTLRVAPDAKALEAAQTALAQRQQRKAAAKAAAHEPAVTRDGVRIEVFANTGSVADAQAAVANGAEGSGLLRTEFLFLDRETPPDEDEQARQYQAIAEALDGRPLIIRTLDVGGDKAAPYLPIPAEENPALGLRGVRVSLWRPHLLKAQLRAILRVEPRGQCKIMVPMVASLDELRAVRAVLEEAKRELGITDRVQLGVMIETPAAAVTADLLAAEADFLSIGTNDLTQYVLAMDRGNPELAAGIDALHPAVLRMIDQTCQGAARHHRWVGVCGGLASDLDATPILLGLGVAELSTTASIAPDVKARVRALSLEACRALAAQALEQTSPQAVRALVQGQTNTPLGGLNP

SEQ ID NO: 35555 - protein, 421 aa, Ostreococcus tauri
MNENATRGRNVPHGTKEGARERCDRVETMMSHFGARSGVFAPAGGRAALSNIGNMITGAQGVRQTRSKTTLNEAKEVPQQQQQQSFEWGRTSQRTSHGKPRRGSVMGGTMTTAGADVDMRESYSTYLERSSAADVMTDALPDIDLYDHDNPLAVTQYVNDIYQYWYKVEVSTPKATASRCAPDTRVSETYMLIQGDINYKMRAILIDWLVEVHLKFKLMPETLFLTTNLIDRFLELKTVTRRNLQLVGVTAMLVASKYEEIWAPEVRDFVYISDRAYTRQQILEMEKQMLNTLGFHLTVPTPYCFLNRFFKAAGGDRQFQLYASYAVECALPEYGMLKYSGSTLAAAGVYIAIRGLQTGSWNHTMEAHTRLSESEVYPCACDMAELMRKAPTATLTAVYKKYSSEKFMKIATLPVPHDLRL

SEQ ID NO: 35556 - protein, 698 aa, Physcomitrella patens subsp. patens
MITGHDMYNVLSAMVPLYVAMMLAYASVKWWGILTPQQCDGINRFVSIFAVPLLSFQFVSGNNPYEMNFRFIAADAVSKVFVLSCLGLWVRFSKRGSLEWVITLFMLTTIPNTLVIGTPLLAAMYGSKPGQLTVQAVVLQCIIWYTLLLVMYEYRAARILIMHRFPENAASIVSFKVESDVMSLDGPDPVLTEAEFRNDGKLHVRVRRSVSSRSQGVHSANHSIPSSKALTPRASNLSNAEIYSMNSSVNLTPRGSSFDRGEDCSTMAHRDPNRKSNFDTSDIYSLQSSRGPTPRNSNFNEENSKEVHNHRGALNVNIPRFAPPLYRNGSGGRLFMARSDLGGVGALSFEPAAHSMGPDGRTIYPGITVVTNSVAAVPASGVSTHIINPVFSPLVSQVAKKVNDPRASIPKTDEEAKELHMFVSSANPTSVSEGELHVFGGSDISINLQQSVNPKELHVHVHPQSEHHLPGAANHKTQDEHARQGFSFGNRRDLKVEDVDNNGSKLDKKFRSILTAELAPKHPMDEGKTSMPPSSVMIKLICVMTFRKLTRNPNTYSSLLGVVWSLISFKCHLDMPLILYKSYHIISDAGIGMAMFSLGLFMGMGDRIIACGTKHALFAMLLRFLVGPAVFAAASYLVGLRGVSLNVSTVQAALPQGIVPFVFAKEYNVHPEILSTAVIFGMIVTLPTALLYYILLGL

SEQ ID NO: 35557 - protein, 96 aa, Triticum aestivum
MDSGNTQTEGSQPPVPKNPAMTSCRKKKTDDDVTFLEDVKEHIDEFIHASMDEHKTCFKKTIQKMFGMSKVVAERSAAAKEAEVESALPLQTSVSQ

SEQ ID NO: 35558 - protein, 222 aa, Thermobifida fusca YX
MAIQISPSILSADFARLADEVEAVAGAADWLHVDVMDNHFVPNLTLGLPVVESLLKVAPLPLDCHLMIEDPDRWAPAYAEVGAQSVTIHAEAAKAPVRTLRAIRAAGARAGLALNPATPVDGYADLLGEIDMLLVMTVEPGFGGQKFLDLVLPKIRRARELIRNADASVWLQVDGGVSAETIERCAEAGADVFVAGSAVYGEKDPAAAVEHLRALAERATAR

SEQ ID NO: 35559 - protein, 476 aa, Arabidopsis thaliana
MALQRQLLKRATSDIYHRRAISLLRTDFSTSPSIADAPPHIPPFVHQPRPYKGPSADEVLQKRKKFLGPSLFHYYQKPLNIVEGKMQYLYDESGRRYLDAFAGIVTVSCGHCHPDILNAITEQSKLLQHATTIYLHHAIGDFAEALAAKMPGNLKVVYFVNSGSEANELAMMMARLYTGSLEMISLRNAYHGGSSNTIGLTALNTWKYPLPQGEIHHVVNPDPYRGVFGSDGSLYAKDVQDHIEYGTSGKVAGFIAETIQGVGGAVELAPGYLKSVYEIVRNAGGVCIADEVQTGFGRTGSHYWGFQTQDVVPDIVTMAKGIGNGLPLGAVVTTPEIASVLASKILFNTFGGNPVCSAGGLAVLNVIDKEKRQEHCAEVGSHLIQRLKDVQKRHDIIGDVRGRGLMVGIELVSDRKDKTPAKAETSVLFEQLRELGILVGKGGLHGNVFRIKPPMCFTKDDADFLVDALDYSISRL

SEQ ID NO: 35560 - protein, 380 aa, Lactococcus lactis subsp. lactis bv. diacetylactis
MVDFNKVLDLHELHTGVLDIQADIDVKKPSDLAEAYTPGVAELSKLIQSDPEAKRKYTMSGKLVAVVTDGTAVLGLGNMGPAGGLPIVEGKALLYKELAGVDAIPIAVEQIGAEKIIETIKNISQSFAGIHLEDISAPQCFEIEERLSKNLNIPVYHDDQAGTAIVVLAGLMNAAKLVNKKLEDLKIVINGVGAAGVATGRLFAEVGIKNVTLIDIEGKVNDKVKSYNRYQLELAKRFNRVAGTTLDEVIDGQDVFIGLSDAKVLTGTQVERMAKDAIIFALANPVPEILPEEALKHGAAVVATGSNQWPNQVNNVLVFPGLFKGLLSANVQHVDYKLQANIATAIADVIKNPDRNHIVPGVFDAGVVESVTKAVKDSAK

SEQ ID NO: 35561 - protein, 410 aa, Thermobifida fusca YX
MNRTASPIPLDDIDEALKAIAAGRPVVVVDDADRENEGDLVFAADAATPELLAFMIRHTSGVVCVPMLGEDLDRLNLPLMTPRNEDRLHTAYTVTVDARTGVHTGISAADRARTIRLLADEASEPGDFVRPGHIFPLRYRPGGVLVRRGHTEAAVDLARLAGRRPAGVIAEIVNDDGTMARLPELRAFADEHGLALVSIEQLVAYRRRTETLIERVVETRIPNRYGEWRAVGYRSVVDDSEHVALVYGDLGTGERALVRLHSECLTGDAFGSYRCDCGDQLDAAMARIAQTGAGVIVYQRGHEGRGIGLLHKLRAYRLQDQGADTVDANLQLGLPADAREFGTGAQILLDLGVRSVRLLSNNPDKAAGLAAHGVVVDERIPLPAAITPDNLRYLRTKRDRMGHDLPGLAS

SEQ ID NO: 35562 - protein, 170 aa, Thermobifida fusca YX
MSGAGRPEYTVDAQGLTLGVVATRWNAEVVEPMLERALAAAEQCKVAETTVVRVAGAVEIPVVAQELARTHDAVVALGAVIRGDTPHFDYVCQSFTHGLTEVALRTEVPVGNGVLTCDTLEQARDRAGLPDSKEDKGWEAAVAALDTALVLRKLRDARGQRDGRPRPTTT

SEQ ID NO: 35563 - protein, 397 aa, Streptococcus pyogenes str. Manfredo
MPKLSKRVLEMKESVTLAAGARAKALKAQGRDVLNLTLGEPDFFTPKHIQDKAIESIQNGTASFYTNASGLPELKAAIATYLKNQYGYHLSPDQIVAGTGAKFILYAFFMAVLNPGDQVLLPTPYWVSYSDQVKMAEGQPIFVQGLEENQFKVTVDQLERARTSKTKVVLINSPSNPTGMIYGAEELRAIGEWAVHNDILILADDIYGSLVYNGNQFVPISTLSEAIRRQTITVNGVAKSYAMTGWRVGFAAGEPEIISAMSKIIGQTTSNLTTVSQYAAIEAFCGSQSSLEEMRLAFEERLNITYPLLCQVPGFEVVKPQGAFYFFPNVKKAMEMTGFSDVTSFANAILEEVGLAVVSGAGFGAPENVRLSYATDIETLKEAVRRLHVFMESNEIN

SEQ ID NO: 35564 - protein, 428 aa, Candida albicans SC5314
MSIIDEYESLEVIGKGSFGTVRRVRHKDGQILVRKEIEYTSMTSQERNHIISELRILRELDHPHIVKYYRHDHIPEKKMIHIYMEYCEGGDLAKVIKNFRASKSRIPEEFVWQVLVQVLLALYRCHYGVDAEKVNLFKTASEPKYANSIIHRDIKPDNIFVGSCIKLGDFGLAKMLSANDFAKTYVGTPYYMSPEVLLDDPYSPVCDIWSLGCVLYELCTLEPPFKAKSHLQLQAKIKRGVIEEVPDFYSSQLRTLIRSCITVDPEERPTCFDLIDSLAVRFLRKEMELKEMNENLEEYKKQLLKRSKELKETSKELDEYKQELVRKSEELSKREKYLDEEFELRKQAIELESKEIRMEYQREFNLVVEQEVKRRLEQRKPHGPRPLEDVSPRSPLKERNRPRVTDALERLHLEKRHTPEFEYISKYR

SEQ ID NO: 35565 - protein, 387 aa, Triticum aestivum
MADQSPAPIRCKAAVSRAKGAPLVIEDIVVDPPKAYEIRMKVICTSLCHTDITFWRGKEDFPLPPVFPRILGHEAYGVVESVGERVEGFAVGDTVVPTFLGQCDSCAGCASAGSNMCSALPFVVGPGMRRDGTTRFRDSQGEPLHDFLAVSSFSQYTVVDVNQVVKVDPAVPPKLACLLGCGAGTGVGAAWRLAKVQPGSSVVIFGLGAVGLSVAQGAKMCGAAKIIGVDLNPDKEELGKKFGVTDFVNPSKLGESPLSQVIIEMTGGGADYCFECIGAASVMTEAFRSAKQGNGKTVILGLEKDGKPISLPSIEFLFGKCVMGSLFGGMKPKTDIPILAEKCMNKELELEKLITHEVGLQEINTAFDLLLQGKSLRCIIWMDKLEV

SEQ ID NO: 35566 - protein, 132 aa, Schizosaccharomyces pombe
MSGGKSGGKAAVAKSAQSRSAKAGLAFPVGRVHRLLRKGNYAQRVGAGAPVYLAAVLEYLAAEILELAGNAARDNKKTRIIPRHLQLAIRNDEELNKLLGHVTIAQGGVVPNINAHLLPKTSGGTGKPSQEL

SEQ ID NO: 35567 - protein, 437 aa, Streptomyces coelicolor A3(2)
MPSETSGADLGRHLIRYSGHAPFSPEVVVRAAGTSVFTESGRELLDFTSGQMSAILGHSHPAIVSTVREQVAHLDHLHSGMLSRPVVELARRLAGTLPAPLEKALLLTTGAEANEAAVRMAKLVTGRHEIVSFARSWHGMTQAAANATYSAGRKGYGPAAPGNFALPVPDRYRPSVVGADGELDWRRQLDLGFEMIDAQSVGSLAACLVEPILSSGGVVELPPGYLAALADKCRERGMLLILDEAQTGLCRTGDWYAFEHEGVVPDILTLSKTLGAGLPLAAVLTSAEIEQRAHERGFLFFTTHVNDPLPAAVGNTVLDVLVRDRLDERARRLGAALREGLDKLAARHEVVGDVRGRGLLLGMELVGDQVLGEGGADRLGAAVTRRCFELGLHMNIVQLPGMGGIFRIAPPLTASDDEIARGVAVLDQALTDAADAL

SEQ ID NO: 35568 - protein, 343 aa, Oryza sativa
MLLAKPHLSSSSFLPSTRVSSPAPGPNHAKPIAASPAPRRCLRLAVTSAAAPAASSAEAAAALSRVDVLSEALPFIQRFKGKTVVVKYGGAAMKSPELQASVIRDLVLLSCVGLHPVLVHGGGPEINSWLLRVGVEPQFRNGLRVTDALTMEVVEMVLVGKVNKHLVSLINLAGGTAVGLCGKDARLLTARPSPNAAALGFVGEVSRVDATVLHPIIASGHIPVIATVAADETGQAYNINADTAAGEIAAAVGAEKLLLLTDVSGILADRNDPGSLVKEIDIAGVRHMVADGQVAGGMIPKVECCVRALAQGVHTASIIDGRVPHSLLLEILTDEGTGTMITG

SEQ ID NO: 35569 - protein, 606 aa, Oryza sativa
MATQAIAPMHAAVVHRHHVLPPRRCVRRCGVFVRASAAAAAETDTLSAAFWDYNLLFRSQRDECLDSIPLRVTEGAIPPDFPAGTYYLAGPGIFSDDHGSTVHPLDGHGYLRSFRFRPGDRTIHYSARFVETAAKREESRDGASWRFTHRGPFSVLQGGKKVGNVKVMKNVANTSVLRWGGRLLCLWEGGQPYEVDPRTLETVGPFDLLGLAAADDNKATNASAARRPWLQEAGLDAAARLLRPVLSGVFDMPGKRLLAHYKIDPRRGRLLMVACNAEDMLLPRSHFTFYEFDAHFDLVQKREFVVPDHLMIHDWAFTDTHYILLGNRIKLDIPGSLLALTGTHPMIAALAVDPRRQSTPVYLLPRSPETEAGGRDWSVPIEAPSQMWSVHVGNAFEEANRRGGLDVRLHMSSCSYQWFHFHRMFGYNWHHKKLDPSFMNAAKGKEWLPRLVQVAIELDRTGECRRCSVRRLSDQHARPADFPAINPSYANQRNRFVYAGAASGSRRFLPYFPFDSVVKVDVSDGSARWWSTDGRKFVGEPVFVPTGGGEDGGYVLLVEYAVSKHRCHLVVLDAKKIGTENALVAKLEVPKNLTFPMGFHGFWGDE

SEQ ID NO: 35570 - protein, 467 aa, Microcystis aeruginosa PCC 7806
MVHQKINLDHLSPEEALITPTYASRALTSAVPKYEIPEGEMPPAAAYNLIRDELALDGNSRLNLATFVTTWMEPEAKQLMAETFDKNMIDRDEYPQTAEIELRCVNMIARLWNAPEGAAATGCSTIGSSEAAMLGGMALKWQWRKRRQKKGKPTDKPNLVMGINVQVCWEKFCRYWEVEPRFVPMEGNRFHLDATEAIQLIDENTIGVIAIMGSTFDGSYEPVQEINDALEKLNRETGWEVPLHVDGASGGFIAPFLDPDLVWDFRLKWVKSINASGHKYGLVYPGVGWIIWRDRQELPEELIFHCNYLGGDLPNFALNFSRPGNQVVAQYYNFLRLGKEGYRQIHQACRDTALYLSGEIAKMGPFELITDGSTIPVFAWKLKEKISDQTNYSLFDLADKLRERGWLVPAYTMPKNRQDLTVQRVVIKEGFSRDMADLLLRDINSAIAFFKSQSNYQSKLSGSHFHH

SEQ ID NO: 35571 - protein, 473 aa, Gloeobacter violaceus PCC 7421
MQPLDRRTKVVATIGPASSSPEVLRQLVKAGINVARLNFSHGSYEDHARMVKLLREVSEELDTPITLLQDLQGPKIRVGQMPEGGLALGEGDELTLLPVAEFAGEPGTVSIDYPYLVEEATPGTQVLLDDGLLEFAVVEVKGNAVRCRVVRGGVLKSRKGVNLPSLDLRLPSMTEKDKQDLEFGLEQGVDWVSLSFVRRGEDIRVLKGLLAEHGAADVPVIAKIEKPQAIANLEEILDEVQGIMVARGDLGVEMSPEKVPLLQKRIIRLCNRRGIPVITATQMLDSMIRNPRPTRAEASDVANAILDGSDAVMLSGESAVGDFPVQSVEMLVRIAKEVEREFTFDNNPPAKSDEIHALCESLGTIDKILALHCIATFTTTGFSASIAAAERPKAPVVAFTPDLKVYHRLNLVWGVKPLLLEHPAAELEKLIEQMESCLVERNLAAPGDRMLVLGGSPVQRAGGTNFLKIHTLH

SEQ ID NO: 35572 - protein, 232 aa, Bacillus megaterium
MSKKPVALIILDGFALRDEDKGNAVTHAKKPNFDRFWNEYPHATLQASGEAVGLPEGQMGNSEVGHLNIGAGRIVYQSLTRVNVAIREGEFEQNETLLAAVKHAKEKGTNLHLFGLLSDGGVHSHIEHLYALLRLAKSEGLEKVYIHGFLDGRDVAPQSAETYLKELNEKIEEYGVGEIATLSGRYYSMDRDKRWERVEKSYRAMVYGEGPSYTSAEECVKDSYENGIYDEF

SEQ ID NO: 35573 - protein, 343 aa, Gloeobacter violaceus PCC 7421
MSAVKIAINGFGRIGRLVLRAGLDNPDLEFVGINDLVPPDNLAYLLKHDSTHGRFKGTVEAHPDGMVVNGRFIPCTAIKNPVELPWGSLGVDYVVESTGLFTGYDGASHHLAAGARRVVITAPTKDPEKVPTLLMGVNHDQFDPDQDLIVSNASCTTNCLAPVAKVIHERFGLAEGLMTTVHAMTATQPTVDGPSKKDWRGGRGAAQNVIPSSTGAAKAVTLVLPELKGRLTGMAFRVPVPNVSVVDLTFKTEQPTSYKAICAAMKEASENELAGILGYTEEQVVSSDFIGDAHSSIFDAGAGIELNSQFFKVVSWYDNEWGYSCRVNDLIVAMAHKEKPADS

SEQ ID NO: 35574 - protein, 260 aa, Synechococcus sp. WH 8102
MRSYQNSENVSKLVIAVSSIFFGGIAVLSSLFVVPAGEVGVVTTLGKVSDEPRQPGLNLKIPFLQSTHSFSVRTQVIPEKFSTLTKDLQVIEATATVKYAVKPSEAPRIYSTIATDDSAIYARVIQPSLLKSLKSVFSKYELDTIATDWNNISSLVQESVSQELSKFDYVVVRGLDITGLQIAEEYRAAIEQKQIAQQQLLRAKTEVQIAEQEAIKFETLSRSLNNSVLYKLFLDKWDGQTQVVPSFAGASTPPVIVGRN

SEQ ID NO: 35575 - protein, 491 aa, Fulvimarina pelagi HTCC2506
MTVHFPFDNSYARLGERFHQPILPTPVTAPKLLKLNRPLCAELGIDADALDTAEGAEILAGNRLPTGADPIAVAYAGHQFGNFVPQLGDGRAILIGEVVDRAGRRRDIQLKGSGPTAFSRSGDGRAALGPVLREYLVSEAMAALGIPTTRALAATATGEPVYRETVLPGAVLTRVASSHVRVGTFQYFAARGEEDAVRRLADHVIERHYPETEDAPHRYRALLEAVATRQAALVARWMQVGFIHGVMNTDNMSIAGETIDYGPCAFLDVYDPGTVFSLIDRQGRYAYGNQPSMASWNLARLAECLLPLLDQDHDRAVEIAQEVLGGFAAAFEAAYLDGFSAKIGLQTRQAGDADLINDLLAIMAQQKADFTLAFRQLGDAAENSDGDAQVRSLFGDPAAYDSWAVRWRERLAAEPQETSECRAAMDAVNPAVIPRNHLVEEALAAALSEDLAPFERLNEALAKPYEDRAEFADYAGVPPTPEVPYRTFCGT

SEQ ID NO: 35576 - protein, 527 aa, Synechocystis sp. PCC 6803
MDTAVNESLSISYNLEQFLIVLSVSLSIATLSKTVPILRKIPYTLLLVIVGMALAFVDVKLINLSPELIMEIFLPPLLFEAAWNLQWRNLKENWFPITLFATLGVVICVVGIAFPLSYWGGMELAIAFLAAAALSATDPVSVIALFKELGASKKLNTLMEGESLFNDGVAVVVFLILVGIPLGTSTFDLSVTLARFVTVIGIGVGCGLVIGFSLSLLTQRFDLPFVEQSLTLVSAYGAYILAENLGGSGVIGVVVVGMVLGNYGSRIGMNPRTRLIVSIFWEFVAFFVNSIIFLLIGDQIGLSSLSDHLNLILIAIAAVVVTRLVSVFGLSLISNKVSDQISSTHITLQEQTVLWWGGLRGSVAIAVALSVPQAIAERQAIIDIVFGVVLFTLLVQGLTTQFVLKGLDLIGDQPQRLEYAELVSRQIALRRVLAELEKTDEFPDINPERLRYKQELVQGQLQSVTDKLKLLLQEYPLLQEVANKKFDQTVLDIEAETYADLIRMGRLEENIMPLLVTLEGENVAEPS

SEQ ID NO: 35577 - protein, 142 aa, Triticum aestivum
MGSVSLKLPASRRRHGGPLSCLCSPAPLNLLMLLSLLCTNLLAFFAFFAAPPRHDPAAGTTPSASSNLSAHVAAIALEIGGGSSSSGARLPDGLPPELLLFLTPHALPLGRDARTGLTHMPASVAASCLRSPSALALLSAFM

SEQ ID NO: 35578 - protein, 659 aa, Ustilago maydis 521
MSNQAQDQPERRDSSSENSSPFKDDEVAADQSVSAHGNTSLNKKDRVSAVRDADASSAREGQQPGVTRIEALYRIFPRNSPIVYTVYASLAAVTICFALDQSTTAAYQLYATRTLGSHAKLFGVIATVEAILNAVSKPFIAKICDIFSRQTAYFLVAVFYTIGFVVVASAQTPAAFAVGRIITEVGQAGFDLVTDIVVADLSPLEWRGVVTALTSSPFIVLPWVGNLIQARLNTGRPEGWRWGYGMFAIMAPVCVAPIILVLMYVDRKAQKAGELSFASSRLETRRAQEQGTVKVQRDSLRDRFANLVQLCKEMDLVGLFLLALSFSLLLVPFSIYKDADKQWRNPSIIAMFVCGGVILGMFLAWEILLASHPVMNKRVWYNRTFLLAVTIDIFYFMGGNARSTYYGSFVLVGTNLSTANWGYVVNALATCALSVFGLAAGFYLRIFHRYKFLQIGGLVIRIVAMGLYLYGRNGNLTTMVVAWSQILNSLGGACSVVGTRVASQASVPHQDLASIISQLALWTRLGGAIGSAIAAGIWTGTLPDYLAATNLTPAQQSRAYNSPTTIKTSYPWNTPLRNQINQAFSKTMKPIFIVALVLAFIPLFAGLLMPNYYLGKTQNAVDGTDNSGRVIESAEDNPNAEINRKNVKYAKGTRLSWLW

SEQ ID NO: 35579 - protein, 891 aa, Schizosaccharomyces pombe
MEYRTNNVPVGNETKSAALNALPKIKISDSPNRHHNLVDAFMQSPSYSTQPKSAVEPLGLSFSPGYISPSSQSPHHGPVRSPSSRKPLPASPSRTRDHSLRVPVSGHSYSADEKPRERRKVIGNYVLGKTIGAGSMGKVKDAHHLKTGEQFAIKIVTRLHPDITKAKAAASAEATKAAQSEKNKEIRTVREAALSTLLRHPYICEARDVYITNSHYYMVFEFVDGGQMLDYIISHGKLKEKQARKFERQIGSALSYLHQNSVVHRDLKIENILISKTGDIKIIDFGLSNLYRRQSRLRTFCGSLYFAAPELLNAQPYIGPEVDVWSFGIVLYVLVCGKVPFDDQNMSALHAKIKKGTVEYPSYLSSDCKGLLSRMLVTDPLKRATLEEVLNHPWMIRNYEGPPASFAPERSPITLPLDPEIIREMNGFDFGPPEKIVRELTKVISSEAYQSLAKTGFYSGPNSADKKKSFFEFRIRHAAHDIENPILPSLSMNTDIYDAFHPLISIYYLVSERRVYEKGGNWNRIAKTPVSSVPSSPVQPTSYNRTLPPMPEVVAYKGDEESPRVSRNTSLARRKPLPDTESHSPSPSATSSIKKNPSSIFRRFSSRRKQNKSSTSTLQNSAPLETSQSPPTPRTKPSHKPPVSYKNKLVTQSAIGRSTSVREGRYAGISSQMDSLNMDSTGPSASNMANAPPSVRNNRVLNPRGASLGHGRMSTSTTNRQKQILNETMGNPVDKNSTSPSKSTDKLDPIKPVFLKGLFSVSTTSTKSTESIQRDLMLVMGMLDIEYKEIKGGYACLYKPQGIRTPTKSTSVHTRRKPSYGSNSTTDSYGSVPDTVPLDDNGESPASNLAFEIYIVKVPILSLRGVSFHRISGNSWQYKTLASRILNELKL

SEQ ID NO: 35580 - protein, 921 aa, Sorghum bicolor
MTTTAARALVALLLVAVAVADDGATLVEIKKSFRNVGNVLYDWAGDDYCSWRGVLCDNVTFAVAALNLSGLNLEGEISPAVGSLKSLVSIDLKSNGLSGQIPDEIGDCSSLRTLDFSFNNLDGDIPFSISKLKHLENLILKNNQLIGAIPSTLSQLPNLKILDLAQNKLTGEIPRLIYWNEVLQYLDVKNNSLTGVIPDTIGNCTSFQVLDLSYNRFTGPIPFNIGFLQVATLSLQGNKFTGPIPSVIGLMQALAVLDLSYNQLSGPIPSILGNLTYTEKLYIQGNKLTGSIPPELGNMSTLHYLELNDNQLTGSIPPELGRLTGLFDLNLANNHLEGPIPDNLSSCVNLNSFNAYGNKLNGTIPRSLRKLESMTYLNLSSNFISGSIPIELSRINNLDTLDLSCNMMTGPIPSSIGSLEHLLRLNLSKNGLVGFIPAEFGNLRSVMEIDLSYNHLGGLIPQELEMLQNLMLLNVSYNNLAGVVPADNNFTRFSPDSFLGNPGLCGYWLGSSCRSTGHHEKPPISKAAIIGVAVGGLVILLMILVAVCRPHRPPAFKDVTVSKPVRNAPPKLVILHMNMALHVYDDIMRMTENLSEKYIIGYGASSTVYKCVLKNCKPVAIKKLYAHYPQSLKEFETELETVGSIKHRNLVSLQGYSLSPVGNLLFYDYMECGSLWDVLHEGSSKKKKLDWETRLRIALGAAQGLAYLHHDCSPRIIHRDVKSKNILLDKDYEAHLTDFGIAKSLCVSKTHTSTYVMGTIGYIDPEYARTSRLNEKSDVYRLWHCSAGAADWQEASGQRILSKTASNEVMDTVDPDIGDTCKDLGEVKKLFQLALLCTKRQPSDRPTMHEVVRVLDCLVNPDPPPKPSAHQLPQPSPAVPSYINEYVSLRGTGALSCANSTSTSDAELFLKFGEAISQNME

SEQ ID NO: 35581 - protein, 333 aa, Streptococcus pyogenes str. Manfredo
MSKLLLVGEPLIRVSPNQFQPLTNACDAQLFFGGSEVNIARTLGGFGLEARLFTALPDNPVGHAFHQFLKQIGVDMTLTAWQGNRVGLYYLENGFGCRASQVYYDRCGSSFSALDKDSLDLAAIFEGIRHFHFSGISLALGKKTQDLIEILAREAKKRDICISFDLNFRSSMIAVADAKRLFSHFAQYADIIFGMEPLLLDSDDFDMFDRNKADTTTIRERLAGLYQRYQLQAIYHTERSNDAQGSNRFKAYAYDGQFYESCEVTTPVLQRVGSGDAFVAGLLYQLLEGNEKQCNLDLAVATASLKCTVAEDQLYHSVQQVEAVLANQRDVQR

SEQ ID NO: 35582 - protein, 430 aa, Vibrio vulnificus CMCP6
MSRCSAIIENNPETRLVVSSACSGVTNLLVELANGVQSQERRAELLAQLAEIHDAILNQLEDATEAAAEVYAILDTITSLAEAASIQASNKLTDHLVACGELMSTHILAQLMRERGVNAVRFDIREVLRTDDNFGRAEPDVAKIAELAQEKLLPLCRDYVVVTQGFIGSDEEGNTTTLGRGGSDYSAALIAEGVKASGLEIWTDVPGIYTTDPRIAAKAAPIPEISFAEASEMANFGAKILHPSTLVPALRHDIPVFVGSSKEPEKGGTWIRHEAQSSPLFRALALRCNQTMVTLRSAKMFHAYGFLAKVFEILAKHKISVDLITTSEISVSLTLDKTDTSGGAPELPQAAREELEELCTVEVEHNLCLVALIGNHMETKGYAKEVFSTLGDFNLRMICYGASDHNLCFLVDAHDSKSVIQKLHQDLFER

SEQ ID NO: 35583 - protein, 337 aa, Volvariella volvacea
MVVNVGINGFGRIGRIVYRNAVENDQINVVAINDPFIDLAYMVYMFKYDSVHGRFKGTVESKDGKLVINGKSITVFSEKDPAAIPWGTAGADYIVESTGVFTTTEKASAHLKGGAKKVIISAPSADAPMFVVGVNLDAYDPKYTVISNASCTTNCLAPLAKVIHDEFGIVEGLMTTVHATTATQKTVDGPSHKDWRGGRSVANNIIPSSTGAAKAVGKVIPSLNGKLTGMSFRVPTLDVSVVDLVVRLEKPTEYSAIKAALKKAAEGEYKGIIDYTEDPVVSTDFIGNPASSIFDASAGIQLNPNFVKLISWYDNEWGYSKRVCDLVVYVAGKDGNL

SEQ ID NO: 35584 - protein, 264 aa, Streptococcus pyogenes str. Manfredo
MENMFSLQGKIALITGASYGIGFEIAKAYAQAGATIVFNDIKQELVDKGLTAYRELGIEAHGYVCDVTDEAGIQQMVSQIEDEVGVIDILVNNAGIIRRTPMLEMAAEDFRQVIDIDLNAPFIVSKAVLPSMIAKGHGKIINICSMMSELGRETVSAYAAAKGGLKMLTKNIASEFGEANIQCNGIGPGYIATPQTAPLRERQADGSRHPFDQFIIAKTPAARWGVTEDLAGPAVFLASDASNFVNGHILYVDGGILAYIGKQP

SEQ ID NO: 35585 - protein, 370 aa, Schizosaccharomyces pombe
MVKRHKNTIGVWRLGKTLGTGSTSCVRLAKHAKTGDLAAIKIIPIRYASIGMEILMMRLLRHPNILRLYDVWTDHQHMYLALEYVPDGELFHYIRKHGPLSEREAAHYLSQILDAVAHCHRFRFRHRDLKLENILIKVNEQQIKIADFGMATVEPNDSCLENYCGSLHYLAPEIVSHKPYRGAPADVWSCGVILYSLLSNKLPFGGQNTDVIYNKIRHGAYDLPSSISSAAQDLLHRMLDVNPSTRITIPEFFSHPFLMGCTSLSSMDSTTPPTPSLSIDEIDPLVVDCMCVLWKKSSSKKVVRRLQQRDDNDEKYVYKVLSEILRDDMLKKQRFDENKYLSLYDLIHDNNLFTKALNKFRTKASENAAY

SEQ ID NO: 35586 - protein, 508 aa, Oryza sativa Japonica Group
MHSAISDSDVDQPSSARNVFRAETCGAQLFCSLQKEWFRGKLGCQGTSVMLVRSVVNELVPYEVRDVLFSGLGYLRSQISSQHTIIIEETEGWSHNHVYNAVRAYLATRINNNMQRLRVSSMDESSEKMVVTMEEGEELVDMHEGTEFKWCLISRSISADPNNGNGSGQREVRSYELSFHRKHKEKALKSYLPFIIATAKAIKDQERILQIYMNEYSDSWSPIDLHHPSTFDTLAMDQKLKQSIIDDLDRFIKRKDYYKRIGKAWKRGYLLYGPPGTGKSSLIAAMANHLKFDIYDLELTGVHSNSELRRLLVGMTSRSILVVEDIDCSIELKQREAGEERTKSNSTEEDKGEDKVTLSGLLNFVDGLWSTSGEERIIVFTTNYKERLDQALMRPGRMDMHIHMGYCTPEAFRILASNYHSIDYHVTYPEIEELIKEVMVTPAEVAEALMRNDDIDVALLGLLELLKSKIKDASETKAESKDANKQTEENKDSKAMENKNDSSTDECT

SEQ ID NO: 35587 - protein, 604 aa, Ostreococcus tauri
MSSGMEMVERKSNLSSLPPRSPEIGQKRRASVETRWTSARGKESKRARARPPASEWDLGVLSELATEVLELVLLNLQARDLAVVGATCAYFNASGIIERVAAARLERVPRADALVLTKRDSYLKAWHHCTVSEQAERASANVSLGQFHTACVVTDAEGDKVGTTIATFGRGFHGQLGLGSYDNHAAPAFVRMGDELARGHDSDDEHFEGVDSIALGGSHCVALSRDGGVISWGLASSGELGYTGNTPIEVNVPRRVFVGIDICTKITQVTTGSNHTMAIDEFGRLFACGRGRHGQLGHGTFRDAAPFSRVEALKGMHVVSAVCGGSHSVCITSDGNVWAWGDCRYGQLGLGDLTFAAAAGWNNGVPWPCLVESLNDMDEPVASVSAGGAHSIFVTAGGRMFVCGRGKHGALGVGKNPFLTIGPPTSACGNRLTPEAVNIHHFVRRADGSVDQNRVQQCSCGPRCRVAVAAAGATHSCCLTACGGVFTTGENSYGQLGHGDKKSTFVFTRVEALRGKRVITVASGHNHTGAMVENTDGSNSLYTWGRGDWGQLGTGNMRSYTTPQEVKGFNVAPPRPESEILMYKQNLDSAEESENGDSDSESEF

SEQ ID NO: 35588 - protein, 398 aa, Corynebacterium diphtheriae
MEMPMRKTLISLTGPAFVAAVAYVDPGNVAANISAGSHYGYLLVWVLVVANLMAMFIQYHSAKLGLVTHRSLPEIMGERLSRRARLGMWAQAELIAAATDLAEVIGGAIALQLLFNLPLFAGALIIGAVSIILLIFQKKNQWFEGLVIGLLLVICIGFLAGLAIAPPDPADVAGGLIPRLEGKDSILLAASMLGATVMPHAIYLHSSLTKQRYPDLEIPHVLAGTRADIAVALSIAGLVNVGLLVLAGSALYGVDGTETISGAHTAIASHLGPLAGVLFAIGLLASGLASTSVGAYAGSEIMDGLLHIKVPLLVRRLVTLIPALVIIGCGVDPTMALVVSQALLSLGIPFAIIPLFRYAGSRDVMGEFAAKPWSMAVGWTLAALVIALNLALVLLPLL

SEQ ID NO: 35589 - protein, 644 aa, Oryza sativa
MAAEAAAEIVREIAAVGAADLAAAAEPLRADCLRLARKVSLLSHLVAEVAEAGAGGGDADAADSWLGDLVRALQAARRFVELGRAPARPSRASDQVRAETIWDAVCNNVAVQFKFVTWQLQTVLARLPQSCFQISDEVQEEVDLVRAQLRREMEKKGDIDVNIFSKFHDILALHVSTVGSQSEQSHGQPDTPQMENLCNGHLELQNIIMLVSEISGVPKSDAERITSQLIEGLENMRVTDSKKPVSVSQSSDETKASPETHKKSDAVAIPEDFRCPISLELMRDPVIVSTGQTYERAFIQRWIDCGNRTCPKTQLKLQNITLTPNYVLRSLILQWCEEKGIEPPTRSKNDGAYLEVGGERVAIETLVRNLSSSSLDERKSAAAEIRSLAKKSTDNRILLAESGAISALVKLLSSKDLKTQEHAVTALLNLSIYDQNKELIVVAGAIVPIIQVLRKGGMEARENAAAAIFSLSLIDDNKITIGSTPGAIEALVELLQSGSPRGRKDAATALFNLCIYQANKVRAVRAGILAPLIQMLQDSSRNGAIDEALTILSVLVSHHECKIAIAKAHAIPFLIDLLRSSQARNKENAAAILLALCKKDAENLACIGRLGAQIPLTELSKTGTDRAKRKATSLLEHLSKLQVL

SEQ ID NO: 35590 - protein, 485 aa, Frankia sp. EAN1pec
MSGHNELYIDGRWTTPASTDLFEVVSAATEEIIGTVPAGQLQDIDRAVAAARAAFDSGPWPRLDPAERGAALGRLSKVLQARSEDLAVTISQENGTPVAAARMAQVLIATMTLDYYAGLGAGLALTDTRPGMLGPAVVRRRPVGVVGAIVAWNVPLYLSVLKLGPALLAGCTVVLKPSPDAPLSLQLLAEAAAEADLPPGVLNVVPADRDVSEYLVTHPGVDKISFTGSTAAGRRIAALCGERLRRVSLELGGKGAAIVLPDADLNAALPGILQYGFMLNGQACVAQTRILAPRARYAELVEGLLAQVGALKVGDPLDEATELGPLANARQRDRVEEYIRIGRSEGARLVLGGGRPADHPRGFFVEPTVFTDVDPAMRIAQEEIFGPVLTVIPYDTVDDAVDIANGTRFGLGGSIWTADVAAGYALADRIDVGVLGVNMFMLDNVAPFGGFKDSGLGRELGPEALAAYLDYQTVNLPAGAIVPGV

SEQ ID NO: 35591 - protein, 908 aa, Porphyromonas gingivalis W83
MEKKRVYTFGNGKAEGEAGMKNLLGGKGANLAEMNLIGVPVPPGFTITTEVCQEYYTLGRDKVVELLRGEVNDAIRNIEGLMKSKFGDTENPLLVSVRSGARASMPGMMDTILNLGLNDEVVAGIVRKTGNERFAWDSYRRFVQMYGDVVLGMKPTNKEDIDPFEEIIEKVKEENGVHLDNELSVENLKDLVSRFKAAVKAQTGKDFPFSAEEQLWGAIMAVFDSWMNERAILYRRMEGIPAEWGTAVNVQAMVFGNMGETSATGVCFSRDAGSGEDLFNGEYLINAQGEDVVAGIRTPQQITKIGSQRWAERAGIAEDVRVAQYPSMEEAMPEIYKELDTLQQKLEDHYRDMQDMEFTVQEGKLWFLQTRNGKRTGCAMVKIAMDLLRQGMISEEEALMRVEPNKLDELLHPIFDKSALLRARVLTKGLPASPGAATGQIVFFADDAAQWKEDGKRVVMVRIETSPEDLAGMSAAEGILTARGGMTSHAAVVARGMGKCCVSGAGALNIDYKARTVEIDGTLFKEGDYISINGSTGEIYEGQVETKAAEMDQDFADLMALADKYAKLKVRTNADTPHDAEIARSFGAVGIGLCRTEHMFFEGEKIKAMREMILSETAEGRVRALAKILPYQQEDFKGIFRAMNGFPVNVRLLDPPLHEFVPHDLKGQEEMARMMGVDVRIIQKRVEDLMEHNPMLGHRGCRLGNTYPEITEMQTRAILGACLELKKEGVVCLPEIMVPLTGILHEFKHQEEVIRATAAKLFEEKGDSVEFQVGTMIEVPRAALTADRIASSAEFFSFGTNDLTQMTFGYSRDDIASFLPIYLDKKILKVDPFQVLDQKGVGQLVRMATENGRKARPNLKCGICGEHGGEPSSVKFCHRVGLNYVSCSPFRVPIARLAAAQAVIEEGK

SEQ ID NO: 35592 - protein, 492 aa, Bradyrhizobium sp. BTAi1
MRRYQCFIGGQWRQPASGDYFESFDPFLAQPWALIPRCDARDVDAAVAAARQALEQGEWANMHPSQRGQLLRRFGDLIARDADHLARIEVQDNGKLYAEMRGQVGYIPQWFHYFGGLADKVEGAVVPIDKPDMFTYTRHEPVGVVAAITPWNSPLLLATWKLAPALAAGCTIVIKPSEFTSASTIELMRLVEEAGFPPGVLNVVTGFGADVGEPLTSHKGVDKIAFTGGENSGRHVLRNAAQTFKRTTLELGGKSAQLVFPDADLDNAVKGVVSGIFAATGQTCIAGSRLLVHESIHDAFLDKFVALARTARMGDPMNMDTQVGPVTTQPQYRRVLSCIAMAREEGAECVMGGKPADRPECGQGWFVEPTVFAGVNNAMRIAQEEVFGPVLSVIKFREDDEAYAVANDTAYGLAAGVWTNDQRRAFTAARRLRAGTVWTNTYRAVSYMAPFGGFKASGIGRESGQDAIMEYLETKCVWMSYGKDVPNPFVMR

SEQ ID NO: 35593 - protein, 282 aa, Cryptococcus neoformans var. neoformans B-3501A
MITLTIVRHGESTDNLKPLWAGWSDAPLSQHGMNQAKALGESLKDTKFDYIFASDLKRAHWTSQQILKNQADPKPPLVISELLREQHFGEGEQKPFGETSGWVRQPGRVFKFPGGESLTDVRKRADQAVEQFIEPILKECRGRPATSKHVVVVAHGIFNSEFLGALMARRKTDAPLEWSYRGMTNTGWTKAEVGYADEARTESTSKISTDPSGPVSPSSAPSAPPPSTPNPDNLEPLVIRVLCSDVTDHLKGVIRQKGGLGSQSYDEKQEDIRKFFGGGGTK

SEQ ID NO: 35594 - protein, 628 aa, Schizosaccharomyces pombe
MSLENSSTLSLCSNNTTHFWNTPSTETQPEKKAEEPEAAAEPSESTSTPTNASSVATPSGTAPTSASLYVGELDPSVTEAMLFELFNSIGPVASIRVCRDAVTRRSLGYAYVNFHNMEDGEKALDELNYTLIKGRPCRIMWSQRDPSLRKMGTGNVFIKNLDPAIDNKALHDTFSAFGKILSCKVAVDELGNAKGYGFVHFDSVESANAAIEHVNGMLLNDKKVYVGHHVSRRERQSKVEALKANFTNVYIKNLDTEITEQEFSDLFGQFGEITSLSLVKDQNDKPRGFGFVNYANHECAQKAVDELNDKEYKGKKLYVGRAQKKHEREEELRKAYEQMKLEKMNKYQGVNLFIKNLQDEVDDERLKAEFSAFGTITSAKIMTDEQGKSKGFGFVCYTTPEEANKAVTEMNQRMLAGKPLYVALAQRKEVRRSQLEAQIQARNQFRLQQQVAAAAGIPAVQYGATGPLIYGPGGYPIPAAVNGRGMPMVPGHNGPMPMYPGMPPLSSLLEVRPGYPGMNARGPVPAQGRPMMMPGSVPSAGPAEAEAVPAVPGMPERFTAADLAAVPEESRKQVLGELLYPKVFVREEKLSGKITGMLLEMPNSELLELLEDDSALNERVNEAIGVLQ

SEQ ID NO: 35595 - protein, 141 aa, Arabidopsis thaliana
  misc_feature (96)..(96): Xaa can be any naturally occurring amino acid
  misc_feature (103)..(103): Xaa can be any naturally occurring amino acid
  misc_feature (124)..(124): Xaa can be any naturally occurring amino acid
MASSMLSSAAVVTSPAQATMVAPFTGLKSSAAFPVTRKTNKDITSIASNGGRVSCMKVWPPIGKKKFETLSYLPDLSDVELAKEVDYLLRNKWIPXCVEFELXTDLCTREARETLPDTTMDGTXGQCGSFHCSDAPTPLKC

SEQ ID NO: 35596 - protein, 237 aa, Gibberella zeae PH-1
MNISYPANGSQKLIDIEDERKVRVFMDKRMGAEVPGDSVGDEFKGYIFRITGGNDKQGFPMKQGVMHPTRVRLLLSEGHSCYRPRRTGERKRKSVRGCIVAMDLSVLALSIVKQGDADIPGLTDVVHPKRLGPKRATKIRKFFGLTKDDDVRKYVIRREVQPKGEGKSPYTKAPRIQRLVTPQRLQHKRHRAALKRRQAEKVKDEANEYAQVLAKRIAEAKVNKADARKRRASSMRK

SEQ ID NO: 35597 - protein, 95 aa, Trichodesmium erythraeum IMS101
MSIETIEKPTTSTVRKTAPHYRVLLHNDDFNSMEYVVQTLMKTVPSLTQPQAVNIMMEAHSNGIALVIICALEPAEFYCENLKNHGLTSTIEPDE

SEQ ID NO: 35598 - protein, 175 aa, Candida albicans SC5314
MARHPFYKRLLKEYQQISLNKLPGIKLVTNDDNLTEFIFQIKVANNPLYPDDEDYYLSIKITENYPVDSPQVKFVIHEEDNDDDSIIILDDDSLEIISHSVIPIHPHIYSNGHICLNLLGDDWTPACSIESILLSIQSMLSTNDKRERPPDDTSYIKHAPTNPKNSKFIYHDDNV

SEQ ID NO: 35599 - protein, 383 aa, Arabidopsis thaliana
  misc_feature (307)..(307): Xaa can be any naturally occurring amino acid
  misc_feature (321)..(321): Xaa can be any naturally occurring amino acid
  misc_feature (367)..(367): Xaa can be any naturally occurring amino acid
  misc_feature (376)..(376): Xaa can be any naturally occurring amino acid
MASTSLLKASPVLDKSEWVKGQSVLFRQPSSASVVLRNRATSLTVRAASSYADELVKTAKTIASPGRGILAMDESNATCGKRLDSIGLENTEANRQAFRTLLVSAPGLGQYVSGAILFEETLYQSTTEGKKMVDVLVEQNIVPGIKVDKGLVPLVGSNNESWCQGLDGLSSRTAAYYQQGARFAKWRTVVSIPNGPSALAVKEAAWGLARYAAISQDSGLVPIVEPEILLDGEHDIDRTYDVAEKVWAEVFFYLAQNNVMFEGILLKPSMVTPGAESKDRATPEQVAAYTLKLLRNRVPPAVPGIMXFVRRTVGGGGNTQXLERNEPGTKPMARVLLLRTCVAEHLSENMGRQTRERERSSDHSLGXPCQGQFVGXSARKIHR

SEQ ID NO: 35600 - protein, 176 aa, Synechococcus sp. CC9605
MKHTLSVVVEDESGALSRIAGLFARRGFNIDSLAVGPAEAEGQSRLTMVVEGDDQTLQQMTKQLDKLVNVLQVLDLTQRPAVERELMLLKVSAPAASRGAVIELVQVFRAKVVDVADEALTLEVVGDPGKLVALERLMAPFGILEIARTGKVALERASGVNTEMLKVSPSQSRVPA

SEQ ID NO: 35601 - protein, 291 aa, Bradyrhizobium japonicum USDA 110
MKIRKAVFPVAGLGTRVLPATKAMPKEMLTIVDKPLIQYVYDEAREAGIEHFIFVTGRNKNVIEDHFDKMFELDATLAARGKKAEQEILAQNQPEAGAVSFTRQQAPLGLGHAVWCARDIVGNEPFAVVLPDELVLNTPGCLKQMIETASSLGDKSNLIAVEAVPDHLTHQYGICGVGKRTGKMFEVDGMVEKPAKGTAPSNLSITGRYILQPEIFKILETQERGAGGEIQLTDAMIGLARSQKFYGVEFEGERHDCGSKPGFLRANIAYGLKRPELRDGLIAEMKKYLGQ

SEQ ID NO: 35602 - protein, 296 aa, Magnaporthe grisea 70-15
MPKDRKQAGAKPAARGQSQAHAAAATSQSLSSQQRQQQEAQQPPAWPIFKPTLPVSDLSLDTIVPGKVVVMHNFFPRSLCRDYVAFLKTLPLVTTPARPKKGEAVRQNDRFQVNDPDFAARLWLQTGLKEALTADCKPIPCASRGGDVVGLSPNIRVYRYTKGQHFAPHYDDSNTLTLDPPPTRPQDAGTNSSTISKPPSVAVRTTWTLLLYLTGTAGGDDQCSGGETVFYPNDRVSRKEEIAVAPQTGLLLLHKHGNDCMLVSFTPDDLGDATILFAYFSRLTRGWHTARGKRSD

SEQ ID NO: 35603 - protein, 252 aa, Streptococcus pyogenes str. Manfredo
MSRKPIIAGNWKMNKNPQEAKAFVEAVASKLPSTDLVDVAVAAPAVDLVTTIEAAKDSVLKVAAQNCYFENTGAFTGETSPKVLAEMGADYVVIGHSERRDYFHETDEDINKKAKAIFANGLTPIVCCGESLETYEAGKAVEFVGAQVSAALAGLSAEQVASLVLAYEPIWAIGTGKSATQDDAQNMCKAVRDVVAADFGQEVADKVRVQYGGSVKPENVKDYMACPDVDGALVGGASLEAGSFLALLDFLN

SEQ ID NO: 35604 - protein, 446 aa, Zea mays
MEADSGKLFVGGISWETDEDRLREYFGRFGDVTEAVIMRDRNTGRARGFGFVVFADSGIAERVTMEKHMIDGRMVEAKKAVPRDDQSIASKNNSSIGSPGPGRTRKIFVGGLASNVTEVEFRRYFEQFGVITDVVVMYDHNTQRPRGFGFITYDSEDAVDKALHKNFHELNGKMVEVKRAVPKEQSPGPIARSPAGGQNYAMSRVHNFLNGFNQGYNPNPLGGYGMRVDARYGLLAGARNGFSSFGPGYGMGMSVEGGMRGYFGASSGFVNSSNGRQIGSYFNGSSNRLGSPIGYVGLNDDSGSILSSMSRNVWGNGNLNYIGNHTNMNSFPQPGSGGGISGDEISWGSLTSAHGMSNISSLGSGNLGRGTGDNNFGLPSGNYVRSNSTGTIGEPFSAAGNTYEVNNRDTYGSSSIYGGTAWRFASSEVDMPSFVHDIGNVDPTIK

SEQ ID NO: 35605 - protein, 282 aa, Zea mays
MAIRMSNNVIGALNLVTLLLSVPILVSGIWLRSRADGTECDHLLSTPAIALGAVLMAVAVAGLAGACFRATWLLWLYLLTMLVFIVALLCFTVFAFAVTNRGAGEAVSGVGYREYRLGDYSTWLRRHVESRKDWARIRSCLADAHVCRRLEERERESKDAAGLVRLGLSPVESGCCKPPTSCNFTYTGGTEWTRTAAGSAPAGRDCSAWGNDEDDLCYGCQSCKAGVVDALKRDWKRAAIVNVVILSFIVVVYSVGCCAFKNSRRDNYAYHSGRGWKRGGDA

SEQ ID NO: 35606 - protein, 375 aa, Bradyrhizobium sp. BTAi1
MKIKAAILEDMGRAGPYAASRPLKILDVELDGPGPGEVLVRIAAAGLCHSDLSVINGDRPRPLPMVLGHEASGVVEEVGAGVDDLVRGDHVVCVFVPSCGHCAPCAQGRPALCEPGAEHNGKGDLLSGGFRLHRGEARVHHHCGVSCFAEYATMSRRSLVKVQKEVPLHIAALMGCAVLTGTGAVFNGGDVGPGGKAAIIGLGGVGLAAVMGAVAIGAETVVAIDMFEPKLALARELGATHAFNGSDPDLVAKVKEATKGGVDAALEFAGSVKALEMGYAITRRGGTTVTAGLPNPKAVLSLPAVSLVAEERTLKGSYLGSGVPSRDIPRFLGLYHRGRLPVDRLLTHRIRLDDINAGFDRLADGSAIRQVVEFN

SEQ ID NO: 35607 - protein, 128 aa, Brassica napus
MGFVLISSCPPSSLVLASQLHQFSARIKSTEISVRPQLAPVRRSRTFTAKPCCFNLPQEPILSEALKEPIAFMGGMFAGLLRLDLNEEPLKEWVTRTVEASGITEEEVADADGMASNEEESPQQIEIE

SEQ ID NO: 35608 - protein, 286 aa, Magnetospirillum magnetotacticum MS-1
MSASPSLSPASGREVIAGIVDPLWTRVRTEAETVLRDEPQLASFFVATILNHPTLEAAVSHRVAARLGHGSLPTELVAHGFHEALQDDPRIGQSMRADILAVMDRDPATTRAIEPLLYFKGFHALQAHRLAHWYWGQGRRDLALYLQSRSSEVFQTDIHPAARIGRGVFLDHATGVVVGSTAVIEDDVSILQAVTLGGTGKHGGDRHPKIRRGVMIGAGAKILGNIEVGACARVAAGSVVLRPVPPHTTVVGVPARVVGAAGCAEPARSMDQLVAMSEFVDIAGGI

SEQ ID NO: 35609 - protein, 124 aa, Triticum aestivum
  misc_feature (43)..(44): Xaa can be any naturally occurring amino acid
  misc_feature (49)..(49): Xaa can be any naturally occurring amino acid
  misc_feature (55)..(55): Xaa can be any naturally occurring amino acid
  misc_feature (57)..(57): Xaa can be any naturally occurring amino acid
  misc_feature (61)..(62): Xaa can be any naturally occurring amino acid
  misc_feature (65)..(65): Xaa can be any naturally occurring amino acid
  misc_feature (68)..(68): Xaa can be any naturally occurring amino acid
  misc_feature (75)..(75): Xaa can be any naturally occurring amino acid
  misc_feature (85)..(85): Xaa can be any naturally occurring amino acid
  misc_feature (93)..(93): Xaa can be any naturally occurring amino acid
  misc_feature (96)..(96): Xaa can be any naturally occurring amino acid
  misc_feature (105)..(105): Xaa can be any naturally occurring amino acid
  misc_feature (107)..(107): Xaa can be any naturally occurring amino acid
  misc_feature (110)..(110): Xaa can be any naturally occurring amino acid
  misc_feature (113)..(113): Xaa can be any naturally occurring amino acid
  misc_feature (119)..(119): Xaa can be any naturally occurring amino acid
MVKICCIGAGYVGGPTMAVIALKCPDIEVVVVDISKPRIDAWXXDTLPXYEPGSXDXVKHXXGRXFLXTDVENTXLKLTSLLSGXTPHKTVGXGAXKVPTHYWEXRXRIXPSXNSDKLXRESLL

SEQ ID NO: 35610 - protein, 707 aa, Bradyrhizobium sp. BTAi1
MASTHTFTKLRYRFIPDHVIGELLSKKWIDNAIPFLVLLCVIAIFGSLIPNFFGGANLAISARELGEFGLVCMAMMVVIIVGGIDLSVGSNFALGNFMTLALLNLGGWPVGLAIPAVVLICGGVGLLNGYLIGFLRLRAFLTTLVTLIIVRAIVDMLLLKYAQAMSVSFYQSDVWDMIGLGGVAEVPSSFIILVIVALIGHVLLTRSRPGWRMMAIGGSRRSAHNIGLSVRGMVCAAYTISGMLCGLAGVLYAARLSGAGTDTGMGLEISALTAAVLGGNSLGGGRGSVAKALIGAVIVLVMTNGVLRIGLNSGSGPMVLGLTLLLAVFIDVRWLKNRDKLLSKVYVSPTYVELPTPRSTSVETGGAFALNDRLGQVEIIGLGEVESPEDVILDDDDYLYCGTRHGDIVRFAPPDYTSWEVYAHIGGSPLGMAFDRAGDLHVCVGGMGLYKIDRARNVGKVTDETNRSAFSVVDDSRLRLADDLDIAPDGRIYFSEATIRYEMHDWPVDALESRGNGRIICYDPKSGKTHTALRNLIFPNGVCLAHDGQSVLFAESWACRVSRLWIAGPKAGQVERVLDALPGYPDNINRASDGSYWCAIMGMRSPALDLALRMPGFRRRMARRIAPDQWLYPNLNIGCVIRFNDKGEVLESLWDQGAKNHPMITSMREHRGYLYLGGITNNRIGRIRLDKADPNWSGMRSYWGQRA

SEQ ID NO: 35611 - protein, 370 aa, Fulvimarina pelagi HTCC2506
MASRKLLLLPGDGIGPEIATEAQKLITVLNEATEGGFEIESGLVGGAAYDDCGEAISDTTMELAQASDAVLFGSVGGPRWDGVPYEKRPEAGLLRLRKEMGLFANLRPAICYPALADASSLKRHIIEGLDILILRELTGGVYFGEPKEIVDLGNGQKRAVDTQVYETYEIERIARAAFELARTRRGKVTSMEKRNVMKTGVFWNEVVSRVHREEFSDLTLEHELADAGGMKLVREPKQFDVIVTDNLFGDMLSDIAAMLTGSLGMLPSASLGKPDDASGRRKALYEPVHGSAPDIAGQGIANPIAMIASLAMCLRYSFAMTREAEALEAAIADTLNDGIRTGDIMAEGCRKVGTSEMGDAVAERFRTGLA

SEQ ID NO: 35612 - protein, 446 aa, Fulvimarina pelagi HTCC2506
MHQQTDALSTLSAPRLDISGRIVDVGPQSFRVAGLSPFVRLGDCISCPGEDRDELGEVVRIDADSLTVKPYTTRFNRGVGSPAIKVGPFSITPDASWRGRVLDAFCRPQDDKGPVRQGEAIRPVDAQPLSALKRARLSEGVPTGVSVVDIFTPLVKGQRIGVFAGSGVGKSTLMGMLSQSKGFDTVIVALVGERGREVREFLEEVMAGQLDKVVTIVATGDESPMMRRLAPRTATAVAEHFRDRGDDVLLIVDSVTRYAHAARDVALSAGEPPVSRGYPPSIFSELPQLLERAGTGIEGSGTITGIYAVLVDGDDHNDPIADAIRGTLDGHIVLDREIAEQGRFPAVDYLKSISRLAEKAWHGSERELVTRLRAMTSRFEDTRDLRLLGGYQRGSDQTLDQAVDLVPHIYDFLTQRPGEGWHEKPFDALSAALKQAMTPKPEPAKK

SEQ ID NO: 35613 - protein, 467 aa, Physcomitrella patens subsp. patens
MIADAWERLRLSMVYFRDRPVGTIAALDPTEDSLNYNQVFVRDFVPSALAFLMNGEPEIVKNFLLKTLRLQSIEKRIDCFTLGEGVMPASFKVLHDPVRKTDTMIADFGESAIGRVAPVDSGFWWIILLRAYTKSTGDHTLADMADCQRGMRLILTLCLADGFDTFPTLLCADGCCMVDRRMGIYGYPIEIQSLFFMALRCAKVLIKPDGDGKEFLERIDKRLHALSFHMREYFWLDHQQLNNIYRFKTEEYSHTAVNKFNVIPESIPDWIFDFLPLKGGFFIGNVSPARMDFRWFAIGNFMAILGSLATFDQASAIMDLLEARWPELVGDMPLKVTYPAMEGHEWRIITGCDPKNTRWSYHNAGSWPVILWMLTAACIKAGRPQIARRAIEQVETRLSADGWPEYYDGKLGRYVGKQARKFQTWSIAGYLVAKMMLEDPSHLGMIGLEEDRKIQKPSLTRSASWTA

SEQ ID NO: 35614 - protein, 385 aa, Oryza sativa Japonica Group
MADKENSTPASAARLTRSSAAAGAQAKRSAAAGVADGGAPPAKRKRVALSDLPTLSNAVVVAPRQPHHPVVIKPSSKQPEPAAEAAAPSGGGGGSPVSSASTSTASPSSGWDPQYASDIYTYLRSMEVEARRQSAADYIEAVQVDVTANMRAILVDWLVEVADEYKLVADTLYLAVSYLDRYLSAHPLRRNRLQLLGVGAMLIAAKYEEISPPHVEDFCYITDNTYTRQEVVKMESDILKLLEFEMGNPTIKTFLRRFTRSCQEDKKRSSLLLEFMGSYLAELSLLDYGCLRFLPSVVAASVVFVAKLNIDPYTNPWSKKMQKLTGYKVSELKDCILAIHDLQLRKKCSNLTAIRDKYKQHKFKCVSTLLPPVDIPASYLQDLTE

SEQ ID NO: 35615 - protein, 468 aa, Hordeum vulgare subsp. vulgare
MGAFILLLCLLVPLVLVCAVRARKGAGGRSSSGGGKKGRLPPGSMGWPYVGETTQLYSSKNPNVFFARKRNKYGPIFKTHILGCPCVMVSSPEAAKFVLVTQAHLFKPTFPASKERMLGRQAIFFQQGDYHTHLRRLVSRAFSPEAIRGSVSSIEAIALRSLGSWEGHEVNTFQEMKTYALNVALLSIFGEEEMQYIEELKQCYLTLEKGYNSMPVNLPGTLFHKAMKARKRLGAIVAHIISARRERERGSDLLGSFMDGREALTDDQIADNAIGVIFAARDTTASVLTWMVKFLGDNPAVLKAVTEEHAEIAREKALSGEPLSWADTRRMRVTGRVIQETMRVASILSFTFREAVEDVEYQGYLIPKGWKVLPLFRNIHHNPDHFPSPEKFDPSRFEVAPKPNTFMPFGNGTHSCPGNELAKLEMLVLCHHLATKYRWSTSKSESGVQFGPFALPINGLPMTFTRKA

SEQ ID NO: 35616 - protein, 444 aa, Capsella bursa-pastoris
MATITVVKARQIFDSRGNPTVEVDIHTSNGVKVTAAVPSGASTGIYEALELRDGGSDYLGKGVSKAVGNVNNIIGPALIGKDPTQQTAIDNFMVHELDGTQNEWGWCKQKLGANAILAVSLAVCKAGAVVSGIPLYKHIANLAGNPKIVLPVPAFNVINGGSHAGNKLAMQEFMILPVGASSFKEAMKMGVEVYHHLKSVIEKKYGQDATNVGDEGGFAPNIQENKEGLELLKTAIEKAGYTGKVVIGMDVAASEFYSSDKTYDLNFKEENNNGSQKISGDALKDLYKSFVAEYPIVSIEDPFDQDDWEHYAKMTTECGKEVQIVGDDLLVTNPKRVAKAIAEKSCNALLLKVNQIGSVTESIEAVRMSKKAGWGVMTSHRSGETEDTFIADLAVGLSTGQIKTGAPCRSERLAKYNQLLRIEEELGSEAVYAGVNFRTPVEPY

SEQ ID NO: 35617 - protein, 376 aa, Photobacterium profundum SS9
MTEQFIKSKAAIAWGPNQPLSIEEVDVMLPKAGEVLVRIVATGVCHTDAFTMSGDDPEGIFPVILGHEGGGIVEMIGEGVTSVEVGDHVIPLYTPECGECKYCKSGKTNLCQKIRETQGKGLMPDGTTRFYKDGQPIFHYMGCSTFSEYTVLPEISLAKVNKEAPLEEVCLLGCGVTTGMGAVLNTAKVQEGDTVAVFGLGGIGLSAIIGAQMAKASRIIAIDINESKFDLARQLGATDCINPTKFDKPIQDVIVELTDGGVDYSFECIGNVNVMRSALECCHKGWGESVIIGVAGAGQEISTRPFQLVTGRVWRGSAFGGVKGRSELPEIVERYMAGEFKLNDFITHTMGLDDINKSFELMHKGESIRTVIHFNK

SEQ ID NO: 35618 - protein, 593 aa, Zea mays
MESTLKGIRGSDAPCVLDLDDAATVAGGVEDTYGEDRATEEQLVTPWTVSVASGYNLLRDPRYNKGLAFTERERETHYLRGLLPPAIVSQELQERKIMNNIRQYQLPLQRYMALMDLQEGNERLFYKLLIDNVEELLPIVYTPTVGEACQKYGSIFSRPQGLYISLKEKGKILEVLKNWPERSIQVIVVTDGERILGLGDLGCQGMGIPVGKLSLYTALGGVRPSACLPITLDVGTNNEELLNDEFYIGLRQRRATGQEYTDFLQEFMSAVKQNYGEKVLIQFEDFANHNAFDLLARYGTTHLVFNDDIQGTASVVLAGLIAAQTLLGGSLADHTYLFLGAGEAGTGIAELIALEISRQTKAPIEECRKKIWLVDSKGLIVSTRKESLQHFKKPWAHEHKPLSNLLDAVNAIKPTVLIGTSGKGQTFTKDVVEAISSFNERPIILALSNPTSQSECTAEQAYTWSKGQAVFATGSPFDPVEYNGKIHVPGQANNAYIFPGFGLGVVMSGAIRVHDDMLLAASEALAQQVTEENFEKGLIYPPFSNIRKISAHIAASVAAKAYELGLASRRPRPKDLVKYAESCMYSPIYRNYR

SEQ ID NO: 35619 - protein, 481 aa, Oryza sativa Japonica Group
MLPSTAMAFHVFLIAALLLLPLPAAFSKAVRTQSLLANPLSPDPITQEQQLSLAAPRTNASTLHFRLAHREHFALNATASDLLAHLLARDAARAAALLAAPNNATRPRRRGGFAAPLLSGLPQGSGEYFAQVGVGTPATTALMVLDTGSDVVWLQCAPCRHCYAQSGRVFDPRRSRSYAAVDCVAPICRRLDSAGCDRRRNSCLYQVAYGDGSVTAGDFASETLTFARGARVQRVAIGCGHDNEGLFIAASGLLGLGRGRLSFPSQIARSFGRSFSYCLVDRTSSVRPSSTRSSTVTFGAGAVAAAAGASFTPMGRNPRMATFYYVHLLGFSVGGARVKGVSQSDLRLNPTTGRGGVILDSGTSVTRLARPVYEAVRDAFRAAAVGLRVSPGGFSLFDTCYNLSGRRVVKVPTVSMHLAGGASVALPPENYLIPVDTSGTFCFAMAGTDGGVSIIGNIQQQGFRVVFDGDAQRVGFVPKSC

SEQ ID NO: 35620 - protein, 364 aa, Paspalum vaginatum
MAIGGAEAGGGGAGASGRSVLVTGGAGFIGTHTALRLLEQGYGVTVVDNFHNSVPEALERVRLIAGPALSARLDFIRGDLRSAGDLEKAFAARRYDAVVHFAGLKAVGESVARPDMYYENNLAGTINLYKAMNEHGCKKMVFSSSATVYGWPEVIPCVEDSKLQAANPYGRTKLILEELARDYQRADPGWSIVLLRYFNPIGAHSSGEIGEDPKGVPNNLLPYIQQVAVGRLPELNVYGHDYPTRDGTAIRDYIHVVDLADGHIAALNKLFDTPDFGCVAYNLGTGRGTSVLEMVAAFKKASGKEIPTKMCPRRPGDATEVYASTEKAERELGWRAQYGIEEMCRDQWNWAKKNPYGYCGTAEK

SEQ ID NO: 35621 - protein, 328 aa, Synechococcus sp. CC9605
MSRIYDDNSQAIGNTPLVKLNNVTKNCKATVLAKVEGRNPAYSVKCRIGANMIWDAEKSGKLTKGKVIVEPTSGNTGIALAFTAAARGYKLILTMPESMSIERRRVMAVLGAELILTEAAKGMPGAIAKAKEISESDPAKYFMPGQFDNPANPEIHFKTTGPEIWNDCDGAIDVLVAGVGTGGTITGVSRYIKNEAGKAIESVAVEPTNSPVITQTMNGEAVKPGPHKIQGIGAGFIPKNLDLSVVDKVEQVTNEESVAMALRLAQEEGLLVGISCGAAAAAAIRLAEKDEYAGKTIVVVLPDLAERYLSSVMFAEVPTGIIEQPVAV

SEQ ID NO: 35622 - protein, 294 aa, Zea mays
  misc_feature (149)..(149): Xaa can be any naturally occurring amino acid
MDSPFKPDVLKGKVALITGGGSGIGFEISSQFGKHGASIAIMGRRKQVLDAAVSDLRSLGIPAVGFEGDVRKPEDARRVVESTFNHFGKVDILVNAAAGNFLAAAEDLSTNGFRTVLDIDAVGTFNMCREALKYLKKGGPGRDSSSGGXSILNISATLHYTASWYQIHVSAAKAAVDAATRNLALEWGTDYEIRVNGIAPGPIGGTPGMSKLGPDEIENKAGDYIPLYKLGEKWDIAMAALYLSCDSGKYVNGLTMVVDNGQWLSRPRNLPKEAVKELSRVVEKRSRAKPTSKL

SEQ ID NO: 35623 - protein, 307 aa, Zea mays
MLRSTHPPSPTSGSSAAPASSSDAAAMVGGGAAAGSGGAPSGAKLLQILNVRVVGSGDRVVVLSHGFGTDQSAWSRVLPYLTRDHRVVLYDLVCAGSVNPEHFDFRRYDTLDSYVDDLLAILDALRIARCAFVGHSVSAMIGILASIRRPELFAKLVLIGASPRFLNDHDYHGGFELPEIQQVFDAMAANYSAWATGYAPLAVGADVPAAVQEFSRTLFNMRPDISLHVCRTVFNTDLRGVLGMVRSPCVVVQTTRDVSVPASVAAYLKAHLGGRTAVEFLQTEGHLPHLSAPGLLAQVLRRALARY

SEQ ID NO: 35624 - protein, 115 aa, Zea mays
MANHQEKPTTSPPPQPAEGSVARPRLPGVGNAHPGSAGYPNPPDAAIPDAATLRDQWRFAVRQYSRWYSHAWGTAILAGAAFFALGWLVKGSNPLPSRAEPQHGAIGKSVAKEDN

SEQ ID NO: 35625 - protein, 1478 aa, Saccharomyces cerevisiae
MPFLRKIAGTAHTHSRSDSNSSVKFGHQPTSSVASTKSSSKSPRATSRKSIYDDIRSQIPNLTPNSTSSQFYESTPVIEQSFNWTTDDHISAGTLENPTSFTNSSYKNDNGPSSLSDSRKSSGGNSVNSLSFDKLILSWDPTDPDEWTMHRVTSWFKFHDFPESWILFFKKHQLFGHRFIKLLAYDNFAVYEKYLPQTKTASYTRFQQLLKKTMTKNVTNSHIRQKSASKLKSSRSSSESIKSKLKNSKSQEDISNSRSTSESPLSPTKSGPSKTDEKIFLHSTSTHQKTKSASSLYRRSFISLRGSSSSNASSAKSPSNIKLSIPARPHSIIESNSTLTKSASPPASPSYPSIFRRHHKSSSSESSLLNSLFGSGIGEEAPTKPNPQGHSLSSENLAKGKSKHYETNVSSPLKQSSLPTSDDKGNLWNKFKRKSQIGVPSPNTVAYVTSQETPSLKSNSSTATLTVQTADVNIPSPSSSPPPIPKTANRSLEVISTEDTPKISSTTASFKETYPDCINPDKTVPVPVNNQKYSVKNFLLDQKFYPLKKTGLNDSENKYILVTKDNVSFVPLNLKSVAKLSSFKESALTKLGINHKNVTFHMTDFDCDIGAAIPDDTLEFLKKSLFLNTSGKIYIKDQMKLQQKPKPAPLTSENNVPLKSVKSKSSMRSGTSSLIASTDDVSIVTSSSDITSFDEHASGSGRSTPKPRVITMTEVSNTNPTEELNYWNIKEVLSHEENAPKMVFKTSPKLELNLPDKGSKLNIPTPITENESKSSFQVLRKDEGTEIDFNHRREAPYTKPEVAPKRESPKPPANTSPQRTLSTSKQNKPIRLVRASTKISRSKRSKPLPPQLLSSPIEASSSSPDSLTSSYTPASTHVLIPQPYKGANDVMRRLKTDQDSTSNSPSLKMKQKVNRSNSNVSTSNSIFYSPSPLLKRGNSKRVVSSTSAADIFEENDITFADAPPMFDSDDSDDDSSSSDDIIWSKKKTAPETNNENKKDEKSDNSSTHSDEIFYDSQTQDKMERKMTFRPSPEVVYQNLEKFFPRANLDKPITEGIASPTSPKSLDSLLSPKNVASSRTEPSTPSRPVPPDSSYEFIQDGLNGKNKPLNQAKTPKRTKTIRTIAHEASLARKNSVKLKRQNTKMWGTRMVEVTENHMVSINKAKNSKGEYKEFAWMKGEMIGKGSFGAVYLCLNVTTGEMMAVKQVEVPKYSSQNEAILSTVEALRSEVSTLKDLDHLNIVQYLGFENKNNIYSLFLEYVAGGSVGSLIRMYGRFDEPLIKHLTTQVLKGLAYLHSKGILHRDMKADNLLLDQDGICKISDFGISRKSKDIYSNSDMTMRGTVFWMAPEMVDTKQGYSAKVDIWSLGCIVLEMFAGKRPWSNLEVVAAMFKIGKSKSAPPIPEDTLPLISQIGRNFLDACFEINPEKRPTANELLSHPFSEVNETFNFKSTRLAKFIKSNDKLNSSKLRITSQENKTE

SEQ ID NO: 35626 - protein, 290 aa, Debaryomyces hansenii CBS767
MSTVNKKVNYPFWYGGAASMVACLVTHPLDLAKVRLQTASKPGQSLGSMVYQIITKEGFLKIYSGLSASLLRQATYSTARFGIYEFLKETYTEKYHTTPSTGILLPMSMVAGALGGLIGNPSDVVNIRMQNDSSLPIEQRRNYRNAFDGIFRIIKEEKVSSLFRGLVPNLTRGVLMTASQVVTYDIAKNLLVDTLHLDPSKKATHFSASLLAGLVATTVCSPADVVKTRIMNAKGASNGSTISILTSAVKTEGVGFMFRGWLPSFIRLGPHTIVTFLALEQLRKFKVGMF

SEQ ID NO: 35627 - protein, 146 aa, Glycine max
KCKPNTPLNFKFFCFSDMQRKRRPMIDYMDKVQKQVTTTMRTILVDWLVEVAEEYKLLSDTLHLSVSYIDRFLSVNPVSKSRLQLLGVSSMLIAAKYEEVDPPRVDPFCNITDNTYHKAEVVKMEADMLTTLKFEMGNPTVNTFLR

SEQ ID NO: 35628 - protein, 53 aa, Glycine max
NSAPDAPVFEVHEVDDEVLPLLTLEDLKDMGISAVGSRRKMYTAIQKLGKGFS

SEQ ID NO: 35629 - protein, 363 aa, Synechocystis sp. PCC 6803
MLRAGIVGLPNVGKSTLFNALVANAKAEAANFPFCTIEPNVGVVSVPDDRLGKLAEISQSVKVVPTRMEFVDIAGLVAGASKGEGLGNQFLANIREVDAIVHVVRCFDDDDIIHVSGSVDPVRDVEVIDLELVLADLAQVEKRLERSRKQARGNKDLLEEVAILERLVAALNEGIPARRVGLTAEEQELIKSLGLLTLKPIIYATNVTEDDLAGGNDWVEQVKAIAAKDEAKVVVISAQVESELVELPEEERQDFLASLGVTEGGLKSLIRATYELLGLRTYLTTGPQETRAWTIISGMKAPQAAGVIHTDFERGFIRAETVAYEDLISCGSMQGAKEKGLVRSEGKEYVVQEGDVLLFRFNV

SEQ ID NO: 35630 - protein, 263 aa, Bradyrhizobium japonicum USDA 110
MLYSATINVMVKAARRAGRSLKRDLGEIEHLQVSLKGPANFVSLADKRAEEILYQDLAKARPGYGFIGEEGGTREGTDKSHTWIVDPLDGTTNFLHGIPQFAISIGLAREGTVIAGVIYNPANDELYIAERGKGAFLNDQRLRVAGRRQLNECVVACGLPHIGRGDHEEFRREMTAIQDRVAGLRRFGAASLDLAFVAAGRLDGYWERNLQSWDIAAGMIMVREAGGTVSDIDTTGDALVTGHVVCGNEFVHGELVKILRKPA

SEQ ID NO: 35631 - protein, 338 aa, Synechocystis sp. PCC 6803
MATQQTILVTGGAGYIGSHGVLALQQAGFDVLIYDNLSYGHKELVQPLGVELVVGHTGDRQKLDQLFATRNIAAVMHFAAFIAVGESVQKPDIYYQNNVVGTLTLLEAMLAAGIKKFVFSSTCAVYGMPKEIPMTESHPIDPLSPYAASKRMVEQILADFDQAYGFKSVIFRYFNASGADPQGRLGEDHNPETHLIPLALLTALKQRPQLSVFGTDYDTLDGTALRDYIHVCDLAIAHVLGLQYLLEGGESNIFNLGNGNGFSVRQVIEVAKAVTGLDIPYQLCPRRPGDAPILVGSSAKAREILGWNPQYPDLHTIIDHAWQWHQRRHGDYKKSNKI

SEQ ID NO: 35632 - protein, 482 aa, Physcomitrella patens subsp. patens
MAGGAIAGGRRLLLPRLQALASCRRGLSLAADASKEVRPEAGVPQMPAFDYTPQPYDGPKADEILAKRKKFLNPALFLYYKKHLNIVEGKMQYLFDESGRRYLDAFAGIVTVSVGHGHPTVVDAVVKQTKLLQHTTTIYLHHAIANYAEALAQRMPGNLKVVYFVNSGSEANDMAMMMARLYTGTFDIVSLRNAYHGMSPSTMGLTAHSTWKYNVAQGFGVHHVMNPDPYRGPFGADGKLYANDLANLIESATPGRIAGFFHETIQGVGGAVELAPGYLPAAYDIVRKAGGLCIADEVQTGFGRTGSNFWGFQNQGVTPDIVTLAKGIGNGLPLAAVVTTPEIAQVLAQRLHFNTYGGNPVCSAAGHAVLEVLEKEKRQAHCATVGDHLLHRLRALQDKHDIIGNVRGRGLMLGVELVKDRTTKAPAKEETLLLFEQLKDLGVLVGKGGLHGNVFRIKPPMCFSMEDADFLVDAMDHVMSKL

SEQ ID NO: 35633 - protein, 128 aa, Triticum aestivum
FLRTRGEMARDIAQKLGFSEQCIEDAKDTIQKLYTIFREKDSTQIEINPLSETSDHQVLCMDAKFGFDDNAEFRQKEIFEWRDTTQEDPDEVRAAQSNLNFIKLGGDIGCLVNGAGLAMATMDIIKIN

SEQ ID NO: 35634 - protein, 275 aa, Zea mays
MDAAPLLALLLAAVSLSAAAAGDGAHPGYSDEGTCTVDAAGAGVGSGPELRRLEERRPGRIIDITHAYVPDLLAFAPGAVTGPLVHLKESMANGSEYNLSELRLECHMGTHVDAPGHMNQGHFAAGLDVDTLDLDVLNGPALLVDVPRDTNITAEAMEFLNIPRGVRRVLFRTLNTDRKLMWRKGGDMSYVGFTEDGAQWLVDNTDIKLVGIDSLSVAAFEHLISAHVVFFKTPDIIPVEGLKLDNIETGIYMLHCLPLRLVGAEGAPTRCILIK

SEQ ID NO: 35635 - protein, 275 aa, Oryza sativa Japonica Group
MAREPSPEIDDELFNEVYGKAYSGPVATTTNNVTPRVNDEKRPLEREKSDEEDGPPDPNAVPTDFTSREAKVWEAKAKATERNWKKRKEEEMICKICGESGHFTQGCPSTLGANRRNADFFERVPARDKQVRDLFTERTISQIEKDVGCKIKMDEKFLFVSGKDRLILAKGVDAVHKIIQEGKGKNTSSSPKRDRLRSPVRTTSDIRPRHTDSRWSHSPRSAPRSQSKGYYNERPLDGRSHDDMPKFSKESPQGRALKHTRLIIVVSANIRSQAF

SEQ ID NO: 35636 - protein, 318 aa, Brassica napus
MMKMQIGVLACLVALSAIEFGLASANTVPAFLWSPHLQRDNGEVDEAVNYQVMSAKDLVGSVFTQGGWSNFLCSEKKVEQAVDVALVFIGRELLSSDVSSKRNSDPALVNTLNNLFTASNFSLAFPYIAAPEEERMESLLLSGLKEACPHNVGVSNIVFSDSCFVEDGTIQKLSDLQSFKDHLLARKETRKEGETDLVVLCSEGSESNSQSGQSHSERESISELVSSVEQSGSKYTALYVSDPYWYTSYKTLQRFLAESGTGNSTVGVATTCDELCKFKSSLLEGILVGIVFLLILISGLCCMAGIDTPTRFETPQDS

SEQ ID NO: 35637 - protein, 230 aa, Oryza sativa
MPAVKWLMHWHPNPGATLNSQILAEACACAESLGGSKDGRWKTSIIFYRAMARDGASAAAAGGGGPPQQHPDVPRELLGVALHERPGLYFSILRAHRLVLQADSAFPQVMEKLQSYKARVTLNFEGFQYQLGDFCLRIGKCVPNNSETLRGIMMEVEYYPLSSIEKSRAVMEDFFDIWQETVAKKSLPGHFIHVESNFSEYGLSDHYSFQHTAVQYATCLQQLMAAVRPQ

SEQ ID NO: 35638 - protein, 799 aa, Polaromonas sp. JS666
MSNLFEATALVVPFENLRMTDVEAVGGKNASLGEMISQLPTGPQGVRVPTGFATTAHAFRVFLAYDGLDKKINALLDALDTDDVRALAEAGAKIRALVEAQPFPPDFEQAVRGSFATLSAGNAQASFAVRSSATAEDLPDASFAGQQETFLNVVGIEDVLHKMKEVFASLYNDRAISYRVHKGFAHADVALSAGVQRMVRSDLGAAGVMFTIDTESGFEDVVFITSSYGLGETVVQGAVNPDEFYVHKPMLEAGNRAVIRRNLGSKLLQMEFTTAEEKKAGGKLVKTTDVPAELRNRYSLSDEDIEQLARYAVIIEKHYGRAMDIEWGKDGTDGQLYILQARPETVKSQSKGKAEQRYKLKGTGTVLAEGRAIGQKIGTGPVRIVHNISEMDQVQPGDILVTDMTDPNWEPVMKRASAIVTNRGGRTCHAAIIARELGIPAVVGCGDATERLVDGMLVTVSCAEGDTGNIYDGLLETEVTEVQRGTMPPIDLKITMNVGNPQLAFDFCQIPNHGVGLARLEFIINNNIGVHPKAILDYPNVDADLKKAVESVARGHASPRAFYVDKVAEGIATIGAAFWPKPVIVRLSDFKSNEYRKLIGGSRYEPEEENPMLGFRGASRYLSPDFGEAFAMECEALKRVRNDMGLVNVEVMVPFVRTLGQAKKVTDLLAQHGLKRGERGLRVIMMCEVPSNAILADQFLEYFDGFSIGSNDLTQLTLGLDRDSGLEILASDFDERDPAVKALLSQAISACRRQGKYVGICGQGPSDHPDFALWLKEQGIGSISLNPDTVIDTWKRLAN

SEQ ID NO: 35639 - protein, 447 aa, Arabidopsis thaliana
MPTFSAIALDRMLEPGASTSVESVPSTTNLFYSKPPISKLEKGKGKLPNERTVTRPLMSPALYATPDAIPLPNSPSSFPPSPYIINHKSRGPPRLLKSSSEANVVSSSHQKTLEEETITAETDVKVSPRRRSTSFSFPITEVTEDDYSNGVHARTVGNYNFDGIVDGPVGNWSPLDGKSGNGKSELDNAANGLERVNGLSEPVPIKTDKESESEDFYDPGESASFTSNTDVEGDAGDESSQRLATPVGEFYDAWDELSTDSGMQSSVNNIESELSEIRLSLLMEIEKRKQTEEALEQMQIHWQRLREQMAQVGLFVPIDPTASTNNMNLSEELRCQLEIARFVSDSLGRGMAKAEVEMEMESMLETKNFEITRLSDRLHYYEAVNREMSQRNQEAIEVARRERQKRKKRQRWIWGSIAATITLGSAALAWSYIPAAKPSSEVSLKDE

SEQ ID NO: 35640 - protein, 190 aa, Polaromonas sp. JS666
MSLINTEIIPFKATAYHNGKFVPVSNENFMGHWSVVVFYPADFTFVCPTELGDLADHYAEFQKLGVQIYGVSTDTHFTHKAWHDTSDTIRKVQYPLIGDPSQQLSRAFQVLIEEGEDAGLAYRGTFVIDPAGKIKTIEVHDNGIGRDAAELLRRVKAAQYVAAHPGEVCPAKWTEGAETLKPSLDLVGKI

SEQ ID NO: 35641 - protein, 308 aa, Pseudomonas fluorescens Pf-5
MSERSSHWQLQTIVGQLRDARDQWRTRNGRVSGEQGGRELPSRAAMAEILEALCGALFPMRLGPVDLREESEDFYVGHTLDAALNALLAQARLELRYVARQSGEADAEVNARAIRLIQDFALALPGLRVLLDTDVLAAYHGDPAARSVDEVLLCYPGILAVIHHRLAHHLYRAGLPLLARISSEIAHSATGIDIHPGAQIGRSFFIDHGTGVVIGETAIIGERVRIYQAVTLGAKRFPADEDGQLQKGHPRHPIVEDDVVIYAGATILGRITIGKGSTIGGNVWLTRSVPAGCNLTQANLQHDDGSQK

SEQ ID NO: 35642 - protein, 331 aa, Pseudomonas fluorescens Pf-5
MIKQQLARFNRLDLLRSTTALEKLERLSAWIGRDVYVKRDDSTPLAMGGNKLRKLEYLAADALAQGADTLITAGAIQSNHVRQTAALAAKLGLGCVALLENPTGTQDPNYLGNGNRLLLDLFDAKVELVENLDQADEQLHALAARLRSNGKKPYLVPIGGSNALGALGYVRAGLELAQQIEDSGLEFAAVVLASGSAGTHSGLALALSEVLPQLPVIGVTVSRSEEDQRPKVQGLAERTAELLGVKLPDAFNVQLWDEYFAPRYGEPNAGTLAAVKLLASQEGLLLDPVYTGKAMAGLLDGVGRQRFDDGPLIFLHTGGAPALFAYAGAFS

SEQ ID NO: 35643 - protein, 229 aa, Burkholderia pseudomallei K96243
MTLRFETAPMPTTQILFIRHGETAWNRIKRIQGHIDIPLADTGLAQARQLAERLAREARGGARIDAVYTSDLSRARQTAQPTADALGLPLVPRQALRERAYGVFQGHDSTEIEARFPDAFAQWQTRDPGFEPEGGESHRAFYHRVLHEVERIVAAHPGGRIACVAHGGVLDCVYRFANDLPLDAPRKHALLNTSVNIVDYDDGRARVVRWADVDHLSGASDDDGYRKVL

SEQ ID NO: 35644 - protein, 282 aa, Zea mays
TIGDKDCCSDCSGNCLYASEPCACARKTGGEFAYTRDGLVRTKFLDECISMNRFPEKHNMFFCKSCPLESIRNEPSPELCRGHIIRNFIKECGSKCGCNAQCGNRVVQRGITCNLQVFSTREGKGWGLRTLDELPKGAFVCEYVGELLTNTKLHEMTTQNMHNARYSVLLDAGWGPDGVLKDEEALFLDATFCGNVGRFINHRCYDANLVEIPVGKETPDHHYYHFAFFTTKKVEAFEELTWDYGIDFVGVGHPVKSFECLCGSRYCRGRKHSRTRGKAASK

SEQ ID NO: 35645 - protein, 443 aa, Synechococcus sp. CC9605
MATTDIFMPALSSTMTEGKIVEWLKQPGDKVARGESVLVVESDKADMDVESFQDGYLAAVLMPAGSTAPVGETIGLIVETEAEIADAQAKAPTAPAAAAAPAPAPAPAPTPAAVQAPAPTPAPAPAPVAAPAPSAPVVNDGRIVASPRAKKLASQMGVDLATVRGSGPHGRIQAEDVEQASGQPISVPRVAEGTAPAASAAGAAAAAAPAAPAGNSFGRPGETVAFNTLQGAVNKNMEASLAVPCFRVGYTITTDKLDAFYKQVKPKGVTMTALLAKAVAVTLARHPQVNAATTVAGMAYPVDVNVAVAVAMEDGGLITPVLRNADRTDLYEMSRQWGDLVKRSRSKQLQPEEYSTGTFTLSNLGMFGVDRFDAILPPGTGAILAVAASRPKVVANKDGSIAVKRQMQVNLTADHRVIYGADGAAFLKDLADLIENRPESLAL

SEQ ID NO: 35646 - protein, 527 aa, Glycine max
MGQCVITMEPFSSTKQNHNNNNTLTKPSLHVESPPLEPSPLRKIIVVASIAAGVQFGWALQLSLLTPYVQLLGIPHTWAAYIWLCGPISGMLVQPIVGYHSDRCTSRFGRRRPFIAAGSFAVAIAVFLIGYAADLGHSFGDDLSKKVRPRAIGIFVVGFWILDVANNMLQGPCRALLGDLCAGNHQKTRNANAFFSFFMAVGNVLGYAAGAYSKLYHVFPFTKTTACDVYCANLKSCFFLSIALLTTLATAALVYVKEVPLSPEKAVIDSDDNGGMPCFGQLFGAFRELKRPMWILLLVTCLNWIAWFPFLLFDTDWMGREVYEGTVGEGKAYDRGVRAGALGLMLNSVVLGATSLGVEVLARGVGGVKRLWGIVNFLLAVCLAMTVLVTKMAQHSRQYTLLPNAHQEPLPPPAAVKAGALALFSLLGIPLAITYSIPFALASIFSSTSGAGQGLSLGVLNLAIVIPQMVVSVISGPWDALFGGGNLPAFVVGAVAAAASGILSIILLPSPPPDLAKAATAAGGGFH

SEQ ID NO: 35647 - protein, 341 aa, Bradyrhizobium japonicum USDA 110
MDLTELNRIATAMVAPGKGILAADESSGTIKKRFDAIGVESTESNRRDYREMLFRSREAMSQYISGVILYDETIWQDAKDGTPLVKLIESSGAIPGIKVDEGTQGLPMCPGELVTVGLDKLAERLKKYYERGARFAKWRAVIDIGSGIPSMTAISVNAHALARYAALCQAAQIVPIVEPEVLMDGDHDIDRCYEVTQRVLNKTFQELRVQRVALEGMVLKPNMAISGKKCAKQAPVEEVAEKTIRLLKACVPAAVPGIAFLSGGQSDEEATAHLNAMHKLGPLPWGLTFSYGRALQAAPQKAWSGKAENVAAGQRAFSHRARMNGLASKGEWQSSLEKKAA

SEQ ID NO: 35648 - protein, 1888 aa, Magnaporthe grisea 70-15
MSTLSDSELEKLFSGAPQFFARSEGVNTGAPNPSVAFPWDETLEIRDLTDHTQIEDEAWGCVTALPHLVRSPRRRSSVSSIGKIKRAHFYPKCRERPNMLSMQGLEKGTVGFSAALELSAADALQEEQYGFESAGGRRPDPIIEARQKMLTSKDGLRYLEEPAIMEQLIKNGRRYVTNDLRDNMLSTDLYNELFLHILHPPTRVLDHQDPYSLSVQIQALLKVLNTPNVWVDFSHVEWRIRLGQVLWGSPSMADVEDVLDGEELDAGDSIEARSEERYWLLLQILLACELWIRLDAIVEADDAGTEHIKPREIYRFQQEAKTAVKWSMLLAKSWLENIEVTKVEGLKPDEAATRHSSAGWLATFTKRLSLASDNGDKSLASLAPGSRPSSRATADHPAYDMRGKHGQRQVDGLTHFARRLKWPGIDAYEARISNNVRAVSEKTPLNTPLASPASDMPSYFGSAAVVGSGNSAKTSMHIADQVRRQPSKRRKIAAALHPAGWLSKSYVSGLMLPGEGLSHFLMSTLLENDTEAMDKLGPMANLCGGFVYSGKSFWSTSCIVGRVIAAGKGSVECMGWISSDITPYGLSDGWVNVEVADIPGESSRLGRQARIWGKAAIERQSSVLGDGDLGSVLPADFIIPFENLYKGLPPPALWIELKALNLFARPDSESTTPAAELSTPLTQLTETTASSSKTSPDIQTYPAAVKFTVGRIDDYNDYGDGLGDDGVEKEYTFNLTHDVYFATAHPCVPSQHVKVLKSPSSPTIQQIDLESSTDSINNENFSNKRSSPVNITGHPLHKYYTYTAIHLSELLDRRDSTLDDLLNNPGPNEAYRRPSIAPGPHGNKTARVLVVDCITGFQPLPQAHEIPLSPVVSRSSSLNMATWEASPPRTQVPVLQEPSPPRSAFAAAFAAASSTNVNGVAVGGAVPESPGHKMHSETRRRQFGSDMEILIRALCAEKGWNALIGDVRHMFARLWQVSAVVLLLAWKAQRFPFFPRNVLPLLNWNPANVSAVTEATDPVYLGHHKAHPLGLVDRVPGEPVLGVRPMSENRGRLAAEYGTVSGRSSSALPPTPKKLKRLDAHDIDLMQPAGRVGRNPGQSQADVAAVRDIAERRSDLEGKYGRVSALLAVGDIIVHADRDAGDFRVALRRGEYGGEGRQRGKGENAPRHGGRFARRRDSGRRVGGRWVREEAWYFNSRGSVTEFLTTEIFASASRPFSPWRASLAPSSPPVSRNALSDRERPIATASSIQPALTKKVPAKKLVPHGANELPNALEGMKLVPPVLDPSIKLGRPQSVVTPLSPGRNNVQATDESVFVDDSVLHKSTAAPGAHMMKQGQENTPPPLSSARAGGGLNIAHAHTDQQAAPSHNHAAVSRHEHYLRDRPTTPATRRFNTNRGLTPEELEILKKPSIKRLVNVTQLYFLDYYFDLLTYTGARQNRLAAFKSEYPPPPETDEETYAAMWHKYTGRERANLRKRRVRLRQGDFQILTQVGQGGYGQVFLAQKKDTREVCALKVMSKKLLFKLDEVRHVLTERDILTTAKSEWLVRLLYSFQDDKSIYLAMEYVPGGDFRTLLNNTGVLSNRHARFYIAEMFCSVDALHQLGYIHRDLKPENFLVDSTGHVKLTDFGLAAGVLAPGKIESMRLRLEKASETSVPFGKPMDQRTIAERREGYRSMRDKDVNYAKSIVGSPDYMAPEVLRGEEYDFTVDYWSLGCMLFEALTGFPPFAGATAEETWRNLKHWKEVLKRPVWEDPNYFLSNRTWGFITTCINSRSRRFANIRDIYAHQYFAEVDWETLRETKAPFVPELDSETDAGYFDDFSNEADMAKYKEVHEKQQALETMAERDDEMGKSLFVGFTFRHRKPQGEDSSSPRKPLTADTFQAETFGTML

SEQ ID NO: 35649 - protein, 398 aa, Bradyrhizobium japonicum USDA 110
MANKFRTLDDVDVKGKRVLLRVDLNVPMENGRVTDATRLERVAPTITELADKGGKVILLAHFGRPKGRDAKESLKPVTEALSKVLNKPVAFADDCIGEPAATAVAALKDGDILCLENTRFHKEEEKNDPAFVAELAKLGDIWVNDAFSAAHRAHASTEGLGHKLPAYAGRTMQAELDALEKALGSPTKPVIAIIGGAKVSTKIDLLENLVSKVDALVIGGGMANTFLHAQGVGIGKSLAEKDLAPTALRIIEKAEAANCAIILPVDATVAYHFAANAPSHAYGLDAIPADGMILDVGPQSVARVHAAIDDAATLVWNGPLGAFEMQPFDRGTVAAAKHAAERTKAKKLISIAGGGDTVAALNQAHVAGDFTYVSTAGGAFLEWMEGKPLPGVEVLRIK

SEQ ID NO: 35650 - protein, 335 aa, Bradyrhizobium japonicum USDA 110
MAVRVGINGFGRIGRNVLRAIAESGRKDIEVVGINDLGPVETNAHLLRFDSVHGRFPGTVTVDGDSISLGGGKIKVTAERDPSKLPWKDLGVDIALECTGIFTSKDKASAHLTAGAKRVLVSAPADGADATIVYGVNHDTLTKDHLVVSNGSCTTNCLAPVAKVLNDLVGIETGFMTTIHAYTGDQPTLDTMHKDLYRGRAAAMSMIPTSTGAAKAIGLVLPELKGKLDGVAIRVPTPNVSVVDLKIIAKRATDVKEINAAMKRASEQQLKGILGYTNAPNVSIDFNHDPHSSTFHEDQTKVQNGTLVRVMSWYDNEWGFSNRMADTAVAIAKVI

SEQ ID NO: 35651 - protein, 274 aa, Oryza sativa Japonica Group
MPVQLGGGGKVAEPKDLAATDKDRPSSKKNRRRQKKPATSAAISPPVAAMQTLFDTSREVFQDSLPGFVPPPQAVARLAALLNDLKPHDVGIEPSMSCFKNADSKGPPRVTYLHFYDCPKFSFGIFCLPKSAVIPLHNHPGMTVFCKILFGSMHLKSYDWAKSAPDNDNNALETSDGARLAKVNTDAVFDASSETTVLYPENGGNLHCFTARTACAVLDVMGPPYNRADGRDCSYYDESPYLSSSGGDARYSWLKENHSTFEMKGVQMPQRFIV

SEQ ID NO: 35652 - protein, 504 aa, Glycine max
MVIIIKYYTYIYIPTIEKSEQNPTKAAMAAMQRPLKRTIAIAKQRACFSSLLPSAAAAAAADTVAPPQLPPFDHQPHPYNGPSADEVFAKRKTFLGPSVFHYYKKPLNIVEGKMQYLYDDSGRRYLDAFAGIVTVSCGHCHPEILNAITEQSKLLQHATTIYLHHTIGDFAEALAAKMPGNLKVVYFVNSGSEANELAMMMARLYTGNLGMISLRNAYHGGSSSTLGLTALNSWKYPIPEGHVHHVMNPDPYHGAFGTDAASYANDVQDHIDYGTSGKVAGFIAESIQGVGGAVELAPGYLKLVYDIIHKAGGVCIADEVQTGFGRTGSHYWGFETQGVIPDIVTMAKGIGNGLPLGAVVTTPEIASVMAQKIQFNTFGGNPVCSAGGLAVLRVLDKEKRQAHCADVGSYLLERLRFLMERHDIIGNVRGRGLMVGLELVTDRTNKTPAKAETAVVFEKLRELGVLVGKGGLHGNVFRIKPPMCFSKDDADFLVDALDYSLSKL

SEQ ID NO: 35653 - protein, 419 aa, Debaryomyces hansenii CBS767
MPSPEQKNLSPLRPSTSLGAQPGLRRRGSSVGNIDVGDTSPSFATLYTSKSQRKKSDARIVELSKESDSDVAIVKKIGVAYREITYRHTWINPLLVLLAALGAFLVSGPDTIIHQVLEAMMIPAYKIEGSDQYGKGMNDFYFVGFYAIFFTFLREFLMCCVLRPTATWLNITKEAKAKRFMEQTYAMFYYGFSGPFGLWIMSTLPLWFFETLPFYESYPHKTHDFYFKVYYLGQAAFWVQQSVVLILQLEKPRKDFKELVLHHIITIALIWCSYRFHFTWMGLAVYITMDVSDFFLATSKTLNYLNSPLTGPFFVLFVGIWIYLRHYLNLRILWSVLTEFRNVGEWELNWDTQQYKCWISQPIVFFLIGALQIVNAYWLFLIFRILWRYVAGGGTKDERSDDEDEEETESGEDETKKTE

SEQ ID NO: 35654 - protein, 603 aa, Magnaporthe grisea 70-15
MPSMLLTWLLLLLGSCLAAEFRVHDKTFKPDYVLVATAQNITINCQTRYSIVFNGTSPGPLLTFHENQTTWVRVYNRIKDQNVTVHWHGLSQRTAPFSDGTPLVSQWPVAPDNFFDYEIRPDIGSAGTYFYHSHVEFQAVTAHGALIVEDAVKPPYEYDEDVVVGLGEYYPKTDRQILDGLLAKPFRWSGEPEAILFAGRSGNKSFTEASHDSCKPDLIKVQPDKTYRVRFIGGTAMSLVVMAFEGHDMTIIEADGSYTKPVKTDRMQVGSGQRYSILLRTKSVQEVASTNKTSYWIQYETRGRPTNVTGWALLQYEMPGQPEAMLPATLPSKPVATIPDDPSTWMEFTLQPLQDSVREQFPKLSEVTRTIYIDVKQVVVDGGVVNGTVKGSIEWAQNSLVWQEDSQAAKNRPPVLVGILTTGMSPSIEAALANQNWDPTTQTFPAAVGETLDIVWQGNSGELGGWDVHPMHAHGTHFWDLGSGNGTYDAPAVDAKYYADGNYVPAVRDTTMLYRYAAKGEKNHTAGWRAWRVRVTEDDIGAWVMHCHVLQHMMMGMQTVWVLGTAAEILQKFPTSPYVNGYLTFGGDAYGNATFDPLVLQHF

SEQ ID NO: 35655 - protein, 294 aa, Zea mays
MPAGQPHAHEAAAAACVGSGANHSNHRVPAHSPPPLPAEVVPAYPPPESEDDETWVWTQIKAEARRDADAEPALASFLYATVLFHLATLTAHPSLRAAVVADLLAAHSRDPACVGFSHCLLNYKGFLAIQAHRVAHVLWAQQRRPLALALQSRVADVFAVDIHPAAVVGKGILLDHATGVVIGETAVVGDNVSILHHVTLGGTGKAVGDRHPKIGDGVLIGAGATILGNVKIGAGAKIGAGSVVLIDVPARSTAVGNPARLIGGKKAEGANEEDMPGESMDHTSFIRQWSDYTI

SEQ ID NO: 35656 - protein, 231 aa, Brassica napus
  misc_feature (213)..(213): Xaa can be any naturally occurring amino acid
MEGIIGNDKSSCSSSSTVPGPCLSKYVDPSSEESHRYYLARRNALEMLRDRGYEVSLEDTNLSLQDFRTVYGERPDGDRLRISAHHRSDSSNKVKVVVFGTGKVKVNTIRSVAAEILSQETITGLILVLQNQVTDKALKAIELFTFKVEIFQITDLLVNLTKHVLSLRHRVLTDGEKKALLKQFNIEEKQLPRISKKDAVVRYYGLEKGQVVXVSYRGELTESYVAYRCVW

SEQ ID NO: 35657 - protein, 152 aa, Thermus thermophilus
MRIGYGEDSHRLEEGRPLYLCGLLIPSPVGALAHSDGDAAMHALTDALLSAYGLGDIGLLFPDTDPRWRGERSEVFLREAMRLVEARGAKLLQASLVLTLDRPKLGPHRKALVDSLSRLMRLPQDRIGLTFKTSEGLAPSHVQARAVVLLDG

SEQ ID NO: 35658 - protein, 458 aa, Oryza sativa
MDTEILCLRFGRVHVIAVASPEMAREVLRKKDAMLASRPSSFASRTFSFGYKNTIMSPAGDQWRKMRRVLTSEILSPAMERRMLGRRVEEADHLVNYVYSHCNDGTVDVRHVTRHFCGNIIRKLVFGRRHFNSGDGNIGPGRDEEAHIDALFTALDYHGAFSVSDYFPTLVGLDLDGHEEVVNGLMNTFNRLHDPIIMERIEEWKSLRTKGDKRREVADFLDVLISLEDAQGKPFLSVDEIKAETLEIILATVDNPSNAVEWALAEMVNNPKVMKKAVDELDMVVGRERLVEESDIHNLTYLKACIREAFRLHPYHPFNPPHVAIADTTVAGYMIPKGSHVMLSRIGLGRNPRAWDKPLEFQPERHLKNTGTVVLAEPELRFVSFSAGRRGCPAVSLGTSITMMLFARLLQGFSWSIPPGGDRIELQESATSLQLSKPLFMQAKPRLLLHLYEADVLN

SEQ ID NO: 35659 - protein, 593 aa, Schizosaccharomyces pombe 972h-
MSYSKSTIYRRQGTEPNSHFRRTVEEKSQLSGTNEESLGGHTLSSNAFKNNSSSISPSSSAKDPREQRKRTFPLNDTHSSRARQHERPFRSRKSRRRKGKKAFSPRPGSPPSPSFYRSGSQKRARNLTTKDYFAKRSESSSSASVSPISPSANRNDSKRQASSFRRSPPSSVHMKPSAFNGRKVSRRPSSSPPPIPSIPHETTSSDTQKKSSVSSGFPENKHGKFHFHIPNERRSRFDQPPSKRMALTSTARESVPAPLPSPPSGPIYTYTYPKPAYEKIDQIGEGTYGKVYKAINTVTGDLVALKRIRLEQEKDGFPITTVREVKILQRLRHKNIVRLLEIMVEKSSVYMVFEYMDHDLTGVLLNSQLHFTPGNIKHLSKQIFEALAYLHHRGVLHRDIKGSNILLNNNGDLKFADFGLARFNTSSKSANYTNRVITLWFRPPELLLGETAYDTAVDIWSAGCIVMELFTGKPFFQGRDEISQLEVIYDMMGTPDVHSWPEVKNLPWYELLKPVEEKKSRFVETFKEILSPAAIDLCQKLLALNPFCRPSAHETLMHEYFTSESPPPEPAVILKNMQGSWHEWESKKRKSKR

SEQ ID NO: 35660 - protein, 327 aa, Synechocystis sp. PCC 6803
MGIGVNSDPKVVHHQSIPKPNAMAIANYRAITTKQWQTWVEAARLQALNGKLPQYIPQLSLVDPGNFALDIGDQNGIIYEAGDTDLTFSLMSVVKPFLWLYILHHRGWQWAEQKVGDRPSHLPFNSVEQLEQDGGYPRNTMVNSGAICLAGHIPGATIEQRCENFLTWLNHTAQCQLWLDQELLASVHSLPNPRNLAIAHLLAAKGYVEDATLALETYNQLCCLSGCLKDLFKLGLMLQCPQPPLQPDTTARVKATMAKAGLYEMSEAFFRRTGFICKSGVSGLILACLPAPSPTIFACYSPPLNEEGNPVAPLALLEFLAEFTSRN

SEQ ID NO: 35661 - protein, 334 aa, Thermosynechococcus elongatus BP-1
MVILCRLWITGSNSSDLSSSIKSIFGHPSLKNKQKSNLHSPDQRNSVILKKKDFCGCIAPMNILGSLLTPSPTPVQTRPRRGIEIKSKREIEIMRQASRIVATVLKEISQIIEPGMTTADLDAYAEKRIREMGATPSFKGYQGFPASICACINNEVVHGIPSPRKVIRNGDIVKIDTGAYYNGFHGDSCITIPVGEISEEAAKLVKVAEEALYRGIEQVKEGNYLMDLAGAIQDYVEANGFVVVEDFTGHGVGRNLHEEPSVFNFRTHDLKNVRLRAGMTLAIEPIVNAGSKQVRILRDRWTAVTVDNSLSAQFEHTVLVTKTGYEILTDRTLV

SEQ ID NO: 35662 - protein, 356 aa, Schizosaccharomyces pombe 972h-
MFKSLVRKSSAFQPLKYGGKYTVTLIPGDGIGRETSNAVTEIFKTANVPIEFEEIDVTGMEKNNKSSGDALHEAIQSLKRNKVGLKGILFTPFEKGGHTSFNVALRKELDIYASLVLIKNIPGFKTRHDNVDFAIIRENTEGEYSGLEHQSVPGVVESLKIITEYKSKRIAQFAFDFALQNGRKSVTCIHKANIMKLADGLFRRTFYDVANGYDAITPKDLIVDNASMQAVSRPQQFDVLVMPNLYGSILSNIGSALVGGPGVIPGANFGRDYALFEPGCRHVGLSITGRGEANPTAAILSACLMLRHLGLKDYADLINAATYSVIEEGKTLTKDLGGSASTGDFTHAILERMESL

SEQ ID NO: 35663 - protein, 386 aa, Aspergillus parasiticus
MTGLDMETIFAKIKEEYARTDDVGKRQIQGHIRELQVGFYSDWDVVMRLSSGPLQVALTKVGIDLGIFRSLKESDTPITLAEIVKKTGASPRLLGRILRTQAAFGLIKETGPQEYTSSAFTDVFANSDAAGAVVQLFDISGPCTQILPDFLAERNYQDITSNKDCVFQKAFGSDLTMFEWMPQHPKHMESLGHLMALERPVSWVDHYPVLEELGGFPAPDKVLMVDIGGGFGQQSKALRAKFPDLPGRLIVQDIPQTLANAQPAAGIEFMEHNFFEPQPIQNAKFYYLRHVFHDWPDEQCVLILKQIIPAMGPESQILIDEMVIPSTGVPWQAAFTDLLMMNSLGGVERTRAEWDDLMEQVGLEIIQSKVYDSKEQAILVAVPKRT

SEQ ID NO: 35664 - protein, 215 aa, Leuconostoc mesenteroides subsp. mesenteroides ATCC 8293
MHKINIDGYSVQEVYEDMKQRNVPGTSEKLAQAHVTIAGAGGLGSNIAIALARAGVGHLTLIDFDAVELSNLNRQQFKLSQINVPKVIALKQNILEFNPFITISTIQERVTSQNVEALFGDSDIICEAFDDPHSKAVLLGSSREIFPNKPLVMGNGLAGIHSPNNIKTRQQSENVYICGDNISAGVEGLMAPRVLVCAGHQANVILQLILGKVAL

SEQ ID NO: 35665 - protein, 261 aa, Zea mays
WVAMRLIHGQGHQRANNETEEARKKIRKFKESAWECVYFLSGELLSLSVTYNEPWFTNTRYFWVGPGEQVWPDQKIKLKLKAVYMYAAGFYTYSIFALMFWETRRSDFGVSMSHHVATVVLIVLSYVFRFARVGSIVLAIHDASDVFLEVGKMSKYSHCDWLANVSFLFFVISWVLLRLTYFPFWILRSTSYEVLLTLDKKKHNFDGPIYYYVFNSLLFSLLVLHIYWWVLIYRMLVRQIKTRNVGDDVRSDSEGEDDHED

SEQ ID NO: 35666 - protein, 189 aa, Staphylococcus epidermidis RP62A
MSLINKEILPFTAQAYDPKKDEFKEVTQEDFKGSWNVVCFYPADFSFVCPTELEDLQNQYAKLQELGVNVYSVSTDTHFVHKAWHDHSDAISKLEYSMIGDPSQTITRNFDVLDEETGLAQRGTFIIDPDGVVQAAEINADGIGRDASTLVNKIKAAQYVRQHPGEVCPAKWEEGSESLQPGLDLVGKI

SEQ ID NO: 35667 - protein, 355 aa, Oryza sativa Indica Group
MALMLAAFLCEAISVRFVSTVLGLQWHRSTAPLPDTGQWLLLALNEKLPQIVVDLLRAPIISLHHYLMLFIMLGFSALFDCIKGPGLGIAARYMFTMAVGRSLRTVTFLATILPSARPWCAEARYQIPDHPHPWAQKYYAPYASDPDAIRRVIQEDMPYAFVKEYPGEYRPSWGHMSFLVDILRPTVEEGSSWYHFLKKASGGCSDLMYSGHMLVAVLTAMAWTEAYGGWISVVIWFLVLHSAQREIRERHHYSVDCIVAIYVGILLWRMTGFIWSAIDNSRARRLAKLDKVQNRLFQAAKDSDMDEIRGLLNEVELAGQERKGFSQRVILSFSSAMIVFTLSCVLLAFTLTSDG

SEQ ID NO: 35668 - protein, 279 aa, Picea sitchensis
MLLLAFLGLLFSILGLKTLVYFLVLGAWFLVAGTFILCGVFVLLNSAVGDTCVAMKEWVAHPYEDTALDHILPCVDVATAEQSLNQSKEVTSKVVAVVNQVLSTVANSNLPPNAGPLYYNQSGPLVPTLCSPYTVRLDNRQCNAGEVNLTNAVQVWKNYTCTVSSSGICATTGRITPDIYKQLVLAVNISYGLYHYTPFLVNLEDCTFVRDTFGTITENYCPGLREHLRWVYIGLAFVSTGIMLSIIFWVVYSKQRRRRDEYLKQHGDGQFMARDNKSV

SEQ ID NO: 35669 - protein, 500 aa, Arabidopsis thaliana
MATIWFLSLLFLCCILLAAFKHKKRRTNQQQPPSPPGFPIIGNLHQLGELPHQSLWSLSKTYGPVMLLKLGSVPTVVVSSSETAKQVLKINDLHCCSRPSLAGAKELSYNYLDIAFSPFDDYWKELRRICVQELFSAKRVHSIQPIKEEEVRKLIVSATESASQKSPVNLSEKFLDLTVSVICKAAFSLDFHTSVLNNDGFDKLIHDAFLFLGSFSASNFFPNGGWIIDWLTGLQRRREKSVKDLDVFYQQMFDLHKQENKQGVEDFVDLLLKLEKEETVLGYGKLTRNHVKAILMNVLLGAINTSAMTMTWAMAELIRNARVMKKVQSEIRNQMINKSVITLDDIDHLPYLKMVIKETWRLHPPVPLLLPREVMSEFEINGYKIQPKTLLYVNVWAIGRDPDSWKDADMFYPERFMDNNIDAKGQNFELLPFGSGRRICPGMYMGTTMVEFGLANMLYQFDWEVPDGMVVEDIDMEESPGLAVGKKNELLLVPVKYLGH

SEQ ID NO: 35670 - protein, 205 aa, Lactuca indica var. laciniata
NDDFRRGKPTNHIVYGEDVAVLAGDALLSFSFEHITTATKGVSSDRILRAIGELAKCIGSEGLVAGQVVDVCSEGADVGLDHLEFIHLHKTAALLEGSVVLGAIMGGGSDEEIEKLRKFARSIGLLFQVVDDILDVTKSSEELGKTAGKDLVAGKTTYPKLLGIEKSREFAEKLNKEAQEQLSEFDQRKAAPLIALANYIAYREN

SEQ ID NO: 35671 - protein, 310 aa, Yarrowia lipolytica CLIB122
MSLTTSTITLNDGRAMPALGLGTFQNDACEQVVYDAIKAGYRHIDTAFIYRTEEAVGNAVERAISDGIVARSDLWITTKVWPTYHDRVPQSVDKSLALLKTDYIDLLLVHWPVALNGDPNDDYSFLPKREDGEIDITEGDDWISFYKQLETEQKTGRVKSIGVSNVSSVYLERLLEHASVIPAVNQFENHPLLPQKDQIEANLKQGIQITAYSPLGSGQGVINLHENPTIVELAEKYNTSTASILINWHICQGRSVIPKTANSLRVVSNAVKVEISAQDLAKIDAISAEHGTHRTVPFHLFKKDCLGYPV

SEQ ID NO: 35672 - protein, 1342 aa, Oryza sativa
MRFGTYEASYDNLPRLLGVIEGRNPGSSYAVKKFPSIEHPGKSVLQRVFLALHACKMAFVNCRPVLCIDGTFLTGKYRGQILTAIGVDGNNQVLLLAFAFVESENTDSWYWFLKLVKTKVISMRPNVCLIHDRHAGILRAIEELQFGSMERGYPGEWEDVQSRWCMRHMGANFFKQFKNKELMNMFKRLCNQNQEKKFNEFWKRLDELTAKCSDQRAAAPSTAVADPPQALGPLPMDSPTLVRRTGVEIRKFSQWILHEPKEKWAKAYDTSGARYGIMTTNLAEVYNWVMRGVHGLPLVGIVEFILHGTCRYFRDRFQAVLPSMLNNSILFGTFMQKKLEELRIKAMKHRALVQGTQQHRFEILCQDKAGRGIYRKRVKQECVLKADGTCHCSCAKPKLLHRPCTHVIAVATKCGIPDAVYVSQYFSKQAVYHTWSGKIYGFGIAGEFTETNDEGAQLGTFQARTCGDLLTVHDSFVERLREAGLLPMCRLVEDDAGNADPARRWNVDRSLLADLVDRWRPETHTFHLPCGEVEQLQAEADEYSYSRCLEAYLLCLFGWVYTKTDPSATFGGCPLFLSIWAAERIAIGRPEVDQHAYEESLCAERPEVDYPTMGTLWCRRQVKRSYPEFVMEFDRLQPTDVVWEPYSATATQARVPLGMSTLCTRDQAYWMTTVPMVFDICVEPHAPFRVMRQFGFRQPFPVPFPTTVPAAVHRYSRKGQQSAGNWPAKLVTFVEDWLLATEEVVDHEGEPHTEEAYQGYLRWYQPRTRTRVTFAPLEQQAHVASTRELYARHRDQDFARAVDDINRVVVDGSMTIQRLGAGIPTTLLGQTQLYSGYPYRLVPVQLRTFLGRLPLRMEGFVHHSAPRLPRLGLLLCPPQVLRSIKPTTLGRRFFVCPNILDDDFMEPPRRCQYREWIDTIRVLTPPSRVVQLELPEQYRWGGKGPKCKKYEPQALYGLLKLHLAPCCPRDAAKIVRRPKITTVVAQQPPGIRRALADVSNLVNGRAALPVVNRQKAPAAADKCRKPIKQRNENNKAKPEVIVISSDSEKQKKSPAQRAASRRAPIQTLTSILTKCSRASGGVISPKKELIYDIDASDAHNELAVIDYVEDIYRFYRSTENTYRPLCTYMVSQTEINERMRAILTDWLIEVHYRLMLMPETLYLTVYIIDQYLSLENVARNELQLVGVSAMLIACKYEETWAPLLAIVFSAAQFAYDVQLAIMFNAVQFAHDFKDFLVISDNSFSRQQVLSTEKSILNKLQWNLTVPTMYMFILRYLKAALGDKELEHMTSVIAAAAVYAARCTLGPCPEPTMERSSGVPHRLSRATIAVCLLLHDLIFAHEI

SEQ ID NO: 35673 - protein, 451 aa, Polaromonas sp. JS666
MNAAGPSQGAKAPLGGSAAHEVASVGARMNAPVNAKELTARASAPETVLAVARLRQDFPILHRTVHGKPLVYLDNAATSQKPQYVIDCEARYYAELNANIHRGVHSLSQQATEAYEAARDTVQRFIHAARREEIVFVRGTTEAINLVAASYGQRLRPGDEILITEMEHHSNIVPWQLLCERTGAVLRVAPIDDAGELRLDEFERLLGPATRIVALTQLSNALGSINPVQRLVALAHAVGAVVLVDGAQAVAHLPVDVQALDCDFYAFSGHKLYGPTGIGVLYGKAALLDAMPPWQGGGDMIREVTFARTTYNDLPYKFEAGTPHIAGGIALGAAIDYVGMVGLPAIAAHEHALLAYATEQAAGMAGLRLIGTARDKASILSFTVEGVHPHDVGTILDDEGVAVRAGHHCAMPVMAHFGVPATVRASFALYNTVEEVDVLLRAIRRAQEVFG

SEQ ID NO: 35674 - protein, 299 aa, Methanosarcina acetivorans C2A
MDRIISVVGHTALDYIIDVENIAGKNESSPVIDYEEYPGGGAANIAVAIAKLGGKSQLMSPVGMDFSSSGYEQLLKDAHVDLSRLYSIEALKLSKAFIFTDREDNQTTYFYWGASSKFKELEPEPVDFAHLATADCIYNAKIAQIAGFVSFDPGQDLVTYSQEKLETILAHTDILFANRHEIKRVSEMTGKSFSELRAMIEVIVITYDAEGSRIYTGNEEWKIPVVSVKAVDPTGAGDAYRAGFLLAYTREYSLPTCGKIGSTVASFAVQSRGCQTSLPTWEEMKSRYEASFGKLEVES

SEQ ID NO: 35675 - protein, 2040 aa, Saccharomyces cerevisiae
SSSWRSAFDVPEWVDPNVQNLVSKVSINEPKLYVPPADNKHIELQTGPDGKVLRILAIDVGMKYNQIRCFIKRGVELKVVPWNYDFTKEDYDGLFISNGPGDPSVLDDLSQRLSNVLEAKKTPVFGICLGHQLIARAAGASTLKLKFGNRGHNIPCTSTISGRCYITSQNHGFAVDVDTLTSGWKPLFVNANDDSNEGIYHSELPYFSVQFHPESTPGPRDTEFLFDVFIQAVKEFKYTQVLKPIAFPGGLLEDNVKAHPRIEAKKVLVLGSGGLSIGQAGEFDYSGSQAIKALKEEGIYTILINPNIATIQTSKGLADKVYFVPVTAEFVRKVILHERPDAIYVTFGGQTALSVGIAMKDEFEALGVKVLGTPIDTIITTEDRELFSNAIDEINEKCAKSQAANSVDEALAAVKEIGFPVIVRAAYALGGLGSGFANNEKELVDLCNVAFSSSPQVLVEKSMKGWKEVEYEVVRDAFDNCITVCNMENFDPLGIHTGDSIVVAPSQTLSDEDYNMLRTTAVNVIRHLGVVGECNIQYALNPVSKDYCIIEVNARLSRSSALASKATGYPLAYTAAKLGLNIPLNEVKNSVTKSTCACFEPSLDYCVVKMPRWDLKKFTRVSTELSSSMKSVGEVMSIGRTFEEAIQKAIRSTEYANLGFNETDLDIDIDYELNNPTDMRVFAIANAFAKKGYSVDKVWEMTRIDKWFLNKLHDLVQFAEKISSFGTKEELPSLVLRQAKQLGFDDRQIARFLDSNEVAIRRLRKEYGITPFVKQIDTVAAEFPAYTNYLYMTYNADSHDLSFDDHGVMVLGSGVYRIGSSVEFDWCAVTAVRTLRANNIKTIMVNYNPETVSTDYDEADRLYFETINLERVLDIYEIENSSGVVVSMGGQTSNNIAMTLHRENVKILGTSPDMIDSAENRYKFSRMLDQIGVDQPAWKELTSMDEAESFAEKVGYPVLVRPSYVLSGAAMNTVYSKNDLESYLNQAVEVSRDYPVVITKYIENAKEIEMDAVARNGELVMHVVSEHVENAGVHSGDATLIVPPQDLAPETVDRIVVATAKIGKALKITGPYNIQFIAKDNEIKVIECNVRASRSFPFISKVVGVNLIELATKAIMGLPLTPYPVEKLPDDYVAVKVPQFSFPRLAGADPVLGVEMASTGEVATFGHSKYEAYLKSLLATGFKLPKKNILLSIGSYKEKQELLSSVQKLYNMGYKLFATSGTADFLSEHGIAVQYLEVLNKDDDDQKSEYSLTQHLANNEIDLYINLPSANRFRRPASYVSKGYKTRRLAVDYSVPLVTNVKCAKLLIEAISRNITLDVSERDAQTSHRTITLPGLINIATYVPNASHVIKGPAELKETTRLFLESGFTYCQLMPRSISGPVITDVASLKAANSVSQDSSYTDFSFTIAGTAHNAHSVTQSASKVTALFLPLRELKNKITAVAELLNQWPTEKQVIAEAKTADLASVLLLTSLQNRSIHITGVSNKEDLALIMTVKAKDPRVTCDVNIYSLFIAQDDYPEAVFLPTKEDQEFFWNNLDSIDAFSVGALPVALANVTGNKVDVGMGIKDSLPLLLAAVEEGKLTIDDIVLRLHDNPAKIFNIPTQDSVVEIDLDYSFRRNKRWSPFNKDMNGGIERVVYNGETLVLSGELVSPGAKGKCIVNPSPASITASAELQSTSAKRRFSITEEAIADNLDAAEDAIPEQPLEQKLMSSRPPRELVAPGAIQNLIRSNNPFRGRHILSIKQFKRSDFHVLFAVAQELRAAVAREGVLDLMKGHVITTIFFEPSTRTCSSFIAAMERLGGRIVNVNPLVSSVKKGETLQDTIRTLACYSDAIVMRHSEEMSVHIAAKYSPVPIINGGNGSREHPTQAFLDLFTIREEIGTVNGITVTFMGDLKHGRTVHSLCRLLMHYQVRINLVSPPELRLPEGLREELRKAGLLGVESIELTPHIISKTDVLYCTRVQEERFNSPEEYARLKDTYIVDNKILAHAKENMAIMHPLPRVNEIKEEVDYDHRAAYFRQMKYGLFVRMALLAMVMGVDM

SEQ ID NO: 35676 - protein, 374 aa, Debaryomyces hansenii CBS767
MLQLKPRRIIFNISQNFQVIQVVGEGAYGVVCLAIHKPTGIKVAIKKLEPFEKPLFCLRALREIKLLTYFKKHENIISIFDVQKPLNFENFNEIYLIQEYMPSDLHKTIATQNLTDDHIQYFIYQILRGLKLIHSANVIHRDLKPSNILVNENCDLKICDFGLARLDILKEGYDKRLAINSGISMLTEYVATRWYRAPEIMLTSSQYSTAIDMWSVGCILAELFTCTPLFPGNDYRHQLILIFQLLGTPTDADLTCIKSQRAKNYIKTLPYCSPLSLDQVFNRHPNRAKRFGGQPINPLGLDLLKKLLVFDPKERLTVEEALEHPYVSTYHDPEDEPTIMPIPHEDFEFDKSKDKLSILELKRQLYNDIIKCNR

SEQ ID NO: 35677 - protein, 644 aa, Oryza sativa Indica Group
MAAEAAAEIVREIAAVGAADLAAAAEPLRADCLRLARKVSLLSHLVAEVAEAGAGGGDADAADSWLGDLVRALQAARRFVELGRAPARPSRASDQVRAETIWDAVCNNVAVQFKFVTWQLQTVLARLPQSCFQISDEVQEEVDLVRAQLQREMEKKGDIDVNIFSKFHDILALHVSTVGSQSEQSHGQPDTPQMENLCNGHLELQNIIMLVSEISGVPKSDAERITSQLIEGLENMRVTDSKKPVSVSQSSDETKASPETHKKSDAVAIPEDFRCPISLELMRDPVIVSTGQTYERAFIQRWIDCGNRTCPKTQLKLQNITLTPNYVLRSLILQWCEEKGIEPPTRSKNDGAYLEVGGERVAIETLVRNLSSSSLDERKSAAAEIRSLAKKSTDNRILLAESGAISALVKLLSSKDLKTQEHAVTALLNLSIYDQNKELIVVAGAIVPIIQVLRKGGMEARENAAAAIFSLSLIDDNKITIGSTPGAIEALVELLQSGSPRGRKDAATALFNLCIYQANKVRAVRAGILAPLIQMLQDSSRNGAIDEALTILSVLVSHHECKIAIAKAHAIPFLIDLLRSSQARNKENAAAILLALCKKDAENLACIGRLGAQIPLTELSKTGTDRAKRKATSLLEHLSKLQVL

SEQ ID NO: 35678 - protein, 392 aa, Prochlorococcus marinus str. AS9601
MKAMILAAGKGTRVQPITHVIPKPMIPILQKPVMEFLLELLREHNFKEIMVNVSHLAEEIENYFRDGQRFGVEIAYSFEGRIEDGELIGDALGSAGGLKKIQDFQNFFDETFVVLCGDALVDLDLTQAVKKHKQKGAIASLITKKVTKDQVSSYGVVVSDENGRIKAFQEKPTVDQALSDSINTGIYLFEPEIFNYIPSAEKFDIGADLFPKLVEMDLPFFALPMDFEWVDIGKVPDYWTAIRNVLLGKVRQVQIPGKEIKPGVFTGLNVAANWEKVNITGPVYIGGMTRIEDGATIIGPSMIGPSCCICEGATIDNSIIFDYSKIGKGVRLMDKLVFGKYCVGKNGDHFDLQDASLDWLIADSRRSDLTEPSPQQKAMAELLGTDLINIPD

SEQ ID NO: 35679 - protein, 621 aa, Synechocystis sp. PCC 6803
MVASIPNPKTNFLKTVPSQRQTGAYILMDSLKRHGVKHIFGYPGGAILPIYDELYRFEAAGEIEHILVRHEQGASHAADGYARATGKVGVCFGTSGPGATNLVTGIANAHLDSVPMVVITGQVGRAMIGSDAFQEIDIFGITLPIVKHSYVVRSAADMARIVTEAFHLASTGRPGPVLIDIPKDVGLEECEYIPLDPGDVNLPGYRPTVKGNPRQINAALQLLEQARNPLLYVGGGAIAANAHAQVQEFAERFQLPVTTTLMGIGAFDENHPLSVGMLGMHGTAYANFAVSECDLLIAVGARFDDRVTGKLDEFASRAKVIHIDIDPAEVGKNRAPDVPIVGDVRHVLEQLLQRARELDYPTHPHTTQAWLNRIDHWRTDYPLQVPHYEDTIAPQEVVHEIGRQAPDAYYTTDVGQHQMWAAQFLNNGPRRWISSAGLGTMGFGLPAAMGAKVGVGDEAVICISGDASFQMNLQELGTLAQYDIQVKTIILNNGWQGMVRQWQQTFYEERYSASNMSQGMPDINLLCEAYGIKGITVRKREDLAPAIAEMLAHNGPVVMDVVVKKDENCYPMIAPGMSNAQMLGLPEVPVRDNGPRMVECNHCQTQNFITHRFCSGCGAKL

SEQ ID NO: 35680 - protein, 387 aa, Xylella fastidiosa Ann-1
MSTEVKVPVLPESVSDATIASWHKKAGEIVKRDENIVDLETDKVVLEVPSPVDGVLKEIKFDTGSTVTSNQVLAIIEEGSIVAAPSQVIDQKPVAVSAPAAKSNVDSLPPGARFTATTEGIDPAHIEGSGRRGAVTKEDIINFAKQNGAARSSGTRLEERVPMTRIRQRIAERLMQSKNSTAMLTTFNEINLAKVSNIRKELQEEFQKAHGIKLGFMSFFVKAVANALQRFPLVNASIDGTDIIYHGYSDISIAVSTDKGLVTPVLRNVERMSFADIEHRIADYAKKARDGKLSLEELQGGTFTVTNGGTFGSLLSTPIVNPPQSAILGMHTIKERPIAENGHIVIAPMMYVALSYDHRIIDGKDSVQFLVDIKNQLEAPGRMLFGL

SEQ ID NO: 35681 - protein, 174 aa, Zea mays
MAAAEPSGSSQPGAPGRWSLHGKTALVTGGTRGIGRAVVEELAALGVAVHTCSRKEAELGERLKEWEARGFRVTTSVCDLSVREQRERLIADVAERFGGKLNILVNNVGTNIRKPTTEFSAEDYSFLMATNLESAYHLCQLAHPLLKASGLGSIVFISSVCGLVAVFSGTLYAM

SEQ ID NO: 35682 - protein, 127 aa, Euphorbia tirucalli
NDDLRRGKPTNHIVYGEDVAVLAGDALLAFAFEHIAVSTLNVSPARIVRAIGELAKAIGAEGLVAGQVVDISSEGLSEVDLERLEFIHIHKTAKLLEGAVVLGAILGGGTDEQVEKLRKYARGIGLL

SEQ ID NO: 35683 - protein, 94 aa, Zea mays
MDGQPGAAASSSPGPRVKASLVLGSESFTINSESGTLSEQLAAVKEKSMAVLKEHIARHNAPNEVPDEAAEGESDSEGEAPLVDNPPKKPKKQK

SEQ ID NO: 35684 - protein, 270 aa, Synechococcus sp. CC9605
MQPAFGVIGLGRMAQALVLPLLERGRIPADQLLAVVGESVSLEQRRGALPAGIGLVAADDPSAQQVWTAPVQLLAVKPQQLDAVAAVSGPVVGEPLLISVLAGVSLARLQHLFPGHRCVRAVPNTPALVGAGLTALAWGEGIDPEQQDQVRQLFADVGEVLELAEAKLDAFLALTSSGPAFVALVAEAMADGAVAAGLPRDLALRLSHRTLAGTAELLDRRDLHPAQLKDMVTSPGGTTIAGVRALERIGLRSALIEAVVAAAERSRELA

SEQ ID NO: 35685 - protein, 484 aa, Pseudomonas fluorescens Pf-5
MSESYDVIVIGAGPGGYVAAIRAAQLGLKTVCIERYKGKDGKTALGGTCLNVGCIPSKALLDSSHHYYEARNGFEVHGIAISNPQMDVPAMLARKDNVVRNFNGGIASLFKANGVALLEGHGKLLANKEVEVTAADGSTQRISAGNIILAPGSRPIDIPAAPLAGEVIVDSTGALEFTQVPKRLGVIGAGVIGLELGSVWARLGAQVTVLEALDSFLPAVDAQIAKEAQKILGKQGLDIRLGARVTACEVQGDSVKVSLSEAGEDKQQVFDRLIVAVGRRPLTTDLLAADSGVHLDERGFIHVDGQCCTSVPGVFAIGDVVRGPMLAHKASEEGVMVAEGIAGHRHPLNYDLIPSVIYTHPEIAWVGQTEQALKAEGVELNIGTFPFAASSRAMAANDTAGLVKVIADAGTDRVLGVHVIGPGAAELVQEGAIGMEFGTSAEDLGMMVFSHPTLSEALHEAALAVNGQAIHIGNRKKKAPAGVK

SEQ ID NO: 35686 - protein, 304 aa, Gibberella zeae PH-1
MASSRTMSRTLAALTRPVTETSSRAVPRWTRSMATVRSRIPSISSGLRPLAQRQRIVRTATPSLAGIGSGVRTIFIQTENTPNPDALKFLPNHRVVPEEFSTPFIEYLNPRATISPPHPSPLAAKLMNIDGVTSVFYGADFITVTKAADANWAHIRPEIFALITEAITAGEQIVTISERREGEAGAPVEEDSLAYNENDSEVVGMIKELLETRIRPAIQEDGGDIDFRGFDDEGYVHLRLRGACRTCDSSTVTLKNGIEGMLMHYIEEVKGVKQVMDQEEEIALQEFEKFEEKLKQQKGQAASA

SEQ ID NO: 35687 - protein, 372 aa, Polaromonas sp. JS666
MSITTTNQASKKRIAVIAGDGIGKETMPEGVRVLDAAARKFGIDLHFDHFDFSSWDYYEKHGQMMPDNWKDQIGGHDAIYFGAVGWPEKIADHVSLWGSLLLFRREFDQYINLRPARLMPGIIAPVVRRDGSPRQPGEIDFYIVRENTEGEYSSIGGRAFPGTDREFVLQESVFTRVGVDRVLKFAFELAQSRPKKHLTSATKSNGISISMPYWDERVAEMAKSYPAIRLDKFHIDILTAHFVQRPDFFDVVVASNLFGDILSDLGPACTGTIGIAPSANLNPERKFPSLFEPVHGSAPDIAGRNLANPIGQIWCGAMMMEFLGHKEAHDAILAAIEKVLRPDSGAPRTPDLGGKAGTADVGKAVAAALAEV

SEQ ID NO: 35688 - protein, 220 aa, Synechococcus sp. CC9605
MTDSFAARWQALQAVRPSSSRLLAVSKGHPAASVRCVAELGQCDFGESRVQEALPKQEALIDLNLRWHFIGRLQSNKVRPVVKAFDVIHSVDSLSLAERVSRIALEEDRRPEVLLQVKFRPDPSKGGLSAEELGAIWSDLQALPGLRISGLMTMAPLDMAAEQRKALFSDCRALADQLALAECSMGMSTDWKEAAEAGSTWLRIGSALFGPRLVSTDAAN

SEQ ID NO: 35689 - protein, 764 aa, Yarrowia lipolytica CLIB122
MALMQPLANEFEMKEPVLKKRRIGATQMEPQLTIVEENNHSGAPSSQTQNGGAVASYPDHVTNQVISSLTCPPNLQVAHDYANHKTPSFEVQAYAKLAGQNWTYFVQKLHVIIGRSSEQQEVDIDLGPAKVVSRKHASIEYNSEAQQWQLWVRGRNGVKVDRVVYKEGHVALRSGSVVDIGGVQMMFVLPGQKVELSGVWVEEAEQQQQQQQGHVADTSSNHMTSLPHPQMTPTHHQIGHMNSLTDISDISMASHMSMDDFNHSFTSLADRVSPSRGKSVFSVYSGVDHGGHHSPHVAHAQPQQPQQAPHLQTQLPQQQQQQPLPLPSGNMTSSSYPRGVALISRPQIRNHTNHYTDYDLSLDDAKDIKPPYSYATMITKAILSGEEHMMTLAEIYEWISKHYSFYRHSRTGWQNSIRHNLSLNKAFVKVPRRSDEPGKGMKWQVTPEHKEEFLRKSKGGELVKKRPAGTLTLQRTGGASGGHVGGVTGGSMSTFVVAPPPPGGEQICLGTGPVIPQQSAQPSLGGLAGGSGREGRGSIDGATPNLAHPNSSQSQNSSANSQGASNSNSSSNHGGSSNNSEQPSEQSSGSNNPLSTPRKDQFGGVGFEDFAFTPSPRYKETFTPDRLSNISASRSTVNMGVAATKTESGTGTTPSVAGATTLPTTSATPAPAAPNLSLAPPSAQQQLPSSFMPASSPAPFWRFMQLSSTPVRGGEGFSPVKYSPSREGGSGARGGDADGLGDLQNIDLTRGFKNWQDSPAKVAK

SEQ ID NO: 35690 - protein, 434 aa, Burkholderia pseudomallei K96243
MSSQSQSPSVAQSIPSYLHADDLGPWGNYLQQVDRVAPYLGSLSRWIETLKRPKRILIVDVPIELDNGTVAHFEGYRVQHNVSRGPGKGGVRYHQDVTLSEVMALSAWMSVKNAAVNVPYGGAKGGIRVDPRKLSRGELERVTRRYTSEIGIIIGPNTDIPAPDVNTNEQIMAWMMDTYSMNQGQTATGVVTGKPISLGGSLGRKEATGRGVFVVGCEAAKKKGLEIEGARIAVQGFGNVGGIAAKLFQEAGAKVIAVQDHTGTIHQPAGVDTVKLLEHVGRTGGVAGFEGAEPMPNDEFWTVETDILIPAALENQITEKNASKIRTKIIVEGANGPTTTAADDILSANGVLVIPDVIANAGGVTVSYFEWVQDFSSFFWTEDEINHRLERVMREAFAGVWAVAEEHNVSVRTAAFIVACKRILMAREMRGLYP

SEQ ID NO: 35691 - protein, 334 aa, Glycine max
MASLVNNANGAVNGFPGISQKLIIDTDPGIDDSMAILMAFQSPDVEVLGLTTIFGNTTTELSTLNALLLCEMAGREDIPVAQGSHEPLKGGKPRVADFVHGKDGLGNTFLPPPKGEKIEKSASEFLVEKVSEYPGEVSVLALGPLTNLALAIKRDSSFASKVKRIVILGGAFFALGNVNPAAEANIHGDPEAADIVFTSGADIVVIGINITTQVQFTDADLLELKESKGKYAPFLSDICKFYRDFHVKSDGVHGIFLHDPVSFVAVVRPDLFTYKKGVVRVETQGICVGHTLMDQGLKNWNTSNPWTGYSPVAVAWTVNLEEVLDYIRELVMKP

SEQ ID NO: 35692 - protein, 688 aa, Candida albicans SC5314
MSHSNALPNSPFRSPKKQRMEVIGPLNASRFSFSPVKTPPHGRAGLSSPEKRLVKDLDKSARKRANNSLYNRLMDEYSDTDDYLDEQDRILADRIIKQSRGEPDEVNYGSDVELEIDLTQQRRTRRREKKVVYSSDSSNEYEDTGMPEESSSEEEEADDDDGNVEFVYGPPKERKTSLSSSPPTVKPTVRRTKRGRPSKSELVSGQIKSIFHQDDVLFSTDRKTFTPTKPTAAKKPVSNYLTSIFDQNFDRSKVPSLSGIPKSTNTHEEKKTFVPLPIPTLDADGNITDKEYISKYFDGVDPAKFKEGRFVDEKVFYLEGPEGYFEQQTTRVKQSGNSLTALAPQIEYKDFARLVKLGDNLSFQRKRHLFELHKYIYHQWCFEMSQGFNLNFYGVGSKIDLLRDFATNYFGIWWENVVHADLPKVLVVNGFNPSINIKKLILEIASILLPNESYPKHIAGTVPFVVDYLNNHRSPCGSIGFHKPKILLIIHNLDGEVFRVDKTQTLLSQLMTLPEVWAMSSTDHINASLLWDSSKVKNLNFIWHNLTTYATYQRETSFRDVISLGKSKKFVGGLGAKYVLRSLTDNHRNLYRELLIAQLDKMEKAVPSASGRVGLKGNAKVAVDLKSLYNTCLDEFITSNEMNFRTFLKEYVEHKMCQLVKDPSGVEKVFIPFTYEEIQNIYKQEFDV

SEQ ID NO: 35693 - protein, 312 aa, Synechococcus sp. CC9605
MSSASKRRGIILAGGSGTRLHPITQAVSKQLLPVYDKPMIYYPLSTLMLAGIREVLIITTPHDREAFERLLGDGSRWGMTIEYAVQPSPDGLAQAFLIGADFLAGHPAALVLGDNLFHGHDLVPQLVNSNDQPLGATVFAYPVSDPERYGVAEFDSDGRVLSLEEKPQQPKSRYAVTGLYFYDDSVVERAREVKPSARGELEITDLNQVYLDEGLLRVELMGRGMAWLDTGTCDSLNDAGSYIRTLEHRQGLKVGCPEEVAWRQGWITAEQLDQLAQPLKKSGYGSYLLQMLEENVSDHAALQTSLEVSHAV

SEQ ID NO: 35694 - protein, 569 aa, Magnetococcus sp. MC-1
MARRAKIVATLGPACSSVEQITRLIEAGLDVARLNMSHGDHKAHLELIHNVREASRIAKREVALLCDLQGPKIRVGHLDEPLRLEKGQQWAIIPEGSHPPKLKCDGIIPCTYAGLAKDAVPGCRILFDDGYLQARAIGTEEGALLVNIEHGGLLKSHKGINMPDASISAPSLTTKDQQDLFFGVKHDVDYVALSFVRSAKCVQNVKFMLHRRKIYKPIIAKIERPEAIRNIDEIIKVVDGIMIARGDMAVEIGNHRVPSVQRQIIQKCRAKGKPVITATQMLESMIQNPSPTRAEASDVANAIWDGTDAVMLSAETSVGVDPINTVLTMGRIVEEAERNPRGPRLDAESHSISSASMMAAARVAEQVSARWIIALTVTGSSALSLARFRPEVPVLGAARTQGGVRRMNLYWGITPRLFNYSIEEREDIEPEVIQWMREQSMLQVGEKIVVVKGGGLLSNHSTSSSIRVDLVRDTRNIDEGVSQITQESVAGKGIITLDAARCVACGNCVNICPYGIWVAAASNTRSVSFNRDQVDNCSLDQECVRVCSSHAITITDAKDMHEWVEKEEL

SEQ ID NO: 35695 - protein, 343 aa, Vibrio cholerae O1 biovar eltor str. N16961
MKIKALSKLKPEQGIWMNEVDMPELGHNDLLIKIKKTAICGTDVHIYNWDEWSQKTIPVPMVVGHEYVGEVVGIGQEVRGFQIGDRVSGEGHITCGHCRNCRGGRTHLCRNTIGVGVNRTGCFSEYLVIPAFNAFKIPDGISDDLASIFDPFGNAVHTALSFDLVGEDVLITGAGPIGIMAAAVAKHVGARHVVITDVNEYRLDLARKMGVTRAVNVAEQNLEDVMKELGMTEGFDVGLEMSGVPSAFSAMLKTMNHGGRIALLGIPPSSMAIDWNQVIFKGLVIKGIYGREMFETWYKMASLIQSGLDISPIITHHFKVDDFQKGFDIMRSGASGKVILDWQ

SEQ ID NO: 35696 - protein, 409 aa, Zea mays
MQFALALDTNSGPHQIRSCEGDGIDRLEKLSIGGRKQEKALRNRCFGGRVAATTQCILTSDACPETLHSQTQSSRKNYADANRVSAIILGGGTGSQLFPLTSTRATPAVPVGGCYRLIDIPMSNCFNSGINKIFVMSQFNSTSLNRHIHRTYLEGGINFADGSVQVLAATQMPEEPAGWFQGTADSIRKFIWVLEDYYSHKSIDNIVILSGDQLYRMNYMELVQKHVEDDADITISCAPVDESRASKNGLVKIDHTGRVLQFFEKPKGADLNSMRVETNFLSYAIDDAQKYPYLASMGIYVFKKDALLDLLKSKYTQSHDFGSEILPRAVLDHSVQACIFTGYWEDVGTIKSFFDANLALTEQPSKFDFYDPKTPFFTAPRCLPPTQLDKCKMKYAFISDGCLLRECNI

SEQ ID NO: 35697 - protein, 370 aa, Methanosarcina acetivorans C2A
MKEISFSENVSRIDTSGIRKIFEAAGSNAINLGLGQPDFDTPVHIKTAAIEAINEGFTGYTVGPGIPELREALSQKFLEENGFSVSPQEIIVTSGASEALTIALAALLNVGDEVLISNPGFVSYNALTEILNGKVVSVPLAEDLTMKPDAVLERITPKTKALILNSPSNPTGAVSSRADIKALAEIADDHNITIISDEVYEYFIYEGEHVSPASYSDNVVTINATSKSYSMTGWRLGYLAARKEYIAQMNKVHQYIQACANSIAQKAAYAAVTGPKDSVNAMREEFRKRRDLLVKGLNELGMECAFPKGAFYAFPKVENSAEVASKMISNGVVVVPGTAFGSEGDGYIRISYAASMKDIEKSLAIMEKVL

SEQ ID NO: 35698 - protein, 452 aa, Polaromonas sp. JS666
MRFTDLEQPTTAAGPRMDAAWLDAHWMPYTANRSFKANPRMVVEASGAYLTDAGGRKIFDGLSGLWCSGLGHCRREITEAVSRQVSKLDYAPAFQFGHPLAFELANKIKELTPQGLDYVFFTGSGSEAADTSLKMARAYWRAKGQAGKTRLIGREKGYHGVNFGGISVGGIAANRKLFGQGVEADHLPHTQPPTGSFHRGMPPTGAELADRLLDVIALHDASNIAAVIVEPFSGSAGVVIPPQGYLQRLREICTAHNILLIFDEVITGFGRCGAWTGAEAFGVVPDIMNIAKQVTNGAQPLGAVVATKDIYDTFMDAGGPEYMIEFPHGYTYSAHPVACAAGVAALDVLQKEDMIGRVKALAPHFENAVHSLKGSKHVADIRNYGLAAGFTIAALPGEPARRPYEIAMNCWKKGFYVRYGGDTIQLAPPFISEKAEIDRLINALGDALAETA

SEQ ID NO: 35699 - protein, 448 aa, Polaromonas sp. JS666
MLEPADFTLGCIIVGALLIVMTLSGSFIARLPLSAAMLYLGVGVAIGPMGLGLLKLDALKNVALLERLTEVAVLISLFTAGMKLKLPLTDPRWRIPVQLATVSMLATVGAITALGVWGLGLPLGAAVLLGAILAPTDPVLASDVQVANVGDRDRLRFGLTGEGGLNDGSAFPFVMLGLGLLGLHELGDGGWRWWTVDVLWAVAGGLGLGYLMGTLIGRVILYLRMRHREALGSDEFIALGLIALTYGLALVSQTYGFLAVFAAGLALRRIDELPQVPVAPPAPELSAAEQHASGAEAPAHMMNEVQRFNSQLESFVEVAMVLTVGVLVATVRFHSEVLWFIPVLFLVIRPLAVYLGLLGTPVKGAQRRLMGWFGIRGIGSLYYLLYAISHDIETALAQRLLSITLAVVIASVIAHGISVTPLMKRYEARKTSRRGPDADRPASGTSPE

SEQ ID NO: 35700 - protein, 96 aa, Alexandrium fundyense
VSDVAEREGFGVVKTLVGHGIGEFFHGVPQVFHCRNSDNRKMQEGTTFTLEPVLTEGSRDWITWDDGWTVATSDHGRAAQFEHTLLITANGCEVMT

SEQ ID NO: 35701 - protein, 428 aa, Sulfolobus acidocaldarius
MEKIRWVIEESEKYLANTTRDPESQPLVIDRGEGVWVYDIEGNKYLDFTSGIGVNNLGWPSHPDVIKVAQIQMTRLAHAPANDFYNIPQMELAKRLVQLSPGNFSKKVFFSNSGTESVEASIKLVKGTGRKYLIAFLGSFHGRTLGSLALTASKPVQRYSAGPFSIGVFHVPYPNPFRNPWKINGYEKPDELINAVIEYIDFWLFQHVVDPEEVAGIIFEPIQGEGGYVVPPHNFFAELRKLAQKYNIPLIDDEVQMGLGRTGKMFAIEHFNIEPDIITLAKALGGGLVPVGATIFRSDLDFKKKGIHSNTFGGNALSMSIGLKVVELIKELMPHVNEIGKIFGEELCQMKVDDCRGLGLAWGIEFVKSDKTPDPKVRDRVVTEAFKEGLIVISAGKSSIRIIPPLVISEEAKIGLSKLKTAINRVRG

SEQ ID NO: 35702 - protein, 180 aa, Synechocystis sp. PCC 6803
MTPAKIRNALLAVVAIALSAAVYLGFQTQTQGISLEAQAQRAIPLATALDNGRPTLVEFYADWCTSCQAMAPDLAELKKNYGGSVNFAMLNVDNNKWLPEVLRYRVDGIPHFVYLDDTGTAIAESIGEQPLRVLEQNITALVAHEPIPYANVTGQTSVVENRTIEADPTSPRSHGNPRPS

SEQ ID NO: 35703 - protein, 143 aa, Triticum aestivum
  misc_feature (45)..(45): Xaa can be any naturally occurring amino acid
  misc_feature (58)..(58): Xaa can be any naturally occurring amino acid
  misc_feature (71)..(71): Xaa can be any naturally occurring amino acid
  misc_feature (82)..(82): Xaa can be any naturally occurring amino acid
  misc_feature (96)..(96): Xaa can be any naturally occurring amino acid
  misc_feature (102)..(102): Xaa can be any naturally occurring amino acid
  misc_feature (110)..(110): Xaa can be any naturally occurring amino acid
  misc_feature (112)..(112): Xaa can be any naturally occurring amino acid
  misc_feature (115)..(115): Xaa can be any naturally occurring amino acid
MAPTVMASSATSVAPFQGLKSTAGLPVSRRSNGASLGSVSNGGRXRCMQVWPIEGIKXFETLSYLPPLNTXALLKQVDYLIXRSKWVPCLEFNKVXGSIFRXANASPRVXTXGRXWTIWKLPNFGVRPTKFNKWRQEGYLTVG

SEQ ID NO: 35704 - protein, 514 aa, Triticum aestivum
MEEWLLSLCFIALSTATVLAFWFLKLSGGKADPHKKQLPPGPWTLPVIGSLHHVISALPHRTMMQLSCRHGPLMLLRLGEVPAVVVSTADAAALVMKTHDLVFVDRPRSPTMDIASSGGKDIVFAPYGGHWRQMRKICVVQLLSSTQVSRMEGVRAEEVGSLLRDITAAASTGATINVSEKVMALTNDIVTRAVFGGKFARQCEFLREMDKAFKLVGGFCLADLFPSSRLVRWLSNGERDMKRCHGLIHHIIAEVVENRKAARASGVGRSIPGDEDMLDVLLTLQEDDSLEFPLTTETMGAVLHDVFAGATETTGNTLAWVISELMHNPHTMAKAQHEVRDVLGEGRSVITNSDLGELHYMPMILKEALRLHPPGPLIPRMAREDCTVMGYDIPKGTNVYINIFAISRDPRYWINPEEFMPERFENNNVNYKGTYFEFIPFGAGRRQCPGIQFSSSITEMALANLLYHFDWMLPDGANLASFDMSEKFGFAVSKKYDLKLRAIPHVWSNAMTLK

SEQ ID NO: 35705 - protein, 170 aa, Zea mays
  misc_feature (24)..(24): Xaa can be any naturally occurring amino acid
  misc_feature (45)..(45): Xaa can be any naturally occurring amino acid
  misc_feature (60)..(60): Xaa can be any naturally occurring amino acid
  misc_feature (62)..(62): Xaa can be any naturally occurring amino acid
  misc_feature (68)..(68): Xaa can be any naturally occurring amino acid
  misc_feature (102)..(102): Xaa can be any naturally occurring amino acid
  misc_feature (113)..(113): Xaa can be any naturally occurring amino acid
  misc_feature (140)..(140): Xaa can be any naturally occurring amino acid
  misc_feature (142)..(142): Xaa can be any naturally occurring amino acid
  misc_feature (157)..(157): Xaa can be any naturally occurring amino acid
MASPIPREWVGLQQFPPATQTELXHELLGKLKEEEASTLAILVMXGIGGVGRSPTVSSVXGXRIATVXAFLSEGLRPMMWWRTRAGFTLNIIGPRGLFGGGXIKHQAFDILKXFLRGQTIRDLLDVDPLVALKMDTLVGXVXEPSTLSLRKTIWTKXFALSGSPSASPHA

SEQ ID NO: 35706 - protein, 188 aa, Polaromonas sp. JS666
MFLTIPTLMTWTRIVAIPLIVGVFYLNIAPAERNLIATVMFIVFAATDWLDGFLARRLNQTSSFGAFLDPVADKFLVCASLLVLVHLQRADVFVALIIIGREIAISALREWMALIGATKSVAVHMLGKVKTTVQMIAIPFLLFDGMLLGMINTHVWGTWLIWISAILTVWSMIYYLQKAIPEIRARAK

SEQ ID NO: 35707 - protein, 167 aa, Chlorobium tepidum TLS
MHPEIHDSVFLAEGSYVIGDVKIGAHSSIWFNAVVRGDVCPITIGEKTSVQDNATLHVTHDTGPLKIGSNVTIGHAATLHACTVEDNVLIGMSATLLDHCVVEPWSIVAAGSLVKQGFRVPSGMLVAGVPAKVIRPITEEERANIAESPENYVRYVAHYREEGYEGR

SEQ ID NO: 35708 - protein, 513 aa, Staphylococcus epidermidis RP62A
MEMAKEQELILVLDFGSQYNQLITRRIREMGVYSELHDHEISIEEIKRMNPKGIILSGGPNSVYEEGSFTIDPEIYNLGIPVLGICYGMQLTTKLLGGKVERANEREYGKATINAKSDELFFGLPSEQTVWMSHSDKVIEIPEGFEVIADSPSTNYAAIEDKKRRIYGVQFHPEVRHTEYGNDLLRNFVRRVCNCTGEWTMENFIEIEIEKIRQQVGNRKVLCAMSGGVDSSVVAVLLHKAIGDQLTCIFVDHGLLRKGEGDMVMEQFGEGFDMNIIRVNAQERFMSKLKGVSDPERKRKIIGNEFVYVFDDEAAKLTDVDFLAQGTLYTDVIESGTKTAQTIKSHHNVGGLPEDMEFELIEPINTLFKDEVRALGIELGIPEHLVWRQPFPGPGLGIRVLGEITEDKLEIVRESDAILREVIREEGLERDIWQYFTVLPGIQSVGVMGDYRTYDHTVGIRAVTSIDGMTSDFARIDWEVLQKISSRIVNEVDHVNRVVYDITSKPPSTIEWE

SEQ ID NO: 35709 - protein, 492 aa, Euptelea polyandra
  misc_feature (2)..(2): Xaa can be any naturally occurring amino acid
  misc_feature (10)..(12): Xaa can be any naturally occurring amino acid
  misc_feature (285)..(286): Xaa can be any naturally occurring amino acid
TXGPGVSALXXXNLGRVTQIIGPVLDVAFPPGKMPNIYNALVVKGRDTVGQQINVTCEVQQLLGNNRVRAVAMSATDGLMRGMEVIDTGAPLSVPVGGATLGRIFNVLGEPVDNLGAVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGXXPSAVGYQPTLSTEMGSLQERITSTKEGSITSIQAVYVPADDLTDPAPATTFAHLDATTVLSRGLAAKGIYPAVDPLDSTSTMLQPWIVGEEHYETAQRVKQTSQRYKELQDIIAILGLDELSEEDRLTVARARKIERFLSQPFFVAEVFTGSPGKYVGLAETIRGFQLILSGELDGLPEQAFYLVGNIDEATAKAMNLEVESKLKK

SEQ ID NO: 35710 - protein, 153 aa, Arabidopsis thaliana
GSGFPGRTTRVQEEVRASFMFSFAVGVTSPVKATMVVQLTGWKQSVFFRVTRKANNTFTSITGIGGGVSCLKVGPPIGRKKLGTLFYLPDLTDVEWAKEVDYLLRTKGIPGVEFEWEHGFGSREPGTTPGSYIGRSWPMGKLPLFGCTDSVQG

SEQ ID NO: 35711 - protein, 275 aa, Mycoplasma gallisepticum R
MQARKLQDFLISTVTLLRDTIKNKKAIIPLNGGVFSFVLAKITKIALNKNLICIYIDNGMMRHNEVANKINFFREKLDLEVWHIDAKELFLNNLKGHISYADKKKAIDDTFLEVVIQTIVDIGEKIDFALLGTCFDDLNQGLNISMALTNDVYIFEPLKQLTIQQVIELGELLSIDPNFLKEPTLPLSGFGLMVEDEVTEEKIVILKKVYYLINTILNQGLQNKFEISIRDDYKDKSAYNLYIEFNQPISDLLVKKVKDQINGLLSNIKKIFIKV

SEQ ID NO: 35712 - protein, 1327 aa, Arabidopsis thaliana
MASRRVLSSLLRSSSGRSAAKLGNRNPRLPSPSPARHAAPCSYLLGRVAEYATSSPASSAAPSSAPAKDEGKKTYDYGGKGAIGRVCQVIGAIVDVRFEDQEGLPPIMTSLEVQDHPTRLVLEVSHHLGQNVVRTIAMDGTEGLVRGRKVLNTGAPITVPVGRATLGRIMNVLGEPIDERGEIKTEHYLPIHRDAPALVDLATGQEILATGIKVVDLLAPYQRGGKIGLFGGAGVGKTVLIMELINNVAKAHGGFSVFAGVGERTREGNDLYREMIESGVIKLGEKQSESKCALVYGQMNEPPGARARVGLTGLTVAEYFRDAEGQDVLLFIDNIFRFTQANSEVSALLGRIPSAVGYQPTLASDLGALQERITTTKKGSITSVQAIYVPADDLTDPAPATTFAHLDATTVLSRQISELGIYPAVDPLDSTSRMLSPHILGEEHYNTARGVQKVLQNYKNLQDIIAILGMDELSEDDKLTVARARKIQRFLSQPFHVAEIFTGAPGKYVDLKENINSFQGLLDGKYDDLSEQSFYMVGGIDEVVAKAEKIAKEVNSSTRTGVAGGNDEVSMEQNFSVSECQLNSNLWSRIIVKNVPKYVTEDQLRGIFSEKGEITDVKLKRLSDGRSRQFAYIGFRSEQKAQDAITYFNKNFKHSHQISVLVADPPPRRTQGKVDAYAKGDKQIQKKDPEVDHDPQLQEFLHQEHKLKFWSNDMCIHPSNGADDPNKAKRSFLDSKKTRKSKVGDDVSDMEYFKSRIKKNLDSDCETDSREDAINVFPIDGEVKADRVDKDDDGHAMEVEADGSDDVLDAGRLFVHGLPYSTTEEELMEHFSKFGDISEVHLVLDKDTRSCRGMAFVLYLIPESAKMAMDKLDKLPFQGRTLHILPAKPRAMSAKQDFHQMFIMDFPNRDNSSNLPKSFKKEREEQRKASEACGNTNAWNSFFMRPDTILENLVRSYGVTKSELLDRECEDPAVRLALGETRVIMETKEALAKAGVRVTSLEEFAARKGDVKNRSKHILLVKHLPFASTEKELAQMFRKFGSLDKIVLPPTKTMALVVFLEAAEARAAMNGLAYTRYKDAPLYLEWAPRDILEPKALADNKEKKSAVEENDARRVNLDQQVGIYSDITESNVLHVKNLSFKTTDEGLKKHLTGVVKQGKILSVKIIRDWTRRRSSGYGFVEFDSVETATSVYRDLPVEGNVLDGHSLILNFSENKRSETVGEGSDKVTKLAKFKRVGLPLKNVRKYAGYAFVEFGTMQEALNAKKALSNTHFYGRHLVLEWARDDESMEAIQKSCAAKYMGQENDNPKKRKSSTVVGSGRETSKKRL

SEQ ID NO: 35713 - protein, 320 aa, Picea sitchensis
MARGYLLGLLVAAAHIIAASCLPTTVPAFLWSNDPHRSLSHYEQGSVNYNVISPRDLAKDVLKMAGWSQLLCSGEKREQAADVALVFIGNKLHSPDISRKRYTDLELIELLKASFKDSSFSMAFPYVTLSEDSEPLANSLLSGFVENCDHGFRNNEIAFVEPCFVEGANNKKLENLEAVNDYVSARKEIRMRGATDLIFICNDKSSVFEASGKTQVEGKILADIIKNLQQAGIIYTVLYTSDPYEMVPHGRFQKLERRLISNDSGNGSASLTYCDGVCKSKASLLEGFLVGLVLLIILLSGLCCMMGIQTPTRFEAPHES

SEQ ID NO: 35714 - protein, 501 aa, Vibrio cholerae O1 biovar eltor str. N16961
MMVIPENSSIVIFGASGDLTYRKLIPALYHLYASQQLPKSFAILGVSRTEYSDESYREKLKRSLQELEKTEPAALEAFMQHVHYQALNTSEVADYQHLATRLDTLANDYQFEQRNTLFYLATPPSLYGVIPACLAAHGLNDESQGWKRLIIEKPFGYDLQSAQDLDVEIHHHFKEHQIYRIDHYLGKETVQNLLVFRFANGMFEPLWNRNFIDYVEITGAEFLGVEERGGYYDGSGAVRDMFQNHLLQVLAMVGMEPPAAINADSIRNEVNKVLQSLQPLSESDLRNNLVLGQYTESEVRGQFLPSYRNEPGVAADSRTETYVALKMFINNWRWNGVPFYVRSGKRLPTRVTEVVIHFKRTPHPVFGQNAPENKLIIRIQPDEGILMSFGLKEPGAGFKAKEVSMNFHYASLEQIKMLTAYERLLLDALNGDATLFARTDAVEACWKFVQPILDFKQDPQSLYGYACGTWGPKESDDLLRRDGREWRFPCKNLTNTDYCEL

SEQ ID NO: 35715 - protein, 509 aa, Gibberella zeae PH-1
MTFPSDIHTFHSGRPQPESSSKSNTFVSVDPSNAKPLATIYTTTSEQLNQTVAAAQAAFPAWSQTPAPRRAAILLKAASILRERNDELALTETLDTGKPWSETSTVDVVTGADVLEYYAHMAAGSFPGQNTRLRPDAFVLTTHEPLGVCAGIGAWNYPIQIALWKSAPCLAAGNCMVYKPSEVTPLHAETLAQIYIEAGVPPGVFNVVYGDGIAVGAPLVAHSGIAKVSFTGQVSTGSKVASQAVTDMKGVTMELGGKSPLVILPDADVEDAADTAMVANFFSTGQVCTNGTRVFVPDTLLSQVEEAIVQRCREGIRMGLPRKTETNFGPMVSAAQQEKVKMYIQHGRTVDKAKVLFNGSQEASMPQPTSDGFWVHPVVFTNCTDDMRVTREEIFGPVMCIMPYKTQGRPRQEWLSDLIARANDTPMGLAAGVVSSDVGLAQEVVQKLDAGITWINTWGESPAEMPVGGWKMSGIGLENGHEGISAYMRTKSTLIQLGRGACKGVFSKL

SEQ ID NO: 35716 - protein, 396 aa, Pseudomonas syringae pv. syringae B728a
MTTQMLRKRICVLPGDGIGIEVMEAALPVIAALNLPFDLVPADIGWQCWRAEGETVPARTWEIMASCDATLLGAITSKPLAEAEAELPLTLQGQNRRYVSPVIQLRQNLDLYANVRPVTDMTGENRFRFVVIRENTEGLYAGLDFGCIPDALVPLLEEREALGAAWQREGQDDATVTLRLQTRSGLMRIFEYAFEYARKNHFTRVTFVDKPMVLRHSSAFARGIFEATAQRYPDVSGVIENVDAVALWMVQRPERFGVIVAENMFGDILSDLGAGVMGGLGFAPSGNFGNSGAYFEPVHGSAPAHAGLNKANPGAMFMAIALMLEHLGFPTESACISQAVSLVSRTSTRTYDLGGSHTTAQVGEAIVQQCIELQSRTFGYRNEQASAPGERHVSAL

SEQ ID NO: 35717 - protein, 259 aa, Triticum aestivum
MAPEMWYIELAVGGSKVHAGCNGKLVWRHTPWLGAHSAKGPVRPLRRSLQGLDPLTTASMFAGARCIGERKVNGDDCFILKLCADPETLRARSEGLAEIIRHVLFGYFSQKTGLLVHLEDSHLTRIQSTTGGDAVYWETTINSFIEDYRPVEGIMIAHAASCRVTLFRFGEVAMSHTKTRMEEAWSIEEVAFNVPGLSMDCFIPPTDIKSGSISETMELPQSGKSKAGGLLPCHGAKVAALEKADDNVAWSGALQRDCK

SEQ ID NO: 35718 - protein, 482 aa, Vibrio cholerae O1 biovar eltor str. N16961
MKGDIGVIGLAVMGQNLILNMNDHGFKVVAHNRTAAKVDEFLEGPAKGTNIVGAYTLQELVDKLATPRKVMLMVRAGQVVDDFIEQLVPLLDKGDIIIDGGNTNFPDTNRRVKALREKGIHFIGTGVSGGEEGARFGPSIMPGGAPEAWEAVKPIFQGISAKTDAGEPCCDWVGNDGAGHFVKMVHNGIEYGDMQLITEAYQFMKDGLGMSADEMQAVFADWNKTELDSYLVEITADILGYKDEDGEALVEKILDTAGQKGTGKWTGINALDMGIPLTLITESVFSRCLSALKDQRVEAEKLFGKTKTQVEGDKQVWVDALRQALLASKIISYAQGFMLMREASNENGWNLNYGNVALMWRGGCIIRSAFLGNIRDAFEKNPELAFLGSDAYFKGILDNCLAAWRKVAAKSLEVGIPMPCTTSALTFLDGYTTARLPANLLQAQRDYFGAHTYERIDRPRGEFFHTNWTGTGGNTASTTYDV

SEQ ID NO: 35719 - protein, 183 aa, Magnetococcus sp. MC-1
MPLYPFAGRWPSVDPSAFVHPDAVIIGDVAIGPESSIWPGVVIRGDVNHIRIGARTNIQDGSVLHVTRGKPDKPAGLPLILGDDITIGHRVTLHACTLKSGCMVGMGATVMDGVVIESGAMVAAGAMVTPGKQIATGELWMGSPAKLARPIRATEAQEITATTQNYIKLGQHYLQELAALNHG

SEQ ID NO: 35720 - protein, 157 aa, Mycoplasma gallisepticum R
MHMNIRIGQGFDSHKLKTKKNSRVFLGGIPVRTDQQLIANSDGDVVLHALSDAVLGCGSFGDIGMYFDENDLSNKGLDSKTILNYCLKLIKKLKLEFVNIDLTIFAQDIRIDPIRFEIKSSLMKLTGCNSVNVKAKSYEEPKNEIACSCVVLMNTNK

SEQ ID NO: 35721 - protein, 409 aa, Zea mays
MQFALALDTNSGPHQIRSCEGDGIDRLEKLSIGGRKQEKALRNRCFGGRVATTTQCILTSDACPETLHSQTQSSRKNYADANRVSAIILGGGTGSQLFPLTSTRATPAVPVGGCYRLIDIPMSNCFNSGINKIFVMSQFNSTSLNRHIHRTYLEGGINFADGSVQVLAATQMPEEPAGWFQGTADSIRKFIWVLEDYYSHKSIDNIVILSGDQLYRMNYMELVQKHVEDDADITISCAPVDESRASKNGLVKIDHTGRVLQFFEKPKGADLNSMRVETNFLSYAIDDAQKYPYLASMGIYVFKKDALLDLLKSKYTQLHDFGSEILPRAVLDHSVQACIFTGYWEDVGTIKSFFDANLALTEQPSKFDFYDPKTPFFTAPRCLPPTQLDKCKMKYAFISDGCLLRECNI

SEQ ID NO: 35722 - protein, 364 aa, delta proteobacterium MLMS-1
MGFRCGIVGLPNVGKSTIFNALTAAGIESANYPFCTIEPNVGMVPVPDHRLDALAAMARTRNKVNAKMEFVDIAGLVSGASRGEGLGNQFLGHIRQVDAIAHVVRCFTDDNIVHVDSGIDPLRDREVINTELILADLETIRKRIQKTANQAKSGDKTSKQQLAILEAMEKHLDQGQPARTLELDDGGRELLREIFLLSAKPVLYVANVLESEINGGNPWVAKLQEAAAAEQASVVVISGAIEEELSNLETDERQAFLADMGLTEPGLNRLIRTGYQLLGLVTFFTVGEKETRAWTIAAGSKAPQAAGVIHSDFERGFIRAEVISCDDLLACGSEAKAKEKGLLRLEGKEYVVKDGDCINFRFNV

SEQ ID NO: 35723 - protein, 326 aa, Mycobacterium smegmatis str. MC2 155
MATDWTDNRKNLMLFAGRAHPELADQVAKELDVAVTAQTARDFANGEIFVRFDESVRGCDAFVLQSHPAPLNQWLMEQLIMIDALKRGSAKRITAILPFYPYARQDKKHRGREPISARLVADLLKTAGADRIVSVDLHTDQIQGFFDGPVDHMRAQKLLTGYIGEHYADEDMVVVSPDSGRVRVAEKWADSLGGVPLAFIHKTRDPLVPNQVKSNRVVGDVKGKTCILTDDMIDTGGTIAGAVNLLREDGAKDVIIAATHGVLSDPAPQRLAECGAREVIVTNTLPITEDKRFPQLTVLSIAPLLANTIRAVFENGSVTGLFDGSA

SEQ ID NO: 35724 - protein, 683 aa, Debaryomyces hansenii
MSDAKDTEDNLSPRFENLNIRTPKAANPENMQSPQRLSHSQINGDIQARILAFQQKRTKPVNGGHGGLNSIPASSNHLSEAPDKPLPPLPPLPSLPKLPNVQAQQRSYSLGDANDLGVIPSPMETENIHTTNQTMNQTMNRGINQSIGQGMSRASSIKKQDSQQLPFELLKKPSLSQRRGMKLNLSEMSSPNSASSPDDTSPIGDDKKNPVFLNAPKGNDIESGAMNTTGDLSRMLSDRKKKPNFKLNLGNTGVPGVNGMQNSQSNSNTNSTASSLDSSGSSSTAGTNNETNQSKKPQLQGLFANYSKYVDIKSGSLNFAGKASLHSKGIDFLSGLLFRISLEELEFLEELGHGNYGVVLKVLHKPTGVLMAMKEVRLELDETKFTQILMELEILHKCDSPYIVDFYGAFFVEGAVYMCMEYMDGGSLDKIYGKDDGVKDEACLAYITECVISGLKELKDEHNIIHRDVKPTNILVNSLGKVKLCDFGVSGNLVASLAKTNIGCQSYMAPERIKSLSPTDNTYSVQSDIWSLGLSILEIAAGHYPYPAETYGNIFSQLSAIVDGDPPKLDPKIFSKDAQLFIKSCLNKNPDLRPSYATLLKHPWLVKYRNIDPHMGEFVTKKIQELEEEKNKKNLSRSNSTSSSAATAKPPKENVRSLLKGKVQAPALHRGGLMNSSRNNANR

SEQ ID NO: 35725 - protein, 284 aa, Schizosaccharomyces pombe 972h-
MLIAAMGPKIPVPAYGVGTALFKKEKGEINRTIVDSVKNALAAGFIHIDCAEVYGNEEEVGVALKEANVPRSKLFITSKVMHNVDNIPEALNESLRKLGTDYLDLYLLHSPIPFYEKKIPISEGWKAMETALGTGLVHSVGVSNFRIPDLEELLKTSTITPRVNQIEFHPQVYKAAKPLVEFCQSKGIIVEGYGPLSPLVRDAQGPVAEFTKSLESKYHVSDTQILLKWAYSKGVIPITTTSKIERMKECLNFDSFTLDKADIDELGTLGVQHHKRTFMKHMDE

SEQ ID NO: 35726 - protein, 540 aa, Leuconostoc mesenteroides subsp. mesenteroides ATCC 8293
MITVSDMSFSFSGPKIYQDVNLKLTPGNTYGIIGANGAGKSTFLKLLQGELQPTEGTISIGDSERMSSLQQDHFAFDKFTVLDTVIQGHKRLYEVKTEMDAIYAKPDFNDEDGVRVADLGAEFEELDGWNAEVEAGQLLSKLGISDSVYDTLMGELTENDKVKVLLAQALFGNPDILILDEPTNGLDVQTINWLEDFLADFPNLVIVVSHDRHFLNAVSTNILDVDFGKITPFVGNYDFWRESSELAQRLASQQNAKKEEQIKQLQDFVARFSANASKSKQATARKKQLDKITLDDIKPSSRKYPFINFPINRELGNDMVRVENVSKTIDGEKVLDNISFIGRPNDKIAILSRSDLATTTLMQIIAGTMAPDEGTVSWGVTTSQSYIAKDLNDNFDNQDVTILDWLRDFAEEDQKDNTSLRGMLGQMLFRGDDSLKQINVLSGGEKVRIVLAKMMLLKANVLLMDDPTNHLDLESIQSLNDAVIAFKGSIIMTSHDHEFLATTANHIIEVSPKGVVDRVDTTYDEFINNDSIQDKVNELY

SEQ ID NO: 35727 - protein, 268 aa, Xanthobacter autotrophicus Py2
MKIEGKRVLVTGGSSGIGRAITVALLKKGARVVITGRRQDVLAAAVASLKANGGDVHGICADVTETAGRKATLDGALVHLGGLDILVNNAGGVRAGRLEDTSEAEIRAMVEVDLVAPILLTRAALPALRASGEGLIADVTSAIALIGMPFYATYAATKAGLARFDEALRRELVGEGVRVLTIYPGATDTPMMRTSRAGAEVGFTKEPADAVADAVVAAIEGDGFEVVRGGEARAQMIALNRSDPTALDRRFADLKPALAEAVRDHSAL

SEQ ID NO: 35728 - protein, 164 aa, Triticum aestivum
AYSGDTIEQVCTKKQAGTGPEFPGYRRPTRPTVPSSVLGVHPMLFLRVLQMCMWRHPQNAPLPYKGYRDEDWEDNDGALNTISMTHPRIPIEHPNRFVVDDSDCNPLQPGIWYHKIIEGDHILFIVNRERAGVQFDLLYDGIFERCRKHAFRKSPPTMPNEASH

SEQ ID NO: 35729 - protein, 391 aa, Desulfococcus oleovorans Hxd3
MDMTKKFGRLDRLQPYVFATVNAIKMEARRAGRDIIDLGMGNPDLPTPNHIIEKMVEAARKPHNHRYSASMGIRKLRLAISDWYKRRYDVPIDHEEEAIVTIGVKEGFSHLILVTINPGDLVFTPNPTYPIHPYATIIAGGNVRGIPVGPGQDFLKNLIDGTRQSWPKPKVLVISYPHNPTTEVVDLNFFKEIVAYAKKYDVMIIHDFAYADLVFDGYEAPSFLQVEGARDVGVEFFSLSKSYSMAGWRVGFCVGNPHIVAALRRIKSYLDYGIFQPLQIASIIALNEDQQCVADIRETYRSRRDTLVNGLNRVGWEIEKPKATMFVWAQIPEKHRHLGSVEFSKMMIREAQVAVSPGLGFGEYGDDYVRFALIENEMRTNQAVRGIKKIL

SEQ ID NO: 35730 - protein, 532 aa, marine gamma proteobacterium HTCC2143
MESIFCNRQALFERLRAGDNSYDLVIVGGGITGAGVLREAARSGYRTLLIEQQDFAWGTSSRSSKMIHGGLRYLVSGDLKLTRESLSERERLLREAPGLIERMGYYYVLRKGSFPGRFVMNAVLAVYDFIAGISDHRFIKLPQILEKFPGVKKEGLNGACYYTDAVTDDARLVMRVLQESSSSTTAAINYVRAGDLLLEDDNVVGVQIEDGETGEHFSLKTPVVINATGAWADRLRNQLNSETRIRPLRGSHLIFPAKLLPVSAVLALPHPDDKRAAFIYPWEGTTVIGTTDLDHTDDLDNEASITEQEVRYLMRIVESEFPEASISRSEIISTWAGVRPVIAAEDARDPSKERRDHAVWFDKGLVTVSGGKLTTFRLIALDALAAAAPLLPDANTSTDEQIFSQPTSAVRPLTLMQSRYGTLADQAVSAAQPGEERSIDNTRFSLSDCRWAARSESVMHLDDLLLRRTRLALLLPNGASELFPALEKICSEELGWNSQRWTEEQQRYESIIARYYAVPNTSIDGDAVNAPG

SEQ ID NO: 35731 - protein, 408 aa, Pseudomonas fluorescens Pf-5
MNQTAFDIQRAAVIGAGTMGRGIVMCLANAGLPVLWLDNNPQMLQQALAAVADTYAHNVRQGRIDQAEADARVARIKPAADYPQLADVDLVIEAVYENLELKQQIFRQLDATLKPEAILASNTSALDIDAIAAVTQRAPQVLGLHFFSPAHIMKLLEVVRAAKTAPAVLDAALALGQRMGKVSVVAGNCFGFIGNRMLNTYVLEARKMLLEGAFPYQVDGALQGFGFAMGPFRMYDVVGIDLGWRARQLDGVGQDAPEVQIDNRLCESGRFGQKSGDGYYHYEPGSRQAEHDLQVDALVLQVSEELGYRRRDIGSEEILERCLLALVNEGAKILQEGIAQSAADIDRVYLNGYGFPKEQGGPMSWADAQGLEQVRQRLQHLQAEHGAHWRPAQLIEELAAAGKGFAQA

SEQ ID NO: 35732 - protein, 786 aa, Arabidopsis thaliana
MSYKNTNNSHLILFKLLLLLILYSADLTASSSCRSECGGCKCGGIAIPYPFGIGKGCYLEKSYEIECLNTSGKLVPFLSVISKEVVSIHLPGRQSFGSVRVRSPITSAGCSSDGKDSAPVMNLTDSPFFVSDINNLVGVGCSSKVSLEHIKQNMVGCELNCSTTNASDSNSIPFFDKTGCSFSYTFAQVCTGNKPEDMGCDGRGCCQASLPREPQQVIGIRIESNDGKSTTSGDCRVAFLTDEFFSLSKLTKPEQLHAKRYATLSLGWIMQTRNTSFVNSLACKIRKDTDTAYSNDQSIKCICDYTMSIISDIRYANCECNLGYKGNPYDSDGCRDIDECKENPKYCKETDTCVNFEGGYRCVGDKTKAIMIGAGTGFGVLVLVGGVWWLRKFLVKRRMAKRKKKFFKRNGGLLLQQELNTRQGVVEKARIFTSKELEKATENFSENRVLGHGGQGTVYKGMLVDGRTVAVKKSKVIDEDKLQEFINEVVILSQINHRHVVKLLGCCLETEVPILVYEFIINGNLFKHIHEEEADDYTMIWGMRLRIAVDIAGALSYLHSAASSPIYHRDIKSTNILLDEKYRAKVADFGTSRSVTIDQTHWTTVISGTVGYVDPEYYRSSQYTEKSDVYSFGVILAELITGDKPVIMVQNTQEIIALAEHFRVAMKERRLSDIMDARIRDDSKPEQVMAVANLAMKCLSSRGRNRPNMREVFTELERICTSPEDSQVQNRIDEEEEEDGVEEEEEVVTIVHRGDSWSIGVTAPASSIVASPPSSDVEPLNPLLTW

SEQ ID NO: 35733 - protein, 310 aa, Synechococcus sp. CC9605
MTWERFTLLFPLWTLLGALLALLHPPLFIWFKGLLISLGLGVIMLGMGVGLTPADFVRVGRRPRAVLLGVLLQFLVMPALAAGIAAALHLPAPLAVGLILVGCCPGGTASNVVALIGRGDVALSVVMTTISTLTAVVLTPHLTQVLASQYVPVDGWALFLAVLQVVLLPVTIGVLLKRGLPGVAQRIEPVMPPMAVMAIVMIVSSIVGSQRGVLLQQGAVLILACLLLHGGGFLLGWLIPRLVGQSVQAQRTISIEVGMQNSGLAVVLARSGGFASSLTALPGAISAVIHCLIGSALAAVWRRQPRGNRR

SEQ ID NO: 35734 - protein, 420 aa, Thermoplasma volcanium GSS1
MSLLLVLSAVAIPIARKMSVVEIPILIFIGLIVGPFLRLISPAFSVYLFSSFAGVGIGMIGLVIILYSESHNMNIKVLKSSFYRIASLDTIGVIITALVAAGLFSLFTGAPLIIGFLFGAIISPTDPVTLIPLFRRMKISEDISEVLIGESLFNDPVGIILVSVGIAILAPHSVYVSLFSSIANSISFYPGIVAYFLIQVAVPSVVGVAIGFAIIYLNKEINFENYLTAILLGVVIFEFTIFEGISITPFPAIIATGAIVGNFSDKGIFWQREKNFQENLSYLSTSIIFLLIGSSFTINEIEQYILLGIMLTTILIFVVRPAAVFPSILIADLGKIKMKGYYKIVAFISLVGPRGVVPVVLSTLPYVVGLSYNIPILITWGPVIGVSALFIVLFSIVFQTIYTPIMKNIFIPDQGNGNSK

SEQ ID NO: 35735 - protein, 423 aa, Saccharomyces cerevisiae
MSEATLSKQTIEWENKYSAHNYHPLPVVFHKAKGAHLWDPEGKLYLDFLSAYSAVNQGHCHPHIIKALTEQAQTLTLSSRAFHNDVYAQFAKFVTEFSGFETVLPMNTGAEAVETALKLARRWGYMKKNIPQDKAIILGAEGNFHGRTFGAISLSTDYEDSKLHFGPFVPNVASGHSVHKIRYGHAEDFVPILESPEGKNVAAIILEPIQREAGIVVPPADYFPKVSALCRKHNVLLIVDEIQTGIGRTGELLCYDHYKAEAKPDIVLLGKALSGGVLPVSCVLSSHDIMSCFTPGSHGSTFGGNPLASRVAIAALEVIRDEKLCQRAAQLGSSFIAQLKALQAKSNGIISEVRGMGLLTAIVIDPSKANGKTAWDLCLLMKDQGLLAKPTHDHIIRLAPPLVISEEDLQTGVETIAKCIDLL

SEQ ID NO: 35736 - protein, 464 aa, Magnetococcus sp. MC-1
MMATIWDLIVIGAGPGGYPAAIRAAQLGLSVLCIEKSPHPGGTCLNAGCIPTKALLASTHLYTQIRDQADLHGIEITTMQVNLARMQGRKERVVSQLRSGILGLFKKYGVTLLHDEAIVSGPGQITLAASGETLQAKAILLATGGQPRRPASMPVDGQVVITSEQAIALTRVPEHLIVIGSGAVGLELASIWVRLGAQVSVIEAQPEILPGWDATVARTAKRSLRQQGITFLTDHRVETVVRSGSRAAVTCLNSKGETLMLDGDQVLVAVGRQAQLCVAGIQNLELQQDEQGRLWVDAHYATSLAGLYAVGDLIAGPQLAHRATAEGLRVADYLAGRPLSPMGPIPSVVYTDPELAMVGLTEQQAKVAGYAVKCGQFPFMASGRARAQEQTEGLIKLVMDQTTGQLLGAHVVGGAGAEHLQLAMAAMLTQDRGQLLERLVMPHPSFGEALHEAWLVATQKPIHI

SEQ ID NO: 35737 - protein, 494 aa, Oryza sativa Indica Group
MYSPGGGLRSLVGTPASSALHSFEPHPIVGDAWEALRRSLVFFRGQPLGTIAAFDHASEEVLNYDQVFVRDFVPSALAFLMNGEPEIVRHFLLKTLLLQGWEKKVDRFKLGEGAMPASFKVLHDSKKGVDTLHADFGESAIGRVAPVDSGFWWIILLRAYTKSTGDLTLAETPECQKGMRLILSLCLSEGFDTFPTLLCADGCCMIDRRMGVYGYPIEIQALFFMALRCALQLLKHDNEGKEFVERIATRLHALSYHMRSYYWLDFQQLNDIYRYKTEEYSHTAVNKFNVIPDSIPDWLFDFMPCQGGFFIGNVSPARMDFRWFALGNMIAILSSLATPEQSTAIMDLIEERWEELIGEMPLKICYPAIENHEWRIVTGCDPKNTRWSYHNGGSWPVLLWLLTAACIKTGRPQIARRAIDLAERRLLKDGWPEYYDGKLGRYVGKQARKFQTWSIAGYLVAKMMLEDPSHLGMISLEEDKAMKPVLKRSASWTN

SEQ ID NO: 35738 - protein, 408 aa, Oryza sativa Indica Group
MDHHQRWHPTVNEREFIERALQSDLRVDGRRPFDFRRLKILFGREDGSAEVQLGDTRVMGYATAQLVQPYKDRPNEGTLAIFTEFSPMADPAFEPGRPGESAIELGRVVDRGLRESRAVDMESLCVVAGKHVWSVRVDLHILDNGGELNVPDAMVLSLRNLIDAANIAALAALSTFRRPECTVGGEDGQQVTVHDPEVRDPLPLTIHHLPIAVTFAYFGEGNIMVIDPTYKEEAVMGGRMTATINSNGDVCSIQKAGGEGVMSSVIMQCLRIASVKAADITSKIKNEVNSYTSAKALQKVKRLPASALKKDNAPDVAMKESSDGALETQSTKPSSDGQQINKEPPSVVEDNKQEDVEPMLSECNPEAQSETRLTAGGSDETQEAISPKSLKDAVKPKHKIKKKQHSKS

SEQ ID NO: 35739 - protein, 495 aa, Pseudomonas syringae pv. syringae B728a
MLEKIKATWFSNVRADVLAGLVVALALIPEAIAFSIITGVDPKVGLYASFCICVVIAFVGGRPAMISAATGAMALLMVNLVKEHGLQYLLAATLLCGVLQIIAGYLRLGELMRFVSRSVVTGFVNALAILIFMAQLPELTHVTWPVYAMTAAGLAIIYLFPRVPVLGKLLPSPLVCILVLTAISIHMGLDVRTVGDMGAMPDSLPTFMWPDVALNLDTLLIILPYSAALAVVGLLESMMTATIVDDLTDTTSDRNRECKGQGIANIATGLIGGMAGCAMIGQSMINVKSGGRTRLSTLSAGLLLLIMMLFLGEWLARIPMAALVAVMIMVSISTFSWGSIRNLKEYPLSTNIVMVVTVVVVVATHNLAYGVLVGSLLASMFFASKIAHFLEVTSHRDPLHSHRTYYVTGQVFFASADRFMASFDLRESLETLVIDLREAHFWDITAIAALDKVVLKLRKAGISVDVIGMNRATATLVDRFGVHDKPDGIDSLMGH

SEQ ID NO: 35740 - protein, 346 aa, Oryza sativa Japonica Group
KDPIKLWERYVEWLYQHKELGLFVDVSRMGFTEEFLRRMEPRMQRAFAAMRELEKGAIANPDEGRMVGHYWLRDPGLAPNSFLRTKIETTLDRILAFSQDVVSGKIKPPSSPAGRFTQILSIGIGGSALGPQFVSEALAPDNPPLKIRFIDNTDPAGIDHQIAQLGPELASTLVIVISKSGGTPETRNGLLEVQKAFRDAGLDFSKQGVAVTQENSLLDNTARIEGWLARFPMFDWVGGRTSEMSAVGLLPAALQGIDIKEMLVGAALMDEETRNTVVKENPAALLALCWYWASEGIGNKDMVVLPYKDSLLLLSRYLQQLVMESLGKEFDLDGNRVHILPFYSHC

SEQ ID NO: 35741 - protein, 172 aa, Synechocystis sp. PCC 6803
MDLKALIRDIPDFPKPGIMFRDITTLLNSPEGLRYTIDSLVEQCESQELVPDHVVGMESRGFLFGMPLAYQMNAGFIPVRKPGKLPAPVHRVEYDLEYGKDSLEIHQDAVAPHHRVLIVDDLIATGGTAKATAELLTKLGCEVLGFAFIIELAALNGRQCLPDLPIISLVEY

SEQ ID NO: 35742 - protein, 292 aa, Synechocystis sp. PCC 6803
MESNFLTTIFLPLALFLIMFGMGLGLTIKDFNRIWLEPKAVAIGLIAQLVMLPMVGFGLSSLFSLSPELAVGLMILAACPGGSTSNVITYLLKGNVALSITLTAISSLVTIITIPLVVNLAANYFMGEQFALQLPFLKTVLQIAVITIIPVSLGMIFYHFLPKIAMVMEKNVKWLSLFFLGIIIVAILVKERENLADFFLQVGGVTVTLNLLTMGLGYGIAILAGLGLAERKSITIEVGIQNGTLAIAIATTLLNAPIMAIPAAIYSVVMFLTSGIFAGLLKAKIFRGLKST

SEQ ID NO: 35743 - protein, 330 aa, Synechocystis sp. PCC 6803
MTISTTDTSLIIWPAMGCGTWAWGNKLLWGYQPAMNGELERVFRECVAAGITFFDTGDSYGTGRLQGQSEKLLGQFSQAYEGLNQDKICLATKLAPYPWRLTPQAMVGAGMASQQRLQRPIDLVQLHWSTANYAPWQEQPLLKGLVQLCQRGHAKALGLSNFGPKRLQKAYDFCQNEGVSIVSLQVQYSLLSTDPVSKLGLKELCEQLGIKLIAYSPLTLGLLTGKYGPQGPFPPGIRGLLFRRLLPKIQPLLDTLQAIAREREKTMAQVALNWCICQGTMPIPGAKNCQQVQDNLGALGWQLDRGEMDELNNQAAALPQTMVQNIFQSR

SEQ ID NO: 35744 - protein, 188 aa, Schizosaccharomyces pombe 972h-
MSDDRINYLKNKLVQYPDFPKKGILFEDIMPIFQDPRAFGILIDLLLEAVETEFNNIDVIVGLEARGFLFGPTLALRANCAFVPVRKPNKLPGDLVVVSYNKEYSTDSFAIQKGTIKPGQRVLIVDDILATGGTALAADELVTRLGGELVGHLFLLELTFLQGRKRLMAPTYTLLTGQDEAPDGSEFA

SEQ ID NO: 35745 - protein, 384 aa, Mycobacterium sp. MCS
MEVSATLLLELGVILAALTVLGTIARRFALSPIPLYLLAGLAVGEGGLAPVPAAGDFVETGATIGVVLLLLTLGLEFSIGEFATSLRRHLPSAGVDLVLNAAPGAIAGWLIGLDGVGILALAGVTWISSSGVIARLLSDLRRLGNRETPAVLSILVLEDFAMAAYLPLLAVLATGGTFLQALLGMAIAVSALGFAFVVSYRWGHHVGRLVVHPDNEQLLLRILGLTLIVAALAEFIHASAAVGAFLVGLTLTGEAAERARTVLTPLRDLFAAIFFLAIGVSVDPAALIPMLPVATALAVATAATKVLTGQFAARRDGVGRPGQLRAGTALIARGEFSLVIIGLVGASVEALEAVATPYVFILAMVGPVLARFTGGRAPARRRPG

SEQ ID NO: 35746 - protein, 569 aa, Crocosphaera watsonii WH 8501
MLRLERISKIYPNAEVLKDVTWEVNPGERIGLVGANGAGKSTQLKIIKGEIEPTSGEVIRPASLKIGYLTQEFEVEPSRSVNQEFWTVFSEANFIQDELAKVTQEMETAEPDYLDELIHKLDNLQRKFEALDGYVLEAEIAKMLPEMGFELEDSERLVSDFSCGWQMRMSLGKILLQEPDLLLLDEPTNHLDYETVDWLGAYLKGLNIPMVIVSHEREFLNKICTKIVETERGISTTYIGNYSDYTQQKTLSRELQENTYQRQQKEIDKQQAFIDRFRASATRSTQAKSREKQLESMDRVEAPIAELKTVTFEFPPAPKSGKDVVLVKDLVHTYDEQILFLDAHLNVERGDRIAFLGPNGAGKSTLLRLIMGIEKPSDGVVSLGKHNVIPGYFEQNQAEALNLTKTVMNTIHDEVPDWKNVEVRSLLGRFLFSGDTVFKTVEGLSGGEKARLALVKMLLQPANLLVLDEPTNHLDIPAKEMLEQALSKYEGTVLLVSHDRYFISQVANKIVELNEGELVVYPGNYYYYLEKKEEERLKAEQARIKAEKEAKAAAKRAKQREKQKAKKKK

SEQ ID NO: 35747 - protein, 979 aa, Arabidopsis thaliana
MALITLLEVSISLLFFSFLYGYFLISKKPHRSFLTNWPFLGMLPGLLVEIPRVYDFVTELLEASNLTYPFKGPCFGGLDMLITVDPANIHHIMSSNFANYPKGTEFKKIFDVLGDGIFNADSELWKDLRKSAQSMMTHQDFQRFTLRTIMSKLEKGLVPLLDYVAEKKQVVDLQDVFQRFTFDTSFVLATGVDPGCLSTEMPQIEFARALDEAEEAIFFRHVKPEIVWKMQRFIGFGDELKMKKAHSTFDRVCSKCIASKRDEITNGVINIDSSSKDLLMCYMNVDTICHTTKYKLLNPSDDKFLRDMILSFMLAGRDTTSSALTWFFWLLSKNPKAITKIRQEINTQLSPRTNDFDSFNAQELNKLVYVHGALCEALRLYPPVPFQHKSPTKSDVLPSGHRVDASSKIVFCLYSLGRMKSVWGEDASEFKPERWISESGRLIHVPSFKFLSFNAGPRTCLGKEVAMTQMKTVAVKIIQNYEIKVVEGHKIEPVPSIILHMKHGLKVTFNLPPSPARPLPFIGHLHLLKQPLHRTFLSFSQSLGDAPIFSLRLGNHLTVVVSSYSIAEECFTKNDIVLANRPKFILGKHIEYNFTTMTSAPYGDHWRNLRRIGTLEIFSSHKLNGFLSVRKDEIRHLLLRLSKNSQHGFAKVEMRQLFYDLTINNILRMVAGKRFYGEGTEQDEVARRVTQLIDEIVYRAGVGNAADYIPILRWITDFEKGVKELASRVDEFLQSLVDERRVHKQKGNTMMDHLLSLQETQPDYYTDVTLKGIIIVMILAGTETLAGTLEWAMLNLLNHPEVLEKARTEIDTEVGFDRLMDEADTKNLPYLQWIVLETLRLYPVAPTNIPHMTSDDCILAGYDVPRGSMLLVNVWSMHRDPSIWEAPEMFKPERFKNEKLNQKLLSFGFGRRACPGVGLAHRLMSLALGSMVQCFEWQRIGEEYVDTREEPMAMMRPATPLLAMCKARPIVHKFLDAFA

SEQ ID NO: 35748 - protein, 198 aa, Prochlorococcus marinus str. AS9601
MFLVIDNYDSFTYNLVQYLGELSVEHEITKELIVKRNDEITLDEIIKLNPSGILLSPGPGNPDQSGICLPILKKLSKNIPTLGVCLGHQALAQAFGGKVIVGKELMHGKTSKIFHNQKGLFKDIETPFVATRYHSLIVDSSSLPSCFDITATLEDSTIMAISHKEYKHLHGVQFHPESVLTQFGHKLISNFLKMAEKK

SEQ ID NO: 35749 - protein, 154 aa, Glycine max
  misc_feature (27)..(27): Xaa can be any naturally occurring amino acid
GVFVFTLDPMYGEFVLTQENSPEPKSXGKIYAFNEGNYQLWDEKLKKYIDDLKDPGPSGKPYSARYIGSLVGDFHRTLLYGGIYGYPRDKKSKNGKLRLLYECAPMSFIVEQAGGKGSDGHQRILDIQPTEIHQRVPLYIGSVEEVEKVEKYLA

SEQ ID NO: 35750 - protein, 581 aa, Zea mays
MDAQDDDERPLIIHRLPLLQDESTSEFTSDGTVDLRNQPARKQRTGNWRACFFILGAEFAECVAFFAISKNLVTYLTGVLHESNVDAAKTVSTWIGTSFFTPLVGAFLADTFWGRYWTILAFLSVYVTGMTVLTASALLPLLMGASYSRSAHRLSAYLGLYLAALGNGGIKPCVCALGADQFDASDPVERRAKGSFFNWYYFSVNIGSLLSATVVVWVQDNVGWGVGFAIPTLLMLSGLVLFVAGRKVYRYQRVGGSPLTRASQVVVAAVRNYRLVLPDDSSALLHQVPPGTTEGNYSTMQHTSQFRFLDKAAIVAPSSGEKGATASPWRLCTVSQVEELKTVLRMFPVWVSMVLFFAATAQMSSTFIEQGETMDNRVGPFTVPPASLSTFDVISVMVCIPIYDKALVPLARRATGKERGLSQLQRLGVGLALSVAGMVYAALLEARRLSLARAAADGRPPMSIMWQAPAFAVLGAGEVFATIGILEFFYDQSPDGMKSLGTALAQLAVAAGNYFNSAVLAAVAAVTTRNGEAGWIPDDLDKGHLDYFFWFMAVLGVVNLLHFLHCSVRYRGSSNNSTYSS

SEQ ID NO: 35751 - protein, 355 aa, Mycobacterium smegmatis str. MC2 155
MPTYELLRYHFRSPETAAHFLQTSASHDRRQDRGTETLGISASPSDPTIVVEIVCHTDESGARPATDAPGIQRVETLALEPRAAGVSEASRGRSGQGRLAGKVALITGGARGQGEAEARLFAQHGAHVYICDVLEEEGEKLAAELRGSGLQADFRFLDVTDAEQWSRTVAHIDAGAGRLDVLINNAGINVRHQLTDTTSEEWDRIVAVNTKGQMLGMQACAPLMKRSGNGSIINIGSTAGIMGHPVAAYSASKWAVRGLTKAAAMELASSGIRVNAMHPGVVETPMVDAGSRVFAELRSLTPLGRAAQPSEMASAALFLASDEASFITGIDLAVDGGFSELAAYGEVWKRLNTAL

SEQ ID NO: 35752 - protein, 391 aa, Wolinella succinogenes DSM 1740
MQKVTLKKSALPAFRTLPAWIYGSQLESLPSSLEQGELVHLYSPKQEFLALGYINPKSQIALRILSFTQKSFTPEELKKRLQKAILKRESLLLKTNGARLIHSESDELPGLIVDSYANHLSLQINTAGMERFRPLILESLKELLSPLSIIDKSDEKSRQLEGLESSNGVIFGEVPQEILLQEEGARFGINLLEGQKTGYYLDQRQNRLLLAEMAKGKRVLDLFCNGGGFGIHALLKGAKEALFIDSSEMACEQVKKNLSLNQLENKGRIISANVFDELKGLREREEKFDLIILDPPSFAKTKEQQKGAMNGWKYLIIGAIKVAAPKARIALYSCSYHMGLNELAQVALEASRDSYTRLQILQYHLQDIDHPAILNMPHSLYLRGIVFEVLK

SEQ ID NO: 35753 - protein, 840 aa, Oryza sativa Japonica Group
MASRRQWGAGAGAVDVPAQERKGEAAKIARRPKTTTVVAQQPPRIRRALADVSNLVNGRAALPVVNRQKAAAAAADKCRKPIKQRNENNKAAKPEVIVISSDSEKHKKNPAQRAASRRAPIQTLTSILTKCSRASDGVISPKKELIYDIDASDSHNELAVVDYVEDIYRFYRNTENTYRPLCTYMVSQTEINERMRAILTDWLIEVHYRLMLMPETLYLTVYIIDQYLSLENVPRKELQLVGVSAMLIACKYEETWAPLVKDFLVISDNSFSRQQVLSTEKSILNKLQWNLTVPTMYMFILRYLKAALGDEELEHMTFFYAELALVQYSMLFFAPSVIAAAAVYAARCTLGLSPLWSDLLEYHTGLAEPQLLECARRLVSLHAAAPESRQKVVYKKYASPKLGAVSLHSPAKKLLPPPSPVCVLQFLVCCCCYGHIQFVFFSSWFVVVMACTMSSMACHSLPESGSNLSAADELFQNQRSEQGIYWTLWDSRLSDDLNTTTVYSDNHGSNGGGTQSFDTSEHCSTVPSDSDEQPGYPSQFEPLHMEQTNDMFLSQFSDEEVRRMDAPFQALDMFPDSMHRLMSYEHILNGALVSDSKNQEVNMDQDDMDTCGFPLYFSHGLQDDGGLPSFAKGMVAADTSSMDKAGASATERGDPGSSPPGFEEAVLEELEEVMVQMARTTRICLRDAFYRLAEGSRSPRSAAAAADGATVAEATRYHAQAAVDLSRSLLEILQLVILMLSVSSSPLAAANPLQCVDDAAAPSPRRDRQDGGEPHLQAAAVLAGSRGGDDAAHACLRRPSSPSPDHRRTGGDSLGFSFQCDLARRIASSLACLTKDTLCM

SEQ ID NO: 35754 - protein, 233 aa, Crocosphaera watsonii WH 8501
MSDPVVMMKQEVGKAAAARVKSDSIVGLGTGSTTAYAIQYIGERLQSGDLKNIIGVTTSFQAEVLARKYNIPLSTLDVVDRIDIAIDGADEVDPQKNLIKGGGAAHTQEKIVDSLAEQFIVVVDGGKLVDKLGSTFLLPVEVIPKAVVPVMRKLEQLGGKPDLRMGVKKAGPVVTDQGNLVVDVKFDSIDDPATLEKTINNIPGVLENGLFVGVTDVVLVGEIIDNKPVVREI

SEQ ID NO: 35755 - protein, 493 aa, Vitis vinifera
MANIDIEGILKELPNDGRIPKTKIVCTLGPASRSVPMLEKLLRAGMNVARFNFSHGTHDYHQETLDNLRIAMQNTQILCAVMLDTKGPEIRTGFLKDAKPIQLKEGEEITISTDYSIKGDEKMISMSYKKLPVDLKPGNTILCADGTITLTVLSCDLGAGTVRCRCENTATLGERKNVNLPGVVVDLPTLTEKDKEDILGWGVPNNIDMIALSFVRKGSDLVNVRKVLGSHAKRIQLMSKVENQEGVINFDEILRETDSFMVARGDLGMEIPVEKIFLAQKMMIYKCNLVGKPVVTATQMLESMIKSPRPTRAEATDVANAVLDGTDCVMLSGESAAGAYPEIAVKIMARICIEAESSLDYAAIFKEMIRSTPLPMSPLESLASSAVGTANKAKAKLIVVMTRGGTTAKLVAKYRPAVPILSVAPARHSLIYRGLIPILAEGSAKATDAESTEVILEAALKSATGKGLCKPGDAVVVLHRIGVASVIKICIVK

SEQ ID NO: 35756 - protein, 551 aa, Vitis vinifera
MGSSGFSWKLADHPKLPKGKILGMVVLDGWGEANPDQYNCIHVADTPTMDSLKKGAPEKWRLVKAHGSAVGLPTEDDMGNSEVGHNALGAGRIYAQGAKLVDFALDSGKIYEGEGFKYIKECFETGTLHLIGLLSDGGVHSRIDQLQLLLKGASENGAKRIRVHILTDGRDVLDGSSVGFVETLENDLAKLREKGVDAQIASGGGRMYVTMDRYENDWEVVKRGWDAQVLGEAPHKFRSAVEAVKKLREDTKASDQYIPPFVIVDENGKPVGPIVDGDAVVTFNFRADRMVMIAKSLEYEDFDKFDRVRFPKIHYAGMLQYDGELKLPNHYLVSPPEIERTSGEYLVHNGVRTFACSETVKFGHVTFFWNGNRSGYFDPSMEEYVEIPSDSGITFNVKPKMKAVEIAEKARDAILSRKFHQVRVNLPNGDMVGHTGDIEATIVACKAADEAVKIILDAIEQVGGIYVVTADHGNAEDMPLLDKTGKIQILTSHTLQPVPIAIGGPGLAAGVRFRNDVPGGGLANVAATVMNLHGYEAPSDYEPTLIEVIDN

SEQ ID NO: 35757 - protein, 303 aa, Vitis vinifera
MDKYEKLEKVGEGTYGKVYKAKDKTSGQVVALKKTRLEMDEEGVPPTALREVSLLQMLSQSLYVVRLLCVEHLDKNGKPFLYLVFEYLDTDLKKFIDSHRKPPNPRPMPPALIQSFLYQLCKGVAHCHSHGVLHRDLKPQNLLVDKDKGILKIADLGLGRAFTVPLKSYTHEIVTLWYRAPEVLLGSTHYSTGVDMWSVGCIFAEMVRRQALFPGDSEFQQLLHIFRLLGTPTEKQWPGVSSLRDWHVYPQWEPQNLARAVPSLGPDGVDLLSKMLKYDPSERISAKAALDHPYFDSLDKSQF

SEQ ID NO: 35758 - protein, 621 aa, Polaromonas sp. JS666
MTPTPARTHSAFQLLAAAFATILLVAGCASPPPFAYSVPLQPESASGYTEKPGWATSKFAVAAANPLATDAGYQVLKAGGSAIDAAIAVQMVLTLVEPQSSGIGGGAFLLHYNGKAVEAFDGRETAPAAVDEKLFLGADGKPMAFYDGVVGGRSVGVPGTVRMLEMAHKQYGKLPWAQLFAPAITLAEGGFKVSARLATQLKNDQHLKKDPVAAAYFYQANGEPLDAGFTLRNQPLANVLKKIAASGSKGLLEGDVAQAIVSKVQNHPTNPGKLSLADLAGYQAKKRDPICHDYQAQARDYRICGMPPPSSGAIAVGQILGILNNTNAATLALDTGMGGIPGSTGAAPSADWLHLYTEASRLAFADRAQYLGDPDFVQPPAGSWTSLLAPAYLADRAKLIAAQPGGQSMKVAKPGSPGGMRAAYAPMPEQPEYGTSHISIVDAYGNAIAMTTTIEDQFGARQMVNGFLLNNELTDFSYAPTDAAGKPVANRVQPGKRPRSSMAPTLVFEKITGQLVMSGGSSGGALIIHDIVKTLYGVLHWGLLPQQAIDLPNFGSLNGPSLLEEKRFAPATVEALRARGAEVREMNMTSGLQAIARGQAHGTPVWLGGADPRREGVVMGD

SEQ ID NO: 35759 - protein, 391 aa, Saccharomyces cerevisiae YJM789
MVSLFKRGKAPPLTKEGPTSKKPPNTAFRQQRLKAWQPILSPQSVLPLLIFVACIFTPIGIGLIVSATKVQDLTIDYSHCDTKASTTAFEDIPKKYIKYHFKSKVENKQQWRLTENENGEQSCELQFEIPNDIKKSIFIYYKITNFYQNHRRYVQSFDTKQILGEPIKKDDLDTSCSPIRSREDKIIYPCGLIANSMFNDTFSQVLSGIDDTEDYNLTNKHISWSIDRHRFKTTKYNASDIVPPPNWMKKYPDGYTDENLPDIHTWEEFQVWMRTAAFPKFYKLALKNESASLPKGKYQMNIELNYPISLFGGTKSFVLTTNGAIGGRNMSLGVLYLIVAGLCALFGIIFLVKLIFQPRAMGDHTYLNFDDEENEDYEDVHAENTTLREIL

SEQ ID NO: 35760 - protein, 336 aa, Burkholderia pseudomallei K96243
MTIRVAINGYGRIGRNTLRAFYENGKKHDLEIVAINDLGDAKTNAHLTQYDTAHGKFPGEVSVDGDYLVVNGDRIRVLANRNPAELPWGELGVDVVMECTGFFTSKEKASAHLKGGAKKVIISAPGGKDVDATIVYGVNHDVLKAEHTVISNASCTTNCLAPLVKPLNDKIGLETGLMTTIHAYTNDQVLTDVYHEDLRRARSATHSQIPTKTGAAAAVGLVLPELNGKLDGYAIRVPTINVSIVDLSFIAKRDTTAAEVNAIMKEASEGALKGILGYNEAPLVSIDFNHNPASSTFDATLTKVSGRLVKVSSWYDNEWGFSNRMLDTAIALANAK

SEQ ID NO: 35761 - protein, 456 aa, Chlorobium tepidum TLS
MTNDIFDISDNTPLVLMKQLTRQKRARFMAKLEYMSPCFSHYCRVSGAIVRDAEERGAIHPGMTLVDWTFGTSGIALAMAAVSRGYKVLLAAPESICREKQEVLRALGAELVLTPSEALPGDLQSCVDVAENLVRTLPNAWFANMYQNPVSRQVHQDGTGPEIFRQTEGKVTHLFVPMASGAMISGIGRYFKSVNPEVQIIGVEPEGSVYGDLHGGKSQGTPSAFQLEDIGAVRPTSFWDPNVIDRIVQVSDADAFNCGRELLRAEAVFAGGASGAAMAAALREGEAYGDDALVVVMMTDFGGYDLSRMYNDDWMRRQGFYRKSKTALDQITADDILQRKAHKDLIFAQPEQTLAEVFETMKQNDVSQMPIVSFGAPIGSISENRILSILIENDSAMNAKVVAFMEKPFPVCQPDATISELSEKLQTNASGVLISLSDGRLQLINKSDLIDVLTRK

SEQ ID NO: 35762 - protein, 442 aa, Picea sitchensis
MAKRVYQVWKGSNKFFLCGRLIFGPDVRSLVVTVFLIVIPVVIFCVFVAGKLLHNFPGYNSGYAILVVTIVYTVYVLVLLLLTSARDPGIVPRAPHPPEPEDIFDSANSPAEWAGGQTPRIRLPRTKDVTVNDVTVKVKYCDTCMLYRPPRCSHCSICNNCVERFDHHCPWVGQCIGQRNYRFFFMFVSSCTLLCIYIFAMSALYIKFLMDDDKHTIWQAMRHTPASIVLMIYTFITVWFVGGLTLFHLYLISINQTTYENFRYRCDNKVNPYNEGIITNFSAIFCTNIKPSQNNFRAKVQQEASVQTRVIPQSTDTRDVIGDLAAKVSIDLEAGRKAAMRDEFDPEREGHEELHSRKSNGPDTVMDIKEGYEDAFTRAIGRPLSLEGSEARSGSHPRHSSWGRKSGSWEITPDLPALPPGDKALPGNKGVAGTARPEDKSS

SEQ ID NO: 35763 - protein, 452 aa, Ashbya gossypii ATCC 10895
MSMPLKRRNKQSQGNEPKKIKVEEQEAEEKISEDIPVTDLKEPEALADIQSTSGGDEVSEGAQGDADPAEKSVGGLKEEVEDEEKGIVKFMFDGVEYKFRERPSVIEEKEGKIEFRVVNNDNTRENMMVLTGLKNIFQKQLPKMPKEYIARLVYDRSHLSMAVIRKPLTVVGGITYRPFEKGEFAEIVFCAISSTEQVRGYGAHLMNHLKDYVRATTNIKYFLTYADNYAIGYFKKQGFTKEITLDKSVWMGYIKDYEGGTLMQCFMLPRIRYLDAAKILLLQEAAIQRKIRTISRSHIVRPGLRQFEDLDNIEPIDPMSVPGLREAGWTPEMDELAQRPKRGPHYATMQNVLTELQNHAAAWPFLQPVNRDEVPDYYEFIKEPMDLSTMEIKLENNRYEKMEDFIYDARLIFNNCRAYNGENTSYFKYANRLEKFFNTKMKEIPEYSHLLD

SEQ ID NO: 35764 - protein, 769 aa, Burkholderia pseudomallei K96243
MSTSSSSSSSKEKLREAALDYHEFPTPGKVAIAPTKQMINQRDLALAYSPGVAFACEEIVENPLNAARFTARSNLVGVVTNGTAVLGLGNIGPLASKPVMEGKAVLFKKFAGIDVFDIELNESDPHKLVDVIAALEPTFGGINLEDIKAPDCFIVERECRKRMKIPVFHDDQHGTAIVVAAAVTNGLKVVGKSIKEVKLVASGAGAAALACLDLLVDLGLPLEHITVTDLAGVVYKGRAELMDPDKERFARETDARTLSEVIDGADIFLGLSAAGVLKADMVKKMAERPLILALANPTPEILPEVALEARPDAVLATGRTDYPNQVNNVLCFPFIFRGALDVGATTITREMEIAAVNAIAELAQQEQSDIVATAYGIQDLSFGPEYLIPKPFDPRLIVKIAPAVAQAAMDGGVATRPIEDMEAYKIHLQQFVYHSGTTMKPVFQIARGAPAEKKRVVFAEGEEERVLRAVQIVVDEKLAKPILIGRPAVIEHRIQRYGLRLTPGVDFTIVNTEHDERYRDFWQTYFKMMARKGISEQLARVEMRRRTTLIGSMLVKKGEADGMICGTISTTHRHLHFIDQVIGKRAGCSVYGAMNALVLPGRQIFLVDTHVNVDPTPAQLAEITIMAAEEVRRFGIEPKVALLSHSNFGTSNAPSAQKMRDTLAILQERAPDLHVDGEMHGDVALDAALRKEILPESTLEGEANLLVLPNIDAANIAYNLLKTAAGNNIAIGPILLGAAQPVHVLTESATVRRIVNMTALLVADVNAVR

SEQ ID NO: 35765 - protein, 434 aa, Streptomyces coelicolor A3(2) [sequence omitted]

SEQ ID NO: 35766 - protein, 604 aa, Oryza sativa Japonica Group
MASISGAAAPPSSSAACRLRLRRQLLLRPSHLRLRAPHSIADLSRSSSSSSEQQPSSTPAAPLASRPGQNGSTRGAVEKDPIKLWERYVEWLYQHKELGLFVDVSRMGFTEEFLRRMEPRMQRAFAAMRELEKGAIANPDEGRMVGHYWLRDPGLAPNSFLRTKIETTLDRILAFSQDVVSGKIKPPSSPAGRFTQILSIGIGGSALGPQFVSEALAPDNPPLKIRFIDNTDPAGIDHQIAQLGPELASTLVIVISKSGGTPETRNGLLEVQKAFRDAGLDFSKQGVAVTQENSLLDNTARIEGWLARFPMFDWVGGRTSEMSAVGLLPAALQGIDIKEMLVGAALMDEETRNTVVKENPAALLALCWYWASEGIGNKDMVVLPYKDSLLLLSRYLQQLVMESLGKEFDLDGNRVNQGLTVYGNKGSTDQHAYIQQLREGVHNFFVTFIEVLRDRPPGHDWELEPGVTCGDYLFGMLQGTRSALYSNDRESISVTVQEVTPRAVGALVALYERAVGIYASLVNINAYHQPGVEAGKKAAGEVLALQKRVLTVLNEARHIEMIYKIIQHMAANDRALIAEGSCGSPRSIKVYLGECNVDEDMLAA

SEQ ID NO: 35767 - protein, 313 aa, Zea mays
MLLHHRLLPRLLLVPSTHTSTLLCPSRLPRRLSLSPRFYALPHLAAPQTVDHSDDEGAPQGEGQIKLPLDHLFVPPGATMDAGDQEAVSARVLKGSNIVLGPYARGDAQVVNADFVKSSVRPDDCPRDGLPEFALVGRSNVGKSSLLNSLVRRKRLALTSKKPGKTQCINHFKVNDSWYLVDLPGYGYASAPQEARTNWDEFTRNYFLSRENLVSVFLLIDASIPAKKIDLDYASWLGQNKVPMTLVFTKCDKRKKKKNGGRKPEENVETFQGLIREYFEAAPPWIMTSSVTNQGRDEILLHMSQLRNYWLKH

SEQ ID NO: 35768 - protein, 489 aa, Licania elaeosperma
GPGVSAFEKKTLGRIAQIIGPVLDVAFPPGKMPNIYNALVVKGRDAVGQQINVTCEVQQLLGNNRVRAVAMSATDGLMRGMEVIDTGAPLSVPVGGATLGRIFNVLGEPVDDLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPQIVGEEHYETAQRVKQTLQRYKELQDIIAILGLDELSEEDRLTVARARKIERFLSQPFFVAEVFTGSPGKYVGLAETIRGFKLILSGELDGLPEQAFYLVGNIDEATAKATTLETENNLK

SEQ ID NO: 35769 - protein, 175 aa, Triticum aestivum
MAPTVMASSATSVAPFQGVKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVTFIAFKPPGCEESGQG

SEQ ID NO: 35770 - protein, 489 aa, Parinari sp. Mlangwa et al. 1138
GPGVSAFEKKTLGRIAQIIGPVLDVAFPPGKMPNIYNALVVKGRDAVGQQINVTCEVQQLLGNNRVRAVAMSATDGLMRGMEVIDTGAPLSVPVGGATLGRIFNVLGEPVDDLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPQIVGEEHYETAQRVKQTLQRYKELQDIIAILGLDELSEEDRLTVARARKIERFLSQPFFVAEVFTGSPGKYVGLAETIRGFKLILSGELDSLPEQAFYLVGNIDEATAKATTLEMENNLK

SEQ ID NO: 35771 - protein, 333 aa, Herbaspirillum seropedicae
MKRISLTQHLIEQQRLHNKIPSELRLLIEVVGRACKSISHAVGKGALGEVLGSAGSENVQGEVQKKLDVISNEILLEANEWGGHLAAMASEEMETIHRIPNRYPKGEYLLMFDPLDGSSNIDVNVSIGTIFSVLKAPEGMTEPTEQDFMQPGTRQVAAGYAVYGPQTVLVLTTGDGVHCFTLDREMGAWVLTQKDIKIPEDTKEFAINASNQRHWFPPVKRYVDEMLAGSTGVRGKDFNMRWIASMVADVHRILNRGGIFMYPADAREPNKPGKLRLMYEANPMAFIVEQAGGAATDGTRRILDIQPEKLHQRVAVFLGSKNEVDLVTSYHQQ

SEQ ID NO: 35772 - protein, 662 aa, Vibrio cholerae O1 biovar eltor str. N16961
MFYDVAQITPSYSKLQQFWLDSSIPIIAFVYAHEDALCGRLAANPRNVGMTTTKGSTMSSGLLSQINVFPVKSLGGLALSSAWVEKQGLTFDRRFMLALSDGSMVTARKFPQMVLIKTALRHDGVLFSAQGHPSLTIRYADFKFQPVPAQVWSDNFTAYTTTDEADDWFSQVLGIRVELLYSGEQSNRVREKVGHNVSFADGYPLLVISQASLDELNRRSPEFHSMDQFRTNLVVSGTEPFAEDSWKRIRIGEVEFEAVKPCERCILTTVEVKKGAFRPTKEPLRTLSQFRANERGGVFFGQNLVAKNEGMIRAGDPIEVLEYKEKEVYPDQGISHFTLTCVEREEIARDFVTFWLEPTQEIATQYFPGQYLPIEMVIEGEPVQRYYTLSSSPSRPGRLAISVKRIDGGRVSNWLQENLQIGTTLTAQHPTGHFHLDTTALQPLLLLSAGSGVTPMLSMLRYLADHNQLDDVVFYHQCRSEQDIPCQAELDALAKQHAGLTLIYALTQPSPQWQGEQGRLSLSHIKRIPNLVSRQVFVCGPDGFMQKAKNLLLKQGVAESAYHQEAFGTLQVAPREKKAVTLSFNGIQVSADNQKTLLEHAEDAGVRIPNSCRAGICGACKVKVKSGLVEQPKVPALMDHERSMGMALACCSVANTDLDVEF

SEQ ID NO: 35773 - protein, 776 aa, Cryptococcus neoformans var. neoformans B-3501A
MPSYFFFSLIIFNCISRMASPSSMRDDHLTFTTSTSDSDTLPSTSHNPNTGTNSRIARNLSDVLFGKTTMSGTSLNTTANESTPLLTELPSHEGRTPRRNFTASLDQVAEAEARNRVVKLNNASIILSESGELGDARSPQKRASITMAYAKRIKQRSKYYVPVTDWLPKYNWSLFSGDLVAGVSVACLLIPQAMSYASGLARLTPVAGLWSTAIPALIYGALGTCRQLSIGPEAALSLLIGQMIQEAVYGDPHSRPAHPEAEAAAIALITTLQIGVITSVLGLLRLGFLDVVLSRALLRGFITAVAVIIFIEQLVPMLGLTALLAQPTDPSQEPPTRPLSKLFFTINNIHSINVPTALLSFISLGFLIVVRVTKQKIAQTPGGKWVRYVPEILILVVGTTVLTNVLKWDDMGVEVLGKIKGGSSLPFGWPIYKKTMKYFNFTLPTAFVSSVVGVVDSIVAARENAAKYGYAVSPNRELVALGASNLVGSSIVGTGAIPVFGSITRSRLNGQIGSRTQMASIITSICMIFSIFFLLPYLYYLPKAVLAAIVTVVVYAILNEAPHEILYFWRMGAWTDFLQMVGTFFLTLCFSIELGLVASVVFSLILVIQSTSQPRIKIIGRVPGTNEWVPIDEDESAQEEIPGVLVVRIRENLSFANTGQLKERLRRLELYGMDKSHPSDEPRRESAKALILHMGDVEQIDASATQILYELTKAYHERGVGVHFAHLRPGQVNAFGIAGITDIVGPSHFHRDLSNAMREVESMGYGTSIFARWDPS

SEQ ID NO: 35774 - protein, 155 aa, Ustilago maydis 521
MIIPVRCFSCGKVIGDKWNAYLALLLDGRTEGEALTELDLKRYCCRRMVLTHVDLIEKLLHYNTGSQKTWIDMAVLLPTLYSSRAQSSGMKLLHPSPCPSYVLITSLYSSICSLLSAITLLDSSRVQSDRNLTTSAQHAYTSHTTSAKHKRTGTQ

SEQ ID NO: 35775 - protein, 407 aa, Haemophilus somnus 2336
MSNFDIITPDLPESVADATVVTWHKNVGDAVKCDEVLVEIETDKIVLEIPALSDGVLETILQPEGSTVVSKQLLGKVSASAGIGEVTKSTVQNVEKTPADRHSANLNTDASSDVLSPAVRRLLAEHELNADEIKGTGVGGRITREDIALVVKQKAQQTETAQASQSIVTGLKIDHRNEKRVPMTRLRKRIAERLLEAKNTTAMLTTFNEVDMQPIMNLRKRYAEKFEKQHGARLGFMSFYIKAVVEALKRYPEINASIDGDDIVYHNYFDISIAVSTPRGLVTPVVRNCDKLSMADIEKEIKLLAEKGRDGKLTVEDLTGGNFTITNGGVFGSLMSTPIINPPQSAILGMHAIKDRPVAVNGEVVIRPMMYLALSYDHRLIDGRESVGFLVTVKDLLEDPTRLLLEI

SEQ ID NO: 35776 - protein, 760 aa, Cryptococcus neoformans var. neoformans B-3501A
MPSYFFFSLIIFNCISRMASPSSMRDDHLTFTTSTSDSDTLPSTSHNPNTGTNSRIARNLSDVLFGKTTMSGTSLNTTANESTPLLTELPSHEEAEARNRVVKLNNASIILSESGELGDARSPQKRASITMAYAKRIKQRSKYYVPVTDWLPKYNWSLFSGDLVAGVSVACLLIPQAMSYASGLARLTPVAGLWSTAIPALIYGALGTCRQLSIGPEAALSLLIGQMIQEAVYGDPHSRPAHPEAEAAAIALITTLQIGVITSVLGLLRLGFLDVVLSRALLRGFITAVAVIIFIEQLVPMLGLTALLAQPTDPSQEPPTRPLSKLFFTINNIHSINVPTALLSFISLGFLIVVRVTKQKIAQTPGGKWVRYVPEILILVVGTTVLTNVLKWDDMGVEVLGKIKGGSSLPFGWPIYKKTMKYFNFTLPTAFVSSVVGVVDSIVAARENAAKYGYAVSPNRELVALGASNLVGSSIVGTGAIPVFGSITRSRLNGQIGSRTQMASIITSICMIFSIFFLLPYLYYLPKAVLAAIVTVVVYAILNEAPHEILYFWRMGAWTDFLQMVGTFFLTLCFSIELGLVASVVFSLILVIQSTSQPRIKIIGRVPGTNEWVPIDEDESAQEEIPGVLVVRIRENLSFANTGQLKERLRRLELYGMDKSHPSDEPRRESAKALILHMGDVEQIDASATQILYELTKAYHERGVGVHFAHLRPGQVNAFGIAGITDIVGPSHFHRDLSNAMREVESMGYGTSIFARWDPS

SEQ ID NO: 35777 - protein, 389 aa, Haemophilus somnus 2336
MNLHEYQSKKLFADYGLPVTKGYVCENVEQALSAIEKLSGSQWIAKCQIHAGGRGKAGGVKVVKSAQEVRSFFTKFLGQRLVTVQTNEQGQPIHQIYLEPCAEIQKELYLSAIIDRSSQRIVFMASSEGGMDIEEVAEKTPHLLHRVTIDPLVGAMPYQGRELAFKLGLSGKQIQQFSQIFCQLAKLFVEKDLSLLEINPLVILKNDELFCLDAKVVVDDNALYRHPDLFSMRDLTQEDPREAEAEKWNLNYVALDGNIGCMVNGAGLAMGTMDIIKLHGGRPANFLDVGGGATKERVMEAFKIILTDSAVKAVLVNIFGGIVRCDLIAKGIVSAINEIGVSVPVIVRLEGTNADLGREILAQSNLNLIAVNSLTEAAEQAVNAAKESE

SEQ ID NO: 35778 - protein, 372 aa, Wolinella succinogenes DSM 1740
MLLFTPGPTPVPESIRVAMGEPTIHHRTPEFEAIFAKTRALLQEMLGMSEVLMLASSGTGAMEACVSSLSAKKALTINSGKFGERFGKIAKALKIPSVEIKNDWDTPVSPAQVMEVLKSDSEIDAFFIQVCESAGGLRHPVEEIAQAIKAYNPNIMVVADAITAMGVEKIETTHIDALIGGSQKAFMLPPGMSIIGLSAKAVEKIEERDVGYYFNLKTEIKNQRKNTTAWTAPTTLIIGLGRYLEMAKERGFERIYEETRARALATQAAMKALGLVIFPKAPAVAMTTVIDEESAEGMRKLLKKEYGVNLAGGQDHLKGKIFRINHMGLIEVYESAWVVNALELALDRLGKRKFDGSANRLFLETYYKELGV

SEQ ID NO: 35779 - protein, 350 aa, Wolinella succinogenes DSM 1740
MKILVTGTAGFIGSHLAKRLLERGDEVVGLDNINDYYDLRVKYGRLERAGIESSSIEYGKLLSSATESNYRFVKLNLEDREALHALFEQEKFDKVCNLAAQAGVRYSLTNPYAYIDSNIVGFINILEGCRHFGVKHLAYASSSSVYGLNESMPFSTSDNVDHPISLYAASKKSNELMAHTYSHLYKIPTTGLRFFTVYGPWGRPDMALFLFTKAILEDRAIDVFNHGEMLRDFTYVDDIVEGVVRVIDNPPMGDPNWSGKHPNPGSSKAPYKIYNIGNNSPVRLMDFITEIEKNLGKVAKKNMLPLQMGDVPATYADVSDLVENLHYKPNTSIEEGIARFVKWYREFFRV

SEQ ID NO: 35780 - protein, 198 aa, Helicobacter pylori
MLVTKLAPDFKAPAVLGNNEVDEHFELSKNLGRSGAILFFWPKDFTFVCPTEIIAFDKRVKDFQEKGFNVIGVSIDSEQVHFAWKNTPVEKGGIGQVTFPMVADITKSISRDYDVLFEEAIALRGAFLIDKNMKVRHAVINDLPLGRNADEMLRMVDALLHFEEHGEVCPAGWRKGDKGMKATHQGVAEYLKENSIKL

SEQ ID NO: 35781 - protein, 198 aa, Helicobacter pylori
MLVTKLAPDFKAPAVLGNNEVDEHFELSKNLGKSGAILFFWPKDFTFVCPTEIIAFDKRVKDFQEKGFNVIRVSIDSEQVHFAWKNTPVEKGGIGQVTFPMVADITKSISRDYDVLFEEAIALRGAFLIDKNMKVRHAVINDLPLGRNADEMLRMVDALLHFEEHGEVCPAGWRKGDKGMKATHQGVAEYLKENSIKL

SEQ ID NO: 35782 - protein, 441 aa, Triticum aestivum
MYVPQSSRGGGGSSGEQPRVYQVWRGSNEFLLQGRFIFGPDVRSLFLTIFLILAPVLVFCIFVARHLMNDFPDHWGISVMVVAVVFTVYDLTLLLLTSGRDPGIVPRNTHPPEPESLDGNNDTGNGQTPQQLRLPRTKDVYVNGVVVKVKYCDTCMLYRPPRCSHCSICNNCVERFDHHCPWVGQCIGLRNYRFFYMFVFSTTLLCLYVFGFCWVYIIKIRDAEGSSIWKAMLKTPASMVLIIYCFICVWFVGGLSVFHFYLMSTNQTTYENFRYRYDRRANPYNVGVVNNFLEIFCTAVPASKNNFRARVPVEQGLQQSRPPTRGFMSPNMGKPVGDLELGRKPVSWDEPRSGADIRDLGVGGMLDEKEGRITHASPDLSREALPVELMEGRAVMHSRRSSWGHRSGTSESMDSIAVQMGGGETNWGSVSSGHGTTSGTH

SEQ ID NO: 35783 - protein, 484 aa, Picea sitchensis
MAILGGLLKSTNFNVSETSSQNIICLSPLNPSSYIASHNYGRSSRLLFQKPHHALTVAVAIKHHGRRMVPLRVSASSRRADGDQLDQLSAAASPVQQQEEEEVQEEEEGVEEAPPLNSKESNMEVVKEAIRRITEEDLDVAIEKYDLADELSAKIDYGQISAFTENPFGGNPAAVCYLPYEKESAWMQLVARQFNLSETAFLVKRWASSKKVSLEGEKALLELDANGKSLKAVKRNLAPAGPKNEFDLRWFTPQVEVDLCGHATLAAAHILFTSGIVEDDIVIFHTRSGVLKAKKIGGYDDPPPKGVENCKQRSGTGVVELDFPLVPASKCESAEVEKLSDVLGNVQIVWAGLNSLGDYLVEVPSTNDVKQLKPDFEKMLEFEGRGGLIVTSVADPDSEFDFISRFFCPKAGIPEDPVTGSAHCTLGPYWADKLQKDTLEAYQASERGGRVSVIVDKVGGRVNLQGSAVLVMVGTLLNSHIVSS

SEQ ID NO: 35784 - protein, 442 aa, Chlorobium tepidum TLS
MHPNPSAIVRKNIVSPSIGNATHPAERLSTGIVESGTLPNGLRIVSNQVPWIHSVTLGLWINAGSREDPEGFEGMAHFIEHALFKGTQKRDYVEIARCVEETGGYIDAWTTKEQTCLCVRCLREHLHLAFDLLADLCCNPVFPPDEIEKEKEVVLEEIASVNDTPEELIFEDFDRRAFSRHPLGTAILGTEESVERLTGKEIRDFMRRHYVPSKMLVTAIGNIEHDAVTGLAESFWGHLKDSPQEDSVRRLFDLSAYRPFTKTLKKSVFQSQILLGTIFPRDDRRFWGLMVLNAMLSSGMSSILNLELREKRGLVYQAYSSVSFYDEVTEFNVYAGTDKGKTSKTLDTIAELLTGNVLKEPDPFELAAAKSKMLGSMILGMEKMTRRMSHIAQDMFYFGRYLSPSEKAGMIDGVTAEDVAVAAAALGIPEQISTLVYKPGGR

SEQ ID NO: 35785 - protein, 198 aa, Helicobacter pylori
MLVTKLAPDFKAPAVLGNNEVDEHFELSKNLGKNGVILFFWPKDFTFVCPTEIIAFDKRVKDFQEKGFNVIGVSIDSEQVHFAWKNTPVEKGGIGQVTFPMVADITKSISRDYDVLFEEAIALRGAFLIDKNMKVRHAVINDLPLGRNADEMLRMVDALLHFEEHGEVCPAGWRKGDKGMKATHKGVAEYLKENSIKL

SEQ ID NO: 35786 - protein, 288 aa, Yarrowia lipolytica CLIB122
MLGKRFVGPVLTPKGARHSSISALAYKTLHRNRSQPKLPVIETPAWNANTAVSSILYETPMPSKAPIKAHVFNCLVQNEPGVLSRVAGTLASRGFNIDSLVVCNTEVADLSRMTIVLRGQDAVIEQARRQIEDLVPVWAVLDYSNASIIKRELLLARVSILGPEYFQDLLTHHGHEFEDAVLQNDFHPNNIAASEALRHKHQYLDAVTKLAHQFGGKILDISERNVIVELSAKPERVSSFLHLLKPFGILEVARSGMMALPRTPLETPDEEDIKKAEEVVDQTSLPPG

SEQ ID NO: 35787 - protein, 512 aa, Arabidopsis thaliana
MSPLISFTPTSLDFTFFAIIISGFVFIITRWNSNSKKRLNLPPGPPGWPVVGNLFQFARSGKPFFEYAEDLKKTYGPIFTLRMGTRTMIILSDATLVHEALIQRGALFASRPAENPTRTIFSCNKFTVNAAKYGPVWRSLRRNMVQNMLSSTRLKEFGKLRQSAMDKLIERIKSEARDNDGLIWVLKNARFAAFCILLEMCFGIEMDEETIEKMDDILKTVLMTVDPRIDDYLPILAPFFSKERKRALEVRREQVDYVVGVIERRRRAIQNPGSDKTASSFSYLDTLFDLKIEGRKTTPSNEELVTLCSEFLNGGTDTTGTAIEWGIAQLIANPEIQSRLYDEIKSTVGDDRRVDEKDVDKMVFLQAFVKELLRKHPPTYFSLTHAVMETTTLAGYDIPAGVNVEVYLPGISEDPRIWNNPKKFDPDRFMLGKEDADITGISGVKMIPFGVGRRICPGLAMATVHVHLMLARMVQEFEWCAHPPGSEIDFAGKLEFTVVMKNPLRAMVKPRI

SEQ ID NO: 35788 - protein, 268 aa, Burkholderia pseudomallei K96243
MASHRESNGALDAQHERYARYPSLVGRAVLITGGATGIGASFVEHFARQGARVAFVDLDEKAGRALVARLADAAHEPVFVVCDLTDIGALRGAIDAIRVRIGPIAVLVNNAANDVRHAVADVTPESFDASIAVNLRHQFFAAQAVIDDMKRLGGGAIVNLGSIGWMLKNAGYPVYATAKAAVQGLTRALARELGPFGIRVNTLVPGWVMTDKQRRLWLDDAGRAAIKAGQCIDAELLPGDLARMALFLAADDSRLITAQDVVVDGGWA

SEQ ID NO: 35789 - protein, 373 aa, Aphanothece halophytica
MLNKNTIFFGLLLFIPISLLGHWLHWDEVSIFLTASLAIIPLAAFMGEATEEIAIVVGPTLGGLLNATFGNATELILAFIALKSGLISVVKATITGSIISNLLLVMGFAMLLGGLRYKEQVFQSEVARVNASSMNLAVIAILLPTAVEHTSNGIGEETLQTLSVAVAIVLIIVYGLTLLFSMKTHSYLCEVGEIDQQSSSAMESGDKIPEKKPEDVNLWFWLGILLVVTITVAIESELLVNSLESATESLGLTALFTGVILLPVIGNAAEHFTAVTVAMKNKMDLSLSVAVGSTLQIALFVAPVLVIAGWIMGQPMDLDFNPFELVAVAVSVLIANSISSDGKSNWLEGSLLLATYIVIGLAFFFHPVVPEIG

SEQ ID NO: 35790 - protein, 239 aa, Synechococcus sp. CC9605
MADLQTQMKQAVADAAVEQIKDGMVLGLGSGSTAALMIQGLGAKLASGELKDIVGVTTSFQGEVLAAELNIPLLSLNAVSRIDLAIDGADEVDPGFQLIKGGGACHVQEKLVAARADRFVVVVDSTKLVDRLNLGFLLPVEVLPGAWRQVKQQLEALGGSAELRMAQRKAGPVVTDQGNLVLDAKLDGGISDPVALEQTINNIPGVLENGLFVNITDEVLVGEITDGVAGVRSLQKRLS

SEQ ID NO: 35791 - protein, 687 aa, Magnetococcus sp. MC-1
MEEILASLEEILDEAEDDQHGLEALRAKPYPSMAVGGEPTPRFEWADEDDTSEQNRLYMADPFAPDQAEEAGDGAVASEDEIVDLSGMETVAVVEEAVEEAAEEVAEEEAEEVAEEEAEEVAEEEAEEVAEEEAEQAVEEEAEEVAEEEAEEEAEEEAEEVAEEEAEEVAEKEAEEVAEEEAEEVAEEEAEEVAEEEAEEVAEEEAEEVAEEEAEEVAEEEAEEVAEEEAEEVAEEEAEEVAEEEAEEVAEEEAEEVAEEEAEEVAEEEAEEVAEEEGEEVAEEEAEEEAEEEAEEEAEEEAEEVAEEVAEEEAEQAAEEEAEQAAEEEAEEVAEEEAEQAAEEEAEEIAEEEAEEIAEEEAEEIAEEEAEEVAEEEAEEAAEEEAEEAAEEEAEEAAEEEAEQAAEEEAEQAAEEEAEEVAEEEAEQVAEEEAEQVAEEEAEEVAEEEAEEAAEEEAEQAAEEEAEEVAEEDAEEVAEEEAEEVAEEDAEEVAEEEAEEVAEEEAEEVAEEEAEEVVEEEAEEVAEEEAEEVAEEEAEEVAEEEAEEVAEEEAEEVAEEEAEEVAEEEAEEVAEEEAEEAAEEEAEEAAEEEAEEAAEEEAEEAAEEEAEQAAEEEAEQAAEEEAEQAAEEEAEQADEKGTVPDSVNAEAILALAREIAEQMIREQLPELLEKIIREEVERVRRGQ

SEQ ID NO: 35792 - protein, 390 aa, Oryza sativa Indica Group
MEMEVEVAGDDEAVPEAPERSVVLISAGASHSVALLSGGVVCSWGRGEDGQLGHGDAEDRPVPTVLTAAFDDAPGGVASVVICGADHTTAYSDEELQLYSWGWGDFGRLGHGNSSDVFNPQPIQALQGVRITQIACGDSHCLAVTVAGHVHSWGRNQNGQLGLGNTEDSLLPQKIQAFEGVRVKMIAAGAEHTAAVTEDGDLYGWGWGRYGNLGLGDRDDRLIPEKVSSVNISGGWRHTMALAADGKLYGWGWNKFGQVGVGDNEDHCSPVQVNFPNEQKVVQVACGWRHTLALTEAKNVFSWGRGTSGQLGHGEIVDRNIPKMIDALSSDGSACKQLESSKAVPMSAKVWVSPSERYAIVPDEKAGKGIPAGNGTETHVPQGDVKRMRV

SEQ ID NO: 35793 - protein, 197 aa, Ashbya gossypii ATCC 10895
MVAQVQKQAPAFKKTAVIDGVFDEVSLEKYKGKYVVLAFIPLAFTFVCPTEIVAFSDAAKKFEDLGAQVLFASTDSEYSLLAWTNIARKDGGLGNVNIPLVADTNHSLSRDYGVLIEEEGIALRGLFVIDPKGVVRHITINDLPVGRNVDEALRLVEGFQWTDKNGTVLPCNWTPGAATIKPDVAASKEYFSEAHKD

SEQ ID NO: 35794 - protein, 399 aa, Pseudomonas syringae pv. phaseolicola 1448A
MSGNRGVVYLGAGKVEVQSIPFPKMEDPRGKRIEHGVILRVVSTNICGSDQHMVRGRTTAQTGLVLGHEITGEVLEAGRDVEHLKVGDLVSVPFNVACGRCRSCKEQNTGVCLTVNPARPGGAYGYVDMGDWVGGQAEYVLVPYADFNLLKLPDRDAAMEKIRDLTCLSDILPTGYHGAVTAGVGPGSTVYVAGAGPVGLAAAASARLLGAAVVIVGDVNPKRLVHAKAQGFEIADLSLDTPLHEQIAALLGEPEVDCAIDAVGFEARGHGHAGAQAEAPATVLNSLMGVVRVAGKIGIPGLYVTEDPGAVDAAAKMGSLSIRFGLGWAKSHSFHTGQTPVMKYNRQLMQAIMWDRIKIADVVGVEVISLDDAPRGYGEFDSGVPKKFVIDPHRLFGAV

SEQ ID NO: 35795 - protein, 324 aa, Physcomitrella patens subsp. patens
MSNGAGEFELPQEMLAVLPSDPYEQLDVARRITAMAVAARVSKLESETGKLRQKLAEKEHLTYGLQERVVEAENTLQETSSRLSHALDEQTKLANEKNALAAQVKKLMRDVAKLETFKRTLMQSLQEDDDHPYVKAESTVSRAQLLDDDGQSAKSFSTSSSGTTEERGYREGAALKPPTRYQSSAHNSARGTPHLSPKLTPSGSPRGSGRTSPRRSMSLTDNSHRISLPSSKPTSQSTTAPNSPPSHGSDPSRTPRVDGKDFFRQARNRLSYEQFSAFLANIKELNAHRQTREETLRKAEETFGPENKDLYAAFDGLLSRHLPS

SEQ ID NO: 35796 - protein, 289 aa, Salmonella typhimurium LT2
MEYSILSNNLKMPMVGFGVFKVTDKEECQQSVLSAIRSGYRLIDTAAVYGNEDAVGDAVREAIATGLCTREELFITSKLWVQDMANYDLAKAGIEASLKKSGLDYFDLYLLHQAMGDYFSAWRALEDAYEAGKLKAIGVSNFYAHVLANFCETVRITPMVNQVELHPYFAQPAALETMKHYNVQPEAWAPLGGGRHKPYENVMLQGIADAHQKTIAQVVLRWNVQRGVTVIPKSTRQERIEENFAIWDFSLTDNEMAQINALDLGYVGEAVKHFNPEFVRGCLGVKIHD

SEQ ID NO: 35797 - protein, 258 aa, Oryza sativa Japonica Group
MDAVAGASVSSSSARLRPCPRPRRIGNVAPATVRRRSRRRAVTCAAAADADVVGLFDAAKLTVDRFVESGMVVGLGSGPASGLAIQYLGTRLRRGSLTGILGIPSSTISASEAVKAGIQVSSYEEGTQIDFAFTDADIIEEDTMTAVIGRRKTESGEPSFMVEKGIVKSADKLAFIIGHEKYVKGIEGSIPVLVKSVWRRPSIGTAGPLGGDFPLVTKEGHHVLDVIFTTPIPDLGKVAESLEKIAGVVDHGIVSSIP

SEQ ID NO: 35798 - protein, 265 aa, Coccidioides immitis RS
MAPSKWDDEEESTPPSTPPPFVARRKFDDEEDSDEVLDSWDAAEDSEVEREKEAKAAAAKAKAEAEAAAQRKSKAQRIAEHKARRALDEEESSEEEDAAEQRARLRRTEKESDLKHAQDLIGDIDLNRNRSAPKATVISDPNDPTKSVDISAMPLFKPGTKAQFTTLTETLAPLLAAQSKKPQYSIWVQEFTKQLVKELPSSEIKKVASALTAASNEKLKEEKAADKGGKKSKAAKTKTSLVTTHSNRADLTAYDGDELDDDDFM

SEQ ID NO: 35799 - protein, 402 aa, Prochlorococcus marinus str. AS9601
MSKLSLSSLDKTHLEGKKVLVRVDFNVPLNEDGQITDDTRIRAAIPTIEYLINHSAKVILAAHFGRPKGQVNEKMRLTPVAARLSELLGQNVALTNSCIGDEAVAQSNSLSNGDVLLLENVRFFGEEEKNDLEFAEKLASHADMYVNDAFGAAHRAHASTQGVTNYLSPSVAGFLLEKELKYLQGAVDSPNRPLAAIVGGSKVSSKIGVLDSLLDKCDKIMIGGGMIFTFYKARGLDVGKSLVEEDKLELAKDLEAKAKAKGVELLLPTDVVLADEFSPDANSKISQIDAISGNWMGLDIGPDSIKVFQNALAECKTIIWNGPMGVFEFDKFADGTNAIATTLADLSAFSEVCTIIGGGDSVAAVEKAGLAEKMSHISTGGGASLELLEGKTLPGVAALNDA

SEQ ID NO: 35800 - protein, 341 aa, Herbaspirillum seropedicae
MTQMMKAAVVREFGKPLSIEQVPVPTPAPGQILVKFEASGVCHTDLHAAHGDWPVKPTPPFIPGHEGTGYVAAVGAGVKHVKEGDRVGVPWLHTACGCCSPCRTGWETLCAEQQNTGYSVNGSFAEYGLADPKFVGHLPDNLDFGPAAPVLCAGVTVYKGLKETEVRPGEWVVISGIGGLGHMAVQYAKAMGMHVVAADIHEDKLALAKKLGADLTVDGRNHNAVAEVQRIIGGAHGALVTAVSPKAMEQAFGFLRARGTMALVGLPPGDISLPVFNTVLKRITVRGSIVGTRQDLEESLVFAAEGKVAAHFTWDKLDNINAIFARMEEGKIDGRIVLDLK

SEQ ID NO: 35801 - protein, 439 aa, Coccidioides immitis RS
MAITKIHARSVYDSRGNPTVEVDVVTETGLHRAIVPSGASTGQHEACELRDGDKTHWLGKGVLKAVKNVNEVIGPAVIKENIDVKDQSKVDEFLNKLDGTANKSNLGANAILGVSLAIAKAGAAEKGVPLYAHVSDLAGTKKPYVLPVPFQNVLNGGSHAGGRLAFQEFMIVPSSAAPSFSEALRQGSEVYHKLKALAKSKYGQSAGNVGDEGGVAPDIQTPEEALDLIAEAIEQAGYTGKVKIALDVASSEFYKPEEKKYDLDFKNPNSDKSKWVTYEELSDLYKKLASKYDIVSIEDPFAEDDWEAWSYFFKTSNIQIVADDLTVTNPIRIKKAIDLKACNALLLKVNQIGTLTESIQAAKDSYADGWGVMVSHRSGETEDVTIADIVVGLRSGQIKTGAPARSERLAKLNQILRIEEELGSSAVYAGENFRTAVNL

SEQ ID NO: 35802 - protein, 429 aa, Candida glabrata CBS 138
MRKCKVFVGNSHPELGNLVCQRLGIEPAPCTLKKFANGETSVQIGVSVRDEDVYVIQSGSPNINDHIMELLILVSACRGGSAKKITAVIPQFPYSKQCKMKKHRGAITARMLANLLVMAGADHVVSMDLHASQMQGFFTKPVDNLYGGPSLANWIRENVENYEEAVVVSKNPGGTKRVTALADVLKINFAMIHTDRRRAKDLYSQHRDMKQLRQRKQSLLRKNKPIIRQGDDPDEEENIILTNGIQTARIRNGHVIGDDEEDFIPESADEVAMESDAEDASVTDTYGLGGTYDAVDSEDEEEVSEAVKEKLITLVGNVNNRSAIILDDMIDRPGSLISAAEHLVKNCGAKKVYVVATHGLFTGNCLEELEESEVIDKIVVTNTYPISNDRIEKSEKLVVIDVSAIFAECIRRDHYGESISVLFDSLSTL

SEQ ID NO: 35803 - protein, 154 aa, Glycine max
ETSSNRQPASPSHLISLDRTPCAEPFQHKTTAKMSSTATVTRAHLENKLALAKRCSREATLAGAKAAAVATVASAVPTLASVRMLPWAKANLNPTGQALIVCTVAGMAYFVAADKTILSLARRHSYESAPDHLKDTSFAGAAAARPRPPAFFRP

SEQ ID NO: 35804 - protein, 469 aa, Desulfococcus oleovorans Hxd3
MADTEKKEKTPRQPMPEQPPKVRAKNFDEVPLGLSPEAAVAEASRCIQCKSPACVEGCPVRVDIPGFIRLVKDNDFTGAISKIWERNGLPAVCGRVCPQEAQCEGKCILGKKGDPVAIGNLERFAADHERANRKAPVPERAPATGKKVAVVGSGPSGLTVAGDLLLKGHDVTIFEAFHRPGGVLVYGIPEFRLPKEIVFSEVDGLETLGGKVETNVVVGRSVTVDELFEQGYDAVFLGVGAGLPMFLNVPGENFAGVFSANEYLTRTNLMKAYRFPEYDTPVIRGKNVVTVGGGNVAMDAARTALRLGAENSYIVYRRSKTELPARAAEVHHAEEEGVQFKLLTNPTQFFGDDNGRVIGMEALQMELGEPDASGRRRPVEIKGSEFRIDCDLVIIAIGAGANPLLTQSTEGLELNKWGYVVADEKTGKTTRKGVWAGGDIVTGSATVILAMGAGRVAADSIHDYLTIGW

SEQ ID NO: 35805 - protein, 261 aa, Mycobacterium sp. MCS
MYLPVRDGVARCQLYRPRAAPADEQLPVIVYYHGGGFTVGVSEDCDFLARKLAFTNSALVVSANYRSAPEFMFPTPLDDAFDVYRWVTVNAELVGGDATRVAVAGDSAGSNFAAALALRARDEHARVPDAVVMLGAMPDFHFERWDSFRAQAPRGIVYDMAFAGFIRGAYVGPTPWDHPWVSPIEGDLTGYPLTVITAGTHDPIVDSARAFGERIRAAGGQTVEYFPAGMPHGYYFFPGVHAEEDVAYEIVAEVLAKPFRR

SEQ ID NO: 35806 - protein, 402 aa, Rhodobacter sphaeroides 2.4.1
MTSSRLSSRLQAVQPSPTIAMTRLAAQLRREGKDIIGLSQGEPDFDTPVHIRQAAAAAIEAGQTRYTDVDGTPELKAAIVEKFRRENGLSYETNQISVGTGGKQVLYNALLATLDEGDEVIVPAPYWVSYPDMVRLAGGVPVTVSCPEEDDFLLTAPALRAAITPRTKWVILNSPSNPTGMGYSAAHLRALADVLLEFPHVLVMTDDMYEHLRYDGWEFATIAQVEPKLMDRVLTCNGVSKAFSMTGWRIGYAGGPADIIKAMATLQSQSTSNPSSVSQAAALAALTGPMEFLAERNEIFRQRRDLCLSALNQIEGLSCVRPNGAFYLFPSCAGMIGRTRPDGRKIETDTDFVMYLVEEAGVAAVPGSAFGLAPYFRISFATDTERLRTACERIRAASARLT

SEQ ID NO: 35807 - protein, 198 aa, Helicobacter pylori
MLVTKLAPDFKAPAVLGNNEVDEHFELSKNLGKSGAILFFWPKDFTFVCPTEIIAFDKRVKDFQEKGFNVIGVSIDSEQVHFAWKNTPVEKGGIGQVTFPMVADITKSISRDYDVLFEEAIALRGAFLIDKNMKVRHAVINDLPLGRNADEMLRMVDALLHFEEHGEVCPAGWRKGDKGMKATHQGVAEYLKENSIKL

SEQ ID NO: 35808 - protein, 574 aa, Oryza sativa
MLPFVRSLRRLGPAAADGRLLLPLAPLSSKAAAPPPEYEMPSVTWGVIQGRKERLVSRVLALDFLRSAGVSDPAGELEAVELPSSLEVLQERLDFLLRLGLSTDDLSAYPLLLACSLRKNAIPVLSYLEKLGVTRARLAAFVRAYPACLHASVAVDLTPVVKSLRGLDVDRQDLPRVLERYPDILGLKPDGTISTSVAYLVGIVGVAPRDIGPMVTHFPFFLGMRVGTTIKPLCEYITSLGLPMRILARILEKRPYILGYDLEETVKPNVEALLSFGIRKEMLPLVIAQYPPILGLPLKTKLAAQQYFFNLKLQIDPDAFACAIEKLPQLVSLHQNIILKLVEFLRGRGISNEDVARMVVRCPQILLLRMELMKNSLYFFKSEMKRPISELLDYPEYFTYSLESRIKPRYMRVSTKGIRCSLDWFLNCSDQRFEERMRGDFIEGDAPGPSFTMGGKLQMPGSQLVSDDDNAESDDEIWWRIIPKIFRDVLLTASCTQAIPSLSVNSCLVICICKLKFANHAGILNCKMKKALALMEHSHTNRGHWSAGLSNSSKGLTKVLYRTLLKKNSNNSPS

SEQ ID NO: 35809 - protein, 491 aa, Xanthobacter autotrophicus Py2
MSSRVIPVQPFVLTVFGATGDLARRKLLPALYQRDRAGQLPERAAIVGASRQQMTPEAFVAFARAAITEYVPAGDLEDADVARFLARLTYVPVEAEGEGGWPQLAALIATHTDMIRVFYLATGPALFGPICSRLGAHGIAVDGARVVVEKPLGKSLESAVALNKAIGEVFEERNVYRIDHYLGKETVQNLMALRFANNLFEPVWNNAHIDHVQITVAEDIGTAGRAGYYDTAGALRDMVQNHILQLLCLVAMEPPVSLDADAVRDEKLKVLKALLPITEANAGQLTVRGQYRAGASAGGAVPGYLEELGSSTSETETFVALKAEIGNWRWSGVPFYLRTGKRLASRVSEIVITFRPVPHSVFDASAGTLRANVLVLRLQPEEGVKLWLMIKDPGPGGMRLEHVPLDMSFASVFGVRNPDAYERLLMDVVRGNQTLFMRRDEVEAAWRWVDPILEAWRASREPPKPYTAGTWGPAAAIALIERDGRTWSGDD

SEQ ID NO: 35810 - protein, 527 aa, Streptococcus thermophilus LMG 18311
MQKERVIMTNISTLNDVQKIIVLDYGSQYNQLIARRIREFGVFSELKSHKITADEVRAINPIGIILSGGPNSVYAEDAFGIDEEIFELGIPILGICYGMQLLTHKLGGKVVPAGEAGNREYGQSTLRLRAQSELFAGTPEEQVVLMSHGDAVTEIPEGFHLVADSVDCPFAAMEDTKKNFYGIQFHPEVRHTVYGNDILKNFAFSICGAKGDWSMANFVDMQIAQIRETVGDRKVLLGLSGGVDSSVVGVLLQKAIGDQLTCIFVDHGLLRKGEGDQVMEMLGGKFGLNIIRVDASKRFLDLLAGVDDPEKKRKIIGNEFVHVFDDEASKLKGVDFLAQGTLYTDIIESGTETAQTIKSHHNVGGLPEDMQFELIEPLNTLFKDEVRALGTELGMPDEVVWRQPFPGPGLAIRIMGEITEEKLETVRESDAILREEIAKAGLDRDVWQYFTVNTGVRSVGVMGDGRTYDYTIAIRAITSIDGMTADFAKLPWEVLQKISVRIVNEVDHVNRIVYDITSKPPATVEWE

SEQ ID NO: 35811 - protein, 161 aa, Podospora anserina
MAEPIKISTLDELNQLITSTKYVILDFWAEWCGPCKAIAPLFAKLSKSHSVPGQLAFAKIDVDASADIAKEYGITAMPSFVFVVDGQVGKGIDVQGRKLGGGVKLGEGESADRVVQIRGADPRNLTLLANELGGLAKKGAEGSAEEAPKEEEKEEEAAATA

SEQ ID NO: 35812 - protein, 441 aa, Zea mays
  misc_feature (203)..(203): Xaa can be any naturally occurring amino acid
  misc_feature (215)..(215): Xaa can be any naturally occurring amino acid
  misc_feature (259)..(259): Xaa can be any naturally occurring amino acid
MAGLPPVARRRPLATASSLLLLLLLLVVTAAAREERGLARVQGPPPRHRHAYAAMMYMGTPRDYEFYVAVRVMMRSLPRVRADADRVLIASADVPRDWVRAMTEEDGMRVLIVENLRNPYESNLGGTNKRFKLTLNKLYAWTLVDYERVVMIDSDNIFLQNTDELFQCGQFCAVFINPCYFHTGLFVLQPSIDVFRSMLHDLXTGRENSDGAELXDLKLHWHVPCGQNSVITFPSAPWFKPWYWWSWPVLPLGLSCLRXHRYASEMPVILMEVLMYIVIITVTRLARPGMTKLCYNRRPEKQSALVQWLIKLTAIVAMVAAYSIPFFVVPRTVHPIMGWSVYLFGALALSVLVINVFLLPPLDVLTTWLAIVGMLIVMAFPWYHDGVVRALAVFGYAFCSAPILWASMVRMMDSLQTMLERDSFFPRIGEPAQETEFSKLY

SEQ ID NO: 35813 - protein, 63 aa, Brassica napus
MRGILVDWLVEVSEEYTLVPDCVYLTVYLIDWFLHGKYLERQRLQLLGITCMLIASKYEEIYP

SEQ ID NO: 35814 - protein, 448 aa, marine gamma proteobacterium HTCC2143
MQTDSHASDSIPHLKPIESGFFETLRIMKKSYNSPLEHCQTMQKEHGNAVMQKMGKLNYVHLFGADANHLAVMNPNQILSNKNSWDLIIGRIFTNGLMLRDGDDHRYHRRIMQAGFKAKAMKSYMATMVDLVPDAIADWPTGDGDIMLAYPAFKQLTLDLAATIFLGMDLGDEATKINKAFETCVAASMPKIPVAFPGTILWRGIKAREYMCSFFHSCIAEKRAGNGNDMFSLLCNAKDEEGNQYTDQEIVDHMIFLMMAAHDTTTSTLTSMTYALAKNPEWQERLYQEVQSLEIDQLNYENLDKMVETEWVMKEALRMYPPLSTLPKFSLKEFEYDGRLIPAGAMVITYPIHTHYMDEYWDKPTTFDPLRFSEERSEQKRHASSWIPYSGGAHMCIGLHFAVMQIKLVMFDMLKRYRWSVPADYDMPVQQSPISKPKDGLPISLELR

SEQ ID NO: 35815 - protein, 198 aa, Helicobacter pylori
MLVTKLAPDFKAPAVLGNNEVDEHFELSKNLGKNGAILFFWPKDFTFVCPTEIIAFDKRVKDFHEKGFNVIGVSIDSEQVHFAWKNTPVEKGGIGQVSFPMVADITKSISRDYDVLFEEAIALRGAFLIDKNMKVRHAVINDLPLGRNADEMLRMVDALLHFEEHGEVCPAGWRKGDKGMKATHQGVAEYLKENSIKL

SEQ ID NO: 35816 - protein, 268 aa, Picea sitchensis
MARSGLGFSILRGGLGVAAICYVGVDYLRRIAPSWHAFLQPILWSVLALAAVCRAPFYPHWSTELQSALPFVGSLLFLVLALALEAISVQFVTAVLGLDWHRTAPPLPDTGQWLFLALNERLPLTIVQVLRAPLIGLHHYLMLFLMLAFSVLFDCVKAPGLGLGARYMFTMAVGRLLRVMTFVATILPSARPWCASARFDIPDHPHPWAQKYYMPYSSDPNMIRQLLRHDMVNVPIEEYPAEIIPDWGWMKFLVNILRPTSPSTSEET

SEQ ID NO: 35817 - protein, 57 aa, Brassica napus
DWLVEVSEEYKLASDTLYLAVNLIDRFLSNNYIEKRRLQLLGVTCMLIASKYEEIYP

SEQ ID NO: 35818 - protein, 198 aa, Helicobacter pylori
MLVTKLAPDFKAPAVLGNNEVDEHFELSKNLGKSGAILFFWPKDFTFVCPTEIIAFDKRVKDFQEKGFNVIGVSIDSEQVHFAWKNTPVEKGGIGQVSFPMVADITKSISRDYDVLFEEAIALRGAFLIDKNMKVRHAVINDLPLGRNADEMLRMVDALLHFEEHGEVCPAGWRKGDKGMKATHKGVAEYLKENSIKL

SEQ ID NO: 35819 - protein, 63 aa, Brassica napus
MRGILADWLVEVSEEYTLVPDTLYLTVYLIDWFLHGNHIERQNLQLLGITCMLIASKYEEIYP

SEQ ID NO: 35820 - protein, 365 aa, Zea mays
MALRRLLQGSVLPRIIGRDLAPAVAPFSTESGETIRATLFPGDGIGPEIAESVKQVFNVAGVPIEWEEHYVGTEVDPRTESFLTWESLESVRRNKVGLKGPMATPIGKGHRSLNLTLRKELGLYANVRPCNSLPGYKTRYDDVNLVTIRENTEGEYSGLEHQVVRGVVESLKIITRQASLRVAEYAFHYAKANGRERVSAIHKANIMRKTDGLFLKCCREVSEKYPEIQYEEVIIDNCCMTLVKNPGLFDVLVMPNLYGDIISDLCAGLIGGLGLTPSCNIGEGGICLAEAVHGSAPDIAGKNLANPTALMLSAVMLLRHMQFNDKADRIHNAILQTIAEGKYRTADLGGKASTSEFTNAVCDHI

SEQ ID NO: 35821 - protein, 165 aa, Methanosarcina acetivorans C2A
MTERQVESVLIEIPKGSRNKYEYDKEKKVIKFDRMLFSSMVYPCDYGFFPDTLALDGDPLDALVLTWEPTFPGCVIDVHPVALLDMKDDKGRDEKILCVPETDPLWNYIETLEQVPPHLLKEIVHFFETYKNLEGKHVIVIGWEGLDAAVDMLREAKSRYLEKNK

SEQ ID NO: 35822 - protein, 409 aa, Yersinia pestis biovar Microtus str. 91001
MGSVMTDKLAVNRNTFDQVILPVYAPAQFIPVKGKGSRVWDQQGTEYIDFAGGIAVTALGHCHPALVSALHQQGETLWHTSNVFTNEPALRLAQKLIAATFADRVFFANSGAEANEAAFKLARHYAIERHSPYKTKIIAFHNAFHGCTLFTVSVGGQPKYSDGFGPKPADIIHVPFNDLAAVKAVMDDHTCAVVLEPIQGEGGITSATPEFLQGVRALCDQHNALLVFDEVQSGMGRSGKLFSYMHYGVTPDILTTAKALGGGFPISAMLTTEEIASVMTVGTHGTTYGGNPLACAVAEAALDVINTPEVLNGIEQRHGLFVQALQSINSKYDVFSDIRGMGLLIGAELTAKYRGQAREFLAAAAANGLMILNAGPDVLRLAPSLVIELEDIQQGMARLEKAMASVIKG

SEQ ID NO: 35823 - protein, 431 aa, Oryza sativa Japonica Group
MATMSRRALGSAFAGFTRTPAMTPTATLPSSCASPARLLRWRRSAGVGARRFASGRNARISMSLRAGIVGLPNVGKSTLFNAIVENGKAQAANFPFCTINPNVGVVAIPDARLHVLSKLSKSKETIPTSIELVDIAGLVKGASKGEGLGNQFLSNIREVDSILQVVRCFEDDDIVHVSGKVDPKSDIDVINLELIFSDLDQIEKRLDKLKKSKTKDQQVKVKEQAERTGLEKIQTVLMDGKPARSVDLADHEKEAIQHLCLLTMKPVIYVANVTESDLAEPGNNPHVKEVAKLATDLESGMVTISAQVEAELAELPLEERVEYLKSLGVTESGLGNLVKATYDLLGLRTYFTTGDKETKAWTILAGMTAPQAAGVIHSDFQKGFIRAETVSYDDFVAAGSLGVAREKGLLRLEGKDYIVQEGDVMLFRFNV

SEQ ID NO: 35824 - protein, 233 aa, Oryza sativa Japonica Group
MDMDSWERLAADARLQDALIGMEEAEGSEGEEEAAEVACPFCDEEFDGFGLCCHIEDEHQAENRAGVYKLIHEVFLSCFHYRVLKVCPICYDAVGMDLVSHITSEHPSFFKGKWRNRRVSHGSHSSTRATLKKDAAYLQYRYGGSTRAASHNTDPDPLLSSFVGNFTDTDLPKDVQQEFRDETDEKSDSLVQKEQKPVESADEPLLPEVKEERTRRSQFVQGLVLSLMFDDIL

SEQ ID NO: 35825 - protein, 318 aa, Apodachlya brachynema
SKVGINGFGRIGRLVLRAAENNPLINVVAVNDPFIPTNYMEYMLKHDTVHGMFNGTVSHEGDHIIVNGRKVRVFGERDPQNIKWSDCDIEYVVESTGAFTTLEKASAHLKNGPKKVVISAPSADAPMFVMGVNHQLYTNNMNVVSNASCTTNCLAPLAKVVNDSFGIKEGLMTTVHAVTASQLSVDGPSKKDWRGGRAACFNIIPSSTGAAKAVGKVIPELNGKLTGMSFRVPTADVSVVDLTCRLNNKASYDEIKAAIKYASENELKGILGYTDAAVVSSDFITDSRSSIFDASAGIALTDDFVKLVSWYDNEWGYS

SEQ ID NO: 35826 - protein, 608 aa, Oryza sativa Indica Group
MRRGAIVDSPLLRPNVGAALGQGAAMPAVHLDFGRLQQPPSGFRLHNVRNLPLQFTSTHLEGSRIRRGRRRFLPSRREVAAAIHVLVESCWNNNPLVPACVASSVRSSWFLTASPGIASLQVAGRAMSEFLTGSFQGEQALLKEESTERVCIDNSTCSDFTLVKVDSMNKNGILLEVVQVLSDLDLAISKAYITSDGGWFMDVFHVVDKQGQKVTDEKTIKHIEKALGPDSNLLGGAKGGSSPVRSVGMHSIGDHTAIELKGPDRTGLLSEVFAVLAELGCNVLAAEVWTHRARVACVVYVNDVASGQAVGDPCRLSRIEHRLRLVLRGHAGGDDGDGDDGPAHANFFSSGGAGSNTHVDRRLHQLMHADVDADDDDGLDSRAIVSGEAGNAAAAEERPVVTVEHCEEKDYSVVNVKCRDRSKLLFDIVCTLTDMHYVVSHASVSSDGIYGIQELYIRRKDGRTLQKDEAGRVIKCLEAAISRRVSEGFTLELCGRDRVGLLSDVTRVLREHGLTVTRADVTTVGGQAINVFYVRDASGEPVDMKTIEGLRVQVGHTVMLNVKKVPSSPSSSSSAAAANGKSPGQPASGALSRTSFFSFGNLFAKLRA

SEQ ID NO: 35827 - protein, 409 aa, Zea mays subsp. parviglumis
MQFALALDTNSGPHQIRSCEGDGIDRLEKLSIGGRKQEKALRNRCFGGRVAATTQCILTSDACPETLHSQTQSSRKNYADANRVSAIILGGGTGSQLFPLTSTRATPAVPVGGCYRLIDIPMSNCFNSGINKIFVMSQFNSTSLNRHIHRTYLEGGINFADGSVQVLAATQMPEEPAGWFQGTADSIRKFIWVLEDYYSHKSIDNIVILSGDQLYRMNYMELVQKHVEDDADITISCAPVDESRASKNGLVKIDHTGRVLQFFEKPKGADLNSMSVETNFLSYAIDDAQKYPYLASMGIYVFKKDALLDLLKSKYTQLHDFGSEILPRAVLDHSVQACIFTGYWEDVGTIKSFFDANLALTEQPSKFDFYDPKTPFFTAPRCLPPTQLDKCKMKYAFISDGCLLRECNI

SEQ ID NO: 35828 - protein, 615 aa, Yarrowia lipolytica CLIB122
MSTGRAYMTSRIANSPTRPKSPTQTSSVMSETKPVQAESISITSEAGQVTGQVEVMPSNAWQRFKYGFGPADTTDMDFTGLTPMEITALKTANSPLQRNLKGRHLQMIAIGGSIGTGLFIGSGSTLSQGGPAALLIAYGIIGVMLLLTMHALGELAVCFPVSGGFFTLFTRFIDPGWGFAMAWNYVMSWFVILPLELVAAAMTVNFWNEINGTSINTAAWIIIFWTLIVCINLFGVRGYGEAEFVFSIIKIAAICGFIIFGIIMAAGGGPSDGAFSSYQGGKLWKSPGTLANGFKGVCSVFVTAAFAFAGTELAGLAAAETENPRKMLPKATKQVFWRICLFYIVALTVVGLLVPYDNEMLLNGSSSADATASPFVIAIRLAGVKGLPSVMNVVIMIAVLSVGNAGVYAFSRTIAGMAEAGQAPKMFAYIDRQGRPIVGIAVVLIFSLFAFISAAGAEVRSAVFNWLLALSGLSSVVVWGSINLAHIRFRQALKYRGRDTGELTFSAGFGVYGSYVGLSLNILVLIAQFWIALFPLGGKPNAEDFFMAYLAAPVILAFVIGYKLVKRDGILKISEIDIDTGRREKDLEKLKAEIAQEEYDLSQRGFAYRVYNFWC

SEQ ID NO: 35829 - protein, 306 aa, Photobacterium sp. SKA34
MSKLVVLGSVNADHVLQVPSFPRPGETLHGRNYQVIPGGKGANQAVAAARLNADIGFIACVGDDAFGLLMHDNFIKDGIDVRGVKTEMGTPTGIAMIQVSDCGENSICLSAEANNKLTEQAIESDLDTIRQAEYLLMQLETPMCGIEKAAKVAKLASTTVILNPAPARELSDELLACVDVITPNETEAEVLTGVMVTDNQSAQQAADILHGKGIKTVMITLGAKGVWLSQNGSGDIISGFRVEATDTTAAGDTFNGALVTGLLEDLALESAIKFAHAAAAISVTRFGAQTSIPTREEVDLFLAQHA

SEQ ID NO: 35830 - protein, 321 aa, Isochrysis galbana
SKVGINGFGRIGRQVVRIAMDRDAFVLKHINSPMTPEYMKYLLEHDTVHGRFPGTCEVNKDGLVINGLPVSLSSTRDPTEIPWGKVGVEYVCESTGAFLSTPDCLKHIAGGAKKVIISAPAKDAETPTIVVGVNTDTYDPETMNVVSCASCTTNGLAPLVKTINDKFGIKQGLMTTVHAATASQVVVDSSMKGADWRAGRAASANIIPSSTGAAKAVAKCYPVMKGKLTGMAFRVPTVDVSVVDLTCELETPCTYDEIKAEVKLASETYAKGIVGYTEDQVVSSDFVGETCSTVFDAGAGIQLTPTFVKLVSWYDNEWGYS

SEQ ID NO: 35831 - protein, 187 aa, Ashbya gossypii ATCC 10895
MSINEYAKELKAALAQYPNFPKEGVLFEDFLPIFRSPQLFQKLIDAFKMHLAEAFPETKIDYLVGLESRGFLFGPSLALAIGAGFVPVRKAGKLPGQVVKTTYVKEYEEDVFEMQVDSIPVGATVVVVDDILATGGSAGAAGDLIKQLGATILEFIFVMELDFLKGREKLQAPVFTLLQGQEEALGN

SEQ ID NO: 35832 - protein, 1551 aa, Kluyveromyces lactis NRRL Y-1140
MSQNNDSRDEAYVREQFQRYTTKMASNKNSNTDSKCRSTSHLNSLASISSDTSNETLKGNLSAASPTFSSDSTLSTKKLPVLQTLPTSLPNGQHQQGQLFPASSSSSSAISSRKPSVSGSFGTQTPTTAQLKTITSPKLSGALSTRSRSNSLTSSKLFALNQSNDSPSSTSVYPVPPNVASLNSQTASSMSVSTSADQYFPAQQNGSTTTVNLTPTLSSPSIRSLNNSTTSTTKSFKPLQKQYVLNEQLYLSSMKNKKADDYYTRGITSSGNEDDDDFRVDGENDDVDNDLSKLNNGLGSAIFGNNIATTTDKGFHSIDDDELVLMNDKILLERMEWLRSVEPNNPLIENSLNLLNKTGGSTDSLESFSNIETQLALEQLSNNHLVRERLEWQTMLSSVLNGDIVKSEKTKLAKRKPDEILLNHNDLIWLELKAWLNGRTVEDQRKSLEYSKTTADEVFEEILNYKNEKEENPEVVIEEAKILLNKYYKVVGYWKNLPNMNLEKPVTKTSNFVSRIEALNSLINSYEGLQYEIEALKQWTQNDDLDVTFTKDSLDTEGIFKNDRSFAEQIMKEKDIEGIFQKKIFFKHAPWMFKSKLVFLKQQNSIHEMRLPLPVDKLHSLLTFPLRLIQEIISIRLEYARKLKKPTMMMIDQMIDDFSTYIKLSVQIKHTLMEYRSGWSLKVEISDAFDAKVVEAIEFLFKLLHLKLIDSSKNSFKTFKEPDILFAHWENLKNFGCYISGASKVIAQGFVNITIRLLNRLHLYIMEEQRNSVDLVTSDDARKWVVEVIENVGAFKRKTNRFSNVLTKAFQNSVLYNIKDHSMLLERLRNSGHFLIYTGGILEQNGIYLIASEELLGCSDDEIMDIIKSTKIGSDLIPKVEINNSLTIYNPPEDLTLPEAMFVQKERRNGVSYYHLKQDDLTQRVGIRGKGGSSTAPEEEGEELVQLENKLKMLGYVLVFCPTKPMVWNGEMYNLTSEEPLTMEEFGLSVEEDVIVMLNQGSTYALDYQVDRFQHFAGDAISIREKKCAINSIETALQRINKSYFRMTYIVLKNFGSVQKNVTLQTNESVFFNIAYLFVKDFAKNFLLLNVATPETKAIIIRLMIQISIDWLTFVLDECDPANPETFRWCVPAMEFAMRMTNGWNILGIEEKEFKLLKEKIARCMSLLISHFDITGARSREAERIDAQQTRPNFDIDDADDDMILAVNSEMRMNAITDMEKVVKVKRHYSVGKVIDDTDNQSKLLKSLASSISNLSIRWQKRSFIGSGSFGTVYSAVNLDTGDILAVKEIKIQDAKSMKQIFPSLKEEMRVMEILNHPNIVQYYGVEVHRDKVNIFMEFCEGSSLASLLEHGRIEDEMVTQVYTLQLLEGLACLHQSGVVHRDIKPENILLDRNGVIKYVDFGAAKLIAKNGSKRISLDANNKSTGGKDMIGTPMYMAPETVTGQGHGKFGSDDIWSLGCVVLEMVTGRRPWANLDNEWAIMYHVAAGHLPQFPTKSEISSAGRKFISRCLIQDANKRATAMELLLDPWISQIRNIAFGGNAESFNNETHN

SEQ ID NO: 35833 - protein, 321 aa, Isochrysis galbana
SKVGINGFGRIGRLVCKAACMKDGATVTAVNDPFCDVEYAAYLFKYDSTHGRYKGTVTFDTASSTLIVDGQKIKFYACRNPNEVPWGEAGADIVCESTGIFTVIEKASMHLQGGAKKVIISAPSADAPMFVMGVNHTSYTKDINILSNASCTTNCLAPLAKIINDEYGIVKGLMTTVHATTATQKTVDGPSGKDWRGGRGAGQNIIPSSTGAAKAVGKVIPALNGKLTGMAFRVPTPDVSVVDLTCVLGKPASYAEICEFIKKSCEKPEYKGIMAYTDEEVVSNDFISDPASSTFDAKAGIGLDDTFVKLVSWYDNEWGYS

SEQ ID NO: 35834 - protein, 242 aa, Zea mays
VLIGSNGTADQVEKIVKTLNEGNVPSSDVVEVVVSPPYVFLPVVKSQLRQEFQVAAQNCWVKKGGAFTGEISAEMLVNLGVPWVILGHSERRALLGESNEFVGDKVAFALSQGLKVIACVGETLEEREAGSTMDVVAAQTKAIAEKIKDWSNVVLAYEPVWAIGTGKVATPAQAQEVHASLRDWVKINVSPEVSESTRIIYGGSVTAANCKELAAQPDVDGFLVGGASLKPEFIDIINAAAV

SEQ ID NO: 35835 - protein, 319 aa, Mallomonas rasilis
SKVGINGFGRIGRLSLRAVKGHPNVKVVAINDPFIPLDYMKYMFYYDSVHGKYDGTVTIDNGKLIVDGTPITVSNEREPEKIKWGDAGAEIVLESTGKFLEEAGAAKHFVGGAKKVVMSAPSKDATPMFVMGVNHFEYKGQKIVSNASCTTNCLGPLAKVINDNFGIQEGLMTTVHAATATQPTVDGPSVKDWRGGRGAVGGNIIPSSTGAAKAVGAVIPALKGKLTGMAFRVPTANVSVVDLTCVLTKGAKYSDIKAAIKAASEGPMKGILGYTEDSVVSTDFISDPRSSIFDAGAGIALNDKFVKLVSWYDNEWGYS

SEQ ID NO: 35836 - protein, 430 aa, Prochlorococcus marinus str. AS9601
MKETIDFLIDTVEARQVLDSRGNPTVEAEVFLECGASGRAIVPSGASTGAHEAHELRDGGSKYMGKGVLNAVNKIHETISPALCGLSSLDQTAVDKLMIEIDGTPNKSNLGANSILAVSLATARASANALDIPLYRYLGDPLSNLLPVPLMNVINGGAHAPNSLDFQEFMLVPHGVNNFSESLRMGTEIFHSLKSLLDQKGLSTAVGDEGGFAPNLSSSVEAGDLLLEAIQKAGFKPGEQVSLALDAASTEFYRDGIYKYEGKSLNSSEMISYLSRLVSNYPIVSIEDGLAEDDWEGWSELNKELGNKVQLVGDDLFVTNTERLRKGIIEKSANSILIKVNQIGTLTETLEAIELAKMSGFTSVISHRSGETEDTTIADLSVATRSGQIKTGSLSRSERIAKYNRLLKIEEELGNQARFAGALGLGPKNI

SEQ ID NO: 35837 - protein, 951 aa, Oryza sativa Japonica Group
MALRFEVLGRFNRARAARLTLPHFTCQTPLFMPVGTQGTIKGLTTDQLEEIGCQIILGNTYHLELRPGSQLIDDLGGLHKFMNWKRALLTDSGGFQMVSLLHLADITEEGVTFQSPVDGKPMLLTPEESIHIQNNIGADIIMALDDVVKTTITGPRIEEAMYRTLRWIDRCIAAHKKPDVQNLFGIVQGGLDPVLRDICVKGLVERNLPGYAIGGLAGGEDKDSFWRVVAQCTAGLPEDKPRYVMGVGYPLDIVVCSALGADMYDCVYPTRTARFGTALVPEGVLKLKQNAMATDERPIDPTCPCMVCKNYTRAYLHCLVTKDAMGSQLLSYHNLSFMMRLSRDLHMSILEGRFPEYVIIQLNFVSFVSFLTVLVNKKVSMPYCRFVRGFLRMQFPKGDVPKWVRNAMVVAGIDISECCTPAKYPRDAMDAPEALSTHFVNEEHSIPYKMASLLPIYSGAATSPPFPSPSQTPRSPSPRIIIIIIASPQRLSGRRIPPLLASQTPNPEADSPAPAGTKLAPLLVSLAVGLAVRFLAPRPPEVSPQAWQLLSIFLSTIAGLVLGPLPVGAWAFLGLTAAVATHTLPFAAAFSAFTNEVIWLIVISFFFARGFVKTGLGDRIATYFVKWLGGSTLGLSYGLTISEAFISPAMPSTTARAGGVFLPIIKSLSLSAGSKPNHPSSRKLGSYLVMSQFQHGSKLLVCQPLLLKLATPYWFYKNFPLETRDTPDAPALAAEKLERMGPVTKNEWVMIGTMLLAVSLWVFGDAIGVSSVVAAMLGLSILLLLGVLDWDDCLNEKSAWDTLAWFAVLVGMAGQLTNLGIVSWMSSCVAKLLESFSLSWPAAFCVLEASYFLIHYLFASQTGHVGALYSAFLAMHVAAGVPRVLSALALAFNTNLFGALTHYSSGQAAVYFGAGYLELPDVFRMGFVTALINILIWGVVGTFWWKLLGLY

SEQ ID NO: 35838 - protein, 188 aa, Neisseria meningitidis MC58
MLVHPEAMSVGALADKIRKIENWPQKGILFHDITPVLQSAEYFRLLVDLLVYRYMDQKIDIVAGLDARGFIIGAALAYQLNVGFVPIRKKGKLPFETVSQSYALEYGEAAVEIHTDAVKLGSRVLLVDDLIATGGTMLAGLELIRKLGGEIVEAAAILEFTDLQGGKNIRASGAPLFTLLQNEGCMKG

SEQ ID NO: 35839 - protein, 522 aa, Gibberella zeae PH-1
MSDAFETAAPPHATYDLILRRLRSLGVYSEMLPCTQKIKDLGWKPVGVILSGGPSSVYADDAPGVDPLVFELGVPVLGVCYGNQLIAWRANPKSVARGVNREYGETQMAIHKIGTHGDRLFEGLGDSLIVVMSDFDKVVQLPDGFQTIATTKNSEFAGIAHETQPIFGIQFHPEISHTEKGTDIIANFATKICGARPDWKMDDFSAREIKRIRELVGDKAQVIGAVSGGVDSTVAAKLMKEAIGDRFHAILVDQGLMRLNDTWALTSLVVDGSELFLGRLAGVTEPEAKRKIIGGTFIDLFEIEALRIEKEAENTDRAGKVEWFLQGTLYADIVESLSFKGAASSTIKSHHNAGGLPARMQNGEAQLKLLEPLRELFKDEVRAFGRQLGIHEELIGRHPFPGPGLGIRIIGEVTPERVEIVRKADHIFISMIREAGIYDEVTQAYAALDSSRAVGVQGDARVYGYICILRAVTSLDMMSAEPYEFTWSLMKAISRRIVNEVDGIARVVYDTTSKPPGTIELE

SEQ ID NO: 35840 - protein, 550 aa, Haemophilus somnus 2336
MMQNINPTQTNAWKALEQHQKDLEQVTIQQLFEQEPTRFNDYSLKFAEQILVDYSKNNINQQTLSLLRQLAKECALNEATESMFNGEKINRTENRAVLHTALRNCANTPVYVDGKDVMPEVNAVLAKMKSFCQRVISGDWKGYTGKAITDVVNIGIGGSDLGPYMVTEALRPYKNHLTMHFVSNVDGTHIAETLKKVNPETTLFLVASKTFTTQETMTNAISARKWFLAAAQDESQIAKHFAALSTNVKEVEKFGIDTHNMFEFWDWVGGRYSLWSAIGLSIALSIGFDNFEQLLAGAHEMDKHFRTAPMEQNIPITLALIGIWNCNFLGAETEAMLPYDQYLHRFAAYFQQGNMESNGKYVDRSGQVINNYQTGPIIWGEPGTNGQHAFYQLIHQGTKIIPCDFIAPAQTHNVLSDHHNKLLSNFFAQTEALAFGKTQQEVEAEFIQAGKSLDEVKNIVPFKIFTGNKPTNSILVQKITPFTLGALIAMYEHKIFVQGVIFNIYSFDQWGVELGKQLANRILPELVGDEQINSHDSSTNGLINQFKSWR

SEQ ID NO: 35841 - protein, 266 aa, Mycobacterium sp. MCS
MDVRSRNNVRIVGAEHGPTIVLAHGFGCDQNLWRLVTARLAPEFRVVLFDHVGSGASDPAAWDADRYSSLDGYAEDILELLRELDLRDVVFVGHSVAAMMGVLAVRADPGRFAKLVLLTPSPCYVDDGDYRGGFTRADIDELLESLESNYLGWSRAMAPTIMGAPEQPELSEELAESFCRTDPTRARVFARATFLSDNRDDLDGVGVPTLIIECAHDAIAPRGVGEFVHGRIAGSTLVTLDTSGHCPHLSAPAETAEAIAGFARST

SEQ ID NO: 35842 - protein, 198 aa, Helicobacter pylori
MLVTKLAPDFKAPAVLGNNEVDEHFELSKNLGRSGAILFFWPKDFTFVCPTEIIAFDKRVKDFHEKGFNVIGVSIDSEQVHFAWKNTPVEKGGIGQVTFPMVADITKSISRDYDVLFEEAIALRGAFLIDKNMKVRHAVINDLPLGRNADEMLRMVDALLHFEEHGEVCPAGWRKGDKGMKATHQGVAEYLKENSIKL

SEQ ID NO: 35843 - protein, 754 aa, Novosphingobium aromaticivorans DSM 12444
MSEESNVRFTEREALFYHNTIRPGKIEIIASKPMATQRDLSLAYSPGVAVPVRAIAEDPSTAYDYTAKGNLVAVISNGTAILGLGNLGALASKPVMEGKAVLFKRFADVDSMDIELATEDADAFIEAVALLEPTFGGINLEDIKAPECFIIEQALKERLKIPVMHDDQHGTAIISAAGLLNACHLTGRRLEDVKVVVNGAGAAAIACTALIKAMGVRHDNVIMCDRSGVIYRGRESGMDQWKSAHAVDTTARSLEDALVGADIFLGLSAAGALKPEWVLKMAPQPIIFAMANPDPEITPPDAKAVRPDCIVATGRSDYPNQVNNVLGFPFIFRGALDVRATAINEEMKIAAAEAIAQLAREPVPEEVAAAYGMNHTFGLDYIIPAPFDPRLMEVVSSAVAKAAMDSGVAQKPIEDFDAYRTSLKARLNPTTSVLTNVFATAKDNPKRVVFAEAENEVVLRAAIQFKDFGYGTPVLVGRTQPVLDLLTELGVSDPSSYEIHNSAVSPLVPEMVEYLYERLKRRGYLERDVRRMVNQDRNVFASLLVALGHGDALITGMTRTFAQSMKEVRRVLDPKPGHLPFGIHLMVAKNYTVFLADTTVNERPSAEDLAHIARETAAVARRMGHEPRVAFLSYSTFGNPYGRWLDSIRGAVAILDAENPGFEYEGEMAPDAALNPKVMANYPFSRLSGPANVLIMPGLQSANISAKLLRELAGNAVIGPMLLGMEKPVQIAPMTSIAPDILTLAVLAAAGIVG

SEQ ID NO: 35844 - protein, 425 aa, Brassica napus
MSKTTNQNRRPSFTSSTESSMRKRHGPSSSSSAVKPISNTAVMVAKKRAPLGNITNQRKDSRIFPNSSSADSAHCPNKSAKLKLAAPTQPVCVNACETKSTCEEEVVPIERKAFSNLCITPSSDTTTNVMSETENKEEKFMNIDNKDDADPQLYATFACDIYNHLRAAEAKKQPAVDYMETVQKDVNSTMRGILVDWLVEVSEEYRLVPETLYLTVNYIDRYLSGNVISRQKLQLLGVACMMIAAKYEEVCAPQVEEFCYITDNTYLKDEVLDMESAVLNYLKFEMSAPTVKCFLRRLFSGCPRVHEAPCMQLECMASYIAELSLLEYTMLSHPPSLVAASAIFLAKYTLDPTRRPWNSTLRHYTQYEAMELRGCVMDLQRLCSNAHVSTLPAVRDKYSQHKYKFVAKKFCPSIIPPDFFKNSLY

SEQ ID NO: 35845 - protein, 198 aa, Helicobacter pylori
MLVTKLAPDFKAPAVLGNNEVDEHFELSKNLGKNGVILFFWPKDFTFVCPTEIIAFDKRVKDFQEKGFNVIGVSIDSEQVHFAWKNTPVEKGGIGQVTFPMVADITKSISRDYDVLFEEAIALRGAFLIDKNMKVRHAVINDLPLGRNADEMLRMVDALLHFEEHGEVCPAGWRKGDKGMKATHQGVAEYLKENSIKL

SEQ ID NO: 35846 - protein, 489 aa, Cryptococcus neoformans var. neoformans B-3501A
MGKRTADAADLPVSKAAATGQATAREPAADDEMGEFEDRWEDEIESEEEVVEHDADGEADGKSCSEDAEPAAAPTQTYLPGTAIAEDEQLVPDNSVYLALHSLSYAWPCLSFDVLRDSLGTDRATYPHTSWIVTGTQAGEVPGEGKAKDEVVIMRLGNLSKTQHDDDDDSDDGKDDDDDEADDEDATLDFLTIPHVGSVNRVRAAPAPVGGAVPDPYHVATFSETGKVHIFDVRPYIDTLAGPSRPRQKLPVHTISNHGRAEGFAVEWGATGLLTGDIDRKIYLTTLTPSGFTTSPNPYLSHTSSVEDLQWSPTEPTVFASASADRTVRVWDVRAKGRRSVVSVEAHSEDVNVISWNKTVDYLLVSGGDEGGLKVWDLRMFKDTPSPVAQFQWHTAPITSVEWHPTDSSVFAASGSDDQLTLWDLSVEPDEDEAPIGPADGNITAVPPQLLFVHQGQKDVKELHWHPQIPGMVISTASDSFNVFKTISC

SEQ ID NO: 35847 - protein, 515 aa, Vitis vinifera
MAPAFAAASSTYSPYYHIFFTALAFLISGLIVLLSRKTKSKKLNLPPGPPGWPIVGNLFQFARSGKQFFQYVRELRPKYGPIFTLKMGNRTMIIISSAELAHEALIEKGQSFASRPRENPTRTVFSCNKFTVNAAVYGPVWRSLRRNMVQNMLSASKIREFSNLRDVSMDKLIDRLRSEAEANDGAVWVLKNARFAVFCILLSMCFGVEMDEETIEVMDDLMKTVLITLDPRLDDYLPLLSPFFSKQRKAATEVRKRQIKTVVPFIERRRAALENPGSDKTAASFSYLDTIFDLKIEGRKSSPTNPELVTLCSEFLNGGTDTTGTAVEWAIARMIENPEIQSKLYEEIKTTVGDRKVQEKDMEKMPYLNAVSKELLRKHPPTYFSLTHAVTEPAKLAGYDIPTDANVEFFLPPISEDPKLWKNPEKFDPDRFLLGGEDADITGVTGVKMMPFGVGRRICPGLSMATVHVNLMLARMVQDFEWSAYPENSKIDFSEKLEFTVVMKNPLRAKIKPRV

SEQ ID NO: 35848 - protein, 198 aa, Helicobacter pylori
MLVTKLAPDFKAPAVLGNNEVDEHFELSKNLGRSGAILFFWPKDFTFVCPTEIIAFDKRVKDFQEKGFNVIGVSIDSEQVHFAWKNTPVEKGGIGQVSFPMVADITKSISRDYDVLFEEAIALRGAFLIDKNMKVRHAVINDLPLGRNADEMLRMVDALLHFEEHGEVCPAGWRKGDKGMKATHQGVAEYLKENSIKL

SEQ ID NO: 35849 - protein, 198 aa, Helicobacter pylori
MLVTKLAPDFKAPAVLGNNEVDEHFELSKNLGKSGAILFFWPKDFTFVCPTEIIAFDKRVKDFQERGFNVIGVSIDSEQVHFAWKNTPVEKGGIGQVTFPMVADITKSISRDYDVLFEEAIALRGAFLIDKNMKVRHAVINDLPLGRNADEMLRMVDALLHFEEHGEVCPAGWRKGDKGMKATHKGVAEYLKENSIKL

SEQ ID NO: 35850 - protein, 303 aa, Novosphingobium aromaticivorans DSM 12444
MSQNHDPAMLAKAETLTEALPYLQRYAGKTFVVKYGGHAMGDPELAQDFAEDIVLLKAVGINPVVVHGGGPQIGRMLKALGIESRFVDGLRVTDKQTAEVAEMVLAGAINKELVSWIARAGGKAIGISGKDGGMVIARKVEAKKAPKAVADAESGDPIVVDLGFVGEPDRIDTTVIDTICKAGMIPVIAPIGVGEDGETYNINADTMAGSIAAALGAARLFLLTDVPGVLDKDKNLLTDLRPADIARLAEDGTISGGMIPKLETCVHAVEAGCEATVVLDGRVPHAMLLEIFTARGAGTLIRA

SEQ ID NO: 35851 - protein, 491 aa, Picea sitchensis
MVGSSGRVDCYDDSNSVDNSMNSSRDPEMNVGDAQRAGSFCPSCHGAMGVERKRIDETIHKVGIPEPKSVAREFSSKMKETFFPDDPFRQFRGQPCGRQWMLGFMYLFPILEWAPNYSLAVFKSDVISGLTIASLAIPQGISYAKLASLPPIIGLYSSFVPPLIYSVLGSYLGLALKAGLVTGLISLTEGIAVGRTFASIKGYQVDGNKEMMAIGLMNMAGSCTSSYVTTGSFSRSAVNYNAGCKSAVSNIVMALTVMVTLLLLTPLFYYTPGVVLASIIIAAVLGLIDFPAAYFIWKVDKVDFLACVGAFLGVIFISLQMGLLIAVGISVFKILLHVTRPHTSLQGKIPGTNYYRNIEQYSEATRIPAFLILRIDAPIYFANSTYLKERIMRWVSEEEDRIESENDDTLQYVILDLTAVTTIDTTGVNIVVEVKKTLEKRGLQVAMVNPGAGVMEKLRRADLIQNLGQDCLYLTVGEAVSSRSSAFKEQV

SEQ ID NO: 35852 - protein, 368 aa, Polaromonas sp. JS666
MKTKAAVAWKAGQPLTIETVDLEGPKFGEVLVEIKATGICHTDYYTLSGADPEGIFPAILGHEGAGIVVDVGPGVTTLKKGDHVIPLYTPECRQCKFCLSRKTNLCQLIRGTQGKGLMPDATSRFSLDCQPIFHYMGTSTFSNYTVAPGISLAKIREDAPFDKVCYIGCGVTTGIGAVIFTAKVEAGANVVIFGLGGIGLNVIQGAKMVGADKIIGVDINPARQEMARKFGMTHFINPKETDNVVDAIVQLTDGGADYSFECIGNTKVMRQALECTHKGWGRSIIIGVAEAGAEISTRPFQLVTGRKWEGSAFGGARGRTDVPKIVDWYMDGKINIDDLITHTMPLEDINKGFDLMKRGESIRGVVIY

SEQ ID NO: 35853 - protein, 237 aa, Brassica napus
MSIFLYFILLLPLLLIFLKRFSPSKGKLPPGPIGLPLIGNLHQLGKSLHRSFHKLSQDYGSVMFLRFGVVPVVVFSTREAAEEVLKTHDLETCTRPKLSATRLFSYNYKDIGFAQYGDDWREMRKLAMLELFSSKKLKAFRYIREEESELLVKKLSKSADTQTLVDLRKALFSLTASIICRLAFGQNFHECDFVDMDKVEELVLESETNLGSFAFTDFFPTGLGWIIDRISGQHSEL

SEQ ID NO: 35854 - protein, 423 aa, Magnetococcus sp. MC-1
MNKNPKIAIIGLGYVGLPLAVAFGKKYPTVGFDIRSQRITQLQQGQDTTLECSSVELAQASQLSFTADLQEIAHCNTYIVTVPTPIDNYRRPDLSPLISASETVGKVLKAGDVVIYESTVYPGATEEVCVPILAKHSGLVFNETFFAGYSPERINPGDKVHRLETITKVTSGSTAEAAQWVDQLYQSIIQAGTHLTSCIRVAEAAKVIENTQRDVNIGLINELALLFNRLEIDTLEVLQAAGTKWNFLPFRPGLVGGHCIGVDPYYLTHKAQEIGYHPDMILAGRRVNDSMGTYVASEVIKLMTRKHLCVASSTILILGLTFKENCPDLRNTRVVDIAQELLEYGAEVAIYDPWVDAQEAHHEYGLNLLTEVPHAHYDAVILAVPHRQFIEAGIEWVQALRKEISVFYDLKSLFAKEQSDQRL

SEQ ID NO: 35855 - protein, 473 aa, Pseudomonas syringae pv. phaseolicola 1448A
MSSSSTSAAADPQGRQSASPNRLIFISVLVATMGALAFGYDTGIIAGALPFMTLPTDQGGLGLDAYSEGMITASLIVGAAFGSLASGYISDRFGRRLTLRLLSVLFIAGALGTAIAPSIPFMVAARFLLGIAVGGGSATVPVFIAEIAGPSRRARLVSRNELMIVSGQLLAYVLSAVMAALLHTPGIWRYMLAIAMVPGVLLLVGTFFVPPSPRWLASKGRFDEAQDVLEQLRTNKQDAQREVDEMKAQDEEARHRPKARELLRQGWVIKLLLIGIGLGFTAQLTGVNAFMYYTPIILKNTGMGTNAALTATIGNGVVSVIATLLGIWAIGRYGRRHLLMTGLVMVILMQAALGCVLQFMPQNLTQSYTALACILVFLLFMQMCISPVYWLLMSELFPMQVRGLLTGTAVSMQWLFNASVAFTFPIAVDTIGNPTFFIFAAINVGSLIFVFLCLPETKGKSLEQIEKHLKKEL

SEQ ID NO: 35856 - protein, 325 aa, Mallomonas rasilis
SKVGINGFGRIGRLVARIMVNDPRTTLKAINTGADATYMAYQFKYDTVHGQWKGSLEVEGDDLIINGQRIKTVHARDPKEIGWGKLGVEYLCESTGVFLTADSAKPHVDGGVKKVIFSAPAKDKSPTIVMGVNDKDYTSDMTYVSCASCTTNGLAPMVKAIHDNFGIEEALMTTVHAMTSTQMVVDGSSKKDWRGGRAASANIIPSSTGAAKAVTAVIPSLKGKLTGMAFRVPVPDVSVVDLTCRLARDTTYEEICNKVKELSQGEMKGILGYTNEDLVSQDFVSSPISSVFDAKAGIMLNPRFVKLVAWYDNEWGYSKGEFQHT

SEQ ID NO: 35857 - protein, 250 aa, Mycoplasma gallisepticum R
MIYIKNPNEIQKIKNAAQIYKKIVKQFNFDYIKNKSLKEIDQMLRDFVSQHHANSCYHGYLGFKGYHCLSLNQTIIHGLANDEIFTSKDKLTIDIGIELDNYYCDSAFTILGPDVNPRQKLLSEVTHNCIFELVKKIVPNQTTTNDLGIWTEEYAKKYGYSVIKDFGGHGCGIKIHEDPIILNYGTKKSSELLTPNMVICIEPMFFEKDNRYYIDPDDSWSVKPVNKNQYVCHWEHMVLIKEDQAEILTL

SEQ ID NO: 35858 - protein, 324 aa, Pavlova lutheri
SKVGINGFGRIGRLVFRIAMARDNMVVKHINSPMAPEYMKYLLSYDSAHGRYKGTVEVDAKGSLIVDGLEVTLTATRDPTEIPWGKRDVAYVCESTGAFTSTESCMLHVTSANPAKKVVISAPAKDAETPTLVVGVNAAEDYKTSMNVVSCASCTTNGLAPLVKHIDQTYGIAEGLMTTVHATTASQLTVDGSMKGSDWRAGRAAAANIIPSSTGAAKAVAKCYPASKGKLTGMAFRVPTIDVSVVDLTCRLVKSTTYDELKASVKAASEGSMKGILGYTEDQVVSQDFVGSEMSTTFDAGAGIMLNPNFVKLISWYDNEWGYS

SEQ ID NO: 35859 - protein, 440 aa, Pyrococcus horikoshii OT3
MKCPRCGREYISSIPPFCICGEELEITYDYSSVDVRKWKRRNPGVWRYKELLPEVKKIITLQEGGTPLIKARISEKINVDVYIKDETRNPTGSFRDRLATVAISYGLPYASNGFIVASDGNAAASVAAYSARAEKECFVVVPRKVDKGKLIQMIAFGARIIRYGDSVDEAIEYARELSKLNGLYNVTPEDNIIGLEGQKTIAFELWEEINPTHVIVPTGSGSYIYSIYKGFKELIKIGVLEKMPRLIAVQTERCNPIAAEILGLKKECKETKALGLYVKNPVMKSRVIRAIKESGGTAVVVNENDIITGEKLLANEGIFAELSSAVVMPALLSLVEKGIIEKGDKVVLVVTGSGLKIGEGGREKFSIGGTKLEILKILEEREMYAYEIWQALGKPLKYQAVHQHIKELQELGLIKEAYRKGKRIYYKLTERGRRLIENLE

SEQ ID NO: 35860 - protein, 176 aa, Yarrowia lipolytica CLIB122
MFRQIRHFSTSPLVRNNVYFNVSANGNPLGKISFKLYKDQVPKTAENFRALCTGEKGFGYAGSSFHRVIPNFMLQGGDFTNHNGTGGKSIYGQKFPDENFNVKHTRPGLLSMANAGPNTNGSQFFITTVDTPWLDGAHVVFGEVTDGMDVVKAIEKLGSNSGRTSQKIVIDDCGQE

SEQ ID NO: 35861 - protein, 388 aa, Triticum aestivum
MASGTDEKAKMESLTSPAAFVEGGVQDACDDACSICLEAFCESDPSTLTGCKHEFHLQCILEWCQRSSQCPMCWQPVSMKDPTRQLLEAVERERNIRTNQTRNTTIFHHSALGDFEVRHLPVVANDAEIEERILQHLAAAAAMGRSHQHGRREGQRNRSGSHGSPQFLVFSAHPNTPAGSVSSSSAQGEGADDLRILVPRVGDLPPHANPIEEAGNQSPGVLTYDAEQDAVVSSGNSTPVSSPRFFNRRHSSGQSTPVGNDRAGPSDVQSFSDSLKLRLNAVSSKYKESITKSTRGWKERLFSRNSSVSDLGSEVRREVNNGIASVSRMMERLETRGSGRPSYSPTTSTSEVCLTTEPSNERVTESNSNTTTSTSNTSTPCVTMSGSN

SEQ ID NO: 35862 - protein, 273 aa, Pavlova lutheri
THGRFPGTVECDEANNILIVNGKKIKFYAAKSPNEVPWGEAGAHIVCESTGIFTVIDKASAHLQGGAKKVIISAPSADAPMFVMGVNHTSYTKDVNILSNASCTTNCLAPLAKIIHEEFGIVEGLMTTVHATTATQKTVDGPSGKDWRGGRGAGQNIIPSSTGAAKAVGKVLPALNGKLTGMAFRVPTPDVSVVDLTCRLSKQTTYDEIKKVIKAKCETPEYKGIMGYTEDEVVSQDFVHDSRSSIFDAGAGIMLTGDFVKLVSWYDNEWGYS

SEQ ID NO: 35863 - protein, 250 aa, Magnetococcus sp. MC-1
MFRDEQLQRYARNFLLKDVGGHGQQALLAAHVLIVGAGGLGSPVALYLAASGVGQLTLADADTVELSNLQRQVIHTTARCGENKSESAATTLRAINPDINITPLPLRLEGEALALAIEAADLVVDATDNFTSRYAINALCVEKQKKLVSGAVMGWEGQVAAFAGFRPGLPCYRCLYPPTEAMDALQPCARSGVLGPAAGVIGTLQAAEVIRQLVGLSEENLQRVTFVDLHSWRFYSMTMRAQAHCPVCGG

SEQ ID NO: 35864 - protein, 640 aa, Yersinia pestis biovar Microtus str. 91001
MIVFSSLQIRRGTRVLLDNATATINPGQKVGLVGKNGCGKSTLLALLKGELSADGGNVTFPNNWALAWVNQETPALDIPAIEYVIDGDREYRQLEAELQAANEKNDGHAIATVHGKLDAIHAWTIQSRAASLLHGLGFSQEKLQQPVRSFSGGWRMRLNLAQALVCRSDLLLLDEPTNHLDLDAVIWLEKWLKSYTGTLVLISHDRDFLDPIIDKILHIEQQTLNEYTGNYSSFERQRATKLSQQQSMYQHQQEKVAHLQSYIDRFRAQATKAKQAQSRIKMLERMELIAPAHVDNPFHFSFRTPESLPDPLLRMDKVSAGYGENTVLQSIKLNLVPGSRIGLLGRNGAGKSTLIKLLAGTLEPQSGEIALSKGIKLGYFAQHQLEFLRADESPLQHMSRLAPKESEQQLRDYLGGYGFQGDQVTDPTARFSGGEKARLVLALIIWQRPNLLLLDEPTNHLDLDMRQALTEALIDFEGALVVVSHDRHLLRSTTDDLYLVHDGKVEQFDGDLEDYQQWLVDSQRQQSQQDNPAKELSGNSAQQRKDQKRRDAEFRTQTQPLRKQIMTLEKQMDKLSTELAAIEAQLADSALYDIARKADLTQCLLQQTQVKSKLEETEMQWLDVQEQLEILTKEFSDADI

SEQ ID NO: 35865 - protein, 550 aa, Prochlorococcus marinus str. AS9601
MKIINGFHLKNLRGDILGGITAAVVALPLALAFGNAALGPGGAIYGLYGAVVVGFLAALFGGTPAQVSGPTGPMSVTVAGVVAGLAAVGVPRDLSAGQILPLVMAAVVIGGLLQILFGILKLGKYITLVPYSVVSGFMSGIGVIIIALQIGPLLGISTRGGVVESLSTVFSNFQPNGAAIGVAIMTLGIVFLTPRKISQWVPSPLLALLIVTPISILIFGEGAIDRIGEIPRGVPSLNFPSFNQYFPIIFKAGLVLAVLGAIDSLLTSLVADNISQTKHNSDRELIGQGIGNAVAGLFSGLPGAGATMRTVINVKSGGSTPISGMVHSVVLLIVLVGAGPLAEQIPTALLAGILIKVGLDIIDWGFLRRAHKLSLKTSVVMYGVLLMTVFWDLIWAVLVGVFIANMLTIDSITETQLEGMDEDNPLSKDDQAKNALPADEKALLDRCSGEVMLFRLKGPLSFGAAKGISERMMLVRNYKVLILDITDVPRLGVTATLAIEDMMQEAKNNSRKAFVAGANEKVKDRLAKFGVEGIIETRKEALETALNEIA

SEQ ID NO: 35866 - protein, 318 aa, Phytophthora palmivora
SKVGINGFGRIGRLVLRAAAKNPEINVVAVNGPFIATKYMEYMLKYDTVHGRFGGELSHDEQNIYVDGKAIRVFNEMNPANIKWGEEQVQYVVESTGAFTTTEKASAHLKNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYEEIKAAIKSASENEMKGILGYTEEAVVSSDFIGDSHSSIFDAEAGIALTDDFVKLVSWYDNEWGYS

SEQ ID NO: 35867 - protein, 409 aa, Zea mays subsp. huehuetenangensis
MQFALALDTNSGPHQIRSCEGDGIDRLEQLSIGGRKQEKALRNRCFGGRVAATTQCILTSDACPETLHSQTQSSRKNYADANRVSAIILGGGTGSQLFPLTSTRATPAVPVGGCYRLIDIPMSNCFNSGINKIFVMSQFNSTSLNRHIHRTYLEGGINFADGSVQVLAATQMPEEPAGWFQGTADSIRKFIWVLEDYYSHKSIDNIVILSGDQLYRMNYMELVQKHVEDDADITISCAPVDESRASKNGLVKIDHSGRVLQFFEKPKGADLNSMRVETNFLSYAIDDAQKYPYLASMGIYVFKKDALLDLLKSKYTQLHDFGSEILPRAVVDHSVQACIFTGYWEDVGTIKSFFDANLALTEQPSKFDFYDPKTPFFTAPRCLPPTQLDKCKMKDAFISDGCLLRECNI

SEQ ID NO: 35868 - protein, 321 aa, Plectospira myriandra
SKVGINGFGRIGRLVARAAFANPNATVVAINDPFMSLDYMVYLFKYDSTHGPYQGTVEAKDGNLVIDGQVVRIFTAKNPAEIGWGEAGADYVCESTGVFTNTEACLAHVKGGAKKVIISAPPKDNTPMYVIGVNHTKYDGSAHVVSNASCTTNCLAPLAKVVHEKFGIVEGLMTTVHATTANQLTVDGPSKGGKDWRAGRGASANIIPASTGAAKAVGKVLPELNGKLTGMAFRVPVPDVSVVDLTVRLEKSATLAEIKAAIKEASENELKNILGYTEDDVVSQDFVTDKRSSIFDANACISLNDNFVKLVSWYDNEWGYS

SEQ ID NO: 35869 - protein, 301 aa, Zea mays subsp. huehuetenangensis
VPVGGCYRLIDIPMSNCFNSGINKIFVMSQFNSTSLNRHIHRTYLEGGINFADGSVQVLAATQMPEEPAGWFQGTADSIRKFIWVLEDYYSHKSIGNIVILSGDQLYRMNYMELVQKHVEDDADITISCAPVDESRASKNGLVKIDHSGRVLQFFEKPKGADLNSMRVETNFLSYAIDDAQKYPYLASMGIYVFKKDALLDLLKSKYTQLHDFGSEILPRAVVDHSVQACIFTGYWEDVGTIKSFFDANLALTEQPSKFDFYDPKTPFFTAPRCLPPTQLDKCKMKDAFISDGCLLRECNI

SEQ ID NO: 35870 - protein, 409 aa, Zea diploperennis
MQFALALDTNSGPHQIRSCEGDGVDRLEQLSIGGRKQEKALRNRCFGGRVAATTQCILTSDACPETLHSQTQSSRKNYADANRVSAIILGGGTGSQLFPLTSTRATPAVPVGGCYRLIDIPMSNCFNSGINKIFVMSQFNSTSLNRHIHRTYLEGGINFADGSVQVLAATQMPEEPAGWFQGTADSIRKFIWVLEDYYSHKSIDNIVILSGDQLYRMNYMELVQKHVEDDADITISCAPVDESRASKNGLVKIDHTGRVLQFFEKPKGADLNSMRVETNFLSYAIDDAQKYPYLASMGIYVFKKDALLDLLKSKYTQLHDFGSEILPRAVVDHSVQACIFTGYWEDVGTIKSFFDANLALTEQPSKFDFYDPKTPFFTAPRCLPPTQLDKCKMKNAFISDGCLLRECNI

SEQ ID NO: 35871 - protein, 135 aa, Brassica napus
GLDNNNGYLPHLPLNQKKSADANGFGSGHVRKEAEVKGPNGIVRFLGSVAKIMLPIIGVISVLSASGYGPEIKKRGVSFKLLGLFPQRVVRAPNQCPPGKVLVIEDGEARCLVKERVEIPFESVSAKRDVTYGYG

SEQ ID NO: 35872 - protein, 426 aa, Desulfococcus oleovorans Hxd3
MIEIIEVQAREILDSRGNPTVEVDVTLSGGATGRAAVPSGASTGTREALELRDTRKKRYLGKGVEKAVENVNTLIGPVLYGMPADEQFMVDSTMIGLDGTANKSKLGANAILGVSMAVARAAADAYELPLYRYLGGIHAKHLPMPMMNIVNGGAHAANSLDIQEFMIIPVGGKTIAECVRMGAEVFHTLKKLLKAKGFATAVGDEGGFAPDLESNEAAIGFIMEAIKKAGYRPGRDVGIALDAAASEFYEKGKYVLKGEGKKLSSKQMVDYYENLIDKYPILSIEDGLAEQDWDNWVMMTDRLGNTTQIVGDDVFVTNPAIFEKGIREGLANSILIKLNQIGTVSETLQAIDMAKQAGYTTVISHRSGETEDAFIADLAVGVNGGQIKTGSLSRSDRIAKYNQLIRIEEALGAGAVLSNDFTAVVR

SEQ ID NO: 35873 - protein, 255 aa, Pseudomonas putida KT2440
MRWSTPIDTNQPSSLSLSYNARHREFANRCAMQPYAIAPSILSADFARLGEDVDKVLAAGADIVHFDVMDNHYVPNLTIGPMVCTALRKYGVTAPIDVHLMVSPVDRIIGDFIEAGATYITFHPEATQHIDRSLQLIKDGGCKAGLVFNPATSLDALKYVMDKIDMVLLMSVNPGFGGQKFIPGTLDKLREARALIDASGRDIRLEIDGGVNVNNIREIAAAGADTFVAGSAIFNAPDYQEVIAKMRAELALARP

SEQ ID NO: 35874 - protein, 314 aa, Prochlorococcus marinus str. AS9601
MQNRHLIMASKKFWFWFWTQLMNGFAPSDLHGNYIRPKGITIDSEYDINNEHGQIYLLVGNSCPWCQRTLLVHEIKHLSKKVKVIFLKADVEHGEWIFNTSIKGYIRLSDLYKNANEKIIFRATLPLLISFVKDEVNILSNESSQIIRLLNSIKNESKYKTLSIKNCNQKFLDLINNSINDGVYKCGFARNQSAYEKASQNLFTAINEVENLLEKNKGDWIFGEELTYADIYLFPTLIRWELIYSKLFKCTEQELSSFEKIIEWRLKFFKLSNVNRTCFDNEWKKDYYRALFPLNPNEIIPVLPSLKEIMKVET

SEQ ID NO: 35875 - protein, 555 aa, Mycobacterium smegmatis str. MC2 155
MTDDGYTVGDYLLDRLAELGVTEVFGVPGDYQLEFLDHVVAHPRITWVGGANELNAGYAADGYGRLRGMAALVTTFGVGELSAANAIAGSYAEHVPVVHIVGAPSKDSQAARRIVHHTLGDGDFEHFLRMSREITCAQANLVPATATREIDRVLSEVHEQKRPGYLLIATDVARFPTEPPTAPLPRHSGGTSPRALSLFTEAATQLIGEHRLTVLADFLVHRMGCVEALNKLLTADTVPHATLMWGKSLVDESSPNFLGIYAGAASEGSVREVIEDAPVLVTAGVLFTDMVSGFFSQRIDPARTIDIGVNQSVVAGQVFAPLDMAAALDALASILAERGIESPALPPAPAPQRPAAPPRDAVLTQEALWDRLAEALTPGNVVLADQGTSFYGLAGHRLASGVTFIGQPLWASIGYTLPAALGAGLADRDRRTVLLIGDGAAQLTVQELGAFGREGLTPVVVVVNNNGYTVERAIHGVTARYNDITAWRWTELPAALGVPDALTFRCATYGELDDALTVAAETQDRMVFVEVMLERMDIPPLLGELAQSASAANAK

SEQ ID NO: 35876 - protein, 1057 aa, Oryza sativa
MAGSFDGRMPTRGVEQAIVALKKGAHLLKFGKRGKPKFCPFRLSSDEKTLVWYSKDREKHLSLNSVSTVVLGQKTICRDRDQAECWFLGLTALTSSPYSPLPLAGSKSGRQINSCAISPRSYLQRKCRLSAALDTPRHTQVYPSYGSPKIQKKIFGGNLDSSEALFYPRHPTSCDIDSYIEKLNPKIATPVKHGLKDIMVANRRAQNITHTPKLKTFEGPRVACRLDSLKDVFLWGSVLGSMLGSEDIPKSLPRLVGSAKMLDVQSIACGENHAAIITKQGEVYTWGSYSSGRLDQKVNVNASCPKMVESLASVHVKAVAFGSKHTCAITVSGELFEWGEGAHSLGLMNDWYGRNQWFPHKFLGPMDNISVSKIACGEWHTAIITSSGQLFTYGDGTFGVLGHGDTQGVARPKEVESLKGSRVKSVACGPWHTAAIVEVMSSFKGNAPSGKLFTWGDADRGKLGHADRKMKLLPTCVDSLTAYDLIQVSCGTAVTVVLTVTGMVFTIGSSRHGQLGNPKADGESICSVEGPLKTEFVREISSGSSHVAVLTMSGKVFTWGKGAEGQLGLGDYSNRSSPTLVEALEGRDVESVVCGFNFTAAICLHKTMSMKDQSVCSSCQMVFGFTRKEHNCYNCGSMFCSSCTSNKITMAALAPDTNRRYRVCDACFYQLQKVVDSSKDKSRLKISKGEMFKLELKAYTPKLSRLFKEANFFAEKMASVQGTNQRNEEPATAVQTKTERWGQVECPALFISAQDSFQTQPVSNSEGCAISFSQRMHDSAVLKSGVSLRFTDAQREEIEMMQTELQGQVKQLHSQVAVLTEQCQQKSVMVQLYKQKLDDTWLVVRDEAARCKAAKDIIKVLTDQCNALSEKLSIGQLSENSKITPNSIPMQPTKIELQGNTGRNLVTRKLGQLNNTQNHGSSIQTEKECVPLSNAVVPEDVPFSQQNGARKFSSDGYTTEAPLAAPPTDSVTEQIEHGVYVTFSTSSCGKKDIKRIRFSRKHFGEKEAQHWWEHNKTRVYDNYKIKAKHPMGRADQLTLDVQARFQIDEIMDVGSRL

SEQ ID NO: 35877 - protein, 478 aa, marine gamma proteobacterium HTCC2143
MIRRTKIVATIGPASGHSEMIAKLLDAGVNVFRLNFSHGTADGHRQQVAIIRQVCASKKVHAAILGDLQGPKIRIGDLRNDAVTLVNGEEIILTIDQSRGEDDDRIPVGYKALPQSVATGDTLLLDDGLIELSVSLIVGGDVHCSVQVGGELKSRKGLNRLGGGLSAPAITEKDLQDIDLAAELSVDYLAVSFPCCASDLDPVKRRLDDLGARIGIIAKIERAEAVANEQTLNELILAADGVMVARGDLGVEVGNSQLIGLQKRIIRQARRSNRPVITATQMMESMISSPVPTRAEVFDVANAVLDGTDAVMLSAETATGKYPVKVVMAMADACVGAEQQPDTRISGHRVDDRVENISESIALSAIYAANHLDNVKASLCLTESGATALIMSRLSSSLPIYGVSRHPETCRRMTLYRGVIPIHCDITTNDEEGYQQALLSVTSTGAIGLGDRVIVTSGDITGTGGMTNTLKILQVKGA

SEQ ID NO: 35878 - protein, 198 aa, Helicobacter pylori
MLVTKLAPDFKAPAVLGNNEVDEHFELSKNLGKNGAILFFWPKDFTFVCPTEIIAFDKRVKDFQEKGFNVIGVSIDSEQVHFAWKNTPVEKGGIGQVTFPMVADITKSISRDYDVLFEEAIALRGAFLIDKNMKVRHAVINDLPLGRNADEMLRMVDALLHFEEHGEVCPAGWRKGDKGMKATHKGVAEYLKENSIKL

SEQ ID NO: 35879 - protein, 142 aa, Streptococcus thermophilus LMG 18311
MKVGNMQKTFFIIKPDAVKRHLIGQVLDRIERRGFVIERMEMLMLDEERLKEHYAQLADKPFFPSISEFMMSGPAVIGIMSGPGVIKSWRDMMGATNPGDAAPGTIRGDFATAPDGDMIPNIVHGSDSEESAAREIKIWFGE

SEQ ID NO: 35880 - protein, 308 aa, Burkholderia sp. 383
MSYTYPPRIAVVGSVNIDLVTRAPRLPVPGETLLGTDFQTAHGGKGANQAVAAARLGASVAMIGCVGDDAFGARLHDALSAEGIDVTHLDRIGGTATGVATITVDAGGANSIVVVPGANARLDADRIDAARDAIAGAAMLVCQLEVPVATVARAIACASAHHTPVLLNPAPAQPLFDALLARVDYLVVNETEAESLTGIAVGDDASAVRAADALCAKGVGNVLVTLGARGVCWRGGAGNGRLPAMPVVAVDTTAAGDTFVGGFAAARAGGASMDDAIGFGQRAAAISVTRYGAQTSIPTRDEVARLEP

SEQ ID NO: 35881 - protein, 392 aa, Populus trichocarpa
METGIACCARGAYLPGVSQHSKAPVSPQSISPSCSSRGLKSSSLFGETLRFVPRSSLKVSKAKNSSLVTRCEIGDSLEEFLTKATSDKGLIRVLMCMGEALRTIAFKVRTASCGGTACVNSFGDEQLAVDMLANNLLFEALTYSHFCKYACSEEVPELQDMGGPTEGGFSVAFDPLDGSSIVDTNFSVGTIFGVWPGDKLTGVTGRDQVAAAMGVYGPRTTYVLALKDYPGTHEFLLLDEGKWQHVKETTEIGEGKLFSPGNLRATFDNVDYEKLINYYVKEKYTLRYTGGMVPDVNQIIVKEKGVFTNVISPSSKAKLRLLFEVAPLGFLVEKAGGYSSDGYQSVLDKEIINLDDRTQVAYGSKNEIIRFEETLYGKSRLKSEGVPVGAAA

SEQ ID NO: 35882 - protein, 418 aa, Novosphingobium aromaticivorans DSM 12444
MARIVMKFGGTSMAGTERIRRVARIVQRQQAAGHEVAVVVSAMAGETDRLVNFCREANPLYDPAEYDVVVASGEQVTSGLLAMHLQALGCKARSWLGWQLPIHTDDAHSKARIEGIDSEALLASMGAGEIAVIPGFQGLTADNRVTTLGRGGSDTSAVAVAAAVKADRCDIYTDVDGVYTTDPRIVAKARKLKNVTYEEMLELASVGSKVLQTRSVSLAMKEGVRVQVLSSFIDDDAPAADTIPGTMIVSDEELEGLDMERQLITGIAADKNEAKVTLTRIADRPGAVAAIFGPLAAANINVDMIIQNIAKDKGETDVTFTVPISDLARTQALLEERKDTIGYYRMLANSKVAKISVVGVGMRSHAGVASTMFRALADRGINIQAITTSEIKVSVLIDEDETELAVRVLHTAYGLDGE

SEQ ID NO: 35883 - protein, 472 aa, Saccharomyces cerevisiae YJM789
MGCTVSTQTIGDESDPFLQNKRANDVIEQSLQLEKQRDKNEIKLLLLGAGESGKSTVLKQLKLLHQGGFSHQERLQYAQVIRADAIQSMKILIIQARKLGIQLDCDDPINNKDLFACKRILLKAKALDYINASVAGGSDFLNDYVLKYSERYETRRRVQSTGRAKAAFDEDGNISNVKSDTDRDAETVTQNEDVDRNNSSRINLQDICKDLNQEGDDQMFVRKTSREIQGQNRRNLIHEDIAKAIKQLWNNDKGIKQCFARSNEFQLEGSAAYYFDNIEKFASPNYVCTDEDILKGRIKTTGITETEFNIGSSKFKVLDAGGQRSERKKWIHCFEGITAVLFVLAMSEYDQMLFEDERVNRMHESIMLFDTLLNSKWFKDTPFILFLNKIDLFEEKVKSMPIRKYFPDYQGRVGDAEAGLKYFEKIFLSLNKTNKPIYVKRTCATDTQTMKFVLSAVTDLIIQQNLKKSGII

SEQ ID NO: 35884 - protein, 487 aa, Glycine max
MEIDSRFLNTGLLLVATILVAKLISAFIVPKSRKRVPPIVKGWPLIGGLIRFLKGPIFMLRDEYPKLGSVFTLKLFHKNITFLIGPEVSAHFFKASETDLSQQEVYQFNVPTFGPGVVFDVDYSVRQEQFRFFTEALRANKLKGYVNQMVAEAEDYFSKWGPSGEVDLKYELEHLIILTASRCLLGREVRDKLFDDVSALFHDLDNGMLPISVLFPYLPIPAHKRRDQARKKLAEIFASIITSRKSASKSEEDMLQCFIDSKYKDGRSTTEAEVTGLLIAALFAGQHTSSITSTWTGAYLLSNNQYLSAVQEEQKMLIEKHGDRVDHDVLAEMDVLYRCIKEALRLHPPLIMLMRSSHTDFSVTTREGKEYDIPKGHIIATSPAFANRLGHVFKDPDRYDPDRFAVGREEDKVAGAFSYISFGGGRHGCLGEPFAYLQIKAIWTHLLRNFELELVSPFPEIDWNAMVVGVKGKVMVRYKRKELSVNQ

SEQ ID NO: 35885 - protein, 467 aa, Chlorobium tepidum TLS
MSTKFDVIIIGGGPGGTPAAMQLASQGKTVLLVEESGKLGGACLFVGCIPSKIIRHWADEYAVKLKYSAQEALSPEDREAAWNEIMRKMQTILSQRSGAAMQMLKHLSNLRFVAGHAKFVSNNELVINEKDTGRKEKYTFNKAIIATGSHSFIPPFKGNGVQDVLTSEVLFSQDKLPESLLIIGGGPIGIELAQMLTKLGTKCTIIELLDSILYGVVETEFVSIISNQLSSLGVNIYTSSQVQEINKSDGHFDVTFTDANGSEHKENFEDVLVVTGKVPNIESLNLDSTDIKYDRKGIIVDEYLETSVKGIYATGDVTHGPKFAHTATYEAHIASANISAGNNQKVDFSKNTWVLFSEPEIVAAGFTEAQAVQEGYDIITGVYDYKIDAAAQVMNSPFGYLKYVVNKKNSEIIGVHICMNNASSLAGEASLIIANRLILKNVAETIHPHPTLTEAFGILAQKMLSKS

SEQ ID NO: 35886 - protein, 427 aa, Chlorobium tepidum TLS [sequence omitted]

SEQ ID NO: 35887 - protein, 376 aa, Mycoplasma gallisepticum R
MRWLVKEQNYYEILGVSTNASSSDIKKAFRKLAKKYHPDVSSDPQSLELFQKINEAYEVLSDEKTRRDYDEFELDLYDSEDDVDDSTEFVDTKDVFSKIFTNIKNNQQTTSKANKPPFGSQASNTPPSSSNKTATKTDPNTPKNLYTILGANKKTSVDELKRLYSILKLKYSTNPKTEANEWLKKEIKCAYTVLSNHESKVKYDKTGIFSFEGVSHLGGVFSRTRHLQELEKRQKKSKATNQSTGTRKVNNKKSSIHNVPYSSPKDRSASFTKFSTPQAQKKSAWQAAKFDINIEDFYTNVNVADDELLSLREEVLEQKKKKEEKHNQDPNAKKQTALARFKENHPILSSVITGLLISVILTVILVVIIAKTGITK

SEQ ID NO: 35888 - protein, 466 aa, Azoarcus sp. BH72
MSNGTIVQCIGAVVDIQFPRDSMPKVYDALKLEDAADSFAEAGLTFEVQQQLGDGVVRTIALGSSDGLRRGMKVSNTGKPISVPVGHGTLGRIMDVLGRPIDEAGPVETDELRAIHQKAPKFDELSPSVELLETGIKVIDLICPFAKGGKVGLFGGAGVGKTVNMMELINNIAKQHSGLSVFAGVGERTREGNDFYHEMKDSNVLDKVAMVFGQMNEPPGNRLRVALTGLTMAERFRDEGRDILFFVDNIYRYTLAGTEVSALLGRMPSAVGYQPTLAEEMGRLQERITSTKVGSITSIQAVYVPADDLTDPSPATTFLHLDSTVVLSRDIAALGIYPAVDPLDSTSRQLDPLVVGEEHYSVARAVQQTLQKYKELRDIIAILGMDELSPDDKLAVARARKIQRFLSQPFHVAEVFTGSPGKYVSLKDTIAGFKAIVNGEYDHLPEQAFYMVGGIEEVLEKAKKLQ

SEQ ID NO: 35889 - protein, 338 aa, Bacillus anthracis str. A2012
  misc_feature (12)..(12): Xaa can be any naturally occurring amino acid
MAILITGGAGYXGSHTCVELLNNNYKIIVVDNLSNSSIESLNRVKEITGKQFEFYKENVLNREKMNEIFLENNIEAVIHFAGFKAVGESTTTPLAYYYNNIISAIVLCDVMQKHNVKNFIFSSSATVYGIPKTLPITEEFPLSVTNPYGQTKLMIEQIMRDVAKADDEWSIALLRYFNPFGAHQSGRIGEDPNGIPNNLMPYVTQVAVGKLKELNIFGNDYPTKDGTGVRDYIHVVDLAKGHVKALEKVLKTKGIEAYNLGTGKGYSVLEMVKAFEKVSGKKIPYKVIGRRPGDVAICFADVSKAKRELGWEAEYGLEEMCVDSWRWQVNNKNGYQMI

SEQ ID NO: 35890 - protein, 521 aa, Yarrowia lipolytica CLIB122
MLLPLLFAGCVFFFLHQRLNYYRRKQRAYEKWLASGKFGAGQKVADIQVQNNFLRNPFGLVQFVEFLNRTKGAFFVDFVNQNFQKYGYILPTRTLGKVNIITCDPELIKTVLATNFKDWSIGIRRKAMFPVLGNAIFSVEGDQWTHSRAMLRPQFARDSIANVADLERHVTRLINVFRGYGVQSFDCQKYFFQFTLDSASDFLFGESTNSLSVQDDKSESEDTGESFNVLTQQGENAESFAQAFKVAFTFTAIRLRLQQFYWLLRPSNKKYRDSIDTVHRLVDGYVERALENKEDTDRYIISNQLVKVCDDKKYIRDQLLGILLAGRNTTAAVLAWIMYESARRPEIWNKMRQEVTDTFSDGPVTSDELRKCVYVRSVINEALRVYPSVPMNQRVAVRDTFLPTGGGPDGSLPLYCPRGTKVAYSVFALHMREDFYGSDSHIFRPERWNEGVGKGWQYLPFNGGPRICLGQQFALMEASYTLVRLVQEFDTVELDMEVVDPPPKMSSFSMVHRDGVRIRVK

SEQ ID NO: 35891 - protein, 581 aa, Mycoplasma gallisepticum R
MLIMKKYEGIGASNGVAIAKAYVLKAPVFNFDNNKIKPTEVEETITKIKQAFDKSSEQLRELRTIALKNLGEEIAVVFDGHINIVNDPMLFDQISQEVKDHLANAPTAVSKIYDQTKAMFEGIEDAYLKERASDIGDVKKRILSNLLNVALPDLLAINHEVIIIADDLTPSETSLLNKQYVKGFATNIGGRTSHSAIMARTLEIPAVLSLKTITETLKHDQLICIDGSKGVVYSDLSEADITTLKQDQQRYNESQAKLKKYLPPKAVTLDGHETIVAVNIGKPIDLLKGNDYGAKGVGLFRTEFLYMDSANWPDEETQFNAYKQALDYANNETVIIRTLDIGGDKKLNYYQFPEEMNPFLGFRAIRFTNQNPDIFKAQLRALLRAAKFGSLGIMFPMIANLEELFKAKEILEEAKKELDQRKVEYGKPLVGIMIEIPSAAVMSDVLAKYVDFFSIGTNDMIQYSFAVDRMSKDVNYLYQPLNPALLRIVKMTIDGGLKHNVWTGMCGEMAGEPLAIPILLGMGLKEFSMSASSMLKAKELINNLKYSDCKELVNRVINLESQEEVVKKVKEFLAKNNLSVA

SEQ ID NO: 35892 - protein, 770 aa, Rhizobium leguminosarum bv. viciae 3841
MDHPEKSKTEKNLTSGDFDEQALFFHRYPRPGKLEIQATKPLGNQRDLALAYSPGVAAPCLAIRDNPEMAAEYTSRANLVAVISNGTAVLGLGNIGPLASKPVMEGKAVLFKKFAGIDVFDIEIDAPGVDQMVSTIASLEPTFGGINLEDIKAPECFEVERRLREKMKIPVFHDDQHGTAIIVAAAILNGLELAGKNIADIKIVASGAGAAALACLNLLVILGAKRENIWVHDLEGLVYEGRVELMDEWKSIYAQKSETRTLAENIGGADVFLGLSAAGVLKPELLAQMADKPLIMALANPTPEIMPDLARAARPDAMICTGRSDFANQVNNVLCFPYIFRGALDCGAETINEEMKMAAVRAIAALAREEPSDVAARAYSGETPVFGPDYLIPSPFDPRLILRIAPAVAKAAEQSGVARRPIQDFDAYLDQLNRFVFRSGFVMKPIFTAAKAAERKRVIFSEGEDERVLRAAQVLLEEGLAEPILIGRPQVIETRLKRYGLRIRPLQDFEVINPEDDPRFREYVDLYFSLVGRRGVIPEAARTIVRTNTTVIGALALRRGEADALICGLEGRYEKHLRDVRQIIGKRKNVRDFSALSLMISQRGATFFTDTYVTFNPTAEEVAEATVLAAEEIRRFGLTPRAALVSHSNFGSRESESATKMRNALQLVRDAAPDLEVDGEMHGESAITEALRKRVMPDTTLHDEANLLVFPNLDAANITLGVVKSMTDGLHVGPILLGTALPAHILAPSVTSRGVVNMAALAVVEASQPA

SEQ ID NO: 35893 - protein, 321 aa, Prymnesium parvum
SKVGINGFGRIGRLVCRAAMMKEGAEVVAVNDPFCDVKYAAYLFKYDSTHGIYKGTVECDEASQMLIVDGKKIAFLAVKNPTEVPWGEKGADIVCESTGIFTVIEKASMHLQGGAKKVIISAPSADAPMFVMGVNHTDYKKDINILSNASCTTNCLAPLAKIIHDEFGIVEGLMTTVHATTATQKTVDGPSGKDWRGGRGAGQNIIPSSTGAAKAVGKVIPSLNGKLTGMAFRVPTPDVSVVDLTVKLGKETTYDAIKALVKAKAATPEWKGIMGYTEDEVVSTDFQGDSHSSIFDAKAGIMLTPTFVKLVSWYDNEWGYS

SEQ ID NO: 35894 - protein, 245 aa, Azoarcus sp. BH72
MNDKTTHFGFETVAENQKQRRVAEVFSSVASRYDVMNDLMSFGLHRLWKAFTIQVSGVRSGDRVLDVAGGTADLSLAFARKVGPTGQVWLTDINHAMLSRGRDRVLDHGFALPVAQCNAERLPFPDDWFDCVTVAFGLRNMTHKDVALAEMRRVLRPGGRLLVLEFSKVWKPLAPLYDLYSFKLLPWMGDKVAKDADSYRYLAESIRMHPGQDELRDMMEQAGLARVDYFNLSAGVVALHRGYKT

SEQ ID NO: 35895 - protein, 318 aa, Pythium graminicola
SKVGINGFGRIGRLVLRAAQTNPLINVVAINDPFIPTKYMEYMLRYDTVHGVFNGTVSHDEENLIVNGKKVRVFNEMKPTDIKWSQADVQYVVESTGVFTTTEKASAHLQNGVEKVVISAPSADAPMFVVGVNEDKYKSDMHVVSNASCTTNCLAPLAKVVNDTFGIKEGLMTTVHAVTATQLTVDGPSKKDWRGGRGACFNIIPSSTGAAKAVGKVIPSLNGKLTGMSFRVPTADVSVVDLTCRLEKKASYDEIKQVIKAASENELKGILGYTDELVVSSDFVGDSRPSIFDAQAGIALTDDFVKLVSWYDNEWGYS

SEQ ID NO: 35896 - protein, 205 aa, Oryza sativa Indica Group
MGAEAVRVLVVDDSPVDRRVVELLLRAHCGGGGGAAAGEAAPFHVTAVDSGKKAMELLGRRRGDRDHLTPSSPAAAAAANDQAIDIVLTDYCMPEMTGYDLLKAIKALGSPNPIPVVVMSSENEPQRISRCLTAGAEDFILKPLKMNDVQRLRKCSGATRPKSAVAGDDDRCCNTAKKAAAAAAATPEQQQQQQRSPHLAGLAMA

SEQ ID NO: 35897 - protein, 409 aa, Zea diploperennis
MQFALALDTNSGPHQIRSCEGDGIDRLEQLSIGGRKQEKALRNRCFGGRVAATTQCILTSDACPETLHSQTQSSRKNYADANRVSAIILGGGTGSQLFPLTSTRATPAVPVGGCYRLIDIPMSNCFNSGINKIFVMSQFNSTSLNRHIHRTYLEGGINFADGSVQVLAATQMPEEPAGWFQGTADSIRKFIWVLEDYYSHKSIDNIVILSGDQLYRMNYMELVQKHVEDDADITISCAPVDESRASKNGLVKIDHTGRVLQFFEKPKGADLNSMRVETNFLSYAIDDAQKYPYLASMGIYVFKKDALLDLLKSKYTQLHDFGSEILPRAVVDHSVQACIFTGYWEDVGTIKSFFDANLALTEQPSKFDFYDPKTPFFTAPRCLPPTQLDKCKMKDAFISDGCLLRECNI

SEQ ID NO: 35898 - protein, 336 aa, Physcomitrella patens subsp. patens
MEGCLSDQITHCAQTLKKEDPELDESKVKKCYDPNMQKLGWMQQRNGLEHTTPPGRLWPRGFEPWPFASMDLLATFLGSCVGSDVGEFGAGNGGIGRELTDWRRRSRVECGLRVEGSNWDCGQPSMAKNTADGFASNRRSPTLLRRKREMELRALRDGDEFGNLAGGSGSVNLRRSSYPSARAPNSNQSGPAEVSVQRKNGVFEVKGVMSMAVDPDITYGILVDYENNSQIFKTVSKVEVEYKGDMKLVTQHAHWNLMFWSGKFTIKMRVEEDRSKHKVAFKLNEPGFLKLFNGYWGIEPWIQEGKQVGSKVLVTQEVLPSILPPGPLGISYVFHS

SEQ ID NO: 35899 - protein, 321 aa, Thraustotheca clavata
SKVGINGFGRIGRLVCRAAFANPNATVVAINDPFMDLDYMVYLFKYDSTHGGYKGTVVAEDGNLVIDGHVVRVFSERNPNEIPWGEAGADYVCESTGVFTTTEKAGLHLGGGCKKVVISAPPKGSTPMYVMGVNHDKYDGSAHVVSNASCTTNCLAPLAKVIHDNFGIVEGLMTTVHAVTANQLTVDGPSRGGKDWRAGRGAGANVIPASTGAAKAVGKVLPELNGKLTGMAFRVPVPDVSVVDLTVRLEKGASLATIKAAVKEASEGSMAGILGYTEDEVVSQDFVSDKRSSIFDANVCIALNDSFVKLVSWYDNEWGYS

SEQ ID NO: 35900 - protein, 566 aa, Escherichia coli
MEMLSGAEMVVRSLIDQGVKQVFGYPGGAVLDIYDALHTVGGIDHVLVRHEQAAVHMADGLARATGEVGVVLVTSGPGATNAITGIATAYMDSIPLVVLSGQVATSLIGYDAFQECDMVGISRPVVKHSFLVKQTEDIPQVLKKAFWLAASGRPGPVVVDLPKDILNPANKLPYVWPESVSMRSYNPTTTGHKGQIKRALQSVVAVKKPVVYVGGGAITAGCHQQLKETVEALNLPVVCSLMGLGAFPATHRQVLGMLGMHGTYEANMTMHNADVIFAVGVRFDDRTTNNLAKYCPNATVLHIDIDPTSISKTVTADIPIVGDARQVLEQMLELLSQESAHQPLDEIRDWWQQIEQWRARQCLKYDTHSEKIKPQAVIETLWRLTKGDAYVTSDVGQHQMFAALYYPFDKPRRWINSGGLGSMGFGLPAALGVKMAFAEETVVCVTGDGSIQMNIQELSTALQYELPVLVVNLNNRYLGMVKQWQDMIYSGRHSQSYMQSLPDFVRRGAYGHVGIQISHPHGWKANLARRWNRCAIIAWCLLMLPSMAASTSTRCRFAGAEWMKCG

SEQ ID NO: 35901 - protein, 163 aa, Escherichia coli
MRRILSVLLENESGALSRVIGLFSQRGYNIESLTVAPTDDPTLSRMTIQTVGDEKVLEQIEKQLHKLVDVLRVSELGQGAHVEREIMLVKIQASGYGRDEVKRNTEIFRGQIIDVTPSLYTVQLAGTSGKLSAFLASIRDVAKIVEVARSGVVGLSRGDKIMR

SEQ ID NO: 35902 - protein, 454 aa, Pyrococcus horikoshii OT3
MELKPNVKEIPGPKARKVIEEHHKYMATTTNDPNEYFLVIERAEGVYWIDVDGNVLLDFSSGIGVMNVGLRNPKVIEAIKKQLDLVLHAAGTDYYNPYQVELAKKLVEIAPGDIERKVFLSNSGTEANEAALKIAKWSTNRKMFIAFIGAFHGRTHGTMSLTASKPVQRSRMFPTMPGVVHVPYPNPYRNPWGIDGYENPDELINRVIDYIEEYLFEHYVPAEEVAGIFFEPIQGEGGYVVPPKNFFKELKKLADKHGILLIDDEVQMGMGRTGRMWAIEHFDIVPDIVTVAKALGGGIPIGATIFRADLDFGVSGVHSNTFGGNTVAAAAALAVIEELQNGLIENAQKLEPLFRERLEEMKEKYEIIGDVRGLGLAWGVEFVKDRKTKEYATKERGEIVVEALKRGLALLGCGKSAIRLIPPLIISEEEAKMGLDIFEEAIKVVSERHGYKIH

SEQ ID NO: 35903 - protein, 806 aa, Candida glabrata CBS 138
MAGHSHRSSVKNGHKAFKSRHSSKNALKRANKGKVERESIGTGRPIKNASKLQRRNKAKQLRAQKILDTLQIRKLFEGSNGAEKIITVIPLTEDVDAHDIITKILSSADLDEQTLSQFVPQGMPNSAFVKDIHIKKFKSNLKFIVPDMSNFLNILDASKVADFTIFGLSGTSEVDSEFGEQVIRALELQGIASYIGVVSNLSQVHPKEKFQLDVKQSLESYFKHFFPNEDKIYNLEKPSDSLIALRTLCQKFPRGVTWRDNRGYMVANNIDFIDSETQPDVGDLVISGTVRGCGFNSDRLIHIPGLGDFQVNKIERIAASTRKTKKDADELDEISSLLENSFAATSEQDTLDEYAPVDMEFEDMSDEDEFEYSNLKAARYDDHGFLPGREQQSKKYKIPKGTSEYQAKWYLEDVVEVDDDEELEPDHEETAMDDMDMDEAVDEYAHEGFNDEMEDDFTDAKTTTEDLFVELSPEEEERQLREYRALEKEDREFPDEIELEPTQSAIEALKYYRGLKNLYNCVWDVEERDPRTPQEWNRLLRIGNYKNTKNRLQKEAVKTAQVVAGDRIKLHINFPKNLLSKVNDPSIISFPVYGLLRHEHKNAMVNFSIQRWEEYEDPVPSKETLLVQYGARRYAIQPLFSGDANSSNNVHKYDRFLHPETASVATCIAPVDFTQSPAIFFKPSSTDRKGIELVGQGTFMNADHTRVLAKRAILTGHPFRFHKKVVTVRYMFFRPEDVEWFKSIPLFTKTGRSGFIKESLGTHGYFKATFDGKLSAQDVVAMSLYKRMWPRPSIPWNGESIEEIQD

SEQ ID NO: 35904 - protein, 281 aa, Gossypium hirsutum
MQLETYWMLQMKAVTSVRKCEVSSLGFSFNLYINTCRVKTFVTLKRNLTMAKSDAEVKVLGTWASPFVMRVRIALNIKSVAYEFLQERLWEGKSELLLKSNPVHRKVPVLIHGDDTICESLIIVQYIDEVWPSVPILPSDPHERAAARFWAAYLDDKWFPSLRAIGMAEGEDARKAAIGQVEEGLMLLEEAFGKCSQGQALFGKDQIGYLDITFGCFLGWLRVTEKMSGIKLLNEINTPALLKWANRFCNDAAVKDVMPETEKLAEFAKMLRGRVRATPTS

SEQ ID NO: 35905 - protein, 208 aa, Brassica napus
MAHYRAGSEVENVLNDRNTSRREKEEDEDEAMKWAALERLPTHDRVRKAMLRGITGGFKEIDMKDLSLVERRELFDRVVAMDDDDWHGFYLRRLKRRTDRVSLKLPTIEVRFENVNVTTEAFEGSRAVPTVINSYVSVAKGVATKIGVLRSKKATISILKDVSGIIKPGRLTLLLGPPGSGKSTLLKAWSGKIESGLKCTGKVTYKGH

SEQ ID NO: 35906 - protein, 469 aa, Xanthobacter autotrophicus Py2
MLDRQTEISTAAAERTRLRELEETYCSHGDTVHYTEEPKIFERCEGSFIYDDEDRAFLDLQMWYSAVNFGYANPRLNEAMRRQLDRLPQVASQYLHREKIELAAEIAEGAMARFGHKGRVHFNVGGAQAIEDSLKLVRNACGGKSLMFAFEGGYHGRTLGASAITSSYRYRRRFGHFGERAHFIPFPYHFRGPRGMTKEEYGHRCVEQFARLFESEYNGVWDPKAGQCEYAAFYVEPIQGTGGYVIPPANFFPELKEVLDRHGILLVVDEIQMGFYRTGKLWAIEHFGVAPDIIVFGKALTNGLNPLSGLWAREALINPQAFPPGSTHSTFNANPLGTAVALEAMRMMREEDFATSVAEKGARFLDGLKELKAKHAIVGDVDGLGLALRVEICEPHDSYTPSKAIVDRMVDEALKGDLVHGGERYGLVLDIGGYHKNVITLAPALTISHAEIDLALALMDQLFARVTPR

SEQ ID NO: 35907 - protein, 119 aa, Brucella suis 1330
MYTIRIMNCAFFAHHGVFDEEHKLGQRFYVDAVLDVDEGNSLESDNIDGTVHYGIAFSVIEGIIMGRQRYLIETLALDVAKALVARFPQIKRAEITVRKPNAPVSGVLDYVEVTVVYPQ

SEQ ID NO: 35908 - protein, 278 aa, Baeomyces rufus
  misc_feature (1)..(2): Xaa can be any naturally occurring amino acid
XXHGAVKVVAVNDPFIEPHYAAYMLKYDSTHGQFKGEITVDGSDLIVNGQRVKFYTERDPANIPWKDTGAYYIVESTGVFTTTEKAKAHLKGGAKKVVISAPSADAPMYVMGVNEKTYKSDIEIISNASCTTNCLAPLAKVINDEFGIVEGLMTTIHSYTATQKTVDGPSAKDWRGGRSAAQNIIPSSTGAAKAVGKVIPELNGKLTGMSMRVPTSNVSVVDLTCRLEKPASYDQIKATIRKASEGSLKGIMAYTEDDIVSTDLNGDSHSSIFDAKAG

SEQ ID NO: 35909 - protein, 365 aa, Arabidopsis thaliana
MTKMSKLPNDLLEEILSRSPLYSMRAIRLTCKKWNTLAKEESFTKKQLVQTKAAKEFMVIMMMDSKFCLMNINLNKEEDVEPSIKCNGKIINPIGMCRVYHCGGLVCITKSFSNTRDVVWNPYLGQTRWIKPRSHHAYIYAIGYETKKSCRSYKILSSEHNYINIDDERVDYEIYELDSNSWRALDVNSNWATAFYKMDVSVKGNSYTYTDYRGDFLISFDFTTERFGPTLPLPFHSRCGDIVALSSVREEKLAVLLHRCNISRMEIWITNKIEPNNVSWGKLFLTVDMKPLIIDDGIFFIDEEKKVVVVFDKDKEMRNRITAYIIGENGYFRKVDLGDSESFPVRCSYVPSSVEIKQLAKGKSN

SEQ ID NO: 35910 - protein, 278 aa, Cladonia bellidiflora
VEHGAVKVVAVNDPFIEPHYAAYMLKYDSQHGQFKGTIEVEGSDLIVNGQKVKFYTEKDPSAIPWKDTGAYYIVESTGVFTTTDKAKAHLKGGAKKVVISAPSADAPMFVMGVNEKTYKSDIEVISNASCTTNCLAPLAKVMHDNFTIIEGLMTTIHSYTATQKTVDGPSAKDWRGGRTAAQNIIPSSTGAAKAVGKVIPDLNGKLTGMSMRVPTSNVSVVDLTCRIEKSVTYDEIKEAMKKASAGELEGIMAYSEDDLVSTDLNGDNHSCIFDAKAG

SEQ ID NO: 35911 - protein, 395 aa, Crocosphaera watsonii WH 8501
MIQLANRVTQVTPSLTLAITAKAKEMKAQGVDICSFSSGEPDFDTPQYIKDAAVSALDQGKTKYGAVAGEPGLREAIARKLNNDSQLNYSPNNVIVTNGGKHSLFNLMLALIEPGDEVIIPAPYWLSYPEMVKLAQGNPIIVDTTAETDYKITPEQLRQAITSKTKLFVLNSPSNPTGTVYNPAEIKALAEVIVEHNLWVVSDEIYEKILYDGVVHISIGSLGEEILKRTIISNGFAKSYSMTGWRIGYLAGPEPLIKAVSTIQSHSTSNVCTFAQYGAIAALESPKSPPCLQTMRDAFSQRRQVILEKIRAIPQLSCPTPMGSFYVFVDISKTGLNSLEFCDQLLEKQQVAAIPGKAFGADHCIRLSYATDLASIEKGMDRIERFVQETKVNQL

SEQ ID NO: 35912 - protein, 298 aa, Zea mays
MPETVPCRSASSTNDQRHDDMSPARLAAVAAAVLLAAALLRVVPGARGQEETEHEEEFSYVPGDEHGPEHWGSIKAEWAACGAGRMQSPIDLSHERVSLVRSLGYLSHSYRPAEASIVNRGHDIMVRFEGDAGSLVINGTAYYLRQLHWHSPTEHTVDGRRYDMELHLVHESAENKAAVIAVLYEIGGHDDALLRQLEPAIRRVADVRDREMRVGVVDPRRARGRASVYYRYVGSLTAPPCTEGVIWTIVKRVRSVSKHQLELLREAVHDDMENNARPLQEANHRDVSMFRPKPNKQY

SEQ ID NO: 35913 - protein, 278 aa, Heterodea muelleri
  misc_feature (275)..(275): Xaa can be any naturally occurring amino acid
  misc_feature (277)..(277): Xaa can be any naturally occurring amino acid
VEHGDVKVVAVNDPFIEPHYAAYMLKYDSQHGQFKGTIEVEGSDLIVNGQKVKFYTEKDPSAIPWKDTGAYYVVESTGVFTTTEKAKAHLKGGAKKVVISAPSADAPMFVMGVNNESYKSDIEIISNASCTTNCLAPLAKVIHDNFTIIEGLMTTIHSYTATQKTVDGPSAKDWRGGRAAAQNIIPSSTGAAKAVGKVIPELNGKLTGMSMRVPTSNVSVVDLTCRIEKSVTYDEIKEAIKKASSGELKGIMSYSEDDLVSSDLNGDNHSCIFDXKXG

SEQ ID NO: 35914 - protein, 195 aa, Bacillus cereus ATCC 10987
MIVLIDNYDSFTYNLYQLLGEYEEEIVVVRNDQITIEQLEEMKPKGIVLSPGPGKPEDAGICMEVIRHFYKNVPILGICLGHQAIISAFGGDIVRAERIKHGKTSRVKHNGTSIFSYVTQPLTAMRYHSLVAAQTSLPQCFDILATAMDDGEIMAVRHNYYPLFGLQFHPESIATEEGGKLIRAFLGEVKEEERV

SEQ ID NO: 35915 - protein, 485 aa, Volvox carteri
MSKLLLVALFGAIAVVATSAEVLNLNGRSLLNNDDPNAFPYCKCTYRQRRSPYRLKYVGAENNYKGNDWLCYSIVLDTTGTVCQTVPLTEPCCSADLYKIEFDVKPSCKGTVTRAMVFKGIDRTVGGVRVLESISTVGIDDVTGVPGAAILRIVKDLALPYSVVASFLPNGLPVCINRVPGSCTFPELFMDVNGTASYSVFNSDKDCCPTGLSGPNVNPIGPAPNNSPLPPSPQPTASSRPPSPPPSPRPPSPPPPSPSPPPPPPPPPPPPPPPPPSPPPPPPPPPPPPPPPPPPSPSPPRKPPSPSPPVPPPPSPPSVLPAATGFPFCECVSRSPSSYPWRVTVANVSAVTISGGAGERVCLKISVDNAAAATCNNGLGGCCSDGLEKVELFANGKCKGSILPFTLSNTAEIRSSFSWDSTRPVLKFTRLGLTYAQGVAGGSLCFNIKGAGCTKFADLCPGRGCTVAVFNNPDNTCCPRVGTIA

SEQ ID NO: 35916 - protein, 593 aa, Physcomitrella patens subsp. patens
FTYSKFGPGSVTLVGDSRIMPDGRLRLCNISVDVEGQVTSVGRALYPTPVQLRNSTTATMASFETSFTFSIDTKLGNFALSSPSGMAWGIFPDNRTIGDYGLYLGLMNSSTDNFSNKVFAIEIDTGFSEFPGYNDTSSCHLGVDLTTMRSDPVFDMATPPGSQTSPCIQNRGVFTLHIRYNGLSHILLVDLLDIGGESVGRINTTKNLYPYMNDQMFVGFSGSGIYITPQEDSVYSWNFSSTFTSPGLIYGAAAGGAGGLLLLLGLGLGCFCCRGKSSEAGTYSQETIPGGVAVVGPRKFTYKELSLATKNFSQSELLGKGGSGSVYRGILRDSGAMVAVKMIQADRSQELAEKEFQAEVSIINQIRHRNLVQLQGWCNEKGMLCLVYEYLPNGSLDSLLRKEMQAPNTVIPWGTRYNILTGVAAALAYLHEEVGQCILHRDLKPGNILLDVNYNACLADFGLARLTEHNQAAATTMLAGTLGYMAPELPQTGRATTQTDVYSFGVLIVEMICGRRPTDVDRDTQMPLLDCVWAAHAGNDISCVVDAKIRDDRDAQQIERTLLLGLLCCHPDPISRPTMRNARQILTGDSPLP

SEQ ID NO: 35917 - protein, 625 aa, Ashbya gossypii ATCC 10895
MGSSMNFPSGYVNKHTLQRTKSSGPKIFQKESVAAKSAGSTKSKLSLALQTQGQRQGEDEAAGPEDQQGDGEEDEDYSSCDEKNEESAGDYRPGGYHPAYKGEIYKDGRYTLVRKLGWGHFSTVWLARDNVTGSHVAMKIVRSDRVYTERLERVKLLHKVRSTNLAEQACGGATESAEGPARPVSRSGAHYILNLLDDFVHKGDNGEHIVMVFEVLGENLLALIKKYEHRGIPIVYVKQIAKQLLLGLDYMHRKCGIIHTDIKPENVLMEIGDVEGIVRMMEQLDKQKRELRKLQRRASRSVFDSPPVRENTSCTGSISNSITETSTSRRARRHTLITGSQPLPSPLSSNNFMELKTQLMGQPMGTISRQPSMSGRSFSLQTLGGATTTLGSSVQKPAESDHDISNSFSSMEIEDHGNSSGNTEVGQVIQIKIADLGNACWYDEHFTNAIQTREYRSPEVLLGCPWGCSADIWSTACLIFELLTGDFLFEPNQGHSYTKDDDHIAQIIELLGNIPSYLFDHGKYVKNFFFSDGKLRNIKKLRFWPLKDVLIEKYGFETSAAEEVSGFLLPMLEMDPRKRADAGGMVNHPWLSDTVGMETVTASDRVLYASGADIPGWFKEDSRHG

SEQ ID NO: 35918 - protein, 525 aa, Ashbya gossypii ATCC 10895
MAAVEQVSSVFDTILVLDFGSQYSHLITRRLREFNVYAEMLPCTQKISELGWKPKGVILSGGPYSVYAADAPHVDRAVFELGVPILGICYGLQELAWIAGAEVGRGEKREYGRATLHVEDSACPLFNNVDSSTVWMSHGDKLHALPADFHVTATTENSPFCGIAHDSKPIFGIQFHPEVTHSSQGKTLLKNFAVEICQAAQTWTMENFIDTEIQRIRTLVGPTAEVIGAVSGGVDSTVAAKLMTEAIGDRFHAILVDNGVLRLNEAANVKKILGEGLGINLTVVDASEEFLTKLKGVTDPEKKRKIIGNTFIHVFEREAARIQPKNGEEIEFLLQGTLYPDVIESISFKGPSQTIKTHHNVGGLLDNMKLKLIEPLRELFKDEVRHLGELLGISHELVWRHPFPGPGIAIRVLGEVTKEQVEIARKADHIYIEEIRKAGLYNKISQAFACLLPVKSVGVMGDQRTYDQVIALRAIETTDFMTADWYPFEHEFLKHVASRIVNEVEGVARVTYDITSKPPATVEWE

SEQ ID NO: 35919 - protein, 371 aa, Candida albicans SC5314
MPIPASMKAIVFYAPYDVRTEERPTPKIKDPKDVIVKVRYSGLCGTDLHSYRGHIKGPVGTIIGHEFVGTVVATGDNITKFSIGDDVISNFSIECGECWYCKHGYSGQCNVTNTFGKVGLDGGQAEYVRVPYAETTLTKKPSTTNSNDDVDDSVYVLMADIFTTGYYGVKKIKDFLSISAAEGIKPQSFEETTILQLGAGPVGLCALRILKYFGFGKVVVVDNVPSRLEEAKRLGATEVINFETEPDGIKKYITEETDGVGFDAVLEVVGSAAAHKTSFDAVRRNGFISSIGMGHEPFPFNGLDVYLKNINMSFGRCHSWSLFPESLAIFEEMKGDLASFIDYKAKLEDSKEAFDMFDKHKVKKIVFDLTS

SEQ ID NO: 35920 - protein, 485 aa, Bordetella parapertussis 12822
MTSSPDIGAYAYIGGRWAQTPAARTFRTALPHDTRQSGREFGCATPADAEAAVARATAAAAPWAAVPALQRAEPLRKAAALLLERLDELTRLLALEAGKPLQEARGEVSAAAGFLHAYAGWPAWGGQGAVKRNGALRIVQEKFPRGVAAIITPWNYPLSNPCQKIGAALIGGNPVIWRPSVSTPAVSLALIEIMHQAGFPDGVFNALIEDGDAVSRALVASEAVAAVSFTGSTRVGLQVAAAAAGRGAAVQCEMGGKNAAVVMPDADLDLAAERIAFGAFGFAGQKCTAVSRVLVHRHVADAFLKRLLDIVRDLRPGLPHQEESCLAPLISARQHDLLVDAIAQARERGARLIEGGAPIEQAPYAHGNYLSPALIQVHDLDDPLWTDEYFGPVLALRVCDDLDQAIAEVNATRYGLGAALFSHDARAIGRFTDQVQAGVVKINDVPPGLYPHVSTGGWKASGLGPNELSEDGVDFFLHKKSVYLA

SEQ ID NO: 35921 - protein, 404 aa, Haemophilus somnus 2336
MRVFPKSDKLEHVCYDIRGPVHQEALRLEEEGKKILKLNIGNPAPFGFEAPDEILVDILRNLPAAQGYCDSKGLYSARKAIVQYYQSKNILSATVNDVYIGNGVSELITMSLQALLNDGDEVLIPMPDYPLWTAAATLAGGKAVHYLCDEQADWFPDVADIKSKVTSRTKAIVIINPNNPTGAVYSKELLLDIVEVARQNGLMIFADEIYDKILYDNAVHHHIAALAPDLLTVTFNGLSKSYRVAGFRQGWMILNGPKQQAKGYIEGLDMLASMRLCANHPMQHAIQTALGGYQSINEFILPGGRLLEQRNKAYELINQIPGLSCTKPMGALYMFPKIDTKKFNIYDDEKMVLDLLRQEKVLLVHGRGFNWQQPDHFRIVTLPYVNQIEDALGRLAKFLTHYRQ

SEQ ID NO: 35922 - protein, 469 aa, Pseudomonas syringae pv. phaseolicola 1448A
MSETTAPSGELKRGLKNRHIQLIALGGAIGTGLFLGSAGVLKSAGPSMILGYAICGFIAFMIMRQLGEMIVEEPVAGSFSHFAHNYWGGFAGFLSGWNCWLLYILVGMSELTAVGKYIHYWLPDIPSWVSAAAFFILINAINLTNVKVFGETEFWFAIIKVVAIIGMIALGSYMLVSGSGGPQASVSNLWEHGGFFPNGVGGLVMALAIIMFSFGGLEMLGFTAAEAEQPKTVIPKAINQVIYRILIFYIGALVVLLSLTPWDSLLASLNASGDSYSGSPFVQVFSMLGSDAAAHILNFVVLTAALSVYNSGTYCNSRMLVGMAEQGDAPRALAQVDRRGVPVKAIFASAAVTVVAVLLNYFVPQQALELLMSLVVATLVINWAMISYSHLKFRQHMNRTAQVPLFKALWYPYGNYVCLAFVLFILGIMLMIPGIQISVYAIPVWLAVMWVCYRAKNRRSVVMNAETGK

SEQ ID NO: 35923 - protein, 393 aa, delta proteobacterium MLMS-1
MKNIRDIDIRGKRVLIRVDFNVPIDEQGNITDDIRIRGVLPTINHALDENAAVIICSHMGRPKGERRPEFSLAPAARRLSRLLDKEVKLAPDCVGPEVAEMAAALAPGEVLLLENLRFHPEEQANDEKFSRELAALAEVYINDAFAVAHRAHASVVGIPRFAPAKGAGFLLQKEMDYFHRSVGNPMRPLAAIIGGSKVSSKLGALTNLMDRVDKMLIGGAMANTFLRSQGLDVGRSKVEDDLLETARELIAKAHERGVKLYLPVDCIVAPELDAKAETKRVTCQEIPATWMALDIGPATTMLFTEALDDAKTIIWNGPMGVFEVDAFSRGTMAMVQTLTRSHALTIVGGGDTDVAVHRAGESANISYISTGGGAFLMLMEGKTLPGVAILEEG

SEQ ID NO: 35924 - protein, 250 aa, delta proteobacterium MLMS-1
MRTPLLAGNWKMHLDQAAAAELAAAVANVAAACPEREVMIAPPFTALAAAGQAAGQQVILAAQNVCWEAQGAFTGEIAPPMLRELGCGMALVGHSERRQLFHEDNAMINRRLGGALAHGLVPVLCIGETLAEREADRTMEVLASQLREGLAGISLDDPRRLVVAYEPVWAIGTGKTAGPEQAQQVHRFVRGLLAELYQKNIADGVRILYGGSVNAANVDSIMAQPDVDGALVGGASLDIASFERIIRFQV

SEQ ID NO: 35925 - protein, 318 aa, Haemophilus somnus 2336
MMSKTLTVLGSINADHVISVPHFAKPGETLSGKQYHIAYGGKGANQAVAAARLADFSQGATVNFVGCIGSDDIGRAMKKAFAQDGINVATITEIPNEMTGIAMIQVADSGENSIVISAGANAYLTPEIVDKFATEIERADYLLMQLETPLNAILEAAKLAKKHGATVVLNPAPANQLPDELLSLLDMITPNETETEILTGVKVTDEQSAAKAASVLHQKGVATVLITLGSKGVYVSRKSSTQELGQNKVIAGFRVNAVDTTAAGDTFNGAFLTALLENKSLDEAIRFAHAAAAISVTRQGAQPSIPTRRETLDFLAQH

SEQ ID NO: 35926 - protein, 372 aa, Leptospira interrogans serovar Lai str. 56601
MSERSYYDILGVSKSANDEEIKSAYRKLAIKYHPDKNKGNKESEEKFKEATEAYEILRDPKKRQAYDQFGKAGVSGGAGGFGQGAYTDFSDIFGDFGDIFGDFFGGGRSSGFGGGRRSGPQRGSDLRYNLEVSLEDAALGREYKIEIPRLESCVDCNGSGASKGSSPATCPDCGGSGQIRRTQGFFSVATTCPTCRGKGTIISNPCRSCGGQGLQEKRRTINIKIPPGVETGSRLKVSGEGEAGPNGGPHGDLYVVTHIKKHELFERQGNDLILVRKISLAQAILGAEIEVPTIDGKKAKMKIPEGTESGQVFRLKGHGMPYLGAYGKGDQHVIVKIEIPKKITRRQRELIEEFARESGENIPGSKGKIFTK

SEQ ID NO: 35927 - protein, 499 aa, Brassica napus
  misc_feature (202)..(202): Xaa can be any naturally occurring amino acid
MAMIEQRPKTKIVCTLGPASRSVEMVEKLLRAGMNVARFNFSHGSHEYHQETLDNLRQAMLNTGILCAVMLDTKGPEIRTGFLKDGKPIQLKQGQEITISTDYDLQGDEETICMSYKKLAEDVNPGMVILCADGTISLLVLSCDTENGTVRCRCENSAMLGERKNVNLPGVVVDLPTLTEKDKEDIMKWGVPNQIDMIALSXFVRKGSDLVQVRKLLGDHAKNILLMSKVENQEGVANFDDILVNSDAFMIARGDLGMEIPIEKIFLAQKVMIYKCNIQGKPVVTATQMLESMIKSPRPTRAEATDVANAVLDGTDCVMLSGETAAGAYPELAVRTMAKICVEAESTLDYGDVFKRIMQYSPVPMSPLESLASSAVRTANSARATLIMVLTRGGSTARLVAKYRPGMPILSVVVPEMKTDFFDWSCSDESPARHSLIFRGLIPVLYAGSARASHDESTEEAIEFATQHGKEKQLCKTGDSVVALLRVGNASLIKILTVK

SEQ ID NO: 35928 - protein, 377 aa, Pseudomonas aeruginosa PAO1
MNCYQDEFDQTNGLRYLNHAAVAPWPRRAADAVSAFARENVAHGASDYPEWLKIEHRLRERLARLLNARAGSDLALVKNTSEALSFVAFGLDWREGDQVVIGNEEFPSNRVVWEALRPRGVEVVEVGLAGDDPESALLAACGPRTRLLSISAVQYASGLRLDLERIGAGCRRRGVLFCIDAIQQLGALPFDVQAYDCAFAMADGYKWMLGPEGLGVFYCHPEQRERLALHEYGWHMLEHALDYERRDWRPARSARRFECGSPNMLGAMALEASLGLLEEVGMERVGRDIAERVQWLQDGLSGIPGVRLHSPRNPSRRAGILTFSLDGQDNRTLFETLRQERVICAQRGGGIRFSPHFYTSSTVIDDTLAILRQVAGT

SEQ ID NO: 35929 - protein, 88 aa, Arabidopsis halleri subsp. halleri
LTESVPFFREIVTGAFEKFIKVTMKLPLTGQQYSEKVTENCVAIWKSLGIYTDCEAKAVEKFLEIFKEETFPPGSSILFALSPTGSLT

SEQ ID NO: 35930 - protein, 141 aa, Haemophilus influenzae Rd KW20
MMTERTFSIIKPDVVKRNLIGAILTRFEQNGFKIIASKMVRLTREQAEGFYAEHQGKEFFVPLVEYMMSSPIVVSVLEKENAVKDYRTLIGTTNPETAAEGTIRKDFALSQRENSVHGSDSIESANREIAYFFTNSEIFER

SEQ ID NO: 35931 - protein, 832 aa, Schizosaccharomyces pombe
MSEIHVKTALSRLADKYLQNSKNPSVPYTIETIVSFFQEIIHSISPDTFQLDIDDILYKIYSKIPPEENNDALFSKLSNLVSRLKSQTVIHNKSQILYFLYLLSPISQSSRDVSSHLLDESISNPINIPSTEVESSNFGQTRYDQVPENPQITDWDEGLENESSISIAHDSSRLNRSTETSSVQHTLITEADLLSSISYVLQGISTEYVQFKNELALLSKRIPVQYLLQMRALSETGLLYQELKVFSNYDPSVSQSIDGDNVSKAFINDQSLALQSLKSVISKELTNFLALIASLDSQIRADASLEKPMVTIRRCIAWTQVAKLKLRILSSVVNDNMNQENKKRLIQVVSKYNVHGDPLIQELSDKILTEITGPLYEMIENWIYKGELVDPYQEFFVKEKNGSESHDHQGQGDVVWKGKYFLDKELIPSFLSEELVDKIFLIGKSLNFARYGCGDFDWAQEHYQKLVKKLSYRDPHSLETVVDKAYTESINHLVYLMEEVFHLTDHLKAIKKYLLLGQGDFVDLLMESLGNSLDQPANTLFRHNLTASLESAIRSSNASYEPEYVLKRLDARLLELSHGETGWDVFTLEYKVDSPINVIITPYCSRQYLKIFNFLWRLKRIEFALAHSWRRVNLGERNVFRNLDYTKFEWHFVSCHLAEMIHFVCQLQYYILFEVIEISWQELQLAMEKPNATLDTYIEAHEKYVTSITHKGLLGGGKSRNEDSFLHQLHDILKVILNFHDAIELLYNFSCSLSNRIRINVPISTDALAAQYTPIKNELSNFTEEFQVRLQKLLHGLASHKDPEMRFLSVRLNYNEFYVSHRRRHDKDVTSQ

SEQ ID NO: 35932 - protein, 257 aa, Lecanora muralis
  misc_feature (4)..(4): Xaa can be any naturally occurring amino acid
  misc_feature (26)..(26): Xaa can be any naturally occurring amino acid
  misc_feature (40)..(40): Xaa can be any naturally occurring amino acid
PFIXPHYAAYMLKYDSQHGQFKGTIXVKGNDLIVNGTTVXFYTEKDPANIPWKDTGAYYIVESTGVFTTTEKAKAHLKGGAKKVVISAPSADAAMFVMGVNEKEYKSDIEIISNASCTTNCLAPLAKVMHDNYTIIEGLMTTIHSYTATQKTVDGPSAKDWRGGRTAAQNIIPSSTGAAKAVGKVIPSLNGKLTGMSMRVPTSNVSVVDLTCRLEKAVSYDEIKATMKKASEGDLKGIMAYSEDALVSTDLNGDNHS

SEQ ID NO: 35933 - protein, 89 aa, Arabidopsis halleri subsp. halleri
SVPFFREIVTGAFEKFIKVTMKLPLTGQQYSEKVTENCVAIWKSLGIYTDCEAKAVEKFLEIFKEETFPPGSSILFALSPTGSLTVAFS

SEQ ID NO: 35934 - protein, 471 aa, Burkholderia sp. 383
MNQRQGFDAIVEREKGLHRGLSTGQLSMIAIGGAIGTGLFLGSGFAIGFAGPSVLVSYAIGALIALLLMGCLAEMTVAHPTSGSFGAYAEHYVSPWAGFLVRYAYWASIVFAVGTEVTAIAVYMKYWFPAVPGWYWIVGFSAALIGINLVSVKVFGAVEYVFSMLKIAAIVAFIALGAVVVFGAPAGSGIGFANYTAHGGFFPKGVWGMWVAVIVSIFSYLSIEMIAVAAGEARDPHQAITRAFRATMVRLVFFYLLTLALMLAIVPWTAAGADESPFVKVMAATHVPGAAGVINFVILVAALSAMNSQLYITTRMMFSLSRAGYAPKALGRLTGHGVPAAALGLSAIGIALATVLNVLYPDTSFVMMMSVSMFGAMFTWLMIFVTHLFFRRHHRGQVLAFRMWGFPVTSLLGAALMFAALVTTYFTREFRMTLFCGVPFMIVLSVVYAVWYRGKGAEPAAGREGVHVPGQ

SEQ ID NO: 35935 - protein, 88 aa, Arabidopsis lyrata subsp. petraea
LSESVPFFREIVTGAFEKFIKVTMKLPLTGQQYSEKVTENCVAIWKSLGIYTDCEAKAVEKFLEIFKEETFPPGSSILFALSPTGSLT

SEQ ID NO: 35936 - protein, 199 aa, Arabidopsis thaliana
MSFLAVHQIVRKKLQLVGVTALLLACKYEEVSVPVVDDLILISDKAYSRREVLDMEKLMANTLQFNFSLPTPYVFMKRFLKAAQSDKKLEILSFFMIELCLVEYEMLEYLPSKLAASAIYTAQCTLKGFEEWSKTCEFHTGYNEEQLLACARKMVAFHHKAGTGKLTGSTTHLSSFMLQEVNQLGFCFKGGKNYNKNLI

SEQ ID NO: 35937 - protein, 266 aa, Mycobacterium sp. KMS
MPRLLDKVVVVTGAARGTGRVHCERFAEEGADVIALDVAAVADELSGTAAAVARHGRRCVTGEADVRDFAALTAAIDRGVEELGRLDVVVANAGVHPAGAPAWELTGEAWRQALDVNVTGVWHTVKAAARHMDSGGGAVIVISSTNGLRGTPNSAHYTTSKHAVVGLARTLANELGPRSIRVNTVHPGAVATPMVLNEATFRRLRPDLEEPTADDAAEVLRARNLLPVPWVDPVDVANAVVFLASDEARYITGSQLVVDAGLTQKV

SEQ ID NO: 35938 - protein, 175 aa, Triticum aestivum
  misc_feature (23)..(23): Xaa can be any naturally occurring amino acid
MAPAVMASSATTVAPFQGLKSTXAGLPVGRRSSGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLPPAPEVKKEYPDAYVRVIGFDNLRQVQCVSFIAFRPPGCEESGKA

SEQ ID NO: 35939 - protein, 474 aa, Physcomitrella patens subsp. patens
MAQKSPYLKQRDGNGSGLRVGYTVDDQEHDKQPLDPGLPLLQHADLEDKIVLLRVDHNVVKKGKILDQYRIDVTLATMYNIIERGGRLIIMTHVGRPYDKKTKTLVVKQDDAVDAVVGYLQRKLRIKFAVPKFHVFEKEGIHDVDTSINWLIQDLRARKIGGIYLPNTRWFAGEEDKGEKMERLAVQLAALADVYVNDAFGSWQPHTSTYHVAKYLPSFAGLCMQDELSNVRAVLEPKRPFLAIVAGAKYDTKIGPLAAIYKRVDHLILGGLIYNTFLCAKYGVKIKGVEDSDIALAKDLVEQDKNERKILELPYLVESDTLEGRIEGKFRTVHTKDFKPGQEFQFILDVDPASFEDPEVLEGLASAKTIFVNAVMGLMPTFWHGTSKMDETIDNNRTAQKFFGGGDTLQEFKSLHPGLYHAALDSPKYYMFTGGGTVLKVLEEADPFGLPTVKALLANGEAFGYQNWRNASAM

SEQ ID NO: 35940 - protein, 196 aa, Populus trichocarpa
MITITLSFRELNKMSPGYQVPHSMKQPKQQDQQQHHQQQQQQQQQPRQARGSYNAVPEDSYGRGDSYGRGDSYGRGDSYGRGDSYGRGRGRGRGRNWGRGGYGYGNNQGNYYQGSYRGNYHGNYQGNYQDNGGYSNQGRGGGRGRNWGYRGTGYERGRGGGGRGYGQGRGRMANRSRGGGGGGGGNGNSNGNGNQA

SEQ ID NO: 35941 - protein, 329 aa, Chlorobium tepidum TLS
MRRRPATIKRSTLMGFLSKIFGKKEVELKRPQVREDAALIKTLVGHEDRVLGVRFSPDGKKLVSGSFDEKVKLWDVETGNAIHTMSGHTTWVKCVDYSPKGDKVASGSIDSTVRIWDVATGQCLHVCKGHDTEVRMIAFSPDGKTVASCSRDTTIKFWDTETGNEVKTLFGHKSYIECIAFSADGKKLVSCGEEPVVKIWDLETGKNIANYPTGDTLSHFVSFSPDGSQIALCGRDAKVKVLDAATGQMLKVLEGHEDGVRALCYNPAGTLIASAANDESVRLWDVAKGALVHTYRGHTHEVQSVAFSPDGKVIASGSDDFKIKLWGVV

SEQ ID NO: 35942 - protein, 140 aa, Rhodopirellula baltica SH 1
MTMSDEATAVAEYSAEAKELGDKIANMTLKQAKELSDYLKDEHGIEPAAGGGAVMMAGPAGDGGGAAEVEQTEFDVVLTGFGEKKLNVVKVVKNITGASLMDAKKMVEGCPATLKEAVSKEDAEKVKAEIEEAGGSVELK

SEQ ID NO: 35943 - protein, 468 aa, Mesorhizobium loti MAFF303099
MAYDVVIIGSGPGGYVCAIKAAQLDLKVAVVEKNATFGGTCLNIGCIPSKALLHASEMFAEAGHSFDTLGVEIPAPKLNLTKMMAHKDATVASNVNGVAFLFKKNKIDSFRGTGKVVAAGKVSVTGEDGKVEEIETKNIVIATGSDVAGIPGVKVDFDEKIIVSSTGALSLDKVPGHLVVVGGGVIGLELGSVWARLGAKVTVVEFLDTILGGMDGEVSKQFQRMLSKQGFEFKLGAKVTGVAKAKKGATVTFEPVKGGAAETIAADVVLIATGRRAYADSLGLKEAGVEVDERGRVKTDGHLKTNVPGIYAIGDVIAGPMLAHKAEDEGVAVAETIAGQAGHVNYEVIPSVVYTSPEIASVGKTEEELKKAGIDYKVGKFPFSANGRARAMLHTDGFVKILADKASDRVLGVHIVGFGAGEMIHEAAVLMEFGGSSEDLARTCHAHPTMSEAVKEAALATFFKPIHI

SEQ ID NO: 35944 - protein, 361 aa, Candida glabrata CBS 138
MKGLILVGGYGTRLRPLTLTVPKPLVEFGNRPMILHQIEALANAGVTDIVLAVNYRPEVMVETLQKYEKEYGVSITFSVETEPLGTAGPLKLAEKVLKKDNSPFFVLNSDVICEYPFKELADFHKAHGGKGTIVATKVDEPSKYGVIVHDIATPNLIDRFVEKPKEFVGNRINAGLYILNPEVIDLIEMKPTSIETETFPILVEQKSLYSFDLEGFWMDVGQPKDFLSGTVLYLNSVSKKNPEKLTKGDNIVGNVMVDPSAKIAASAKVGPDVVIGPNVTIGEGVRITRSVVLSDSSIQDHSLVKSTIVGWKSTVGKWCRLEGVTVLGDDVVVKDEVYVNGGKVLPHKSISANVPSEAIIM

SEQ ID NO: 35945 - protein, 424 aa, Mesorhizobium loti MAFF303099
MATEIRVPTLGESVTEATIGKWFKKVGDAIAVDEPLVELETDKVTVEVPAAAAGTLGEIVAKEGETVGVGALLGSISAGGSAPATKPQAVSQASSPDAASTSKQAAAETAKIAGDAGAVEPRSMPPAPAAAKLIAENNLSVDQLSGSGKRGQVLKGDVLDAIAKGAPSQPAETPRAAPAPIAVRAPSSGDDASREERVRMTKLRQTIARRLKEAQSTAAMLTTFNEVDMSAVMALRTKYKDVFEKKHGVKLGFMGFFTKAVTHALKEIPAVNAEIDGTDIIYKNFAHVGVAVGTEKGLVVPVVRDADQMSIAEIEKEIGRLGIAARDGKLSVADMQGGTFTISNGGVYGSLMSTPILNAPQSGILGMHKIQDRPVVVGGQIVIRPMMYLALSYDHRIVDGKEAVTFLVRVKESLEDPERLVLDL

SEQ ID NO: 35946 - protein, 346 aa, Bacillus anthracis str. A2012
MGLTAGIVGLPNVGKSTLFNAITQAGAESANYPFCTIDPNVGIVEVPDERLNKLTELVEPKKTVPTVFEFTDIAGIVKGASKGEGLGNKFLSHIRQVDAICQVVRCFEDENITHVSGKVDPIDDIETINLELILADLESVDKRIERVAKLARQKDKEAVYEHEILVRLKEAFEEGKPARTVEFTEEQMKIVKGLHLLTTKEMLYVANVSEDDVIDPSENKYVQMVKEFAANENSQVIVVCAKIESEIAELDEEEKKVFLEELGIEESGLDQLIRAAYDLLGLATYFTAGVQEVRAWTFKQGMKAPQCAGVIHTDFERGFIRAETVSYEDLMTNGSMTAAKEAGKVR

SEQ ID NO: 35947 - protein, 453 aa, Ashbya gossypii ATCC 10895
MLAFTRIAPKVRTLASVARMQLRTYASYPPHTIIGMPALSPTMTQGNLAVWTKKEGDKLSPGEVLAEVETDKAQMDFEFQEEGFLAKILVPEGAKDVPVNKPIAVYVEEEGDVAAFKDFKVEESAAESKDAPAKEEAAPAKAAPAAAAPAKAAKKSTGSAASGGRIMASPLAKTIALEKGISLKEVTGTGPNGRITKEDVEKYLAKAPKKTESAAAPAAATYEDVPISNMRRVIGSRLLQSCQSIPSYPISSDISVAKLLKLRQSLNAAGKDQYKLSINDILIKAIAGAAKRVPEANAYWLEDQGVIRLFKNVDVSVAVATPTGLITPIVKNAESKGLRSISAEIKELGKRAKENKLAPHEFQGGTICISNLGMNNAVSSFGSIINPPQSTILSIGTLRRVPVEDAGAEYGFTFEDRMNITGVFDHRTIDGARAADFMRELKNIIENPLELML

SEQ ID NO: 35948 - protein, 478 aa, Sinorhizobium meliloti
MEIDRQVAKYQPASDRIRHFREFTIPMSDQEVQKQSARCMDCGIPYCHGPTGCPVHNQIPDWNDLVYNGNWDEAIRNLHSTNNFPEFTGRVCPAPCEEACTLNLEDVPVAIKTIEQAIADKAYEMGYIVPQPAVTKTGKKVAVIGSGPAGMAAAQQLARAGHEVHVYERESKPGGLLRYGIPDFKMEKNFIDRRVEQMRGEGVTFHCGVNVGVDVAVQKLVDENDAVLYCGGSETPRDAGIPGVEFFGVHDAMPYLVQQNRRVGRENIDSVGWPSEPILAGGKHVVVVGGGDTASDCVGTAFRQGAVKVTQLDIRPQPPEKEDKLAVWPFWATKMRTSSSQAEGAVREFQVATLEFVGDEDGNLTGVKCCQVDERRKPIAGTEFIIKADLAFIAIGFRGPFADSVLKDLGEKLTVNTDRRGSTNVVANERDYRTSVDKLWAAGDIRRGQSLVVWAIREGRQAARAIDEALMGSTVLPR

SEQ ID NO: 35949 - protein, 78 aa, Pseudomonas aeruginosa PAO1
MSTIEERVKKIVAEQLGVKEEEVTNSASFVEDLGADSLDTVELVMALEEEFETEIPDEKAEKITTVQEAIDYIVAHQQ

SEQ ID NO: 35950 - protein, 227 aa, Mesoplasma florum L1
MNNKKVAVSIYVFNFLEIGKKIDELIEAGMEWIHVDIMDGNFVNNYALCQKFCKDIKDKYPKIKVDAHMMCSNSEKYIESFAEAGCDYFIFHYETLTDKNPITVNNIINKIKSYNMKPIIALNPETSFEHIKTYCDDLYAVMCMNILPGFNGQKIIESSYSKINIINKYRKENNKVFKIMTDGGLREDTYKEILDAGADIVVVGAFVNVENNKLKGQFEKIKNYEIK

SEQ ID NO: 35951 - protein, 332 aa, Capsicum annuum
MEYYYNYNSINKMVSIIFILVLAIDLTMVLGQGTRVGFYSSTCPRAESIVQSTVRSHFQSDPTVAPGLLTMHFHDCFVQGCDASILISGSGTERTAPPNSLLRGYEVIDDAKQQIEAICPGVVSCADILALAARDSVLVTKGLTWSVPTGRRDGLVSRASDTSDLPGFTESVDSQKQKFSAKGLNTQDLVTLVGGHTIGTSACQFFSYRLYNFNSTGGPDPSIDASFLPTLRGLCPQNGDGSKRVALDTGSVNNFDTSYFSNLRNGRGILESDQKLWTDDSTKVFIQRYLGLRGFLGLRFGVEFGRSMVKMSNIEVKTGTNGEIRKVCSAIN

SEQ ID NO: 35952 - protein, 308 aa, Mesoplasma florum L1
MKKILTMGSIGVDHVFNVDKLPNKGQSIISKNFNIFFGGKGANQAVAAAKLGADVKYIGHVGNDDAGLHAIENLVKNKIDASYIKKINNINTQVANIIVDDKGDNLLIVDTGANFTFLKDEINEYKELIDHSDILLTQLETNLEFVEDFINYGHSKNKLIILNPGPAKVISNKIIEKCDFITPNESEICILLGKEYTENYELLKKYAYELWDINKKNVIVTLGENGSIWIDEKGELHKFEAYKVKAVDATACGDTFMGGISAYLAQDKTIEEAIKFATAAASLAVTKMGAQSSLPELKEVHEFIKKNG

SEQ ID NO: 35953 - protein, 366 aa, Mycobacterium smegmatis str. MC2 155
MVNRYKVAVIAGDGIGREVVPEGLRVLQAASERFGFTLDLEEFDYANVDYYLKHGQMMPDDWFEQLRGFDAIFFGAVGWPELVPDHISLWGSLIQFRRHFDQYVNLRPVRLLPGIAGPLAGRKPGDIDFYVVRENTEGEYSSIGGKIFEDTPRETVIQDTVMTRVGVDRILRYAFELAQRRPRRLLTSATKSNGISISMPYWDERVEQMSTMFPDVSVNKFHIDILAANFVLHPDWFDVVVASNLFGDILSDLGPACTGTIGVAPSANINPERTFPSLFEPVHGSAPDIAGQGVANPVGQIWCASMMLEHLGERTAAKAVLDAIEAVLADGAVLTPDLGGTATTTALGTAIADSVGASASASAGTR

SEQ ID NO: 35954 - protein, 444 aa, Neisseria meningitidis MC58
MTDLNTLFANLKQRNPNQEPFHQAVEEVFMSLDPFLAKNPKYTQQSLLERIVEPERVVMFRVTWQDDKGQVQVNRGYRVQMSSAIGPYKGGLRFHPTVDLGVLKFLAFEQVFKNALTTLPMGGGKGGSDFDPKGKSDAEVMRFCQAFMTELYRHIGADTDVPAGDIGVGGREIGYLFGQYKKIRNEFSSVLTGKGLEWGGSLIRPEATGYGCVYFAQAMLQTRNDSFEGKRVLISGSGNVAQYAAEKAIQLGAKVLTVSDSNGFVLFPDSGMTEAQLAALIELKEVRRERVATYAKEQGLQYFEKQKPWGVAAEIALPCATQNELDEEAAKTLLANGCYVVAEGANMPSTLGAVEQFIKAGILYAPGKASNAGGVATSGLEMSQNAIRLSWTREEVDQRLFGIMQSIHESCLKYGKVGDTVNYVNGANIAGFVKVADAMLAQGF

SEQ ID NO: 35955 - protein, 92 aa, Arabidopsis lyrata subsp. petraea
LSESVPFFREIVTGAFEKFIKVTMKLPLTGQQYSEKVTENCVAIWKSLGIYTDCEAKAVEKFLEIFKEETFPPGSSILFALSPTGSLTVAFS

SEQ ID NO: 35956 - protein, 496 aa, Burkholderia sp. 383
MNRDTTDAARTPRLLRHYIDGAFVETARTFADTSPVDGREIARVCEADEASVDAAVRAARAAQAAGWRDTTPAQRADWLHRIADGIQARFDDFVAAEVADTGRPLAQARTLDIARGIANFRTFADLVRTAGDDCFESQTADGAQYLNYVTRKPLGVVGIISPWNLPLLLFTWKVAPALAMGNCVVAKPSEETPGSATLLAEVIDAVGLPRGVFNLVHGHGPAAAGEFLTRHPGIDAITFTGESRTGSAIMKAVADGVKDISFELGGKNAAVVFADADFDAAVDGIVKSSFTNAGQVCLCSERVYVERPIFERFVAALKTRTEALQVGAPDDPATTMGPLISRGHRDKVLSYFRLAVDEGATVVTGGGVPAFGDARDDGAFVQPTIWTGLPDTARCVTEEIFGPVCHVAPFDSEDEVIRRVNDSAYGLAASVWTTHLARGHRVAKRIETGIVWLNAWFVRDLRTPFGGTKLSGIGREGGRHSLDFYSETTNVCVRVA

SEQ ID NO: 35957 - protein, 408 aa, Brucella suis 1330
MTPFVKSVAQAEKAMRALFCETPLQRNDYLSRKYGAQIWLKREDLTPVRSYKLRGAFNFISKAVETTDKNAVFVCASAGNHAQGFAFVCRHFGRKGVVFMPVTTPQQKIDKTRTFGGEFIEIKLVGDIFDVCYAASQEFAAANKGVMVPPFDHPGIVEGQATVALEIERQLPDDSKSDLVLLPVGGGGLSSGVTQYIADLGWKTAFRFVEPQGAASLKASLEAGKRVKLSHIDNFVDGAAVAEIRKENFKLLKGFDPKTVITVPENRLCATIVEMLNIEGVVLEPAGALGIDALKDFKKSDIKGKRIVIVVSGGNFDFERLPDVRERALRFEGLKKYFIFRFPQRPGALRSFLDLLGPDDDIARFEYLKKSARNFGSVLIGIETRDAANFKLLEKKFAESGWASGYQR

SEQ ID NO: 35958 - protein, 392 aa, Nostoc punctiforme PCC 73102
MKALCWHGANDVRVDTVPDPKIINPRDAIVKITSTAICGSDLHLYDGYIPTMEKGDILGHEFMGEVVELGSAVKNVKIGDRVVVPFTISCGSCFFCQKDLWSLCDNSNPNAWIAEKLMGHSPSGLFGYSHMMGGYAGGQAEYARVPFADVGLFKIPDGLTDEQVLFLTDIFPTGYMAAENCDIQPGDTVAIWGCGPVGQFAIRSAYMLGAERVIAIDRVPERLQMAKDGKAEVLNYEEVEVGEALKDMTGGRGPDACMDAVGMEAHGTGPDAFYDQVKQAVRMETDRPTALRQVIVACRKGGTVSIPGVYGGFVDKIPMGAAMNKALTFKMGQTHVHKYLRPLLDRVQNGDIDPSFVITHRLPLEQAPHGYEIFKHKKDNCIKIVLKPGQAA

SEQ ID NO: 35959 - protein, 356 aa, Mycobacterium smegmatis str. MC2 155
MIELGVLRGDGIGPEIVSATTQVVERALDAAAVGVRWVPLPFGRQAIDEFGTPVPDVTLERLDGLTGWIIGPHDNAGYPEQFRGTLSPGGVIRKRYNLFANIRPARALSKSVRAVCPDIDVVIVRENTEGFYADRNMYDGAGEFMPTADVALAVAVFTRAAIERIAHEAFRIAATRRRSVTIAHKTNVLTRTTGLFRDTCMAVADQYPDVEVRGEHVDALAALLVSRPTQFDVIVAENMFGDILSDLTGQLSGSLGMAPSLNASDSKAMAQASHGAAPDIAGRDVANPVAMMLSAAMLLRWLGERAGSGRALVGAADAVEHAVRRTLDAGLSTPDVGGSAGTREFTDGVLTALRPT

SEQ ID NO: 35960 - protein, 345 aa, Streptococcus thermophilus LMG 18311
MKSAVYTKAGQVGLAEIDRPQIVAADDAIIKIVRTCVCGSDLWSYRNPEMEEGHRNSGHEAIGIVEEVGEQVTTVKPGDFVIAPFTHGCGQCDACRAGFDGSCDNHSGNNWSEGVQAEYIRFHFANWALVKILGQPSDYSEGMLKSLLTLADVMPTGYHAARVANVQKGDKVVVIGDGAVGQCAVIASKMRGASQIVLMSRHEDRQKMALESGATAVVAERGEKGIDKVREVLGGGADAALECVGTEAAVEQALGVLHNGGRMGFVGVPHYNNRSLGSTFAQNILVAGGVASVTTYDKQVLLKAVLDGDINPGRVFTTSYKLEDINQAYKDMDERKSIKSMIVLD

SEQ ID NO: 35961 - protein, 424 aa, Bacillus cereus ATCC 10987
MIEIKVPELAESITEGTISQWLINVGDKVEKGGSVVELETDKVNVEIIAEDSGIVSKLLGEPGDTVEVGATIAILDANGAPVAVSTPAPAAEQPKQETAEAPKAEAPKAAAPSAEQTATLQGLPNTNRPIASPAARKMARELGIDLNDVRSTDPLGRVRPHDVQAHAAAPKEAPAAPKSPAPAPVAKTEFEKPVERVKMSRRRQTIAKRLVEVQQTSAMLTTFNEVDMTAIMELRKERKDAFEKKHDVRLGFMSFFTKAVVAALKQFPLLNAEIQGDELIIKKFYDIGIAVAAPDGLVVPVVRDANQLNFAEIESEIRELGKKARDNKLSLKELQGGTFTITNGGVFGSLMSTPILNSPQVGILGMHKIQVRPVAIDAERMENRPMMYIALSYDHRIVDGKEAVSFLVAVKDMLEDPKSLLLEG

SEQ ID NO: 35962 - protein, 482 aa, Saccharomyces cerevisiae YJM789
MADKIERHTFKVFNQDFSVDKRFQLIKEIGHGAYGIVCSARFAEAAEDTTVAIKKVTNVFSKTLLCKRSLRELKLLRHFRGHKNITCLYDMDIVFYPDGSINGLYLYEELMECDMHQIIKSGQPLTDAHYQSFTYQILCGLKYIHSADVLHRDLKPGNLLVNADCQLKICDFGLARGYSENPVENSQFLTEYVATRWYRAPEIMLSYQGYTKAIDVWSAGCILAEFLGGKPIFKGKDYVNQLNQILQVLGTPPDETLRRIGSKNVQDYIHQLGFIPKVPFVNLYPNANSQALDLLEQMLAFDPQKRITVDEALEHPYLSIWHDPADEPVCSEKFEFSFESVNDMEDLKQMVIQEVQDFRLFVRQPLLEEQRQLQLQQQQQQQQQQQQQQPSDVDNGNAAASEENYPKQMATSNSVAPQQESFGIHSQNLPRHDADFPPRPQESMMEMRPATGNTADIPPQNDNGTLLDLEKELEFGLDRKYF

SEQ ID NO: 35963 - protein, 461 aa, Rhizobium leguminosarum bv. viciae 3841
MSSYDYDLFVIGGGSGGVRGARVAASLGKKVAIAEEYRYGGTCVIRGCVPKKLFVYASQFHEHFEDAAGFGWTVGESSFDWKKLVAAKDVEIARLEGLYKKGLAGANAEILETRAELVDAHTVRLLKTGRTVTAKTIVIATGGRPNPHAALPGHELCISSNEAFHLEELPKSMVISGGGYIAVEFANIFHGLGVETTLIYRGAEILSRFDEDLRRGLHEAMVAKGIRILCHDTLQKVSKGEDGLVLETLNNGTLQAGVVMLALGRDPNTEGLGLEAAGVAVDERGAVIVDEYSRTNVENIYALGDVTNRVQLTPVAIHEAMCFIETEYKNNPTRPDYELIPTAVFSQPEIGTVGLSEEDAGKRYSELEVYRAQFRPLKATLSGRAERMIMKLIVDAASRKVVGAHILGHDAGEMAQLLGITLKAGCTKDDFDRTMALHPTAAEEFVTMYAPSYRIRDGKRI

SEQ ID NO: 35964 - protein, 192 aa, Populus trichocarpa
MACTIDFRRLDEGFGGKTYKRKREEEALQLTATTDASMEIDAPAAKRTAIPSSDNPDKPVAVGKPTYDGVMAGKVSGRKWKQPRKQRASAKQVSKRGTRYEERDREKEIKKAYRERKNELKEEIRKNKVEKRKMREEREKRKQDNILKSGTKLQKITNPKTLKKIAKSKDRKLLKVVPDDLVNKKRKNSNED

SEQ ID NO: 35965 - protein, 649 aa, Oryza sativa Japonica Group
MPLGQRAGDKSESRYCGVEVLDFPAGEELPAVLSHSLSSSFDFLLAPLVDPDYRPTPGSVLPVAASDLVLGPAQWSSHIVGKISEWIDLDAEDEQLRLDSEITLKQEIAWASHLSLQACVLPPPKRSSCANYARVVNHILQGLTNLQLWLRIPLEKSEPMDEDHDGAKDNSDMSDTVDSWEWWNSFRLLCEHSSQLCVALDVLSTLPSMNSLGRWFGEPVRAAILQTNAFLTNARGYPCLSKRHQKLLTGFFNHSVQVIISGRSNHNVSQGGVLSGDENHTEDTAVRHALSPYLDYIAYIYQRMDPLPEQERFEINYRDFLQSPLQPLMDNLEAQTYETFEKDTVKYTQYQRAIAKALVDRVSDDDVSTTKTVLMVVGAGRGPLVRASLQAAEETGRKLKVYAVEKNPNAVITLHSLIKLEGWESLVTIISSDMRCWEAPEKADILVSELLGSFGDNELSPECLDGAQRFLKPDGISIPSSYTSFIEPITASKLHNDIKAHKDIAHFETAYVVKLHRIARLAPTQSVFTFDHPNPSPNASNQRYTKLKFEIPQETGSCLVHGFAGYFDAVLYKDVHLGIEPNTATPNMFSWFPIFFPLRKPIYVPSKTPIEVHFWRCCGATKVWYEWAVTAPSPSPIHNSNGRSYWVGL

SEQ ID NO: 35966 - protein, 464 aa, Novosphingobium aromaticivorans DSM 12444
MASIAPDSRTDLHTERANPHWVRLGGDHKLDHVPGEDGWPVLGTTLMQLADPLGFQRRMVETHGPVFRTRSFGRRGVNLIGADANELVLFDRDRLFSNEQGWGPVLNLLFPRGLMLMDFEAHRVDRRALSIAFKPEPMRAYCSVLNTGIAQAVQGWGGQMRFYDAIKALTLDTAASSFLGLPLGPEADRLNKAFVDMVQASGGVVRRPLPFTRMGKGVAGRRLMVEYFGRLVRERRADPGQDMFSQFALATREDGSLLPEDVVVDHMIFLMMAAHDTITSSATVLFWQLARNPDWQDRLRAEARAVTGGDGLPLAYEDLGRMELTEMAFKEALRFMPPVPNMPRRALRDFEFGGYRIPAGTPVGISPAAVHADPAHWPEPDRFDPLRFTPENVSGRHKYAWVPFGGGAHMCLGLHFAYMQVKLLVSHILTRYEVAMQPGPAPSWQAWPIPKPRDGLRVEMRRIC

SEQ ID NO: 35967 - protein, 232 aa, Rhizobium leguminosarum bv. viciae 3841
MDAREMKIKAAEAALAHVESGMRLGIGTGSTAEEFVRLLAEKVAGGFRVEGVPTSERTARLCVELGVPLKSLDELPALDLTIDGADEVDQALRLIKGGGGALLREKIVAAASERMIVIADESKLVETLGAFALPIEVNPFGLVSTRIAIEKVAARLGLSGELDLRQSGDGEFTTDGGHHIIDASFGRIPDAEALSSELNSIPGVVEHGLFINMAALAIIAGPAGARTLQANR

SEQ ID NO: 35968 - protein, 397 aa, Mesorhizobium loti MAFF303099
MNIHEYQGKALLKSFGAPVAEGVPVFKASEAEAAARALPGPLYVVKSQIHAGGRGKGKFKELSPDAKGGVRLAKSVADVVANANEMLGHTLVTKQTGPAGKQVNRLYIEDGADIERELYLSILVDRSVGRIAFVVSTEGGMDIEAVAHDTPEKVITVAIDPERGVTADDVKKLNAALKLDGDAAKDGGTLFPILYKAFIEKDMSLLEVNPLIVMKNGRLRVLDAKVSFDNNALFRHPDVLELRDTTEEDEKEIEASKYDLAYVALDGNIGCMVNGAGLAMATMDIIKLYGAEPANFLDVGGGASKEKVTAAFKIITKDPAVKGILINIFGGIMKCDIIAEGVIAAVKEVGLEVPLVVRLEGTNAELGKKIINDSGLNVVSADDLDDAAKKIVAAVKG

SEQ ID NO: 35969 - protein, 397 aa, Rhodopirellula baltica SH 1
MHRFDSISVAPPDAILGLTEAFKADERETKMNLSVGVYQDASGTTPVLRCVKEAEKRLLDTESTKGYLSIDGLPDYREAARRLIFSDQIAAERVAAVQTPGGTGALRVAAEFLATQCGPLRIFLPTPTWANHNAIMAAAGLPVETYSYLASDKKTLDFDALIEDLKTKPKAGDAVLLHACCHNPTGVDPTPEQWEQIASVVSEKKLIPLLDFAYQGFGEGLDEDAIGVRTILRQMDEAIVCSSFSKNFGLYSERVGTACLVSGSAETTKAALSQLKRVVRANYSNPPRHGGAIVATVLADEGLTQMWHEELAEMRTRIASLRKQFVDGMAATGVDQDFSFLLDQKGMFSFSGLSPMQVDQLRSEHGVYLVGSGRINVAGMNESKMEWLCNAVAAVLR

SEQ ID NO: 35970 - protein, 527 aa, Zea mays
MAFPAVPLLAALLLVAATRLWDYVFVRLVWRPYAITKGFREQGIHGPSYRFFKGCNEEIRSMKEKTDGLVLDVGDHKYLPRIAPHYLEWRAQYGEPFLYWYGAQARICIFDYELARQILSSKSGHFVKNDAHPTLLALVGKGLGFMEGSDWVRHRRVINPAFTIDKLKIVTETMLDFADSMAGELEAEASQNENGETQVDIYKHFSDLTVDNIAYAIFGSSYKLGKQVFEAQTELLGITMATFLDVPIPGSKYLPTQANRRKWMLETKLKSLLTRIIQPRLASGEHGNDLLGVMLDSCTETKQGGKQQQVDRLRLSLSMEEIIHECKLFFFAGHENTALLLTWSVYLLSIYPEWQERLRKEVLREFGRDAPNPNALNRLKEMTMVLFETLRLYSPALFMQRKTLADMTVGPIKLPKGTAIVIPIPIMHRDKQAWGDDADEFSPMRFANGITGAAKVPHGLLAFSMGPRSCIGQNLSMLEAKSTLALMLRKFSFALSPDYVHAPVDLFTLKPKFGLPVILRPLDNVLI

SEQ ID NO: 35971 - protein, 597 aa, Oryza sativa Japonica Group
MALWWPLLVLAAAYALCRILLFLIPPTVPSIDVDASDVLEDANQNKEDSYIYIPPRKGKGAQTDKVQCYEPATMKYLGYFPALTPDEVKEHVAQARKAQKIWAKSSFKQRRQFLRILLKYILEHQDLICEISSRDTGKTMVDASLGEIMTTCEKITWLLDEGEKWLKPEYRSCGRSMLHKKAKVEFYPLGVIGAIVSWNYPFHNVFNPMLAAIFSGNAAVIKVSEHASWSGCFYFRIIQAALAAVGAPDNLVHIITGFAETGQALVSSVDKIIFVGSPGVGRMIMNRASDTLIPVTLELGGKDAFIVCEDVDLPSVVQVAVRAALQSSGQNCAGAERFYVHKDIYSTFVSQVVKIIKSISVGPPLSGRYDMGAICMIEHSEKLQNLVNDAVDKGAEIAGRGSFGHLGEDAVDQFFPPTVLVNVNHTMKIMQEEAFGPILPIMKFNSDEEVVKLANDSKYGLGCAVFSGNQKRAIKIASQLHCGVAAINDFASSYMCQSLPFGGVKDSGFGRFAGVEGLRACCLVKAVVEDRWWPYVKTMIPKPIQYPVSENGFEFQELLVETLYGLSVWDRLRSLVNLLKMISEQNNSPANTRKKSR

SEQ ID NO: 35972 - protein, 164 aa, Brassica napus
MMLRQAAKKALGLTSRQSTPWSVGISRSYHENVIDHYDNPRNVGSFDKNDTSIGTGLVGAPACGDVMKLQIKVDEKTGQIVDARFKTFGCGSAIASSSVATEWVKGKAMEEVLTIKNTEIAKHLSLPPVKLHCSMLAEDAIKAAVKDYKEKRLKTNGAGETSQA

SEQ ID NO: 35973 - protein, 535 aa, Brucella suis 1330
MGRLIFIGFPGLGLVASHLPHRNGPAEEGTRNQFGHDSASRQRVFRRPVVIIKWNYVRQVALARRFKADRECAVPLKEIELTKENTGGFAALGITGVLLKGVEAAGMTEPKPIQTQAIPSQLEGQDILGIAQTGSGKTAAFSLPILQKIIGLGDKRRPKTARALILAPTRELAVQIEQTIRNVSKSAHISTALVLGGVSKLSQIKRIAPGIDVLIATPGRLTDLMCDGLVDLSQTRWLVLDEADRMLDMGFINDVKRIAKATHAERQTALFSATMPKEIASLAERLLRDPVRVEVAPQGTTASEITQVVHPVPTKEKRRLLSAMLTDADMRSVIVFTRTKHGADAVVRHLERDRYDVAAIHGNKSQNARQRALNGFRDGTLRILVATDIAARGIDVPGISHVVNYDLPDEPETYVHRIGRTGRNGASGASITLYDPATEESKLRAVERVTRSKLSIKDAPVKLAPAPVAKGPAPQGQRTEQAESRKAPAHKHRRPAQKAGEQHRAGAHASAGEAAPKPKRPFRRKRRSNGGQRAA

SEQ ID NO: 35974 - protein, 342 aa, Brucella suis 1330
MFNSVLDTIGNTPLIRLSKASELTGCDIYGKAEFLNPGQSVKDRAALYIIRDAEKRGLLRPGGVIVEGTAGNTGIGLTMVAKALGYRTAIVIPETQSQEKKDALRLLGAELIEVPAAPYRNPNNYVRLSGRLAEQLAKTEPNGAIWANQFDNTVNRQAHIETTAQEIWRDTNDQIDGFVAAVGSGGTLAGTAIGLKERNHNIKIALADPHGAALHAFYTTGELKAEGDSITEGIGQGRITANLEGFTPDFSYQIPDAEALDILFALVEEEGLCLGGSSGINIAGAIRLAKDLGPGHTIVTVLCDYGNRYQSKLFNPAFLRGKSLPVPRWLEKKTEIDIPFEG

SEQ ID NO: 35975 - protein, 310 aa, Pyrococcus horikoshii OT3
MNLVFGMIASIGELLIDLISVEEGDLKDVRLFEKHPGGAPANVAVGVSRLGVKSSLISKVGNDPFGEYLIEELSKENVDTRGIVKDEKKHTGIVFVQLKGASPSFLLYDDVAYFNMTLNDINWDIVEEAKIVNFGSVILARNPSRETVMKVIKKIKGSSLIAFDVNLRLDLWRGQEEEMIKVLEESIKLADIVKASEEEVLYLENQGVEVKGSMLTAITLGPKGCRLIKNETVVDVPSYNVNPLDTTGAGDAFMAALLVGILKLKGLDLLKLGKFANLVAALSTQKRGAWSTPRKDELLKYKEAREVLAP

SEQ ID NO: 35976 - protein, 85 aa, Physcomitrella patens subsp. patens
KVVCAVGDVSAEGTNYLVAGAIAIALVGSAFPILFSRKDLCPVCDGAGFVRETGSALNANAARKDQAQIVCKNCNGLGKVGQVDK

SEQ ID NO: 35977 - protein, 820 aa, Zea mays
MDLSRLASVAGPSRAAPRAGLQIGAAGNGFRVCSLRHRGAGNGRLTSAAALLRGSSGLFYLAPARGGPPRLRARGRPRCQGSYQLAHSRTPPSRPPGSGEVYDDDATSSGPDDDDNDKGPADVDGLREMLQRCRNELEVARLNSTMFEEKAQRISESAIALKDRAEGAQRDVSAAVATVQEVIVKEADAKEAVQKATMALSMAEARLQLASEALDAKRGSVGPMEVSIEGVEEEALVSAQEEIKDCRAALLRCEEELERIQEQKMNLQKEVDRLTELAEKAQLDASKAEEDVTNIMVLAEQAVALEMKATQRVNDAEAVLLKAEKVISSVDTVVELTSLAEEQKSAEEDSVSEGYEYSSNGTDDVPVRDEVSSIERLMVGDLTVEGIEQLEPSREIYDEASSDKMSVEPQKEAEPDSDKLKQGKKQEMERKEFTKEPLSAQKSLKKRSSRFFPASFFSSKADGEFTPTSVFRGLMKSVQKQAPKLVVGILLLGAGAFFLNRAEKSQLFQQQEIATSIGKVTSTTKPIVREIRQIPQRVKKLIELLPHQEVNEEEASLFDILYLLLASVIFVPLFQKIPGGSPVLGYLAAGVLIGPYGLSIIRNVHGTKAIAEFGVVFLLFNIGLELSVERLSSMKKYVFGLGSAQVLATTAAVGVIAHRFAVLPGPAAIVVGSGLALSSTAVVLQVLQERGESTSRHGRATFSVLLFQVGFQAIAEAMGMAAVKAVAAITAIIAGGRLLLRPIYKQIAENQNAEIFSANTLLVIFGTSLLTARAGLSMALGAFLAGLLLAETEFSLQVESDIAPYRGLLLGLFFMTMEPF

SEQ ID NO: 35978 - protein, 490 aa, Xanthomonas campestris pv. vesicatoria str. 85-10
MPRFSDQLLYIGGRYVPARGGHTFEVVNPATGEVLANVHNAGADDLDAAVDSAQAGQRQWAALTTVERSRILLRAVALLRERNDALAELETLNTGKPLSETRSVDVVTGADVLEYYAGVAQALQGAQVPLREGSFFYTRHEPLGVVGAIGAWNYPIQIALWKAAPALAAGNAMIFKPSEVTPLTALKLAEIFTEAGLPDGVFNVLPGDGASVGTALTEHPQIEKISFTGGTATGRKVMASASSSSLKEVTMELGGKSPLIVCADADLDLAADIAMMANFYSSGQVCTNGTRVFVPRALRHAFEARLLARVQRIHIGDPLDERTTFGPLVSAAHMQRVLEHIEQGKAEGARLLCGGERLQDGALAQGYYVAPTIFSDCTDVMTIVREEIFGPVLSLLTYDDEDEAVTRANATTYGLAAGVVTPDLARAHRLIHRLEAGICWVNTWGESPAPMPVGGYKQSGVGRENGLATLQAYTRTKSVQIELERYASVF

SEQ ID NO: 35979 - protein, 564 aa, Burkholderia thailandensis E264
MTPAGTRVARLAGPAAFVRPSSGAPGAGAPNPNQRRGAGRSRRRPRTKRRRAHAPARVPKRRRLGRAASALAALHPALSLSQTRRFMHRATKIVATIGPASSSPEVLLQMMHAGLDVVRLNFSHGSADDHRERAEMVREAARRVGREIAIMADLQGPKIRVGKFEAGKTTLTPGQPFILDATCELGNDERVGLDYKDLPRDLKPGDVLLLNDGLIVLKVDRVFGDEIHTTVKVGGDLSNNKGINRQGGGLSAPALTAKDMEDIRTAMSLGADLVAVSFPKNATDMEMARQLANIAGAPYGIKPKMIAKIERAEAIPALQEILDASDGIMVARGDLAVEVGNAAVPALQKRMIRMARESNKLVITATQMMESMIHAPVPTRAEVSDVANAVLDGTDAVMLSAETATGKYPAVTIEAMAAICVEAEKSEHVELDKDFLDRTFTRIDQSIAMGALFTAYHLGAKAIVALTESGATALWMSRHYTHVPIFALTPRVGSERAMALFRNVTPLHVDFDSDRDSALQQALELIVRRGYVAHGDMVVLTVGEPMGQAGGTNTLKIVRVGEHY

SEQ ID NO: 35980 - protein, 200 aa, Zea mays
RTRGAWSFGGMIFALVYCTAGISGGHINPAVTFGLFLARKLSLTRAIFYIIMQCLGAICGAGVVKGFQQGLYMGNGGGANVVAPGYTKGDGLGAEIVGTFILVYTVFSATDAKRNARDSHVPILAPLPIGFAVFLVHLATIPITGTGINPARSLGAAIIYNRDHAWSDHWIFWVGPFIGAALAAIYHQVIIRAIPFKSRS

SEQ ID NO: 35981 - protein, 204 aa, Triticum aestivum
  misc_feature (44)..(44): Xaa can be any naturally occurring amino acid
MLPPAMAAGLACSRPRLKQGVRTSGRVRLLLHRGPPCFPGFGRXNGGPRRKSVRGSIVSQDLSVINLVIVKKGENDLPGLTDTEKPRMRGPKRASKIKKLFNLGKDDDVRSYVNTYRRTFLNKKGKKVSKAPKIQRLVTPLTLQRKRARIADKKKRIAKKKSEAAEYQKLLAQRLKEQRDRRSESMAKRRSKLSAATKAPAASA

SEQ ID NO: 35982 - protein, 182 aa, Zea mays
  misc_feature (48)..(48): Xaa can be any naturally occurring amino acid
MGEECVEVFGVKTFCWAFPSTNIQSLSIPSPIQIPPIPSHRQIPPTPXCNCGRPLSPLSTLSHLSILWHPTPSHPLLGGYYYFPPPRTRVVGAPPSPFVVPGPPPLGGSPPILFFGPGPPGTPFIPAPFPPIPGTWVFGGTPPPLIWGFLGGGGTFGGAFGPVSFPSTFPGFVPPMTFFRAI

SEQ ID NO: 35983 - protein, 221 aa, Xanthomonas campestris pv. vesicatoria str. 85-10
MQQNCRARTCDPRRMSLLIEQARYHLSAHNARQLPDDGGYEVAFAGRSNAGKSSALNALTRQNALARVSKTPGRTQQLVFFQIQPERYLVDLPGYGYAKVPQDLQAHWQAFIDRYFRTREALRGLVVVMDIRHPLKDYDLQMLGYAAERGLPAHGLLTKADKLGRGQQMQTLQKVKKEVTSRFGDSVTVQTYSGESRQGVDELRAIVGAWLGLDVETTAAE

SEQ ID NO: 35984 - protein, 306 aa, Zea mays
MAMQAARRLASLKLQRRLLLPSQAESPSISIPTAAAAAAFLHSHATSFGYKQQVREEDKSKLVGNVFSSVASSYDLMNDLMSVGLHRLWKDRLISKLNPFSGMKHLDVAGGTGDVAFRVLERVKSVGHRAMQGTLTETEEGTHIYVCDINPNMLNVGKKRAAERGYSEEHCLSWIQGDAEALSFEDGSMDGYTIAFGIRNVTHIEKALSEAYRVLKQGGRFLCLELSHVDVPIFKEIYDVYSFSMVPAIGELVAGDRQSYQYLVESIRRFPNQEKFAQMIQEAGFQRVEYENLVGGVVAIHSGLKL

SEQ ID NO: 35985 - protein, 329 aa, Chromobacterium violaceum ATCC 12472
MPDEGAPHAATWMAFGPSLSVWGARLLPEVRRDLARVASAIAAFEPVRMLARENELDLAGRLCGSGVELVAQPLDDLWIRDSGPVFVKTGAGGMAAVDFNFNGWGGKQAHGRDARVAGFVAGRAGALPLRSGLVLEGGGIEVDGEGTAIITESCVLNANRNPGWSKAQCEGELRRVLGVEKVIWLPGVAGRDITDGHTDFYARFARPGVVVAGLETDPASYDYQVTRRHLAMLRQARDARGRKLEVVAIPGPDRVRPEYEDDEMAAGYINFYVCNGAVIALEFGDARADRNARSALRELFPEREVVQLNIDAIAAGGGGIHCATQQQPA

SEQ ID NO: 35986 - protein, 641 aa, Vitis vinifera
MAMPSGNVVISDKMQFPGGGGRGGGGGAAEIHHHRQWFPDERDGFISWLRGEFAAANAIIDSLCNHLRLIGEPGEYDAVIGCIQQRRYNWSSVLHMQQYFSVAEVIYALQQVGWRRQQRHLDPVKGAGKEYKRYGVAYRQGQRGETAKDSHNSNFENHSHDANSSGTLEKGERVSEIYDDVKGGDKGDVVGKLEDKDLAAAEEKKGKRAVSPSRYPRGSSRKPNPTTSPKTFVGTEIFDGKAVNVVDGLKLYEELFDDSEVSKFVSLVNDLRAAGKRGQLQGQTFVVSKRPMKGHGREMIQLGVPIADAPLEDESVVGTSKGMFHKSIPSLLQDVIGHLVGSQVLTVKPDACIIDFYNEGDHSQPHIWPTWFGRPVCILFLTECDMTFGRVIGADHPGDYRGSLKLSLVPGSLLVMQGKSADFAKHAIPSLRKQRILVTFTKSQPKKTMATQSSHWVPPPSRSPNHMRHPMGPKHYGAVPTTGVLPAPAPPMRPQLPPPNGMQPLFVTTAVAPAMPFPAPVPLPTGSPGWPAAPPRHPPPRLPVPGTGVFLPPPGSGNSSSPQHISTEATSTSVETAAPTEKENGSGKSSSNSNTVSPKGKLDGKVHRQECNGSMDETAVTKEEQQHNDELKVASKPAGAV

SEQ ID NO: 35987 - protein, 593 aa, Vitis vinifera
MSKQTYRVCFCFRRRFRLTVSEAPQEIKELFDRYSENGMMSIDHLQRFLIEVQQEEKATVEDAQAILDSLHEFKHLNIFHRKALNLEAFFKYLFGDINPPLSTALGVHHDMTAPLSHYFVYTGHNSYLTGNQLSSDCSDVPIIHALQRGVRVIELDIWPNSTKDNVDVLHGRTLTTPVELIKCLKSIKEHAFSASEYPVVITLEDHLTPDLQAKVAEMVTQTFGDILFTPGPECLNEFPSPESLKKRIIISTKPPKEYLEAKDVKEKENDSQKGKESADEEAWGKEVSNLKPSTVAVDESNLEEEENIDEEDLDEGDPKSQQNAAPEYKRLIAIHAGKVKGGLTEWLRVDPDKVRRLSLSEQELEKAVLTHGKEIVRFTQRNLLRVYPKGIRFDSSNYNPVIGWMHGAQMVAFNMQGYGRSLWIMHGMFKANGGCGYVKKPDFLLNNGSHDGVFDPKAKLPVKTTLKVTVYMGEGWYFDFRHTHFDAYSPPDFYARVGIAGVPADTIMKKTKTLEDNWTPNWDEHFEFPLTVPELALLRVEVHEYDMSEKDDFGGQTCLPVSELRRGIRAVPLFSRKGDKYPSVKLLMRFEFV

SEQ ID NO: 35988 - protein, 273 aa, Pseudomonas syringae pv. phaseolicola 1448A
MSVQQRNNVNIVGDGPATLIFAHGFGCDQHMWRFMAPHFAERFKVILFDLVGSGDSDVSAWYPHKYASLKGYASDLLELVDEFAGDGPIVHVGHSVSCMIAVLAELQSPGRFDGHIMVGPSPHYLNDGDYVGGFTRADIDSLLETLESNYLGWSSTMAPTLMGASDRPELGEELASSFCRTNAEIARQFARVTFLSDHRADVAKLKSKTLIMQSSDDLVVPVQVGEYLHRVIADSTLHMIDNVGHYPHMSAPQECITAMNQFLASYESAAHDG

SEQ ID NO: 35989 - protein, 160 aa, Zea mays
KFLPGFFAQGIPPQNPFKVLDQKGVGQLVKFSPKRGPKNRPNFKGGLFGKPGGKPSPLAFFPKGGGGYVSCPPFRGPIFRPTPTPGVVLGCPPLGNPNAPRWGRGGPPGFFQNPALWTFLGTGVKKSPIPWPFFSPAWKTSQLAPGLKTCFSKPPPFSVF

SEQ ID NO: 35990 - protein, 636 aa, Glycine max
MADLVSYRNADRDIDQALIALRLEAQLLKYGRKGKPKFCPFRLSHDESSLIWITSSGERNLKLSSVSRIIPGQRTAVFQRYLRPEKDYLSFSLIYSNGKRSLDLICRDKVEAEVWIAGLKALIASGQGGRSKIDGWSDGGLILNDSRDLTSNNPSVSLASTSRGICSPDISVTLPNTSPKSFRSDNTISERSHAPPDPTNMQVKGSASDVFRVSVSSAPSTSSHGSAPDDCDALGDVYIWGEVTCENVKVGADKNVNYVSPRADVLLPRPLESSVVLDVHHIACGVRHASLVTRQGEVFTWGEESGGCLGHGVGKNVVQPRLVEALTSTTVDFVACGEFHSCAVTMAGELYTWGDGTHNAGLLGHGSDVSHWIPKRIAGPLEGLQIAFVACGPWHTALVTSTGQLFTFGDGTFGVLGHGDRQNVSYPREVESLLGLRTIAVACGVWHTAAVVEVIATHSSTSISSGKLFTWGDGDKNRLGHGDKEARLKPTCVAALIDSNFHKIACGHSLTAGLTKSGRVFTMGSTVYGQLGNPQSDGKVPCLVGDKIARESIEEIACGAYHVAVLTSKNEVYTWGKGANGRLGHGDIEDRKTPALVEALKDRHVKYIACGSNYSAAICLHKWVSGAEQSQDRHVN

SEQ ID NO: 35991 - protein, 501 aa, Ashbya gossypii ATCC 10895
MSTTGLLKYDAEARKARFAVGKKGKWLHLFSILAAGFALISDGYQNNVMSMLNRVFRNQYGEIEYSADVSTRVSNASLIGTIIGQVGMGFACDYMGRKWGILVATILLVLGSVLCAVAYGKTTSALFMMLTVTRWVVGCGIGAEYPSSSVAANEAANEYSERRRGGIMVMVTNLPLSLGGPFATAIFLVVYKILGSQRLVAVWRTMFALGCIWPISVFYFRWRLASNELFESGRMRSNVPVWLIIKYCWRSMIGTCGAWFLYDFVTFPNGIFSGTIIASVIGDSEDLIKIAEWNLLLGVLAVPGVILGALLCDRIGRKYTLVFGFTGYIIFGLIIGCAYTRIMKIVPLFIIFYALMLSLANAGPGDMLGVVSSESFPTPVRGTCYGISAAIGKLGAVVGTQSFQPIRNRLGPSYTFIIAAICGILGVVVSWIFVPHLREHDLMENDIKFYNYLLANGWTGTPKYTRCDVLDNESSETDTAICLKEPITHADTSDGKKSPSK

SEQ ID NO: 35992 - protein, 575 aa, Blastopirellula marina DSM 3645
MSQPTLSKIENLKLDSRQLRGTLADELQNDRPDFSADAIQLLKYHGSYQQDDRDVRKQKNADGTKKEKAYSCLIRTAVPGGRVSAEQFLAELDLCDRLGNGSLRITTRQGFQLHGVLKSNLKETIRTINQIKLSTFAACGDVSRNVMCCPAPFKNNPVREQMQTLAQEIAVHFRPRSTSYYELWLTDDEGNKQDVADFQPVAEPIYGERYLPRKFKFGVAEPADNCIDVYTQDVGLLAIVEENEVIGYNVIVGGGMGNTPSADKTFPRLGDEVTFATPDQVIAVCGAIVKVQRDFGNREDRKRARLKYLLHDWGVAKFKSQVEAYYGAPLPEPKHAPVTGVDDHVGWHVQGDGKLFLGVNIENGRIVDVGDVRIKSGLRAILQRYGMPTRLTPLQSVILCDIDPADRRGVEALLGEYGLKSADELSLARRFAVACPALPTCGLAITESERVMPQLIDQIEPVLAQHGLEKSQISIRMTGCPNGCARPYVADIGLVGKSVGKYTIYLGGNPQGTRIGFVYQDATPLEEIPAQLSPLLASYQAEKSGDEAFGDYCARLGRETLLAKVGRAEAAILQN

SEQ ID NO: 35993 - protein, 574 aa, Oryza sativa Japonica Group
MPGQAAKPKGTGEQGGDAEVVSEERTPSDQHQGSPASTLDKELSGLSSESGILDDSLVAEEEDSGELKEIQNLDCNGNQEKKTSQKSSTSDSFASAKVSDGTNSLRKTSGSAKTSDRANFTESGKSSMCRASTSSDISDESSRSSMSSATTKPHKGNDSRWEAIQTVKTKDGILGLNHFRLLKKLGSGDIGSVYLSELSGTRSYFAMKVMDKASLASRKKLLRSQTELEILQSLDHPFLPTLYTHFETDKFSCLVMEFCPGGDLHTLRQRQPGKHFSEQAAKFYVAEVLLALEYLHMLGIIYRDLKPENVLVREDGHIMLSDFDLSLRCSVSPTVIKSANPGLDALQRNNAAYCVQPACIEPSCIQPSCVAPTTCFGPRFFKSKSKSKSKKEKSKPEAANQASLFPELIAEPTDARSMSFVGTHEYLAPEIIKGEGHGSAVDWWTFGIFLYELLFGKTPFKGSGNRATLFNVVGQPLRFPESPIVSFSARDMIRGLLVKDPQHRLGYKRGATEIKQHPFFEGVNWALIRCASPPDIPKPVELDCRPKQVPSTNGKVAPASNQKGSDNYLEFEFF

SEQ ID NO: 35994 - protein, 364 aa, Mesoplasma florum L1
MSLKVGIVGLPNVGKSTLFNAITNSNVEAANYPFATIEPNVGVVEVPDERLDKINEIFNSKKKIATTIEFVDIAGLIAGASKGEGLGNAFLANIRETDAICEVVRCFENKDITHVEGSVDPIRDIEIINLELMLSDEATIKKRIERITPKVRGGDKTLVAEMEVLKKAAECLDSNKLLNTLELNDEEDKILKGFQFLTAKTFIYVANVNDDELIEDNEYVKQVKEFALNNNASVVKICAKIEEDLSEATPEEKAEFLNDLGVKYSGLEQVIKAAYEALDLETYFTAGPQEARSWQYKKGWTAPQCAGVIHTDFERGFIKADIYNVQDLIELGDEKKVKESGKMRLEGKGYIMQDGDVCFFKFNV

SEQ ID NO: 35995 - protein, 335 aa, Brucella suis 1330
MTILVTGGAGYIGSHTCVQLIEAGHEVVVVDNFDNSHPEALHRIEKITGRAPRREPGDIRDRALMEQVIKRHKCTAVIHFAGLKAVGESSEKPLLYYDCNVLGTLRLLQAMEATGVKKLVFSSSATVYGDPDKLPITEDQPLSATNPYGRTKLVIEDMLRDLYNSDNSWAIAILRYFNPVGAHESGLIGEDPKGIPNNLMPIIAQVATGRREKLNIWGNDYPTPDGTGVRDYIHVNDLAAGHLKALKKLDKPKCFAVNLGTGQGYSVLDVIKAFEHVSNREIKYEIAPRRPGDVAECYADPGFAKKFLGWSAEKNLREMCQDMWNWQSKNPNGYE

SEQ ID NO: 35996 - protein, 325 aa, Bacillus sp. SG-1
MKAVLVTEFGGTEFIKVGSVRTPTIEDHEVLIKVAKTSVNFADIKSRYGNKGGAKLPFIPGLDAAGYIEKTGSGVTSLYEGQRVIAFPKAGSYAEYAVASKELVFPIPEEMDFNTAAACPVVSFLSHRLLYNVARIQKGETVLVHAAAGGVGTTAIQLAKLLGAGKVIGTVGNRDKRQFAKESGADSVICYEEEDFAQAVNSITNGKGADIILDSVAGSVTENSLNCLAPYGRLVHFGNSGGKAGKILTSELHSSCRSVLGFSLGTTRKLRPELLHETAKEVFPYLVRNQLKIKIQHEFSLEDAAKAHELMENRLNRGKIILNVE

SEQ ID NO: 35997 - protein, 205 aa, Mesoplasma florum L1
MKQKQKLNLPNWLTLIRLLLVPVVVMLVISNICDWDKSFIIGTDTSTFHITLTMLLAGIVFIVASFTDFLDGYLARKNNQVTEFGKFFDPIADKLLVNATLILFASSISIIPVWVTLVLILRDIFVDFIRMILSSKNITLSAGIFGKLKTVFQMIGLSILFFFSSFTLNIEVWQEQLILIPMYIAVAFSLYSGLDYFLKARKNLF

SEQ ID NO: 35998 - protein, 374 aa, Zea mays
HEGRLVARVALQSEDVELVAVNDPFITTDYMTYMFKYDTVHGHWKHSDITLKDSKTLLFGDKPVTVFGIRNPEEIPWGEAGAEYVVESTGVFTDKDKAAAHLKGGAKKVVISAPSKDAPMFVVGVNEDKYTSDVNIVSNASCTTNCLAPLAKVIHDNFGIVEGLMTTVHAITATQKTVDGPSAKDWRGGRAASFNIIPSSTGAAKAVGKVLPDLNGKLTGMSFRVPTVDVSAVDLTVRIEKGASYEDIKKAIKAASGGPPKGIMGYGKKDLVFTDFLGDTRWSIFAPKPGIVLNDPFVKFFSGNNNEGGSSNRVVAPIPPMFKPQWGFSPPPFNGRCLLGYPEKKWGGGGPWGPQVHPELGQFFHFCSPSGAPL

SEQ ID NO: 35999 - protein, 464 aa, Pseudomonas aeruginosa PAO1
MAVYNYDVVILGTGPAGEGAAMNASKYGRKLAVVDSRRVVGGNCTHLGTIPSKALRHSVKQIIEFNTNPMFRQIGEPRWFSFPDVLKSADRVISKQVASRTGYYARNRIDMFTGTASFVDERTVEVVTPSGAVERLVADQFVIATGSRPYRPSDINFNHPRVYDSDTILSLSHTPRRLIIYGAGVIGCEYASIFSGLGVLVDLIDTRDQLLSFLDDEISDALSYHLRNNNVLIRHNEEYERVEGLDNGVILHLKSGKKIKADALLWCNGRTGNTDKLGLENVGIKVNSRGQIEVDENYRTSVSNIFAAGDVIGWPSLASAAYDQGRSAAGNIVESDSWRFVNDVPTGIYTIPEISSIGKNESELTAAKIPYEVGKAFFKGMARAQISNEPVGMLKILFHRETLEILGVHCFGDQASEIVHIGQAIMNQPGELNTLKYFVNTTFNYPTMAEAYRVAAFDGLNRLF

SEQ ID NO: 36000 - protein, 252 aa, Streptococcus thermophilus LMG 18311
MSRKPFIAGNWKMNKNPEEAKAFVEAVASKLPSADLVEAGIAVPAVDLTTVIAAAKGSNLKVAAQNTYFENSGAFTGETSPQVLKEIGTDYVVIGHSERRDYFHETDEDINKKAKAIFANGMIPIICCGESLETYEAGKAPEFVGAQVSAALAGLTLKQVASSVIAYEPIWAIGTGKSASQDDAQKMCKVVRDVVAADFGQEVADKVRVLYGGSVKPENVAEYMACPDVDGALVGGASLEPESFLALLDFVK

SEQ ID NO: 36001 - protein, 618 aa, Haemophilus influenzae Rd KW20
MSQLANPELMKVVILLASSVTIVPLFKRLGLGSVLGYLVAGCLIGPSVFGIVQEPTAVVHLAELGVVMFLFIIGLEMYPERLWAMRKAIFGRGLLQVGLCGCLLTFSGIYLLGLTKEVSFIAGMGFTLSSTAIVMQSLEERGLTSTSKGQRVISTLIFEDIAIVPLLASVAFLAPHSKEATPHTDWVSIGIALSAVVGLIVTGKWLMNPLFRLISKARIREMMTAGALLVVLGAALAMEIGGLSMAMGAFVAGVMMSESAFRHQLEADIEPFRGLLLGLFFMGVGMSLDLHLVFNHWILLLGIVFLYILGKASAVYIIARITRLDHREAIGRMSLMAHGGEFAFVLFSAAATAEVISNEEQATFTAAVIISMLFSPIIAQIARKLIQRTEPKHLDQLDENDLDTIVDLEDNVLVIGFGRFSQIVCQTLLIRGISVSVIDRNIENIRAAAKFGFKVYYGDGIRLDVLRAAGIEKAKCVVLGINDTQRIEHIVSQMKEAYPNLPILTRTYDRKTTVSLIKQDVDFIVRETFESAITLSRATLMKLGIDKIEAEEIIKEVRTLDQERLNEEVLHGFSNEIVKKYWTPRPFIKPHLDTKALNKETEEILSEKIEEEISNDHS

SEQ ID NO: 36002 - protein, 369 aa, Xanthomonas campestris pv. vesicatoria str. 85-10
MKSRAAVAFGPGKPLEIVEIDVAPPKAGEVLVRITHTGVCHTDAFTLSGDDPEGIFPSVLGHEGGGIVEAVGEGVTSVKVGDHVIPLYTAECRKCKFCLSGKTNLCQAVRATQGKGLMPDGTTRFSYNGEPIYHYMGCSTFSEYTVVPEISLAVVNPEAPLEKVCLLGCGVTTGIGAVHNTAKVKPGESVAVFGLGGIGLAVIQGAVQAKAGRILAIDTNPGKFDLARSMGATDCINPKDYDKPIQEVIVELTDGGVDFSFECIGNVNVMRSALECCHKGWGESVIIGVAGAGQEISTRPFQLVTGRVWRGSAFGGVKGRTQLPGMVEQSMKGEIDLDPFITHTMPLEEINEAFHLMHEGKSIRTVIHF

SEQ ID NO: 36003 - protein, 290 aa, Oceanobacillus iheyensis HTE831
MVNITVVGSSSIDLVVTAPTRPKAGETIIGDDFQTVPGGKGANQAVAASRLGANVSMIGRVGKDTFGEEILSNLQENKVSVEYVEPVTDVASGTAHITLAEDDNSIIFVKGANDYVTPDYIKKSLDKLINADIVLIQQEIPEETVEFVIETCHTYEVPILLNPAPAREVSNQVIERTTYLTPNEHEFSIMFGNENRSDVLKRYPNKLLITEGKNGVRYFDGEAEIVIPSYEVVPVDTTGAGDTFNASFAIAIAEGRSLEDAIRFANKAASISITKFGAQGGMPTRTEMEE

SEQ ID NO: 36004 - protein, 348 aa, Burkholderia sp. 383
MKIVKPLLIAAAVAAALSVTTTAFAAGAGAGVEAVRPDATTSAFLAALNGQKGPGLETLSPAKARQVLVDAQNGTKVDLSGIDVSNRTIEQDGLSVPVTIVRPQGATGTLPVFMFIHGGGWVLGDFPTHERLVRDLVVQSGAVAVFVNYTPSPEAHYPVAINQAYAATKWVAAHGAEIGVDGSRLAVVGNSVGGNMAAVVALMAKDKGGPAIRFQGLMWPVTDHNFNTGSYNAYQQGHFLTRPMMKWFWDAYTKNEAQRNEIYASPLRASTAQLKGLPPALIQVAQFDVLRDEGEAYGRKLDAAGVDATTTRYDGTIHDFGLLNALAMDAPTKAATKAMANEIATRLK

SEQ ID NO: 36005 - protein, 216 aa, Brassica napus
  misc_feature (147)..(147): Xaa can be any naturally occurring amino acid
  misc_feature (175)..(175): Xaa can be any naturally occurring amino acid
  misc_feature (180)..(181): Xaa can be any naturally occurring amino acid
  misc_feature (196)..(196): Xaa can be any naturally occurring amino acid
  misc_feature (208)..(208): Xaa can be any naturally occurring amino acid
MDSGQWHVEKRSTLRNESFLKEYGPVSETGSLSIVVLGASGDLAKKKTFPALFNLYHQGFLNPDEVHIFGYARSKISDQELRDKIRGYLVDEKNASEKAEALSKFLQLIKYVSGPYDSEDGFKRLDKAISEHEISKKTSEGSSRRLXYLALPPSVYPPVCKMIKAWCTNKSDLGXWTTLXXEKPFGKDFGSAEQLXSQIGALVDEPQXYRIDHYLG

SEQ ID NO: 36006 - protein, 295 aa, Saccharomyces cerevisiae YJM789
MTIDLASIEKFLCDLATEKVGPIIKSKSGTQKDYDLKTGSRRVDIVTAIDKQVEKLIWESVKTQYPTFKFIGEESYVKGETVITDDPTFIIDPIDGTTNFVHDFPFNCTSLGLTVNKEPVVGVIYNPHINLLVSASKGNGMRVNNKDYDYKSKLESMGSLILNKSVVALQPGSAREGKNFQTKMATYEKLLSCDYGFVHGFRNLGSSAMTMAYIAMGYLDSYWDGGCYSWDVCAGWCILKEVGGRVVGANPGEWSIDVDNRTYLAVRGTINNESDEQTKYITDFWNCVDGHLKYD

SEQ ID NO: 36007 - protein, 496 aa, Burkholderia sp. 383
MNQPTFEDWQARAAVLRVEGRAFIDGDARHAHTGATFACVSPIDGCVLAHVADCGADDVDLAVAAARRAFDARSWAGMNPRTRKAVLQRWAALMREHLDELALLETLDTGKPIADTTAIDVPAAAHCVDWYAEAIDKVGGEVAPVDHHLVGLVTREPIGVVAAVVPWNFPLLMAAWKFAPALAAGNSVVLKPSEKSPLTAIRVAQLACDAGVPPGVFSVVPGGAEPGKALALHRDVDCIAFTGSTRTGQQIMACAAQSNLKRVWLELGGKSPNIVLRDCPDLDRAAQAAADAIFFNMGEVCTAGSRLLVHRDIKDAFVAKLVDASRRFAPGHPLDPSVTMGAIVDRTQLDRVMGYIGAGRDEGKLVTGGARVREETGGFYVEPTVFEVKPDAKIAREEIFGPVLSVIVFDEVDEAVRIANDTEYGLAAAVWSADLSTAHAVARRLRAGTVWVNCYGDGSDDMNFPFGGYKLSGNGRDKSLHALDKYTELKSTVVRL

SEQ ID NO: 36008 - protein, 455 aa, Bacillus cereus ATCC 10987
MSISSIVNKQKAYFYNGYTRSVEVRKNNLKKLYEGVQRFEQEIFQALKLDLNKSVHESFTTEVGYVLKEISFQLKHISSWSKPKRVRTALTHFGSKGKVVPEPYGVTLIIAPWNYPFQLAIAPLVGALAAGNTIVLKPSELTPNVSKVITRMLEELFQEELVAVVEGGVEESTALLKEPFDYIFFTGSVGVGKVVMEAAAKQLTPLTLELGGKSPCIVHKDAKIDVTARRIVWGKFLNAGQTCVAPDYMYVHASVKEQLIEALRHEIEEQYGKEPLHNDNYVRIVSERHFERLCTFLKDGKTVIGGNYKKETLHIEPTVLTNVTWESAVMEDEIFGPILPIIEYDNIEDVIDTIQQHPKPLALYVFSEDKGVQKKVTSNISYGGGCINDVVYHLATPYLPFGGVGSSGLGSYHGEESFRTFSHYKSILAQSTAFDMKIRYSSTKSALKFIRKLLK

SEQ ID NO: 36009 - protein, 397 aa, Nostoc punctiforme PCC 73102
MTSLSVTQTKLHSHREQFPALANKTYFNYGGQGPMPQRAMDAMTETQAYVQQIGPFGNEAYRWIAPQTQAARVAIASELNAPSETISLTQNVTVGCNIAMWGIDWHSGDHILLSDCEHPGVIATTQEIARRFAVEVTTCPLKATLNEGDPVKVIAQHLRPNTRLVILSHVFWNTGQVLPLKKIAEVCRNNHSFLLIDAAQSAGLLPLNLTELGVDFYAFTGHKWLCGPAGAGGLYVRPEARESLKPTFIGLNGIVVDSQSQPVDWLPDGRRYEVSTLAYPLYVGLKEAIAIHQQWGTSQERYEQIYQNSGYLWQRLVALPDVKCLRTSPPESGIVSFQLANNQPQAHLKLVQFLDSQNILTRTIADPSCIRATIHYLTLESEIDQLVEAIQSFCKIS

SEQ ID NO: 36010 - protein, 582 aa, Candida albicans SC5314
MLHKKETNDTFVQLNRSPSTGEQKSSGIWSSIKDSFKPALPQDKLTGVDDIPDRELTDIERININAANSNLQRKLKTRHLQMIAIGSSIGTGLFVGTGGALSTGGPAAIVLAWAISAISVFMTMQGLGELAVAFPVSGGFNLYASKFLEPGIGFAVGWNYFLQFFVLLPLELVAGAITIKYWNASINSDVFVIIFWFVVLVITMLGVRWYGEAELVFCTIKVIAVIGFIILGIVLICGGGPNHEFIGGKYWREPGPFANSFKGFASSLITAAFSFGGTEMIALTASESSNVRHALPKAIKQVFWRIVIFYLGSIIMIATLVPYNDKRLLGSSSVDVTASPFTIAIVNGGIKGLPSVINAVILISVLSVGNASVYATSRTLNSLAEQGMAPKWTGYIDRAGRPLFAILITNVFGLFALIAADNEKQVVAFNWLLALSGLSSIFTWMSINLSHIRFRRAMKVQNRSLTELPFVAQSGVWGSYFGLTLNILYLIAQFYIGLFPVGGKPNAYDFFLAYLGVPVILASWIGYKIWKRDWTLFIRAKDIDLDTGRINVDLDLLQQEIAEEKAQLAEKPFYIRIYRFWC

SEQ ID NO: 36011 - protein, 566 aa, Populus x canadensis
MESKSPRDDDGHGTHTATTAAGSAVSGASLFGYASGIARGMATEARVAAYKVCWLGGCFSSDILAAMEKAVADGVNVMSMSIGGGLSDYTRDTVAIGAFRAAAQGILVSCSAGNGGPSPGSLSNVAPWITTVGAGTLDRDFPAFVSVGDGKKYSGISLYSGKPLSDSLVPLVYAGNVSNSTSGSLCMIGTLIPAQVAGKIVICDRGGNSRVQKGLVVKDSGGLGMILANTELYGEELVADAHLLPTAAVGLRTANAIKNYAFLDPKPMGTIASGGTKLGVEPSPVVAAFSSRGPNLVTPEVLKPDLIAPGVNILAGWTGGAGPTGLTNDKRHVEFNIISGTSMSCPHVSGLAALIKAAHQDWSPAAIKSALMTTAYATYKNGEDLLDVATGQPSTPFDYGAGHVNPVAALDPGLVYDATVDDYISFFCALNYSASDIKQITTKDFICDSSKKYSPGDLNYPSFSVPLQTASGKEGGAGVKSTVKYTRTLTNVGDPATYKVSMTSQTTSVKMLVEPESLSFAKEYEKKSYTVTFTATSMPSGTNSFAHLEWSDGKHVVRSPIAFSWT

SEQ ID NO: 36012 - protein, 494 aa, Salmonella enterica subsp. enterica serovar Paratyphi B str.
MSDVTLLAEVTTFLRQRHGQFIAGERQAGNGTNFSVTNPATGKIIADVVSATPAQAEQAMQSARRAFDVWRKMPTLQRGALLLKLADTLAAHREELAQLESVCSGKTIMLSRGLELDQSVAFLRYFAGWAGKITGETLNVSLPSMGEERYTAFTQRQPIGVVVGIVPWNFSIMIAIWKLAAALVCGCTIVIKPSEYTPLTLLRVAELAKEAGFPDGVINVVNGAGGEIAQQLIAHPDCAKVSFTGSVATGEKVRRSATSSGKRVTLELGGKNAALFLNDLSAQAMVNGILEAGYLNQGQICAAAERFYLPQEKLDTVMTLLRQRLSEIVPGSPLDEKTVMGPLANQVQLEKVLRLIQRAREEGDTIVYGGETLPGEGYFLQPTAVKVRSKNSTLMHEETFGPVCSFIGYQNEKEALSHINASPFGLAASVWSENMSKALRYAEDIDAGMVWVNMHTFLDPAVPFGGMKGSGSGREFGSAFIDDYTELKSVMVRY

SEQ ID NO: 36013 - protein, 272 aa, Physcomitrella patens subsp. patens
MGLHQSEELESCLAVAVEVAKKAGQIIKDGFHRAKAVEHKGLVDLVTETDKACEDVIFTQLKESFPSHELIGEETASVNGIPVLTDSPTWVIDPLDGTTNFVHSFPFVCVSIGLVIDKVPVVGVVYNPLLDELFTGIKGQGAFLNGQRIHASNQEHIGNGLLATEIGVKRDKQTVDRTSNLINYFLYKVRSLRLSGSCAMNLCGVACGRLDMFYELGFGGPWDVAAGTLILREAGGLVFDPSGGEFDMMSHLVAASNGHLKGALVEGLVAHM

SEQ ID NO: 36014 - protein, 389 aa, Zea mays
  misc_feature (225)..(225): Xaa can be any naturally occurring amino acid
SLHSSALCPCLEPSPLCLRFPWHDDCWYCCNHCLLDHPLLFSSVRIIVCLITTLFATDFFEVKAVKEIEPALKKQLIISTTLMTVGIAVISWLALLAKFTIFNFGTQKDVSNWGLFFCVAIGPWAGLIIGFVTEYYTSNAYNPVQDVADSCRTGAVTNVILGLALGYKSVIIPIFAIAVIIYVSFSIAAMYDIAVAALGMLSTIATGLAIDAYAPISDNAGGIAXRTDAVDAAGNTTAAIGKGFAIGSAALVSLALFGAFVSRAGVKVVDVLSPKVFIGLIVGAMLPYWFSAMTVKSVGSAALKMVEEVRRQFNTIPGLMEGTAKPDYATYWKISTDASIKEMIPPGALVMLTPLIVGTLFGVETLYGVLAGALVSGVQPSFSLNRKEL

SEQ ID NO: 36015 - protein, 318 aa, Rhizobium leguminosarum bv. viciae 3841
MNAPINAPKLYDCRDAFATTLERLAAEDETIVAVCNDSVGSSKLGGFKAKFGERLVNVGIAEQNMVGVAAGLANGGRLPFVCAAAPFLTGRSLEQIKADISYSNANVKLVGISSGMAYGELGPTHHSIEDFAWTRVLPNLPVIAPCDRIETAAAVEWAAAYNGPCFLRLSRVGVPDLLPEGHKFELGKANLLRQGSDVTLIANGTLTHRILKAAEILAERGINARVLNLATVRPIDEDAIIAAAKETGAIVTAEEHSIFGGLGSAVAEVVVDNAPVPMKRLGVPGVYAPTGSAEFLLDEFGMAPSAIADAAQSLIRRK

SEQ ID NO: 36016 - protein, 132 aa, Brassica napus
VRGRVGASGRPRSRTRRFPDGQKVVQVSCGWRHTLAGTERNNVFAWGRGTNGQLGIGESIDRNSPKIIEALSVDGASGQQIESSNFDPSSGKSWVSPSERYAVVPDETVNGSKEGNGGDISVPQTDAKRVRI

SEQ ID NO: 36017 - protein, 1462 aa, Candida albicans SC5314
MSTVVNRRSSHQFDSPSNHLDHSSSMNVDKVVQSVTNATKRLSQISTNTNNSNKKRKTQNKIGPWKLGRTLGRGSTGRVRLAKNTTTGQLAAVKIVPKSNFKKLENPKYKRSKEDATRLPYGIEREIIIMKLISHPNIMGLYDVWENKNDLYLILEYIEGGELFDYLIKRGKLQEYEAINYFKQIINGINYLHQFNICHRDLKPENLLLDFNKNIKIADFGMAALEVKEKLLETSCGSPHYASPEIVAGKNYHGAPSDIWSCGIILFALLTGHLPFDDENIRKLLLKVQSGKFNMPPELSFEAKDLITKMLKVNPRERITIDAILTHPLLAKYPEPTVSYSSTTTLDINSINIKQIESVDKIDKEILKNLSVLFHNCDEKTIISRLLSPNRCPEKMFYYLLMKYRNEHLSNSNSFNSSNDVDSARSLPRSTSYVKTTVTDHATGEKHTTVKKIQQSSSIYSNRSLLKKSTSAKGNVLSNITNRPNTPKQFSASSSFNKKKALHSKTQIYASRSRNASSRSLKSNSSTGRNGNNASVTSVNKIPEITGATVLQPIPSMAMNRGDEQQNKTKKNLTGTFGNKSLLNFQLICEEVFENDKENSKPVSKTPVSQLPPPPPPPIETPTSRTNSVKRGKTWSLARRERELAEQVRQRNEARENKLKAEELARKELEQEKKRIAEEKKRLEQQERELDEKQKLQEKQKAALEKLQKHQSAHDFEGLFASNRRSVTDMAPSSGMSSLDPRAHMVSRANTIGSPNLSSSSVNIDENASKVLHKFGIDVAPSPKRFSRASKTSTSKNLSSFLAPTVSRNLSSQLKTSSSKNLAGYLHGTTDTNGSAIAAKKKDDSTNEALTIEEFNAKERTSMSPSISKASVNKRNSNQSSYYRSMFSDNGNDDNVTKVRTGESHLSVQEEEEMDMENAIDEDISLIPNPRFSRFSFGGLLGSNTVANEEGDWTIMNSTLNHSNTVVRGTHNKSSTMLGLGIKMRDTTTIKEDEEFEDEKPFISVPSSEDDEGNTHKNKRGGLRDSGNYDFDEEHSVASTANTEYSDVASQGQQMPGSHTIHQLETELSNFDLLSYRVADIGKVNKHKPSIVDSKETLLKNHSSDEATIEVKEDNNEHDFNDKIKQHYDDNGDSEEDDEDEDEEEEDDDDDDDARSSFEARPHSHNYSLAEITSESPVGGGYESPSIANDFKKSRHSTGIFSTTQFPRSPYVVNNNGDSNKDENSQQQTKHMLNDGHKGLITSPVQDTFGSKKPVESNSLFRRLSLNPNRAAPKAPAPPPPSAPISSAAKANISQPLSSPTKGHNRFSRISIGSKNMLQKEDKSTKSNWFKKFFHSLTTPSAKDQSGNSSSKVASKDIKIIDTSLTAAQLIRVIKYQLELKKIEGSISKVDIDEEFGLISGVIPSKFANGRKLKFKIEVIDLINSSSLHVIKMKGNDKGFQSLVNIVTFIIKKEEQDKISRR

SEQ ID NO: 36018 - protein, 475 aa, Xanthomonas axonopodis pv. citri str. 306
MSSVSIDGAPDAGENTRFIILISCVATIGGFLFGFDSGVINGTVDGLKQTFQSTAAETGFEVASMLLGCAIGAFFAGRLADRWGRRAVLIISAALFLLSAIGAGASHSSAFFIFARVMGGFAVGAASVISPAYIAEVASARYRGRLATMQQIAIISGLFCAFLSNYLLANAAGASTEPLWAGQAAWRWMFWMQAVPSILFLLLLLVIPESPRYLVVKGRREQALVVLKRLYGNAAAQTKLGEISASMAADQHKPKFSDLINKATGKIRPIVWIGIGLAVFQQLVGINVVFYYGAVLWQAVGFSEQDALLINVLSGGLSIGACLVTVMLVDKIGRKPLLWIGSAGMAVSLALVTYAFATASLDPNGKLAMSDAMGMLALVAANVYVVFFNASWGPVMWVMLGEMFPNQIRGSGLAIAGAAQWTSNFAITVSFPILLGSIGLAGAYGIYTVAAFISVFFVLKYVYETKGKELEQMEG

SEQ ID NO: 36019 - protein, 242 aa, Triticum aestivum
  misc_feature (38)..(38): Xaa can be any naturally occurring amino acid
MAAAGTLVVYRAVFAALGCLMVGTLVYTCITDGSPFRXQLLTPWMVTTLVDLYVNIAAISTWVVYKEGNWITSIFWVVLLICFGSATTCAYIVSKLFEITSSGLSQNPLDLLLLRQNNLPERKCSFVVIGRTIFSILGILMAALVTYTVITDGLPFRKDLLTPWMAATLIDFYINVFAISVWVVHRESTWISAVIWICLLICFGSITTCGYIVVQLLQVSYQDPVYHLLLNSHSKYGIAPLQ

SEQ ID NO: 36020 - protein, 431 aa, Lactobacillus sakei
MSIITDILGREVLDSRGNPTVEVEVYTEDGGFGRAIVPSGASTGEHEAVELRDGDKSRFGGKGVLKAVENVNGPLAKEIVGFDTTDQRGIDAAMIKLDGTENKGKLGANAILGVSLAAARAAADELGLPLYEYLGGPNAHVLPTPMMNVINGGAHSDNKVDFQEFMIMPVGAKSVREAIRMGSETFQALKSLLSADGKVTSVGDEGGFAPDFANNEEPLQYLIKAIEKAGYKAGEDISIAIDVASSELWNNEDKTYKLRWSTGEEFTTPEFVKYLEGLVAKYPIISIEDPIDENNWEDWASITKELGEKVQLVGDDFFVTNTDYLRKGIKMGAANSILVKGNQIGTLTESLEAIEMAKEAGYTAVVSHRSGETEDTTIADLVVATNAGQIKTGSMSRTDRLAKYNQLMRIEEQLGDTASYKGINSFYNIKK

SEQ ID NO: 36021 - protein, 411 aa, Bordetella parapertussis 12822
MNTISDSAAVAAGRRVAARMARVTTSKIYLAIAKVADMQAQGMQVASLTAGEPDFDTPAHVIEAAVQAMRGGDTHYTPVRGSLAMREAVRQKFQRENGLAFRDEEVMVGTGSKQVIANALAVTLETGDEVLLPVPYWAAYTGMVYAAGGVPTFVGTRAEDGYKLTPQALRAALGPRTRWVILNTPSNPSGLVYGSDELRALGEVLRERPDVLILTDEIYEHLNYTAEPPASLRKLCPDLAERIVVVNGVSKAYAMTGWRLGFAGGPADIIEAMANLQAQTTLAPCSISQAAAVAALNGPRESIDAMAAAYRRRRDLVMQIAGGQSGVRLQRPDGAFYAMLDLSEALAGGERFRGDPEPDQAFCEWLLETRHVAAVPGSVFGAPGSVRISFATDEQTIERGLTGLLDAAAHC

SEQ ID NO: 36022 - protein, 90 aa, Escherichia coli
LQDQGYDTVEANHQLGFAADERDFTLCADMFKLLGVNEVRLLTNNPKKVEILTEAGINIVERVPLIVGRNPNNEHYLDTKAEKMGHLLNK

SEQ ID NO: 36023 - protein, 1150 aa, Ashbya gossypii ATCC 10895
MTSETNNNNAASSNGGQLPPSGLPASWFTTPIPARSTTDRQQYSQEFRERVSRVTQRGQNYVSQLNEPGRDWPRSFVGQNTRFFQQAATPSRNTISLAGAGLESGVGIARPAGGNSNFMPANMVDADNDVDLLHDEQVMSYLPPSAEERRLFESFQAEARSVFRRSIETIGRRKSLLLQSFEADNLKLQQLQSGQVQWSGDANDPESENRYISRLSKVQRIRLRAVEMETLNMQRLRGNFQVTMQQFKIEVQRYLVAKARGEYLRNPVEYFKPQLIDWDPHKNMGIKIALMENHMDESDWDRLRLMVESDPPENTNTRPRAQAQHIHESIVRAPFTNGYNNININSRVATTAISTTTNLSFPYIFPLQELPQEILSLVLEMVGQKTDIVLLLTVCKAWAAIIVKLLYYRPHINKKPQLDLFMNTMRKPASELVFDYRPMIKRLNFSFVGDYMTDAQLLHFVGCPNLERLTLVFCKQVTTKSIAKVLKGCRFLQSVDITGVREVGNELFNVLSTDCKRIQGLYVPRADLVSCEAIEQFVENAPMLKRVKITFNKNITNNLLIKMAHSCPLLVEVDLTSTPQINNDSIVTLMTELPQLREFRLTQNMLLSDAFATQLALNVTSLPALRLVDLSACESITDKTVVKLVQLAPKLRNVYLGKCSRITDNSLIALSKLGKNLQTVHFGHCFNITDEGVKVLIQNCPRIQYVDFACCTNLTNHTLYELGDLTKLKRIGLVKCSQMTDEGLLNMIALRGRNDTLERVHLSYCTNLTIYPIYELVMACPKLSHLSLTAVPSFLRPDITQFCRPPPSEFTVNQRQIFCVFSGKGVQKLRHHLMSMTRPTDGPTTKVRKILIEFLIARGLFKPNENEEEALKRIADDINQESAALMTASSMFNAANEPFQSINFERIDELFTFLKRVPQDDSVSSEDLAELMPLVDESFCEEPFRSEWRDHDGIVAPRASNDLNSELADIVRKFHALNDRIADFEVNVSSIIRIQFQYTGSMLAEMSHIYMLLVDLNRTICDIQKRIYEINNPRDVKAITIWRMLWTPRFEEMLRKYKLDTVVLRLYLKNNVAVLTRQREVALLRARTLWDTEQSGLVQGNGAVNGNTVASDPSVVAARQLFPQFQIPVFRPTQDGPPPDQDDDEVLEES

SEQ ID NO: 36024 - protein, 449 aa, Leptospira interrogans serovar Lai str. 56601
MISTFTRYKAEFECINDSCKTRYDLNEIIYECKKCGSLLQVSHDLDALKSVSGQEWKDLFDSRFRSVKFPNSSGIWNKREWVLPHIEDKNIVTSGEGLTHLFTSDRLTESLGLGSFYVKQCGISHTGSFKDLGMTVLLSQVKQMISSGVPIRAVACASSGDTSAALASYAAKAGIPAIIFLPAGKVSQAQLIQPVSNGAKVIALDTDFDGCMKIVKEVTREAGIYLANSMNSLRIEGQKTISVEITQQLGWKVPDWIVIPGGNLGNVSALGAGFEMMFSLGLIDKLPRIVLAQAEHANPLYLSYLKNFESFEPVSAKTTLASAIQIGNPVSIQKAIKTLKKFNGVVEQASESELADAASKADLFGLYNDPHTGVALAALEKLIQKGTISKGESVVVISTAHGLKFTEFKLKFHGGEIPGTDFKIVNSIHKVEPKADKVVGLIRDLLVSK

SEQ ID NO: 36025 - protein, 181 aa, Zea mays
MAGATTPASGALVRLCLPSLLLFLYRCCRCEAVEMERTLAMIKPDGLSGKYTEAIKEVILDSGFHIVKETEVQLDAERASVFYAEHSQRSFFDSLVKYITSGPVLAMVLERPDAVAQWRTLIGPTDAKKAKTSHPNSIRAMCGLDSEKNCVHGSDSPESADREISFFFGEAESVTVEHDEL

SEQ ID NO: 36026 - protein, 469 aa, Pseudomonas aeruginosa PAO1
MDGQHLHQGELKRGLKNRHIQLIALGGAIGTGLFLGSAGVIKTAGPSMILGYAIGGFIAFLIMRQLGEMIVEEPVAGSFSHFAHKYWGGFAGFLSGWNYWVLYILVGMSELTAVGKYIQYWWPDVPTWATAAAFFVLINAINLANVKAFGETEFWFAIIKVAAIVGMILLGIYLLVGGGGGPQASVSNLWDRGGFFPNGLSGLVMTLAIIMFSFGGLELVGITAAEASEPRKVIPKAINQVIYRILIFYIGALAVLLSLYPWDQLVETINASGDDYSGSPFVQIFSLIGSGTAANILNFVVLTAALSVYNSGVYCNSRMLYGLAAQGDAPKVLMSVDRRGVPVLSILVSALITFLCVIVNYVLPHKALELLMSLVVAALVINWAMISLSHLKFRAAMKRQGVDTFFKALWSPFSNYLCLAFVLFILGIMLMIPGINISVYAIPFWLLLMWLCYRVKLSLAERRGLGQQA

SEQ ID NO: 36027 - protein, 259 aa, Physcomitrella patens subsp. patens
MLFGEWSGGGEIALWFGSVLSGIMFCKLMYDFSKDISPNTFPGYNKLTRTQKVEWNNRAFSTAHAFVSSAIAFYLLYVSDIFRDSAPYGPVMFRSSILSQFGLGFSCGYFIADMGMIVAFYPTLGGYEFLLHHLVSMLALILAVHSGHAHLYLYIVLLSECTTPFINLRWYLTILDLKGTDVYLYNGVFTAFLWLIARVINFVYCFVHLYLHFDQAKQVHTAGFVFLLVSPTSLGLMNIFWFYKIVNALLRTFNRKHAP

SEQ ID NO: 36028 - protein, 200 aa, Physcomitrella patens subsp. patens
MGTLIQDDENDEDDEKQNKDDDDQDEDDEDQDENDDDQDKNDDDQDKNDDDQNKNDDDQDKNDDDQDKNDDDQDKNDDDHEDDLPRWSSSIIVIILCRQMQLFVPDLITPSNSRSCVLPVQHRRCAVDSLLPEQLTAPAPMREGIDMDPRGCRRRRCGRAHQATFPLPLCRSLFRRLPLGLSSSFSGGIAASGAVDLSAY

SEQ ID NO: 36029 - protein, 379 aa, Xanthomonas campestris pv. vesicatoria str. 85-10
MNFAPVPELIEELRAGRMVVIVDDEDRENEGDLIMAAELVKPSDINFMVTHARGLVCLSLTRERCAQLGLAPMVRNNTAQFQTNFTVSIEAAEGVTTGISAYDRAHTVRTAVRPDARPQDLSQPGHIFPLISQPGGVLTRAGHTEAASDLPMLAGLEPAGVLVEVLNPDGSMARRPQLEVFAREHGLKMGSIADLIAYRLANEHTVERVDERQITTEFGPFKLVTYRDRIAHDLHFALVRGRADPQTPTLVRVQVENPLADLLHWQRDDFGVAATDALRAIAAEGQGVMVVLSAPRDSESLLARLRQQPEAAANAKDVSQWRRNGAGAQILADLGLGKLRVLGTPRRQVGLAGFGLEVVEYLECHPGEGVRSVPPSAVP

SEQ ID NO: 36030 - protein, 250 aa, Zea mays
MPINRIALGSHQEVYHPGALKAAFAEFISTLIFVFAGQGSGMAFSKLTGGGPTTPAGLIAAAVAHAFALFVAVSVGANISGGHVNPAVTFGAFVGGNITLFRGLLYWVAQLLGSTVACFLLRFSTGGQATGTFGLTGVSVWEALVLEIVMTFGLVYTVYATAVDPKKGSLGTIAPIAIGFIVGANILVGGAFDGASMNPAVSFGPALVSWEWGYQWVYWVGPLIGGGLAGVIYELLFISHTHEQLPSTDY

SEQ ID NO: 36031 - protein, 229 aa, Chlamydomonas reinhardtii
MTFAFAALEQQLSGLATDAAQLAQPYLAHIPKGLLRDYTCIAAVAFAFWAVEGVLLAVLVPTLTRILVQPPTKDADAKKQLRRAKGAAIQTVARLVGTIHNTVQVPLGLLILLDPQFQSNRMFQTTPLSYAVCYISAGYFAHDLVMCASRFALEGPLYTIHALVCHAAYAFGVTTGFIHYHGAAFLQWELSTTFVHLRWFMYKAGWANTRAYVLNGICMVLVFFGCRIA

SEQ ID NO: 36032 - protein, 372 aa, Populus trichocarpa
MGCFSCAGKSSKNDSKKKPDDQIPSSSDKTKSNGAPDVKEASKDGGSEHIAAHTFTFRELANATKNFRADCLLGEGGFGRVYKGRLESTNQVVAIKQLDRNGLQGNREFLVEVLMLSLLHHPNLVNLIGYCADGDQRLLVYEYMPLGSLEDHLYDLPPDKKRLDWNTRMKIAAGAAKGLEHLHDKANPPVIYRDLKCSNILLGEGYHPKLSDFGLAKLGPVGDKTHVSTRVMGTYGYCAPEYAMTGQLTLKSDVYSFGVVLLEIITGRKAIDNSRAAGEHNLVAWARPLFKDRRKFAQMADPLLHGQYPARGLYQALAVAAMCVQEQPNMRPLIADVVTALSYLALQKYDPETHPVQGSRTGPSTPRTRREQ

SEQ ID NO: 36033 - protein, 318 aa, Burkholderia xenovorans LB400
MSSHDGLMVFTGNANPALAQEVVKILGIPLGKAMVSRFSDGEIQVEIQENVRGKDVFVLQSTCAPANDNLMELMIMVDALKRASAGRITAAIPYFGYARQDRRPRSARVAISAKIVANMLEIAGVERIITMDLHADQIQGFFDIPVDNIYATPVLLGDLRKQNYENLLVVSPDVGGVVRARALAKQLNCDLAIIDKRRPKANVAEVMNIIGEVEGRTCVIMDDMVDTAGTLCKAAQVLKERGAKQVFAYATHPVLSGGAGERIAASALDELVVTDTIPLGEEARSCAKIRSLTSAGLLAETFSRIRRGDSVMSLFAES

SEQ ID NO: 36034 - protein, 1129 aa, Phragmites australis
MGEPDDAVLFVGVSLVLGIASRHLLRGTRVPYTVALLVLGVALGSLEYGTQHGLGKLGSGIRIWANINPDLLLAVFLPALLFESSFSMEIHQIKRCMAQMVLLAGPGVIISTFLLGTAVKLTFPYNWSWKTSLLLGGLLSATDPVAVVALLKELGASNKLSTIIEGESLMNDGTAIVVYQLFYRMVLGRTFDAGSIMKFLSQVSLGAVALGLAFGIVSVLWLGFIFNDTIIEIALTLAVSYIAFFTAQDSLEVSGVLTVMTLGMFYAAFAKTAFKGDSQQSLHHFWEMVAYIANTLIFILSGVVIADGVLQNNVHFERHGTSWGFLVLLYVFVQISRVVVVGVLYPLLCHFGYGLDLKEATILVWSGLRGAVALSLALSVKRTSDAVQPYLKPEVGTMFVFFTGGIVFLTLILNGSTTQFLLHMLGLDKLSATKLRILKYTRYEMLNKALEAFGELRDDEELGPADWVTVKKYITCLHDLGDEPEHPHDVSDKDDRMHTMNLRDIRVRLLNGVQAAYWGMLEEGRINQATANILMRSVDEAMDLVSRQPLCDWKGLQSSVQFPNYYRFLQMSKLPRKLITYFTVERLESGCYMCAAFLRAHRIARRQLHDFLGDSEVARIVIDESNAEGEEARKFLEDVRITFPQVLRVLKTRQVTYSVLTNLSGYIQNLQKTGLLEEKEMVHLDDALQTDLKNLKRNPPLVKMPRVSELLNNHPLVGALPAVSRDLLLSNTKETVRGHGTNLYREGSRPTGIWLVSIGVVKWTSQRLSSRHSLDPILSHGNTLGLYEVLIGKPYICDMITDSVVHCFFIEAEKIEQLRQSDPSIEVFLWQESALVIARLLLPQIFEKMAMHEIRVLIAERSTMNISIKGEDIELEQNYIGILLEGFLKTKNQNLITPPGVLLPSNTDLNLFGLESSAMNHIDYCYTAPSYQVEARARIIFFEIGRVSETQPDLQRTVSLLAQTHEPPRTLSKEHSGLLSWPESFRKSRGPHNVSFAEMRNQPGSLSARALQLSMYGSMINDMHSGQGHRRLRHRMQATNQKRSSSYPRVPSRPSNARPLLSVQSEGSNMKRMATPKEAGEAPAPATSAGQRRRKAMEANNSSDDESAGEEVIVRIDSPSMLSFRQPSK

SEQ ID NO: 36035 - protein, 231 aa, Fusobacterium nucleatum subsp. vincentii ATCC 49256
MNKEQKSKFVHEVFENIHTQYDKANNRISFGLQKNWKQELVDKIVEEIPKNADFLDVCCGTGDISIWLAEKRKDLNIVGVDFSSAMLNEAVKKSKDLDIVWKEADALCLPFKDCSFSAVAISFGLRNTVDYEKVLSEMIRVVKKDGFVYCLDSFVPDCLWIQPFYKIYFKYIMPLFGGGKKYYKEYVWLYESTQQFLKKKELILLYEKLGLKEIKHHSKMFGVCVMIQGKK

SEQ ID NO: 36036 - protein, 706 aa, Magnaporthe grisea 70-15
MQRSDSHQAGGGVSGDATSLPTLNPVLSRYVDAVFKSHTDRNTGKWPKDQIATFLRVVQGEDGAEPQSALLKQSDLDLEGFVSYMLSPESSIIGPAKDQDLSWPLASYFISSSHNTYLTGNQLYSLSSTEAYTNVLRRGCRCIEVDVWDGDASDAEVSSVSSDDDDPDKYAKRKERVGQIKDKIPKSLTSRFRESSLAKRLGQFVDSKTEPKQPPISTSNSQGSGGPSPSALTRGADEDSTNDQNLSALQKTQTHEAPVIEPKVYHGYTLTKEVSFRDVCYAIRDDAFTASDLPLIVSLEVHCGPEQQLCMVDIMEEAFQGYLVPKPAEDAAVLPSPEALRNKILIKVKYAPPVDAPEVAGTSPSSVEDVHSNAVLAATDSAKSAPMSSTSETLSPSTTSPNLDTPKKKKKSKIIQRLSDMGIFTRGVSFKSLSQPEAVMPTHIFSVSEKAVLDLHEKYGQELFDHNRHYLMRTYPSGMRIGSSNLDPVVFWRKGIQVVALNWQNWDEGMMLNEGMFAGTRGYLLKPEGYRGNKSAATPTSTSGQTQATAVRHRTLDLAVEVFAAQNIPLPPGDEKVKSFRPYIKCEIHVEEPGERHGGADAVPHNGREKEGEFKARTKTIKGTVDPDYGGEILRFSAIDGVVEELSFLRFTVRDDELGRDDLAAWACVRLDRLRAGYRIIRLLDGKGMESDGLVLVKISKSIYDC

SEQ ID NO: 36037 - protein, 81 aa, Physcomitrella patens subsp. patens
GAPPKGTGGSGLRRRRTTSTGSGGGGGGSMRSGNSNMLRFYTDDAPGLKITPTVVLVMSLCFIGFVTCLHVVGKLYNYRTK

SEQ ID NO: 36038 - protein, 211 aa, Rhizobium leguminosarum bv. viciae 3841
MTIARIEDAISAIASGKMVVVVDDQNRENEGDIVVAADAVTPETIAFMMNHARGLVCIAMEGERLDALDIPLMVPNNTESHKTAFTVSVDYLKGTTTGISAADRAATVRALVDDRTKPDEFARPGHIFPLRANPRGVLGRPGHTEAAVDLARLAGRIPAGVICEVANDDGTMSRLPELTLFAERHNLPLVTIEDLVAYLERQAARDIREVA

SEQ ID NO: 36039 - protein, 151 aa, Candida albicans SC5314
MSDERTFIAIKPDGVQRGLISSILGRFEQRGFKLVGIKLVQPTESLLRTHYEDLQSKPFFPSLLSYMLSGPVLATVWEGKDVVKQGRAILGATNPLQSAPGTIRGDFAIDMGRNVCHGSDSVESANKEIDLWFKKEELVEYKPALFGWIYE

SEQ ID NO: 36040 - protein, 1129 aa, Phragmites australis
MGDPDDAVLFVGVSLVLGIASRHLLRGTRVPYTVALLVLGVALGSLEYGTQHGLGKLGSGIRIWANINPDLLLAVFLPALLFESSFSMEIHQIKRCMAQMVLLAGPGVIISTFLLGTAVKLTFPYNWSWKTSLLLGGLLSATDPVAVVALLKELGASNKLSTIIEGESLMNDGTAIVVYQLFYRMVLGRTFDAGSIIKFLSQVSLGAVALGLAFGIVSVLWLGFIFNDTIIEIALTLAVSYIAFFTAQDSLEVSGVLTVMTLGMFYAAFAKTAFKGDSQQSLHHFWEMVAYIANTLIFILSGVVIADGVLQNNVHFERHGTSWGFLVLLYVFVQISRVVVVGVLYPLLRHFGYGLDLKEAAILVWSGLRGAVALSLALSVKRTSDAVQPYLKPEVGTMFVFFTGGIVFLTLILNGSTTQFLLHILGLDKLSATKLRILKYTRYEMLNKALEAFGELRDDEELGPADWVTVKKYITCLHDLGDEPEHPHDVSDKDDRMHTMNLRDIRVRLLNGVQAAYWGMLEEGRINQATANILMRSVDEAMDLVSRQPLCDWKGLQSSVQFPNYYRFLQMSKLPRKLITYFTVERLESGCYMCAAFLRAHRIARRQLHDFLGDSEVARIVIDESNAEGEEARKFLEDVRITFPQVLRVLKTRQVTYSVLTHLSGYIQNLQKTGLLEEKEMVHLDDALQTDLKKLKRNPPLVKMPRVSELLNNHPLVGALPAVSRDLLLSNTKETVRGHGTNLYREGSRPTGIWLVSIGVVKWTSQRLSSRHSLDPILSHGNTLGLYEVLIGKPYICDMITDSVVHCFFIEAEKIEQLRQSDPSIEVFLWQESALVIARLLLPQIFEKMAMHEIRVLIAERSTMNIYIKGEDIELEQNYIGILLEGFLKTKNQNLITPPGVLLPSNTDLNLFGLESSAMNHIDYCYTAPSYQVEARARIIFFEIGRVWETQPDLQRTVSLLAQTHEPPRTLSKEHSGLLSWPESFRKSRGPHNVSFAEMRNQPGSLSARALQLSMYGSMINDMHSGQGQRRQRHRMQATNQKHSSSYPRVPSRPSNARPLLSVQSEGSNMKRMAAPKEAGEAPAPATSAGQRRRKAMEANNSSDDESAGEEVIVRVDSPSMLSFRQPSK

SEQ ID NO: 36041 - protein, 181 aa, Pseudomonas syringae pv. phaseolicola 1448A
MAIRKFQDHTPALGERAFVDHSAVVIGDVEIGADSSVWPLTVVRGDMHRIRIGARTSVQDGSVLHITNAGPFNPDGFPLLIGDEVTIGHKAMLHGCTIGNRILVGMGTTIMDGAVVEDEVIIGAGSLVPPGKVLESGFLYVGRPVKQVRALTDKEIAFFPYSATNYVKLKDQHLAEGFDKA

SEQ ID NO: 36042 - protein, 299 aa, Schizosaccharomyces pombe
SKLDSYTHLSFYEKRELFRKKLREIEGPEVTLVNEVDDEPCPSLDFQFISQYRLTQGVIPPDPNFQSGCNCSSLGGCDLNNPSRCECLDDLDEPTHFAYDAQGRVRADTGAVIYECNSFCSCSMECPNRVVQRGRTLPLEIFKTKEKGWGVRSLRFAPAGTFITCYLGEVITSAEAAKRDKNYDDDGITYLFDLDMFDDASEYTVDAQNYGDVSRFFNHSCSPNIAIYSAVRNHGFRTIYDLAFFAIKDIQPLEELTFDYAGAKDFSPVQSQKSQQNRISKLRRQCKCGSANCRGWLFG

SEQ ID NO: 36043 - protein, 253 aa, Rhodopirellula baltica SH 1
MAEPISKQQMKCDEATAKSLIVDNWNSVNSSVSETAQRCGRSPDSVRVVGVTKYVDAEITSWLVEAGCHDLGENRPQLLESKFQTLDDSNIRWHQIGNLQRNKVRRLLPAEPLVHAIASERLLDALHNECLLQSRSIDGLIEINVSEEEAKTGLPIDQLEPLLVHWRELAGSSNAGLNINGLMAMAGWGTDETAAARQFAKLRELRDQMESSTGISLPELSMGMSGDYPAAIAEGATLVRIGTRLFQGVLPTG

SEQ ID NO: 36044 - protein, 494 aa, Archaeoglobus fulgidus DSM 4304
MIEENLVEFIEILMLATAVAVTVKFIRLPYTIALVLAGLFVGLAGLLPEVPLSREIVFFIFLPPLLFEAAMNMDLKELRENFGPIALIAFLGVVVTTTVVGFSLNWILGIPLALALIFGAMVSATDPVSVLATFKSISAPKKLSILIEGESVLNDGAAIVVFAIALEMMLKGVFDPLNAALDFAVVCVGGAAVGLAVGYLAYRILAKIDDALVEIAVTIVAAYLGFVLAERFHFSGVIAVVAAGLILGNYGRDFSMSPTTRVIMLDFWSVIVFLVNSIIFILIGVNTHITIFSAWKEILVAIAAVILARAFVVYPVMTYYRFPNLWKHVVFWGGLRGVIPVALALSFGNQLLSAMAFGVVLFSLLLQGISLEIFVKRKFVSESERELEEIIARYIAARSAKFELMKAVEQGRIVEPVAREMLPNLDAEIEELRSKLEEKIRGGMGSKLRKAAVKYVIDAKKSAVVDAMAGGLVSQEVALEIMRELDSKTAELME

SEQ ID NO: 36045 - protein, 406 aa, Zea mays
  misc_feature (54)..(54): Xaa can be any naturally occurring amino acid
MASNGCNGNGNGNGNGKAAPAGVVVPEIKFTKLFINGEFVDAASGKTFDTRDPXYQGYTLKEPIGVVGVIIPWNFPTMMFFLKVSPALAAGCTVVVKPAEQTPLSALYYAHLAKMAGVPDGVINVVPGFGPTAGAALASHMDVDSVAFTGSTEVGRLIMESAARSNLKTVSLELGGKSPLIIFDDADVDMAVNLSRLAVFFNKGEVCVAGSRVYVQEGIYDEFVKKAVEAARSWKVGDPFDVTSNMGPQVDKDQFERVLKYIEHGKSEGATLLTGGKPAADKGYYIEPTIFVDVTEDMKIAQEEIFGPVMSLMKFKTVDEVIEKANCTRYGLAAGIVTKSLDVANRVSRSVRAGTVWVNCYFAFDPDAPFGGYKMSGFGRDQGLAAMDKYLQVKSVITALPDSPWY

SEQ ID NO: 36046 - protein, 434 aa, Streptococcus thermophilus LMG 18311
MSIITDVYAREVLDSRGNPTLEVEVYTESGAFGRGMVPSGASTGEHEAVELRDGDKARYGGLGTQKAVDNVNNVIAEHIIGFDVRDQQGIDRAMIALDGTPNKGKLGANAILGVSIAAARAAADYLEVPLYSYLGGFNTKVLPTPMMNIINGGSHSDAPIAFQEFMIVPAGAPTFKEALRWGAEIFHALKKILKERGLETAVGDEGGFAPRFDGTEDGVETIIKAIEAAGYVPGKDVFIGLDCASSEFYDAERKVYDYTKFEGEGAAVRTAAEQIDYLEELVNKYPIITIEDGMDENDWDGWKALTERLGDKVQLVGDDFFVTNTAYLEKGIAEHAANSILIKVNQIGTLTETFDAIEMAKEAGYTAVVSHRSGETEDSTIADIAVATNAGQIKTGSLSRTDRIAKYNQLLRIEDQLGEVAEYRGLKSFYNLKK

SEQ ID NO: 36047 - protein, 328 aa, Bacillus cereus E33L
MKAIVVTSFGGPEVMKYTDVDIPAISEDQVLIRVVATSANFADIKSRYGKKGNKALPFIPGIDAAGIVERVGSHVKNIYPGQRVIAFPQNGSYAEYVVANENLTFALPDEVDFQTAAACPIVSFTSYNLLANVARLQQGESVLIHAAAGGIGTTAIQLAKLLGAGTVIGTVGSEAKKEIALDAGADYVIGHQDEDFVEKVNELTNGEGVDVILDSISGTVSERSLKCLAYYGRLIHFGNASGEIGNFQTKDLHASCRSILGFSFGTTRKKRPELLQKTANEVFRYLRDGRLQIKATKSFPLQDAGKAHEWVESRKSTGKVILTVQSSS

SEQ ID NO: 36048 - protein, 326 aa, Bacillus cereus G9241
MQKETAIIIGGGPCGLAAAISLQKVGINPLVIEKGNIVNAIYNYPTHQTFFSSSEKLEIGDVAFITENRKPVRNQALAYYREVVKRKSVRVNAFERVEKVQKDGEVFQVETTKRDGNKEIYIAKYIVVATGYYDNPNYMNVPGEELQKVAHYFKEGHPYFDRDVVVIGGKNSSVDAALELVKAGARVTVLYRGSEYSPSIKPWILPEFEALVRNGTIHMHFGAHVKEITEHTLTYTVDGEAYTIQNDFVFAMTGYHPDHSFLTKMGVRIDEETGRPIYAEDTMETNAENIFIAGVIAAGNNANEIFIENGRFHGDALAQTIATREM

SEQ ID NO: 36049 - protein, 310 aa, Bacillus cereus G9241
MEEDKETGVVQPGEKNPLLKFIPDLEGDVDLIVEDVFHLPSPHMTPSEMLQLQVIIDERVKQDNIHGVVITHGTDTLEETAYFLDLTVQATIPIVVTGAMRSSNELGADGLYNFLSAVKVASSSEAAEKGVLVVLNDEIHCATNVTKTHTSNVATFQSPQYGPIGMVTKRGVVFHHALVHHETYSVNKVSKNVVVLKAYAGMDDTLLAAIENLPVDGIVIEALGQGNLPPRTLPSLERLINNGIPIVLVSRCFNGIVQDVYSYEGGGKQLKDMGIVFTYGLNAQKARIKLLVALENTTSHEAIQNMFMHN

SEQ ID NO: 36050 - protein, 131 aa, Triticum aestivum
  misc_feature (102)..(102): Xaa can be any naturally occurring amino acid
MAATIQSVKARQIFDSRGNPTVEVDVCCSDGTFARAAVPSGASTGVYEALELRDGESDYLGKGVSKAVDNVNLIIAPTLIGKDPTAQTELDNFMAQQLDGTXNEWGWCQHKLGANAILVEPLAIFKAWPQH

SEQ ID NO: 36051 - protein, 86 aa, Leptospira interrogans serovar Lai str. 56601
MSVNIYVGNLSYDLNEGTLGDLFRAHGTVNSVKIIMDQYSGKSKGFGFVEMPNKEEADKAIKDLDGKNVLTRNLKVNVAKPKNERF

SEQ ID NO: 36052 - protein, 436 aa, Haemophilus influenzae Rd KW20
  misc_feature (28)..(28): Xaa can be any naturally occurring amino acid
MAKIVKVIGREIIDSRGNPTVEAEVHLXGGFVGLAAAPSGASTGSREALELRDGDKSRFLGKGVLKAVAAVNNEIAQAIVGKDATNQAEIDQIMIDLDGTENKSNFGANAILAVSLANAKAAAASKGLPLYAYIAELNGTAGVYSMPLPMMNIINGGEHADNNVDIQEFMIQPVGAKTLREALRIGAEVFHNLAKVLKAKGMSTAVGDEGGFAPNLASNADALACIKEAVEKAGYVLGKDVTLAMDCASSEFYNKENGMYEMKGEGKSFTSQEFTHYLEELCKEYPIVSIEDGQDESDWEGFAYQTKVLGDRVQLVGDDLFVTNTKILKEGIEKGIANSILIKFNQIGSLTETLAAIKMAKDAGYTAVISHRSGETEDATIADLAVGTAAGQIKTGSMSRSDRIAKYNQLIRIEEALERAGTPAAFPGLKAVKGQA

SEQ ID NO: 36053 - protein, 336 aa, Nostoc punctiforme PCC 73102
MIKVLVTGAAGFIGFHLSQRLLARGNEVFGLDNLNDYYDVNLKKARLAKLQDNSSFKFYQVDLADRESMAMLFAEEGFDVVANLAAQPGVRYSLKNPHAYIDSNVVGFINVLEGCRHSRVKHLVFASSSSVYGANTKVPFSVHDKVDHPVSLYAATKKANELMAHTYSHLYGLPTTGLRFFTVYGPWGRPDMAPFLFTKAILAGESINVFNYGQMRRDFTYIDDIVEGVIHVIDKIPKPNSSLSEKASDSEISNAAYKLYNIGNNQSVELMRFIEVIENCLGMKAEKNLLPMQPGDVPVTYADVDDLATDVGFRPNTPIEVGVERFVSWYRSYYQV

SEQ ID NO: 36054 - protein, 413 aa, Alteromonadales bacterium TW-7
MSDFREQALHYHSHPVPGKISIELTKPAETVKDLALAYSPGVAEPVREIAADPANAYKYTGKGNMVAVITNGTAILGLGNLGPLASKPVMEGKALLFKRFAGLDSIDIEVKHRTTEDFINTVANIADTFGGINLEDIKAPECFEIEKALIERCSIPIFHDDQHGTAIVTAAGMLNALEVQGKSIENATIVCLGAGAAAVACMELLIKCGALREHIYMLDRKGVIHTRRDDLNEYKKLFANNTDKRTLQDVIEDADVFVGVSGPNLLAADDLKLMAEKPVVFACSNPDPEIDPALAHSARNDLIMATGRSDYPNQVNNVLCFPFIFRGALDVRASAINDEMKIAAVEAIRSIAKEPVPAEVLTAAGVDKLEFGDKYIIPKPMDPRLLPRIAKAVAIAAVESGVAQIDLPENYME

SEQ ID NO: 36055 - protein, 1140 aa, Vitis vinifera
MGSVLEGVFPYRALGEESSSSSSNPTDAVIFVGICLVMGIACRQLLRGTRVPYTVALLILGIALGSLEHGTSNKLGKIGDGIRLWANIDPNLLLAVFLPALLFESSFSMEVHQIKRCMVQMLILAGPGVLVSTFCLGSALKFTFPYDWSWKTSLLLGGLLSATDPVAVVALLKELGAGKKLSTIIEGESLMNDGTAIVVYQLFYQMVLGKSFNFGAVVKFLTQVSLGAVGIGLAFGLASVLWLGFIFNDTVIEITLTLAVSYIAYFTAQEGADVSGVLAVMTLGMFYAAVAKTAFKGDGQQSLHHFWEMVAYIANTLIFILSGVVIAEGVLGSNDIFKNHGRNSWGYLILLYVYVQVSRIVVVGVSYPFLWYFGYGLDWKEAIILIWSGLRGAVALSLSLSRASDSSSYLSSETGTLFVFFTGGIVFLTLIVNGSTTQFILHLLNMDKLSEVKRRILDYTKYEMLNKALEAFGDLGDDEELGPADWPTVKRYIASLNDVEGGLVHPHTVYESDNNLYPTNLKDIRIRLLNGVQAAYWRMLDEGRITQTTANLLMQSVDEALDLVSDEPLCDWKGLKANVNFPNYYRFLQTSICPQKLITYFTVERLESACYICAAFLRAHRIARRQLLDFIGDSEIASTVINESEAEGEEARKFLEDVRVTFPQVLRVVKTRQVTHSVLLHLIDYVQNLEKIGLLEEKEMFHLHDAVQTDLKKLLRNPPLVKIPRMRDMITTHPLLGALPSAVREPLESSTKEIMKVRGVALYREGSKPSGIWLISSGVVKWASKSIRNKHSLRPTFTHGSTLGLYEVLIGKPYICDMITDSVVLCFFVETDKIMSMLRSDPAVEDFLWQESAIVLAKLLLPQIFEKMAMQDLRALVAEKSIMTIYISGETIEIPHYSIGFLLDGFIKGQEELITYPAALMPSHNLSFRSLDTSGAKVAGSSHQGSPYQVQTRARVIIFDISAFEADRGLQRRSSSLVPHSADQPSRSLSREHGDLMSWPEHFYKLRQDNQSTEGDRWKSNSLSYKAMQLSIFGSMVGTHQHIRSFQSSRVKPSHSLSYPRVPTTHAPPLVSVRSEGPATARRGIDMGKLTGQNLKPPLQGTPHTKETHEVDDSSEESGVEDELLVRIDSPSKLSFHQAP

SEQ ID NO: 36056 - protein, 1129 aa, Phragmites australis
MGDPDDAVLFVGVSLVLGIASRHLLRGTRVPYTVALLVLGVALGSLEYGTQHGLGKLGSGIRIWANINPDLLLAVFLPALLFESSFSMEIHQIKRCMAQMVLLAGPGVIISTFLLGTAVKLTFPYNWSWKTSLLLGGLLSATDPVAVVALLKELGASNKLSTIIEGESLMNDGTAIVVYQLFYRMVLGRTFDAGSIIKFLSQVSLGAVALGLAFGIVSVLWLGFIFNDTIIEIALTLAVSYIAFFTAQDSLEVSGVLTVMTLGMFYAAFAKTAFKGDSQQSLHHFWEMVAYIANTLIFILSGVVIADGVLQNNVHFERHGTSWGFLVLLYVFVQISRVVVVGVLYPLLRHFGYGLDLKEAAILVWSGLRGAVALSLALSVKRTSDAVQPYLKPEVGTMFVFFTGGIVFLTLILNGSTTQFLLHILGLDKLSATKLRILKYTRYEMLNKALEAFGELRDDEELGPADWVTVKKYITCLHDLGDEPEHPHDVSDKDDRMHTMNLRDIRVRLLNGVQAAYWGMLEEGRINQATANILMRSVDEAMDLVSRQPLCDWKGLQSSVQFPNYYRFLQMSKLPRKLITYFTVERLESGCYMCAAFLRAHRIARRQLHDFLGDSEVARIVIDESNAEGEEARKFLEDVRITFPQVLRVLKTRQVTYSVLTHLSGYIQNLQKTGLLEEKEMVHLDDALQTDLKKLKRNPPLVKMPRVSELLNNHPLVGALPAVSRDLLLSNTKETVRGHGTNLYREGSRPTGIWLVSIGVVKWTSQRLSSRHSLDPILSHGNTLGLYEVLIGKPYICDMITDSVVHCFFIEAEKIEQLRQSDPSIEVFLWQESALVIARLLLPQIFEKMAMHEIRVLIAERSTMNIYIKGEDIELEQNYIGILLEGFLKTKNQNLITPPGVLLPSNTDLNLFGLESSAMNHIDYCYTAPSYQVEARARIIFFEIGRVWETQPDLQRTVSLLAQTHEPPRTLSKEHSGLLSWPESFRKSRGPHNVSFAEMRNQPGSLSARALQLSMYGSMINDMHSGQGQRRQRHRMQATNQKHSSSYPRVPSRPSNARPLLSVQSEGSNMKRMAAPKEAGEAPAPATSAGQRRRKAMEANNFSDDESAGEEVIVRVDSPSMLSFRQPSK

SEQ ID NO: 36057 - protein, 781 aa, Alteromonadales bacterium TW-7
MTQTVHKFGGSSLSSAQRYERVASIILEHTQPGDCVVVSAAGKTTDTLVKLWQSYQQQDTHVVADILLQLNNHQTDLITQLLHADLKRTALRLLHSELTAISELIKNQGLKEAPLLAHGEVWSARLLALYLTQLNINACDLDARTLFTLNNGQLLHTQNAQQCAKFITPDYINVVTGFIASNTLGDTVTLGRNGSDYSATLLANYCHAKQVCIWTDTQGVYSTDPRKVSKAVKYNKVCRGQANLLARLGNPVLHAKTLSPLRNSDIKLSVRSSFDVQATPTDIVKEGNVKQKRFITTLNNIDLLTVEKLAEGEVADVSQLIQHSIHHFSQNGETYLVVPSASTYKVVSYFEGRANISESSLNGCAVVAPVNDISKLNVLAIDTLNAHAIEPRFTHQDSGYILLLTDQVIDSDILSVLHDKLINKGQEVALIIAGLGNVGEVFIEQLSAQFERFSDDFTIKLVGLIRSETLLFNPSGINIADWKKHFLSQSKVYNNQTLLNIISELDYEHKVVVDITASEAFSQLYPEFVALDCHLISANKYAGTADTAWYKALRTSISERNLHWRYNTSVGAGLPVNFALADLQNSGDKITRIEGVFSGTLSWLCSKFDGTIPFSDLVLEAQKMGFTEPDPREDLSGRDMQRKLLILARELGLELDLDAISLSALMPETLAIGGWDDFLANESTLNDFIDAHAANAKAQSSVLRYTGLLEITENKVTAQVGITYTPIGDALANLTPGDNIFVINSKWYSANALVIQGPGAGKEVTAAGIHSDLYWLVQNIK

SEQ ID NO: 36058 - protein, 780 aa, Sulfolobus acidocaldarius
MRINILRVEYHSKTAHSILLQLDLFKKVKVICHMSQSIKFRVTEARQRDVGKKVARISETSMRKLNVEAGDYIEIIGQDGNSALAQVMPAYDISDDEIRIDGYIRKSIKVGIGDDVTVRKTNVSPASKVVLAPTQPIRFDNSFVEYVKDTLMDKPLAKGETLPIPIYTGTLELTVVNTQPSNYVYVTGSTNIEIREEPVKESSLAYPKVSWEDIGDLEEAKQKIREIVEWPMRHPELFQRLGIDPPKGILLYGPPGTGKTLLARALRNEIGAYFITVNGPEIMSKFYGESEQRIREIFKEAEENAPSIIFIDEIDAIAPKREDVTGEVEKRVVAQLLTLMDGIKGRGRVIVIGATNRPDAIDPALRRPGRFDREIEIRPPDTKGRKDILQVHTRNMPITDDVDLDKLAEMTYGYTGADLAALAKEAAIYALRRFVDEKKLNLDQPTIPAEIIKELKVSMNDFLNALKSIQPSLLREVYVEVPKVNWNDIGGLDNVKQQLREAVEWPLRFPELFTKSGVTPPKGILLFGPPGTGKTMLAKAVATESGANFIAVRGPEILSKWVGESEKAIREIFRKARQAAPTVIFFDEIDSIAPIRGLSTDSGVTERIVNQLLAEMDGIVPLNKVVIIAATNRPDILDPALLRPGRFDRLIYVPPPDKTARFEILKVHTKNVPLAEDVSLEDIAEKAEGYTGADLEALVREATINAMRSIYSMCDKQSRDECKGNMECYQKHIKECMNKTSFKVSKEDFEKALNVVKASLTQADIQRYERFSKELKRAIA

SEQ ID NO: 36059 - protein, 157 aa, Zea mays
MSSPSKRREMDLMKLMMSDYKVEMVNDGMQEFFVEFKGPAESIYQGGVWKVRVELPDAYPYKSPSIGFINKIYHPNVDEMSGSLLLYPNPSDPLNGEAAALMMRDRPVYEQKVKEYCEKYAKPEDAGITPEDKSSDEELSEEEDDSGDEAILGNPDP

SEQ ID NO: 36060 - protein, 303 aa, Populus trichocarpa
MATDNTEISHDFPSFFKVYKDGRVERYWNTDSVEAGVDTETGVQSKDVVISPEANVKARIFLPKIDGPAKKLPLLVHYHGGGFCLGSPFASAFKTFLSTLATQANVIAVSIDYRLAPEHKLPTAYDDSLAGLRWIAEHSDGKGPEPWINEHADLGRVILAGESAGGTLAHYVAVQAGAAGLGGVAIKRLLIVHPYFGAKEPDKFYQYMCPTSSGTDDDPKLNPAVDPDLLRLKCDAVLVCVAEKDMLKGRGLAYYGAMKKSGWGGTVDLHETKGEDHCFHFFNPKSENIGPLMKKMVDFIQLN

SEQ ID NO: 36061 - protein, 494 aa, Chlamydomonas reinhardtii
MQQEGCAINIKRVACIGAGYVGGPAMAILAYKCPDVTVTVLDISDARVQAWNSDQLPIYEPGLTDLVKACRGVNLFYSTDAKKHLAEADLIFVCVNTPTKLQGVGAGKAATFGFWEAAARLIAASCQGCGPKIIAEKSPVPVKTAQAMSRVLSGCQDGEKTRFEVISNPEFMSAGSAVEDCLKPDRVLIGGRDTPEGRAAVESLARLYRRWVPPDRVLSMGLWSSELAKLAANAFLAQRISSINAISALCEETGADVQQVSHAIGTDSRIGPRFLSAGCGFGGPALQKHVLNLVYICESLGLAQAAAYWQQASRAGGQGPRVVDMNDWIKARFVRRVITSMFNTIRGKRIAVLGFSYKAHTTDTRDTASIDVCRGLLLDGAALSVYDPKVTPEQIHLDMCLPKGSLEQPRRQHTAVSLATVDVARSAMEACRGAHGVCVLTDWPEFRRLDFHAIFKAMMKPAFIFDGRNVLDHARLREIGFVVYALGKPLDPFL

SEQ ID NO: 36062 - protein, 371 aa, Candida albicans SC5314
MLIKSNYNCINIKRFLLNQTRVSVTASNSFSFYFYFKPYKFNCYKSYSTMSTTTPTIKLNSGYEMPIVGFGCWKVTNATAADQIYNAIKTGYRLFDGAEDYGNEKEVGEGINRAIKDGLVKREELFIVSKLWNNYHSPENVEKALNKTLTDLNLEYLDLFLIHFPIAFKFVPLEEKYPPGFYCGDGDKFHYENVPLLDTWKALEKLVNLGKIKSIGISNFNGGLIYDLIRGATIKPAVLQIEHHPYLQQPRLIEFVQNQGIAITAYSSFGPQSFLELQSKRALDTPTLFEHETIKSIADKHGKSPAQVLLRWATQRNIAVIPKSNNPDRLAQNLAVVDFDLTEEDLQAISKLDIGLRFNDPWDWDKIPIFV

SEQ ID NO: 36063 - protein, 154 aa, uncultured marine gamma proteobacterium EBAC20E09
MIINLICIGSKPKASEKESIEYYTKQLPKNFNVNFTYLKNLSSSKLSTKEIIKKESAILLNNIPQESYVISWDLEGKQISSADFANLIKQKIQSKKSISFLIGGSHGFTNEVKSKSDMVLSASLLTFPHKLFRLILVEQIYRAHTIIANMPYHK

SEQ ID NO: 36064 - protein, 506 aa, Myxococcus xanthus DK 1622
MIYAAPNQPGSKVQFKPRYQNFIGGRWVEPTRGQYFENISPVTGKPFCEVARSTAEDIEKALDAAHAARLSWGRTSPTARANILNKIADRMEQNREMLAVAETWDNGKPVRETLAADIPLAIDHFRYFAGCIRAQEGGVSELDHDTVAYHFHEPLGVVGQIIPWNFPLLMAAWKLAPALAAGNCVVLKPAEQTPSSILLWTELIQDLLPEGVLNVVNGFGVEAGKPLASSPRIAKVAFTGETSTGRLIMQYASENLIPVTLELGGKSPNIFFEDVMAQDDDFFDKSLEGFAMFALNQGEVCTCPSRSLISERIYSQFMEKALDRVRKVKPGNPLDTDTMVGAQASNDQLEKILSYIDIGKKEGAKVLIGGERVALSGDLKDGYYVAPTVFQGHNRMRVFQEEIFGPVVSVATFKDFDDAIRQANDTLYGLGAGVWTRDGNTAYRAGRAIEAGRVWTNCYHIYPAHAAFGGYKQSGIGRENHRKMLDHYQQTKNLLVSYSPKAMGFF

SEQ ID NO: 36065 - protein, 124 aa, Pyrococcus horikoshii OT3
MMAKPSYVKFEVPKELAEKALQAVEIARDTGKIRKGTNETTKAVERGQAKLVIIAEDVDPEEIVAHLPPLCEEKEIPYIYVPSKKELGAAAGIEVAAASVAIIEPGKARDLVEEIAMKVRELMK

SEQ ID NO: 36066 - protein, 568 aa, Candida albicans SC5314
MVLSKHIDALRLESQILKKTPQAQLRKEAFIDAYDSHKNIPQFEIPQNSSNEQLIYKYLSQELALDGIPTLNLASFVNTYVDDTSARLIQDNLTKNLADNDEYPSLIDIQTRCISILSNLWHAPGKVDKVTGNRVTNSIGTATTGSSEAIMLAGLALKKRWQLKRKAEGKSTDNPNILMATCAQVALEKFACYFDVENRLIPVTEESGHLIDVSKIKENIDENTIGIFVIMGSTFTGAFEPVEEISKLLDEVEKERGLDIRIHVDGASGGFVAPFIFPHLKWDFAVPRVDSINTSGHKFGLTSVGLGWVIWKDADLLPKELRFSLDYLGGVEETFGLNFSRPGFPVITQYYNFLSLGRQGYAKIFDGCMTNARLLSRFLEESKYFDVVSVIHHKLSDSEKKAQFIREVDDKKLDSKLYTINEEFKPGLPVVAFRFSKEVRDKYPELPQELLSTLLRKRGYIIPNYHLPPSENDKEILRVVVRNSLSLNLLERLIQDITDATELLIKAADSIADYVSTSGEHTDVENRERIHKLLAAIASGGVAEVKEEKHKKDNHQGSKNKKSYRGTC

SEQ ID NO: 36067 - protein, 436 aa, Streptomyces kasugaensis
MSDSVLLSARQPLPPIDYSHAAGAWIHTAEGDSLLDAASGLVCVNIGHAHPHVVEQITRQARTATFASPGVLLPAVQEELAGRLTEAVNRPGDGVSLACSGTSAVELAISYARLIQRSRGQDGRHHILTARLGYHGNSALTLGLSGHRRRRPHPDDALGLAPAFDPPYPGHHRDCPHDRCRASCADAVAEAIDRRGPESVAAVLIEPVNGTTGGAYTPPPGYLAALRRACHERGVLVIHDEVLTGLGRTGLPLGADHCTDAAADIVVLSKGLSAGYLPLAAVLVNPEGVARLRSGPRPLPLMGTMSATPLQAAAGLAVLDVLGEIGALDSTRVRGGDVAAAVRAVAALPVVQETRGVGYFHAVELAPGTQAAALAAARDERLLLYPFNGFHADGTGEGLIVAPPLNSTPSEVEFLAQGLRRALERTAARSEDRSHR

SEQ ID NO: 36068 - protein, 438 aa, Pyrococcus horikoshii OT3
MLILNNMKANDIIKRYSKVIAQANKMHYFPLVPVKAENAKVWDINGKEYIDFLSDAAVQNVGHNNPRVVKAVKEQVDKLMHASYIYAYPIEPLLLAEKLAEIAPIDNPKVSFGLTGGDANDAAIKFARAYTKRQTILSYMKSFYGSTYGAMSLTGLDFRVRAIVGELSGVHYLPYPYCYRCPFGKEPGSCKMECVEYIKEKFEGEVYAEGVAALFAEPIQGDSGIVVPPKNYFKKVTKILREHGILLVVDEIQSGMGRTGKWFAIEHFGVKPDIITVGKALGGGLPISATIGKAEIMDSLPPLSHAFTLSGNPTTSRAALAVIEEIEEKNLLRRAEKLGNYAMKRLREMMDKHELIGDVRGIGLMIGVELVKDRETKERAIEETSKVIERAFDLGLIVTHFSGNVLRIEPPLTIERETLDEGLDVLEKAIEDVEEGRV

SEQ ID NO: 36069 - protein, 372 aa, Annona cherimola
YETDPYHPITNPRGVIQMGLAENQLCSDLIEEWVRRNPSSSICTPEGASEFKEIAIFQDYHGLPAFRKAVANFMEKVRGGRAKFDPDRIVMSGGATGAHELIAFCLADPGDAFLVPTPYYPGFDRDLRWRTGVQLVPVECHSYNNFKVTRSALEAAYMKAQEENIRVKGLLITNPSNPLGTILDRETLESIISFINEKSIHLVCDEIYAATVFSSPPFVSIAEILTDVPHCNLDLVHIVYSLSKDLGLPGFRVGVVYSYNDHVVRIGRKMSSFGLVSTQTQHLIASLLSDDAFVNKFIVESARRLAERHSTFTRELARVRISCLKSNAGLFCWMDLRALLKEPTVEGEMELWHTIVNVIKLNVSPGASFHCS

SEQ ID NO: 36070 - protein, 91 aa, Glycine max
  misc_feature (13)..(14): Xaa can be any naturally occurring amino acid
  misc_feature (20)..(20): Xaa can be any naturally occurring amino acid
IYGSLQVHAFSVXXDPDYFXNFAQGLLDGLKAGVSSRDIVHIQNAKGLGYAMNTSEELNFVKEVAATIFVVLDPVYRYLFVPYIVYSLSAL

SEQ ID NO: 36071 - protein, 267 aa, Haemophilus influenzae Rd KW20
MNPMLNIAIRAARKAGNVIAKNYERRDAIESTQKGINDYVTNVDKASEAEIIEVIRKSYPDHTIITEETGAIEGKDSDVQWIIDPLDGTRNFMTGLPHFSVSIAVRVKNRTEVGVVYDPIRNELFTAVRGEGAKLNEVRLRVDSKREIQGSILATGFPFKQPKLMPAQFAMMNALIEDAADFRRTGSAALDLCYVASNRIDGYFEMGLKAWDCAAGDLIVREAGGLVCDFDAGNSYLRSGNIIAAPSRVIKEMLNKIRPCLGAEFNH

SEQ ID NO: 36072 - protein, 587 aa, Oryza sativa Japonica Group
MESNGGGGGSPKEAAVVVPSSGDATLGGHLARRLVQVGVSDVFAVPGDFNLTLLDHLIAEPGLRVVGCCNELNAGYAADGYARARGVGACAVTFTVGGLSVLNAIGGAYSENLPLICIVGGPNSNDYGTNRILHHTIGLPDFSQELRCFQPLTCYQAVVNNLDDAHDQIDRAISTAIRESKPVYISVSCNLPAVPHPTFSRDPVPYFLSPRLSNQASLHAALDATLAFLDKAVKPVLVAGPKLRVAKAGGAFVDLADASGHAVAAMPSAKGLVPETLPRFIGTYWGAVSTAFCAEIVESADAYLFAGPIFNDYSSVGYSCLLKKEKAVVVQPDRVTVGNGPAFGCVMMRDFLSELAKRVRKNTTAFDNYKRIFVPEGQLPECEAGEALRVNVLFKHIQRMIGGTEIGAVMAETGDSWFNCQKLRLPEGCGYEFQMQYGSIGWSVGALLGYAQAVQKRVVACIGDGSFQVTAQDVSTMLRCGQRSIIFLINNGGYTIEVEIHDGPYNVIKNWDYVGLVNAIHNGEGRCWATRVRCEEELEAAIATATGDKADSLCFIEVVAHKDDTSKELLEWGSRVSAANSRPPNPQ

SEQ ID NO: 36073 - protein, 495 aa, Vitis vinifera
MVLSKTASESDVSVHSTFASRYVKASLPRFKLPENSIPKEAAYQIINDELMLDGNPRLNLASFVTTWMEPECDKLMMAAINKNYVDMDEYPVTTELQNRCVNIIAHLFNAPLEDSEAAVGVGTVGSSEAIMLAGLAFKRKWQNKRKAEGKPYDKPNIVTGANVQVCWEKFARYFEVELKEVKLRDGYYVMDPEKAVEMVDENTICVAAILGSTLNGEFEDVKLLNDLLVEKNKQTGWDTPIHVDAASGGFIAPFLYPELEWDFRLPLVKSINVSGHKYGLVYAGIGWVVWRSKEDLPEELIFHINYLGADQPTFTLNFSKGSSQVIAQYYQLIRLGFEGYRNVMENCQENAMALKEGLEKTGRFNIISKDNGVPLVAFSLKDNSCHDEFEVADMLRRFGWIVPAYTMPPDAQHVTVLRVVVREDFSRTLAERLVFDITKVLHELDMLPAKLSAKISVEEKKQNGTILKKSVIETQREITDAWKKFVMAKKTNGVC

SEQ ID NO: 36074 - protein, 476 aa, Vitis vinifera
MPEKSIPKEAAYQIVHDELLLDGLPRLNLATFVTTWMEPECDKLMAEAINKNYVDMDEYPVTTELQNRCVNMIAKLFNAPSADQTKQAVGVGTVGSSEAMMLAGLAFKKKWQNKRKAQKKPFDKPNIVTGANVQVCWEKFARYFEVELKEVKLREGYYVMDPVKAVEMVDENTICVAAILGSTFNGEFEDVKLLNTLLTQKNKRTGWDTPIHVDAASGGFVAPFLYPELEWDFRLPLVKSINVSGHKYGLVYAGVGWAIWRSKEELPEELIFHINYLGGDEPTFTLNFSKGNQVIAQYYQFLRMGFEGYKKVMSNCMESARILREGLEKTGRFQIISKEKGVPVVAFAFKGNDRKNLAFGLSKALRNYGWIVPAYTMPANAENVTVLRVVVREDFGRQLVEKLLFHIGVALKEVTDAASSVPMIRLTVEMKADESEMNAGEGTLHIPAASVHWKHDKPETVDTQVPIMDGKTKGVC

SEQ ID NO: 36075 - protein, 465 aa, Chromobacterium violaceum ATCC 12472
MSLMRKKSVQGMLAAAQTSRGLRKELSAFDLTMLGIGAIIGTGIFVLTGTGATIAGPGLVLSFVISAFACGFAAMCYAEFASMLPISGSTYTYAYATLGELIAWIIGWDLLLEYLLASSAVSVGWSGYFQSLLSGFGVTLPQALTAAAGSVPGKETLFNLPAFCIAMIITALLAFGIKESKRVNNIVVLIKVAVVVLFIAIGVWHVKPANWQPALPFGFSGVFHGAAIVFFSFIGFDAVTCAAEEVKNPAKDIPRGVIWSLVVCSILYVVVAAIMTGIVPYMNFAGVDHPVSLALQVAKLDWFAGFVDLGAILGMMTVILVMTYGQTRILFAMSRDGLLPKIFSEVNPKYGTPYKATWLIGTIIALLAGFVPLHTLAELVNIGTLAAFTLIALSVIVLRKREPDLPRKFVCPAVPTIPALAILCCGFLMTQLSLLTWTCFAAWLLIGLVVYFGYSRRNSLLHNPA

SEQ ID NO: 36076 - protein, 224 aa, Oceanobacillus iheyensis HTE831
MNEQDKLKKAVGEKAATMVKDGMKVGLGSGSTVYWMIRSLGERIQQDGLKIEGIPSSNQTATWAEEAGIPLTDFSNVKELDITIDGADEVDANNHLIKGGGAALFREKIIAQAAKEFVIIVDQSKVVETLGEFSLPVEVLPFSWQRTANEISKLGCVPTVRVHEEEPLVTDNGNYILDCPFKVIPHPDKLNKEIKSIVGVIETGLFIDMATTVIVGEKDNIYIK

SEQ ID NO: 36077 - protein, 291 aa, Brassica napus
MAEHLASIFGTEKDRVNCPFYFKIGACRHGDRCSRLHNRPTISPTLLLSNMYQRPDMITPGVDPQGQPLDPSKIQAHFEDFYEDIFEELDKFGEMESLNVCDNLADHMIGNVYVLFKEEDQAAAALKALQGRFYSGRPIIADFSPVTDFREATCRQYEEDNCNRGGYCNFMHVKQISRELRRKLFGRYRRSYRRGSRSRSRSRSVSPRRKRERGERGGDVRERGDVRERDRHGNGKRSSDRSERHDRDGGGGGRRRHGSPRRSRSPVVVREGSEERRARIEQWNKERDEGV

SEQ ID NO: 36078 - protein, 573 aa, Vitis vinifera
MSELSPKLGQNGTIKNIDSSSTVAETEDIDFSKLSERPRPLTMERQRSYDERSFLSELSVGMSPRLSIRNIDSYSRNIDHLDTVFSPCRRSGFNTPRSAMDFEPHPMFAEAWEGLRRSLVFFRGKPVGTIAALDNSDEELNYDQVVFVRDFVPSALAFLMNGEPEIVRNFLVKTLRLQSWEKKVDRFQLGEGVMPASFKVLHDPVRNSDTLIADFGESAIGRVAPVDSGFWWIILLRAYTKSTGDSTLAELPECQKGMRLILTLCLSEGFDTFPTLLCADGCCMIDRRMGVYGYPIEIQALFFMALRCALLLLKQDDQGKEFIERIVKRLHALSYHMRSYFWLDMKQLNDIYRYKTEEYSHTAVNKFNVIPDSIPEWIFDFMPTYGGYFIGNVSPARMDFRWFCLGNCVAILSSLATPEQSTAIMDLIESRWEELVGDMPLKVCYPAIEGHEWRIVTGCDPKNTRWSYHNGGSWPVLLWLLTAACIKTGRPQIARRAIELAESRLVKDSWPEYYDGKLGRFIGKQARKFQTWSVAGYLVAKMMLEDPSHLGMISLEEDKQMKPLIKRSASWTF

SEQ ID NO: 36079 - protein, 171 aa, Triticum aestivum
  misc_feature (119)..(119): Xaa can be any naturally occurring amino acid
NKFVQKSRLVPVRNSRDIVDPRVRWSVGALLGYAQGASDKRVIACIGDGSFQVTAQDVSTMLRCEQNSIIFLINNGGYTIEVEIHDGPYNVIKNWNYTALVEAIHNGEGKCWTAKVKCXEELTAAIETALGEKKDSLCFIEVIAHKDDTSKELLEWGSRVSAANSRAPNPQ

SEQ ID NO: 36080 - protein, 666 aa, Burkholderia xenovorans LB400
MISPLEMTLFLLLASVAGVVTFRFLNLPPMLGYLTVGIVVGPHAFGLIPDSAGAQNLAEFGVVFLMFSIGLEFSLAKLRSMRRLVFGLGLLQVLGTIAVAVTLGFVLERWVHITWQASVALGGALAMSSTAIVSKMLAERLEIETEHGRNIFGVLLFQDLAVVPLLIVIAALGGSSKDLVSSLGVAAIKIVVALSLLLIVGQRFMTRWFNVVARRRSQELFILNLLLVTLGCAFITDKFGLSLALGAFIAGMLIAETPYRHQVEEDIKPFRDVLLGLFFITTGMLLNPRVIWEHPLIVLGFLVGPILLKAVMITGLSRLFGASPGVAMRTGIGLAQAGEFGFVLLNLILDKHLVDATLLQAILAAMLLSMLAAPFLIQNADRIVLRLSSTEWMMQSLQMTRIATQSLKQSGHVIICGYGRAGQNLARMLEHEGLSYVALDLDPDRVAAAAAAGESVVFGDAGRRESLLAAGIHRAAAIAITYANTPSALRVLHNIHELEPTLPVIVRTVDDADLEKLLAAGATEVIPEIVEGSLMLASHTLVVMGVPMRRVVRRVEEMRDERYALLRGYFHGADDVDDDDGHEQVRLQSVPVDENSDAVGRTLAELGLFEVGVEVTAIRRHGIRGVEPDPSTKLRSSDIVVLRGLPEQLAEAEERLSKHRRAGAAA

SEQ ID NO: 36081 - protein, 227 aa, Alteromonadales bacterium TW-7
MFSPEQKYLIAPSILSADFAKLGEDVDSVLAAGADVVHFDVMDNHYVPNLTIGPMVCKALRDYGITAPIDVHLMVKPVDSIIPQFAEAGASIITFHPEASEHIDRTIQLIKDHGCKAGLVFNPATSLSYLDHVIDKLDTILLMSVNPGFGGQSFIPHTLKKLAQAKQRIVESGRDIRLEVDGGIKVDNIAAAAQAGADMFVAGSAIFNQPDYKVVVDQMRKQLESVK

SEQ ID NO: 36082 - protein, 573 aa, Vitis vinifera
MSELSPKLAQNGTIKNIDSSSTVAETEDIDFSKLSERPRPLTMERQRSYDERSFLSELSVGMSPRLSIRNIDSYSRNIDHLDTVFSPCRRSGFNTPRSAMDFEPHPMFAEAWEGLRRSLVFFRGKPVGTIAALDNSDEELNYDQVVFVRDFVPSALAFLMNGEPEIVRNFLVKTLRLQSWEKKVDRFQLGEGVMPASFKVLHDPVRNSDTLIADFGESAIGRVAPVDSGFWWIILLRAYTKSTGDSTLAELPECQKGMRLILTLCLSEGFDTFPTLLCADGCCMIDRRMGVYGYPIEIQALFFMALRCALLLLKQDDQGKEFIERIVKRLHALSYHMRSYFWLDMKQLNDIYRYKTEEYSHTAVNKFNVIPDSIPEWIFDFMPTYGGYFIGNVSPARMDFRWFCLGNCVAILSSLATPEQSTAIMDLIESRWEELVGDMPLKVCYPAIEGHEWRIVTGCDPKNTRWSYHNGGSWPVLLWLLTAACIKTGRPQIARRAIELAESRLVKDSWPEYYDGKLGRFIGKQARKFQTWSVAGYLVAKMMLEDPSHLGMISLEEDKQMKPLIKRSASWTF

SEQ ID NO: 36083 - protein, 451 aa, Nostoc punctiforme PCC 73102
MVADVFELPAPSVNSIVGHLFELGQDPLGFLTRCRDYGDIVPLQLGLTPSCLIINPEYIEEVLKNRNDFIKSRGLRALKSLLGEGLLSAEGESWFWQRRLAQPVFHQKRINGYSQTMVEYTNRMVQTWHDGETHDIHEDMMRLTLQIVMKCIFSDDIDAGEAKVVADALDVAMQWFESKRRQNFLVWEWFPRPENIRYRDAIAQMDEAIYKLIQERRNGGEKTNDLLTMLMEAKDEQTLQQMDDKLLRDEVATLMLAGHETTANTLSWTWMLLAQNPGVREKLESELNQVLQGKLPTLEDLGQLVYTQQIIKESMRLYPPVPLMGREAAVDTQIGDYEIPQGMAIMISQWVMHRHPKYFENPEAFQPERWTQEFEKQLPKGVYIPFGDGPRICIGKGFAQMEAALLLATIAQRFQIDLVPGYPIVPQPSITLRPENGLKVQLKQIALDTSK

SEQ ID NO: 36084 - protein, 188 aa, Burkholderia xenovorans LB400
MSNALPSAPLDAADYIKSHIRTVPDWPEPGVQFRDITPLLQEPKSLRVLIDLFVQRYIDAKLDYIAGLDARGFIIGPILAYELNLGFIPIRKAGKLPYNRLAQSYELEYGCATVEIHEDACKPGDRVVIIDDLIATGGTMMAGKILLERLGAVVVEGAAIIDLPELGGSKLLRDSGLALYTVTGFEGH

SEQ ID NO: 36085 - protein, 591 aa, Magnaporthe grisea 70-15
MPESDNYEVLEKIGHGSFGVIRKVRRKSDGMVVCRKEISYLKMSQKEREQLHAEFQILSTLHHENIVGYFHREHLKSSQDLYLYMEYCGNGDLGRVIRDLQTKNQYAEESFVWSIFSQLVTALYRCHYGINPPEVGKSLFGPVKSTKPVIPPGTMTILHRDLKPENVFLGEGNLVKLGDFGLAKMIQSQDFASTYVGTPFYMSPEICAAEKYTLKSDIWSLGCIIYELCTREPPFNAKTHVQLVQRIREGKISPIPKHYSPDLMEVIKECLRVNPERRPDTATLLHLPHVKMMRKEKELVDCNRMLKQKQEAIRKELNASLHREWEVKARLEIDRILKEEIAGLEKRFEAEVQKRIEEDRQKRPEMDYQKRFEMDYQKRFEADYQKRFDLEFPKKLEEEMRRRYPDTPGSKMDLSWSVPKPKASKSQSSVEEVSADGDESSGPDQPDLSGTSPDSSFSNSNHNEPKRRPRTPYKRAQTMYAGGGRAAGTPMDIEMVSPSPIAIASLSLSPRRHAATTGSPTKNPFSKRNNVQGRTLVELSKARASGRPLFDKSNLISRSEPVATWNPEIDEMPSPFLVRRKGVMPPVSAGR

SEQ ID NO: 36086 - protein, 795 aa, Rhizobium leguminosarum bv. viciae 3841
MTVAKYFDEMSYGPAPESDIEARDWLARHASGFGHFINGAFVPSASGKNFDTFEPATGKVLAKLANGGATDVDNAVAAARKAQASWARLPGHARARHLYALARMIQRHARLIAVVEAIDNGKPIRETRDLDVPLAARHFYHHAGWAQIQDTEFADHVPVGVVGQIIPWNFPFLMLAWKVAPALALGNAVILKPAEFTSLTALLFAELASAAGLPPGVLNIVTGEGETGALLVGHEDIDKIAFTGSTEVGRVIRERTAGSGKSLTLELGGKSPFVVFDDADIDGAVEGAVDAIWFNQGQVCCAGSRLLVQEGIADLFHERLKRRMETLRVGQPLDKCIDMGAIIAPVQLTRIEALVKKGVSEGATLHQAKIDLPKGGSFYPPTLLSGVQPTSIVATEEIFGPVAVSMTFRTPEEAIQLANHTRYGLAASVWSETIGLALNVAAKLAAGVVWVNATNLFDAAVGFGGKRESGFGREGGREGCYEYLKPKAWVGRKTRAAMPALSQVKPVAGDFALPSIDRTAKLFIGGKQARPDGNYSRVIASPKGKAIGEVGEGNRKDIRNAVVAAQAASAWSNATTHNRAQILYYIAENLSGRADEFASRITAMTGASAANANAEVDAAISRLFTYAAWADKYEGGIHQPPLRGVALAMPEAIGVVGIICPPEAPLLGFISLIAPLIATGNRVVAVPSEAFPLSATDFYSVLETSDLPAGVVNIVTGSAIELAKILAAHNDVDALWAFGSAELSTTVEKLSSGNLKRTFVDNGKATDWMDRAAGEGALYLRRAVDVKNIWIPYGE

SEQ ID NO: 36087 - protein, 310 aa, Rhizobium leguminosarum bv. viciae 3841
MKVGVSILGIFVADTAYLAKRMPNVGETITGTGFAVGPGGKGSNQAVAAARAGGTVSFISKIGRDTFGDMALKTYAEAGVTPKVVQMDDMPTGAAFIYVNDGNGDNAIIVYPGAAGTIGIGDVEAARETIEQSAVFVTQLEQPAEAAQRALEIAHAAGVTTVFNPAPAEPFPDTIYPLCDYIVPNETEAAAIVGFPLDTLDDARRAGDALLAKGVKAALITLGGRGVLYHTARQSVHVPAVSSGAVIDTTGAGDAFVGGFSAALSRGASPVEAVRFGCATAGIAVTRRGTAPAMPKIEEIEALLQKGGAA

SEQ ID NO: 36088 - protein, 468 aa, Saccharomyces cerevisiae
MGQILSNPIIDKEHHSGTDCLTAFGLCAMQGWRMSMEDAHIVEPNLLAESDEEHLAFYGIFDGHGGSSVAEFCGSKMISILKKQESFKSGMLEQCLIDTFLATDVELLKDEKLKDDHSGCTATVILVSQLKKLLICANSGDSRTVLSTGGNSKAMSFDHKPTLLSEKSRIVAADGFVEMDRVNGNLALSRAIGDFEFKSNTKLGPHEQVVTCVPDIICHNLNYDEDEFVILACDGIWDCLTSQECVDLVHYGISQGNMTLSDISSRIVDVCCSPTTEGSGIGCDNMSISIVALLKENESESQWFERMRSKNYNIQTSFVQRRKSIFDFHDFSDDDNEVFAITTKKLQDRLNRSKDNDDMEIDDLDTELDSSATPSKLSGEDRTGPIDLFSLEALLEAGIQIRQRPSSDSDGNTSYFHGASLSDMLASLSNAAAGETEPNDADDNDDNDGEENGKNENAKKGSKIEEIE

SEQ ID NO: 36089 - protein, 539 aa, Oryza sativa
MSGSAATLGMRCGSYGSLASAGGGRKGGGRGWGWRGGGEKERLQLLHRALRLVGRRRAGVLLLLAAASAAVFCSIFAVVKDDNASMIIANNYEVANTIQNSVYPSMTRPLMTSSDQFSASSVNKTELPNRLRLSFANFTHHPCEGFSVAPPLVDPKRTGPRPCDVCYVPVDQAFALMPPQPSPSPVLKNLSYVFEDNITANFSNQGSVFGGHPSLEQRNKSFDISESMTVHCGFVRGKKPGQGSGFDINDDDLLEMEKCHEETEAYVKNSSSLYRNNKVGLWRLVVVRNLPYEDPRRTGKIPKLLLHRLFPNVRFSVWIDAKLKLVVDPYLLLERFLWRKNATFAISRHYKRFDVFEEAEANKAAGKYDNASIDYQIEFYRNEGLTYYTPAKLPITSDVPEGCVIIREHIPITNLFTCLWFNEVDRFTSRDQISFSTVRDKIRARVGWMPEMFLDCERRNFVIQGYHRELLEQMIASGWKPPPTASEPSRKLRLGSRKAPPSKKSSMKRKRVKKSSSRRRLPKPITRMTDTTTWQKLGA

SEQ ID NO: 36090 - protein, 605 aa, Oryza sativa Japonica Group
MKKKKNGMGAAADRGRLLALAHHDKLNPTKPSEAQRRFKPSILLLLGSSLPRLVPPLPSSFLPVVIKQTEFHQRWLVGDLNPPPPPCHLLPIQGQGQMQMQQRRKPPPAAAPVAAKQPSPRRTPGPLSFAGALLSLLVVATFLYINDHGNMMPPHASPDPDLRLLQEAAHQKVNSILLSRHAPAPPPRTNTNTSSSDQHLRLINIPMSSDLDLELGGNSTSSSGVEIQFEQQQQQEEKNLRGCELYKGRWVYDAAGREAPLYRESECGFLTEQVTCMRNGRRDDSYQRWRWQPEGCDLPSFDARALLERLRNKRMMFVGDSLNRNQWESMVCLVQSAIPYGQKTLTKFVNNGSLNVFRAHEYNATVEFYWAPFLVQSNSDDPQVHSVRDRVIAWRSIAKHAANWKGVHYLVFNTYIWWLNNFQIKVLKSRGAPFAGSGGWSSRYALVDRAIAYREVLKTWAKWVDRRIDPNKTHVFFMAMSPNHFMPEAWGGSAGAVKCAMETQPIVNRTSGGLDIGTDWRLHGVARGVLRSMRRVGVRFVDITALSELRKDAHTSVHTLRQGKLLTPEQQADPRTYADCIHWCLPGLPDTWNHFLYAHIVAHAA

SEQ ID NO: 36091 - protein, 454 aa, Oryza sativa Japonica Group
MKAPPPPSPVAKRARVSPFVFLLVLFLLLFSFLYGEDLKELLGSQAQARPSLHFNAAAAGDGIELPAATAATTEGRTTTRRWRGRLPFAANGDGEEEEEECDVFSGRWVRDEAARPLYREADCPYIPAQLACEAHGRPETAYQRWRWQPRGCALPAFDAAAMLDRLRGKRVMFVGDSLGRGQFTSLVCLLLAAVPDPAARSFATSPDQQRSVFTAAAYNATVEFYWAPFLLQSNADNAAVHRISDRMVRRGSIGHHGRHWEGADVIVFNTYLWWCTGLQFRILEDGPFDAGGNSSTTTWVSTEEAYAMAFREMLQWAREHMDFATTRVFFTSMSPTHGKSQDWGGGEPGGNCYGETEMIGDAAYWGSDSRRGVMRAIGEVLDGDGADVPVTFLNVTQLSLYRKDAHTSVYKKQWTPPTPEQLADPKTYADCVHWCLPGLQDTWNELLYTKLFYP

SEQ ID NO: 36092 - protein, 522 aa, Nocardioides sp. JS614
MTNHLQTGPSASRRELERRLSDAVPEPRGGRRRTALERAQALCDDGSFAPTGALRQSTSRNADKLHDGDGVVTGFGTVDGRPVAVVSHEFSHSGGSIGSGFALKVADLQDRAISLRMPIVYLNDSGGARINEGIDSLDGCGQMFRRNVRAKGLVPQVSVILGPCAGAAAYSPALTDWTIMVRGTSHMFLTGPDVVRAAIGEEVSSADLGGAELHTIRSGVAHLAVDTEEEAFDRVRELLSFVPTNSADELPLTAPCEPAPQHAREIATVVPRRGSEVFDMHRLVRAVVDGSESFEMMPDYGTSVITAFARLGGVPVGIVASQPHRRGGILEITSSRKIARFVRFCGRFHLPIVTFVDVPGFMPGAAQESGGIIAEGAEVLDAYVDADSPRLTVVARKAYGGAFIAMGSKSLGADFAWAYPDAELAVMGPGGAVNILHRRELAAAEDPELLRARLAEEYRETVTRPFAAAEAGIIDDIIRPEDTRATLLAALRLWHPSAAAAPAKRLVEASNEAASSSRTGAA

SEQ ID NO: 36093 - protein, 162 aa, Blastopirellula marina DSM 3645
MIRIGLGHDTHRLAEGGPLRLGGVDILHDQHLVGHSDADVLMHAITDALLGAANLPDIGEWFPNSAAENRGRDSADFLRFAYHKVNEEGWRIINIDTVIFAQEPKLSPYKEAMRTALANILTIEPAQVGIKAKTGEQVGLVGRREAIQAECVVLLEKIDEFI

SEQ ID NO: 36094 - protein, 522 aa, Oryza sativa Indica Group
MTPEQRLRAADLDAKAASLRRSIHDLRLRVPPPHVAQRLPHLHAHSLASSAALALQLNAHSSTKEQQSSSCNYSSRAGCYLHPYLKLKTSAATCFGSLPPFRIAADLRFPAISAMTTNMRPNDTFNTISHKALQREITLQEENAAYEKAISNCRQKIQEKQMEVTLLRSNLKEMEISEQDLKAQLDNAQNEQYASQNKASAAASDNTGNALMEAESLINLKSNDLKEKNEELAQAEGLIVDVHAKEKELERLNNLHKNLQSRNNDGSVARNPFRAVHEDSDAKAVRRPYQFGLRTEGLKRLMILRSAFVLYILVLHIVVFIKLSVSKQGDTGGGHCRRATTPTPPPSSASLPQGRRQQGLLLPRGRGFGAHDPGQLLGRCQALGEERDGLAAGVEGDGIGGWVDRVAMARRQHWFDALPARSDTLSSGSGLPDAGGQPPVLAATARRRGTAAWWRGRRDAGSGTPRQISPTLSGSGLPGAGGQPRGPAARAWRMRRSRGGSGATVEAGETAGRRYGGDGADI

SEQ ID NO: 36095 - protein, 454 aa, Haemophilus influenzae Rd KW20
MTMITPVQAILASNQHFLDRQDVMESNVRSYPRKLPFAYAKAQGCWVTDVEGNEYLDFLAGAGTLALGHNHPILMQAIKDVLDSGLPLHTLDLTTPLKDAFSEELLSFFPKDKYILQFTGPSGADANEAAIKLAKTYTGRGNIIAFSGGFHGMTQGALALTGNLGAKNAVENLMPGVQFMPYPHEYRCPFGIGGEAGAKAVEQYFENFIEDVESGVVKPAAVILEAIQGEGGVVSAPISFLQKVREVTQKHGILMIVDEVQAGFCRSGRMFAFEHAGIEPDIIVMSKAVGGSLPLAVLAIRKEFDAWQPAGHTGTFRGNQLAMATGYASLKIMRDENLAQNAQERGEYLTNALRELSKEYPCIGNVRGRGLMMGIDIVDERQSKDATGAYPRDCELAAAIQKACFKNKLLLERGGRGGNVVRVLCAVNINQSECEEFIKRFKQSVVDALKVVRS

SEQ ID NO: 36096 - protein, 209 aa, Brucella suis 1330
MRDPIETVMNLVPMVVEQTNRGERAYDIFSRLLKERIIFVNGPVEDGMSMLVCAQLLFLEAENPKKEINMYINSPGGVVTSGMAIYDTMQFIRPPVSTLCMGQAASMGSLLLTAGATGHRYALPNARIMVHQPSGGFQGQASDIERHAQDIIKMKRRLNEIYVKHTGRDYDTIERTLDRDHFMTAQEALEFGLIDKVVEVRDVSADESK

SEQ ID NO: 36097 - protein, 676 aa, Vitis vinifera
MNSSSYIGITTMKPYCRVLTSCRNSSIFKFPSSKSNHFIADNSSKFQSKLIHSRRFHCCSAQILGKKCGINSNRRAFRLSDPNWGQIRVYRSCSGAHGGRRGVLVISNVASDFRKHSTSVESHVNEKGFESIYINGGLNVKPLVIERIERGHVEEESGLEFKDPDVNFDHSEGLNKEKVEREVPEIEKEAWRLLRSAVVDYCGNPVGTVAANDPGDKQPLNYDQVFIRDFVPSALAFLLKGEGEIVKNFLLHTLQLQSWEKTVDCYSPGQGLMPASFKVRTVPLDGGNGAFEEVLDPDFGESAIGRVAPVDSGLWWIILLRAYGKITGDYALQERVDVQTGIRLILNLCLTDGFDMFPSLLVTDGSCMIDRRMGIHGHPLEIQQALFYSALRCSREMITVNDGTKNLVRAINNRLSALSFHIREYYWVDMKKINEIYRYKTEEYSTDAINKFNIYPDQIPTWLVDWIPDQGGYLIGNLQPAHMDFRFFTLGNLWSIISSLGTAKQNEGILNLIEAKWDDLVAHMPLKICYPALENEEWRIITGSDPKNTPWSYHNGGSWPTLLWQFQFTLACIKMGRPELARKAVALAEERLSVDHWPEYYDTRNGRFIGKQSRLYQTWTIAGFLTSKMLLENPEMASLLAWEEDYELLEICVCALSKTGRKKCSRSAARSQIPVQ

SEQ ID NO: 36098 - protein, 792 aa, Shigella flexneri 2a str. 301
MSNNGSSPLVLWYNQLGMNDVDRVGGKNASLGEMITNLSGMGVSVPNGFATTADAFNQFLDQSGVNQRIYELLDKTDIDDVTQLAKAGAQIRQWIIDTPFQPELENAIREAYAQLSADDENASFAVRSSATAEDMPDASFAGQQETFLNVQGFDAVLVAVKHVFASLFNDRAISYRVHQGYDHRGVALSAGVQRMVRSDLASSGVMFSIDTESGFDQVVFITSAWGLGEMVVQGAVNPDEFYVHKPTLAANRPAIVRRTMGSKKIRMVYAPTQEHGKQVKIEDVPQEQRDIFSLTNEEVQELAKQAVQIEKHYGRPMDIEWAKDGHTGKLFIVQARPETVRSRGQVMERYTLHSQGKIIAEGRAIGHRIGAGPVKVIHDISEMNRIEPGDVLVTDMTDPDWEPIMKKASAIVTNRGGRTCHAAIIARELGIPAVVGCGDATERMKDGENVTVSCAEGDTGYVYAELLEFSVKSSSVETMPDLPLKVMMNVGNPDRAFDFACLPSEGVGLARLEFIINRMIGVHPRALLEFDDQEPQLQNEIREMMKGFDSPREFYVGRLTEGIATLGAAFYPKRVIVRLSDFKSNEYANLVGGERYEPDEENPMLGFRGAGRYVSDSFRDCFALECEAVKRVRNDMGLTNVEIMIPFVRTVDQAKAVVEELARQGLKRGENGLKIIMMCEIPSNALLAEQFLEYFDGFSIGSNDMTQLALGLDRDSGVVSELFDERNDAVKALLSMAIRAAKKQGKYVGICGQGPSDHEDFAAWLMEEGIDSLSLNPDTVVQTWLSLAELKK

SEQ ID NO: 36099 - protein, 366 aa, Oceanobacillus iheyensis HTE831
MEKHIILLPGDGIGREIIDSAKQVLTAIASEYNHRFTFEEHAIGGSAIDEYGTPLPDKTVDACSKADAILLGAVGGPKWDANPSHLRPEKGLLGIRKQLGLFANLRPVKTISSLLYASPLKEEIVSQADMLIIRELTGGIYFGTPSERTTNGVVDTLQYSREEIERIVERGFEAARIRKKHLTSVDKANVLESSKLWREIVEEKSKDYPDVAVNHLLVDAAAMKLVTQPSFFDVIVTENLFGDILSDEASVLTGSLGMLPSASLRADGLGLYEPVHGSAPDIAGKGIANPLAMILSAALMLEHSFGLVDEAKEIERAVNDCLLQGFHTADIHIPGGVQVGTKQMTDAVLENVTTKSISDSICSSYV

SEQ ID NO: 36100 - protein, 676 aa, Vitis vinifera
MNSSSYIGITTMKPYCRVLTSCRNSSIFKFPSSKSNHFIADNSSKFQSKLTQSRRFHCCSAQILGKKCGINSNRRAFRFSDPNWGQIRVYRSCSGAHGGRRGVLVISNVASDFRKHSTSVESHVNEKGFESIYINGGLNVKPLVIERIERGHVEEESGLEFKDPDVNFDHSEGLNKEKVEREVPEIEKEAWRLLRSAVVDYCGNPVGTVAANDPGDKQPLNYDQVFIRDFVPSALAFLLKGEGEIVKNFLLHTLQLQSWEKTVDCYSPGQGLMPASFKVRTVPLDGGNGAFEEVLDPDFGESAIGRVAPVDSGLWWIILLRAYGKITGDYALQERVDVQTGIRLILNLCLTDGFDMFPSLLVTDGSCMIDRRMGIHGHPLEIQQALFYSALRCSREMLTVNDGTKNLVRAINNRLSALSFHIREYYWVDMKKINEIYRYKTEEYSTDAINKFNIYPDQIPTWLVDWIPDQGGYLIGNLQPAHMDFRFFTLGNLWSIISSLGTAKQNEGILNLIEAKWDDLVAHMPLKICYPALENEEWRIITGSDPKNTPWSYHNGGSWPALLWQFQFTLACIKMGRPELARKAVALAEERLSVDHWPEYYDTRNGRFIGKQSRLYQTWTIAGFLTSKMLLENPEMASLLAWEEDYELLEICVCALSKTGRKKCSRSAARSQIPVQ

SEQ ID NO: 36101 - protein, 184 aa, Arabidopsis thaliana
  misc_feature (13)..(13): Xaa can be any naturally occurring amino acid
  misc_feature (107)..(107): Xaa can be any naturally occurring amino acid
  misc_feature (157)..(157): Xaa can be any naturally occurring amino acid
  misc_feature (161)..(161): Xaa can be any naturally occurring amino acid
MASSMLSSTAVVXSPAQATMVAPFTGLKSSASFPVTRKANNDITSITSNGGRVSCMKVWPPIGKKKFETLSYLPDLSDVELAKEVDYLLRNKWIPCVEFELEHGFVXPVRHGETLPGYYDGRYWTMWKLPLFGCTDSAQVLKEVEKCKKEYPGAFIXGIIXIHTTRQVHGLSSFAYKPPSFTQA

SEQ ID NO: 36102 - protein, 152 aa, Zea mays
MESAVNPKAYPLADAQLTMGILDIIQQAANYKQLKKGANEATKTLNRGISEFVVMAADTEPLEILLHLPLLAEDKNVPYVFVPSKQALGRACGVTRPVIACSVTSNEGSQLKQQIQGLKIFQCDGPRRHIFQRLGLVMVSCLLYPQTIFEHC

SEQ ID NO: 36103 - protein, 674 aa, Vitis vinifera
MITIHCFANSTMKSSSRILLFRRNLPFSGCPLPKSHHFLASNLSNFRINSDHTCKFRSCPLQNLGFRRVIDHTQKFSRVPSPGFGQSRVISSGNVRRLSVISSVSSDVRSFSTSVETRVNDKNFEKIYVQGGMNVKPLVVERIDIDETIENNEESRIEVDGNFLNGENVKGVDESEVLITKREESEAEKEAWKLLQDSVVMYCGSPIGTMAANDPGDKTPLNYDQVFIRDFVPSALAFLLKGEGEIVRNFLLHTLQLQSWEKTVDCYSPGQGLMPASFKVRTVPLDGNNEAHEEVLDPDFGESAIGRVAPVDSGLWWIILLRAYGKITGDYTLQERVDVQTGIKLILNLCLTDGFDMFPSLLVTDGSCMIDRRMGIHGHPLEIQALFYSALRCSREMLTQNDASINLVRAINNRLSALSFHIREYYWVDMKKINEIYRYKTEEYSTDATNKFNIYPDQIPSWLMDWVPEEGGYLIGNLQPAHMDFRFFTLGNLWSIISSLGTPKQNQGILDTIQAKWDDLVGHMPLKICYPALEYEEWRIITGSDPKNTSPWSYHNGGSWPTLLWQFTLACIKMGRPELARKAVADAEKRLAVDRWPEYYDTRNGRFIGKQSRLFQTWTIAGYLTSKMLLENPEMAALLFWEEDYDLLEICVCGLSKTGRRKCSRFAARSQILV

SEQ ID NO: 36104 - protein, 282 aa, Mycobacterium tuberculosis H37Rv
MTGESGAAAAPSITLNDEHTMPVLGLGVAELSDDETERAVSAALEIGCRLIDTAYAYGNEAAVGRAIAASGVAREELFVTTKLATPDQGFTRSQEACRASLDRLGLDYVDLYLIHWPAPPVGKYVDAWGGMIQSRGEGHARSIGVSNFTAENIENLIDLTFVTPAVNQIELHPLLNQDELRKANAQHTVVTQSYCPLALGRLLDNPTVTSIASEYVKTPAQVLLRWNLQLGNAVVVRSARPERIASNFDVFDFELAAEHMDALGGLNDGTRVREDPLTYAGT

SEQ ID NO: 36105 - protein, 174 aa, Oceanobacillus iheyensis HTE831
MKRIIIATVQDRGGVLNRITGMLHKRQFNIESISVGASETEGISKMTFVVEINDKQKLEQLTKQLNKQIDVLKVMDVTDKALVARELALIKVVGTNQTRAEIQSIITPFRAAVIDVSKDSLIIQVTGKPDKVDALIALLRPYGIKELTKTGLTAFLRGQQPEQSISDFNLVAKG

SEQ ID NO: 36106 - protein, 674 aa, Vitis vinifera
MITIHCFANSTMKSSSRILLLRRNLPFSGCPLPKFHHFLASNLSNFRINSDHTCKFRSCPLQNLGFRRVIDHTQKFSRVPSPGFGQARVISSGNVRRLSVISSVSSDVRSFSTSVETRVNDKNFEKIYVQGGMNVKPLVVERIDIDETIENNEESRIEVDGNFLNGENVKGVDESEVLITKREESEAEKEAWKLLQDSVVMYCGSPIGTMAANDPGDKTPLNYDQVFIRDFVPSALAFLLKGEGEIVRNFLLHTLQLQSWEKTVDCYSPGQGLMPASFKVRTVPLDGNNEAHEEVLDPDFGESAIGRVAPVDSGLWWIILLRAYGKITGDYTLQERVDVQTGIKLILNLCLTDGFDMFPSLLVTDGSCMIDRRMGIHGHPLEIQALFYSALRCSREMLTQNDASINLVRAINNRLSALSFHIREYYWVDMKKINEIYRYKTEEYSTDATNKFNIYPDQIPSWLMDWVPEEGGYLIGNLQPAHMDFRFFTLGNLWSIISSLGTPKQNQGILDTIQAKWDDLVGHMPLKICYPALEYEEWHIITGSDPKNTSPWSYHNGGSWPTLLWQFTLACIKMGRPELARKAVADAEKRLAVDRWPEYYDTRNGRFIGKQSRLFQTWTIAGYLTSKMLLENPEMAALLFWEEDYDLLEICVCGLSKTGRRKCSRFAARSQILV

SEQ ID NO: 36107 - protein, 374 aa, Zea mays
MVTTAVADGWGTCGGMVRQAPLFIDVCPTARRGPLHKILTPDVKQEQQPRSRSPAAPRETCTTTQVARCSLLSGIQPSASPPVAIRLLTPPPPPAGRRLPNTAAALAAAARRFRWPSAAASARGLCAPPHSGGEGMGSDAGAGARKRRDSAVNGLAKDVPPVNGMMMPKEEPATAPPRLLTLPTVLTIGRVAAVPLLISTFYMEGPWAATATTGIFLAAAVTDWLDGYIARKMQLGTPFGAFLDPVADKLMVAATLVLLCTKPLETSLLNDGPWLLTVPSIAIIGREITMSAVREWAASQNSEALEAVAVNNLGKWKTATQMTALTLLLASRDPSVPAQGALVAPGVALLYISAGLAIWSLVVYMRKIWRTLLK

SEQ ID NO: 36108 - protein, 405 aa, Zea mays
  misc_feature (90)..(90): Xaa can be any naturally occurring amino acid
  misc_feature (190)..(190): Xaa can be any naturally occurring amino acid
MTSGAAAVGGLGRTPTWKERENNKRRERRRRAIAAKIFTGLRALGNYKLPKHCDNNEVLKALCREAGWVVEDDGTTYRKGCKPPPGMMSXPCSSSQLLSAPSSSFPSPVPSYHASPASSSFPSPTRLDHGSGSNSNSHTPGPAAAAAAAAAAAAAAASSLLPFLRGLPPLRVSSSAPVTPPLSSPTAASXRPPRVRKPDWDAAAAGGADPFRHPFFAVSAPASPTRARRREEHPDTIPECDESDVCCSAVADSGRWISFQIGAATTAPASPAYNLVNPAGGGGGGGCASASDSMELDGVAGAEFEFDKGRVTPWEGERIHEVAAEELELTLGVGANVFVLETRPGRADYLGSFYAPRPRGCRESDGRLKGTRHSGAPAVRCTRTLAQADAPPAPPDRRGLFNANS

SEQ ID NO: 36109 - protein, 302 aa, Alteromonadales bacterium TW-7
MPASFKINETTITQTIDDPWLKSKGIELLVKRDDLLHPLINGNKWRKLKYNLLKMQSQNKTELLTFGGAFSNHIHACAAAGKVFGLKTHGIIRGPNLDLSNPTIQFAQQCGMQLHVVNRIEYKLRNDSQYLAELQEKFPDAYILAEGGTNTYAVPGCAELAQSLPEHDYLICPTGSGGTLAGLIEGSNTATQIIGIAVLKQAQYLIDEVRELSCKAKSQTNWQLLCDFHGGGYGKFTPELWAFCQYMDITHNLPLEPIYSGKMMYAIWNLIEQDYFPSGSKIIAIHTGGLQGLKGLKYRKLI

SEQ ID NO: 36110 - protein, 619 aa, Chlamydomonas reinhardtii
MSASAIAAGADADMHRVVNETIVNFYNPANRTQRGGAVPKDAARYAILVNDTMPGPKLDVVVGQQVNITVLNRLSSDSVAIHWHGIRQTNTPWSDGADYVSICPADAIIGSTSYVFTFDEPGTYFWHSHIGMQMDQGLVGPIVVRDPNDPHMHWYDAEFPEPLMIQEWYWDPVGMLKAPHYHNFNTLEAALVNGRCASCLADASAPPSNTTTPGATGPNSYTYYPPVYSVQAGLCYRLRLINANGDFPGRMQAACCSGFCLWRAPGRASATRLQGWQVALMGHNLTLIAMDARNLQPVQAGSLVTYGGNRADLVFCADQAAGDYALSFGSVQQRTPDCPWYPNGCRYQARVIIRYGGRDNATKSAVNRTQLAGLPYVEVLDPMRRTSDFVPLAPQPAPQPTRSMRVKLGFLVLEVIFDNLSDNPHNMHMHGGGFYVLGTGVVAESGWLGDIANQTLCPPELAEHADPGWQAKDAVSYQRFWGCTFSNSSADRASKLASATPYVSDMVIVPPRGWAVMRIANWHSGVWPLHCHTNHHGMRGMSMLLNVLPAQRPPLPTWVDPFCGPCSAHASLGTLAPFLNLSSSVQEDRSHDSHGGGAAEGSVLGMSVALVVALAALLG

SEQ ID NO: 36111 - protein, 159 aa, Triticum aestivum
EFFDPVSAATFPEHKLRFRNDRLLPMLGLEPSQVKDDNFVEAFGLFHGVRPFLALRYHGYQFGEYNPNLGDGRGFLYGQVRGVNGELFDFGTKGSGQTPYSRGGDGRLTLKGGVREVLAAEALHRLGVTTSRCLSLVETGDSLWRGDEPSPTRASVMIL

SEQ ID NO: 36112 - protein, 577 aa, Streptococcus mutans
MTEMLKGIAASDGVAVAKAYLLVQPDLTFETVSVTDTQAEEARLDAALEASQNELSLIRQKAVDTLGEEAAAVFDAHLMVLADPEMIGQIKETIRTKEVNAESALKEVTDMFVTLFENMEDNPYMQERAADIRDVAKRVLAHLLGVELPNPATISEESIVIAHDLTPSDTAQLDANYVKAFVTNIGGRTSHSAIMARTLEIAAVLGTNDITERVKNGDIVAVNGITGQVIINPTEDQIAEFKAAGETYAKQKAEWALLKDAETVTADGKHFELAANIGTPKDVEGVNNNGAEAVGLYRTEFLYMDSQDFPTEDEQYEAYKAVLEGMNGKPVVVRTMDIGGDKELPYFDLPKEMNPFLGFRALRISISETGNQMFRTQLRALLRASVHGQLRIMFPMVALLNEFRKAKGILEEEKANLKAEGVAVSDDIQVGIMIEIPAAAMLADQFAKEVDFFSIGTNDLIQYTMAADRMNEQVSYLYQPYNPSILRLVDHVVKAAHAEGKWAGMCGEMAGDQTAVPLLVGIGLDEFSMSATSVLRTRSLMKKLDTAKMQELAQRALTECATMEEVLELEKEYIDFD

SEQ ID NO: 36113 - protein, 598 aa, Oryza sativa Japonica Group
MGTYKCCLIFKRRFRWNDAPPPDDVRALFANHSAGGGPHMAADGLRAYLQATGQDGDVDMERLVEQIRQLQGRGGRIPRVGRALPLLTVDDFHRFLFSHELNPPIRHGQGQVHHDMAAPLSHYFIYTGHNSYLTGNQLSSDCSDLPIIRALQRGVRVIELDMWPNSSKDDISILHGRTLTTPVSLLKCLLSIKQHAFEASPYPVIITLEDHLTPDLQDKAAKMVLEVFGDILYYPDKDHLKEFPSPQDLKGRVLLSTKPPREYLQAKDGNAATIKEDAKAAATDDAAWGKEVPDIHSQIHSATKHDQREDDDDTDEDEDDEEEEQKMQQHLAPQYKHLITIKAGKPKGTLLDALQSDPEKVRRLSLSEQQLAKLADHHGTEIVRFTQRNLLRIYPKGTRVTSSNYNPFLGWVHGAQMVAFNMQGYGRALWLMHGFYKANGGCGYVKKPDFLMQTDPEVFDPKKSLSPKKTLKVKVYMGDGWRMDFTQTHFDQYSPPDFYARVGIAGVPADSVMKRTRAIEDNWVPVWEEDFTFKLTVPEIALLRVEVHEYDMSEKDDFGGQTVLPVSDLIPGIRAVALHDRKGIKLNNVKLLMRFEFE

SEQ ID NO: 36114 - protein, 250 aa, Geobacter metallireducens GS-15
MAQQFKDYFSEKSDVYRSYRPGYPTELFAWLAGLPARRDAALDCGCGTGQASVALAEHFARVYAVDPSAGQIKSATPHKRVEYRVAPAEETGLPDASVDLVIAAQALHWFDFSRFYAEVRRVARGGAVFAAFTYGLLAIDDEIDRIIGRFYRDVIGPYWPPERAHVDAGYRTLPFPFAEIETPTFAMKAEWDLGHLMGYFETWSAVKEYRRLRGDDPLELVAGDLATAWGDPALVRQVSWPLVLRAGRIE

SEQ ID NO: 36115 - protein, 89 aa, Zea mays
  misc_feature (35)..(35): Xaa can be any naturally occurring amino acid
  misc_feature (47)..(47): Xaa can be any naturally occurring amino acid
  misc_feature (81)..(81): Xaa can be any naturally occurring amino acid
MEDLIVEELVSNLFTYKEQLLEVKKLIKEKKDDAXISEYIDMEKELXQEVITLTEEILVSAKHTESAHNVACLSPTSFSSXVQSEGLDD

SEQ ID NO: 36116 - protein, 407 aa, Bifidobacterium longum DJO10A
MSQNESGTIAIPMYDKDDAVLVLEDGQVYVGEPYGALGETTGEIVFATGMTGYQETLTDPSYDRQIVVQTFPHIGDTGVNSEDPESSRIWVAGYIVRDPSPNVSNWRAEGSLDDDLAKNGIVGLSHIDTRKLVRHLRSAGVMRAGIFSGDALTDQATGALKTIEQLLEDVKNTPQMQGLSLYDEVSTKGTYTIEPCGEYEGKEPLYTVAAVDLGIKGMTPHRMAERGCRVHVVPSTITFAEIENLNPDGVFFSNGPGDPEQAGPEIELLRQVLDAGYPFFGICFGNQLLGRALGFGTYKLKFGHRGINQPVKDLTTGKVEVTAHNHGFAVDAPIGKQVDAPFENGKYGKVFVSHIDLNDDVVEGLQCVDIPAFSVQYHPEAAAGPHDAAYLFDRFCELMKNNSKEGK

SEQ ID NO: 36117 - protein, 432 aa, Gibberella zeae PH-1
MTVKSSSPRYHGHQCHRQERVLSKQWLIDNQMGICLALLAPLLFAQCNAVTRPYTGKFTSLSYFNSETLEYGVGFGDNYLVLVLILLLTGLRDGTMRFILGPIASVWGLSRNKSMRFKEQAWLFIYYSTCCSVGTYIYATSPYWLDLKAMWTNWPNREVSGLMKSYMLAQLAFWLQQMIVVNIEKRRKDYWQMVSHHIVTIALVYSSYRYGLTRVGNVVLILMDLNDLIFSVAKCLKYMGLQTLCDIMFGIFVVSWVLCRHVAFVMVCWSVYAHSLAIAGATCYTGSGDTILGPGPVPQDEGYFYMLQPLVYDSGRICYDYTIKSLFLAGLLFLEGLMVFWLVMIIKLVVRVLRGGNAEDTRSDGEEEEHEEHEITEPIEVVVDTGKLQYPLRLSSSGRGTSCVFQTAGGLTITKDKKGYLDRIGCEQRISR

SEQ ID NO: 36118 - protein, 295 aa, Oryza sativa Japonica Group
ERCPRAEEVVREEVRRLYEEHGNTAVSWLRALFHDCMVYSCDASLLLHTTTTTGVSEQSSHRSFGMRNFKYITAIKAAVERECPATVSCADILALAARDGVAMLGGPSVAMRTGRRDSRESYYGVVEQYIPNHNDSVSTVLSRFAAIGVDTEGAVALLGAHSVGRVHCFNLVGRLYPQVDGSMEAAYGEYLRGRCPTAAATEDTREVVYARNDRVTPMLIDNMYYRNLLAGRGLLLVDQQLASDARTAPYVRRMAADNDYFHQRFAAALLTMSENAPLTGAQGEVRKDCRFVNSS

SEQ ID NO: 36119 - protein, 116 aa, Zea mays
  misc_feature (19)..(20): Xaa can be any naturally occurring amino acid
  misc_feature (26)..(26): Xaa can be any naturally occurring amino acid
  misc_feature (28)..(29): Xaa can be any naturally occurring amino acid
  misc_feature (32)..(32): Xaa can be any naturally occurring amino acid
  misc_feature (50)..(50): Xaa can be any naturally occurring amino acid
  misc_feature (52)..(53): Xaa can be any naturally occurring amino acid
  misc_feature (58)..(58): Xaa can be any naturally occurring amino acid
  misc_feature (65)..(65): Xaa can be any naturally occurring amino acid
  misc_feature (67)..(67): Xaa can be any naturally occurring amino acid
  misc_feature (88)..(89): Xaa can be any naturally occurring amino acid
  misc_feature (93)..(93): Xaa can be any naturally occurring amino acid
  misc_feature (97)..(97): Xaa can be any naturally occurring amino acid
RPPGPGHERRGNPDGPHNXXKNGNHXGXXDAXHKGAGKSRTAKAKSEEEXTXXQETGXGEKKDGXRXTEGNAHKDDTSKEPPERGARXXAANXRPPXPQKPRRQAPEGQGQAGARG

SEQ ID NO: 36120 - protein, 385 aa, Oceanobacillus iheyensis HTE831
MLTDQHLLRIPGPSPIPPSVQQAMNGTMIGHRGKETKELLQRILPRLKPIFGTKQDVIPIAGSGTAGLEMAVTNAVRPGDHVLVIVTGAFGDRFTKICNAYDLHVNRIDVPWGEAIDPSYIESYLQEHPEISVVFATFCETSTGVLNPIPSLGKVIHQNSNALLVVDGVSCVAGVETKMDDWGIDILITGSQKAFMLPAGLMFISASDRAWEVIENNPHHRFYLDMRTYKKSLADISTPFTPALSLLFGLDQVLNLIDQEGLNNVFKRHLLLRDMTRAAFKALDIPLLTTDEAASPTVTAVQPTDFDSEELRQILKSQFNLSLAGGQQHLKGNIFRVGHMGYCSPADALQTISLIEIGLQLIGKNIELGKGTAAAQQIYIQQEVK

SEQ ID NO: 36121 - protein, 544 aa, Dechloromonas aromatica RCB
MSHQKILILDFGSQVTQLIARRVREAKVFCEIHPYDVSEEFIRNYGAKGIILSGGPSSVTEGDTPRAPEVVFQLGVPVLGICYGMQTMAQQLGGKVMTAEAAGKSREFGYSEVRAHGHTALLNDIADFYSPEGHGMLKVWMSHGDSVMELPAGFVKMASTASCPIAAMADESRKFYAVQFHPEVTHTQQGRAILERFVHGICGCGTDWVMGDYIAEAVDAIRRQVGDEEVILGLSGGVDSSVAAALIHKAIGDQLTCVFVDHGLLRLNEGDMVMEMFARNLGVKVIRVDAVDDFMGKLAGVSDPEQKRKIIGKEFVEVFQVESKKLAAAKWLAQGTIYPDVIESAGKGKKGAHTIKSHHNVGGLPEDMHLKLLEPLRELFKDEVRELGIALGLPREMVYRHPFPGPGLGVRILGEVTLKAAHLLQRADAIFIDELRATHATERDVAAGACTEADIGKSWYDLTSQAFAVFLPVKSVGVMGDGRTYENVVALRAVVTSDFMTAHWAHLPYELLGRVSNRIINEVRGLNRVVYDVSGKPPATIEWE

SEQ ID NO: 36122 - protein, 320 aa, Bifidobacterium longum DJO10A
MDDIKTIANVGTGTMGHAITLQFALAGYPVHLAGRGEASLEKAMKAIRSDAEDFAEAGLLKDGDTVDAVLARITGYADYASGVADVDFVIESVAENLDIKKSVWTEVEHAAPKDAILSTNTSGLSPTALQSVMGHPERFVVAHFWNPAQLMPLVEVVPGEKTDPKVVDITFDLMAKIGKKPAKIKKESLGFVGNRLQLAVLREAFYIVQQGIADAATVDDVMKYSLGRRWNLVGPLASIDLGGLDVFYNISTYLFDDMDNGTGPSPLLAEKVREGNLGAKTGQGFFSWQGEDGKRIIESRNKALLRALKNDAADAAAAQA

SEQ ID NO: 36123 - protein, 507 aa, Zea mays
MGGCLSQEEHRLQSRPAEAAGADGLRKSKSDSKAVASVLAPPKDVVDLQVEGYGNVNIFTYDELRAATKNFRPDQILGEGGFGVVYKGVIDENVRAGFPSRQVAVKELNPEGFQGDKEWLAEVNYLGQLSHPNLVELIGYCCEGSHRLLVYEYMACGSLEKHLFRRVCLNMPWSTRMKIALGAARGLEYLHGAERSIIYRDFKTSNILLDAEGDCGGGWSEGGQKVHIGCQVGWPVHFSSFLADVLLLHFLTLDYNAKLSDFGLARTGPSGDQTHVSTRVMGTYGYAAPEYVMTGHLTARSDVYGFGVVLLEMIIGRRAVDKSRPSREHNLVDWARPLLVHNRKLFRIIDPRMEGQYSTKAATEVASLAYRCLSQNPKGRPTMSQVVETFEAVQNMPECQDILLQNGITGAVTLYEVPKEPADRVELEKAKQEPAVKTAAIPPVNGKPAPQSRRTRPGNGRSKSEPSLECKMYIPSPDFDEQQLGLEALASPNGSMKDHPDEDLYKI

SEQ ID NO: 36124 - protein, 232 aa, Zea mays
MPKRTTHTYSSEDALPEGPESDLFVYYCKHCASHVLITDTQLQKMPKRKTDRAHVLDKAKHLSRLNVKEAGKVMLKRGEGKLEKQFRMSCVGCDLFVCYRSEEDLEVAPFIYVIDGALSSVAAETNPHDAPVPPCITQLEGGLVQVAIEVEDRAQRSAITRVNADDVRVTVAALAARGEANSELLEFMGKVLGLRLTQMTLQRGWNNKSKLLIVEDLSARQVYEKLLEAVQP

SEQ ID NO: 36125 - protein, 191 aa, Escherichia coli
  misc_feature (41)..(41): Xaa can be any naturally occurring amino acid
  misc_feature (74)..(74): Xaa can be any naturally occurring amino acid
  misc_feature (104)..(104): Xaa can be any naturally occurring amino acid
  misc_feature (160)..(160): Xaa can be any naturally occurring amino acid
  misc_feature (167)..(167): Xaa can be any naturally occurring amino acid
TTHYSVVDKDGNAVAVTYTLNTTFGTGIVAGESGILLNNQXDDFSAKPGVPNVYGLVGGDANAVGPNKRPLSSXSPTIVVKDGKTWLVTGSPGGSRIITTVLQXVVNSIDYGLNVAEATNAPRFHHQWLPDELRVEKGFSPDTLKLLEAKGQKVALKEAXGSTQSIXVGPDGELYGASDPRSVDDLTAGYE

SEQ ID NO: 36126 - protein, 334 aa, Mycobacterium tuberculosis H37Rv
MAGIASTVAVMGAGAWGTALAKVLADAGGEVTLWARRAEVADQINTTRYNPDYLPGALLPPSIHATADAEEALGGASTVLLGVPAQTMRANLERWAPLLPEGATLVSLAKGIELGTLMRMSQVIISVTGAEPPQVAVISGPNLASEIAECQPAATVVACSDSGRAVALQRALNSGYFRPYTNADVVGTEIGGACKNIIALACGMAVGIGLGENTAAAIITRGLAEIIRLGTALGANGATLAGLAGVGDLVATCTSPRSRNRSFGERLGRGETLQSAGKACHVVEGVTSCESVLALASSYDVEMPLTDAVHRVCHKGLSVDEAITLLLGRRTKPE

SEQ ID NO: 36127 - protein, 428 aa, Chlamydomonas reinhardtii
MQLQARMQLRSAGPRRAGPVPVRAMAGSRFADVAQAPPDPILGVSEAFKASTDPNKLNLGVGAYRDEQLKPVVLSVVKKAESKIFSRNENKEYLTIEGLDAFRKATVDLLLGGDHPAIKEGRVAVVQSLSGTGSLRVGAAFIARFMKGATVYLSNPTWGNHRNIFGDEGVEWKYYRYFDADTVGLDFRGMVQDLQAAPPGSVVVLHGCAHNPTGIDPTKDQWAAIADLCKERNLMPFFDVAYQGFATGDLDKDAYAPRLFVEKGLEIVVSQSYSKNLGLYGERVGALVMVLNDKEAATRCLSQLKRLARALYSNPPTHGARIAAEVVNDKELFEEWKGEMRGMAGRIERVRGELQRSLESKYPSKDWSFITKQIGMFSFTGLTPAQVDNMTNKHAIFMTRDGRISLAGLNSAKVDYLAEAIVDSVRNH

SEQ ID NO: 36128 - protein, 453 aa, Alteromonadales bacterium TW-7
MTQHFDYIAIGGGSGGIASANRAAMRGAKVALIEAKHMGGTCVNVGCVPKKVMWHGAQVAEAINLYAPDYGFNVEVKDFNWSKLVESREAYIGRIHKGYDNGLASNGVTVIKGFATFIDSKTVEVNGEHYTADHILVAVGGRPTIPNIPGAEHGIDSNGFFELNEQPKRVAVIGAGYIAVEIAGVLHSLGTETHLFVRKSKPLRTFDPYIIDTLVDIMAKEGPTLHTECSPKEVIKESDGSLTIHFENGYSQNVDQVIWAIGRTPTTDKINLAAAGVEVNESGYVKVDEYQNTTAKNVYAVGDIIEGGIELTPVAVKAGRTLSERLFNKALPDDLKMDYSLVPTVVFSHPPIGTIGLTEQEAISQYGAENVKVYKSSFAAMYTAVTQHRQACNMMLVCAGEDEKVVGLHGLGFAVDEMIQGFAVAMKMGATKADFDAVVALHPTGSEEFVTMR

SEQ ID NO: 36129 - protein, 241 aa, Saccharomyces cerevisiae
MATIASEYSSEASNTPIEHQFNPYGDNGGTILGIAGEDFAVLAGDTRNITDYSINSRYEPKVFDCGDNIVMSANGFAADGDALVKRFKNSVKWYHFDHNDKKLSINSAARNIQHLLYGKRFFPYYVHTIIAGLDEDGKGAVYSFDPVGSYEREQCRAGGAAASLIMPFLDNQVNFKNQYEPGTNGKVKKPLKYLSVEEVIKLVRDSFTSATERHIQVGDGLEILIVTKDGVRKEFYELKRD

SEQ ID NO: 36130 - protein, 484 aa, Salmonella enterica subsp. enterica serovar Paratyphi B str.
MAEKKSQGVKWLPFILILVIAAGLWQLTPPSGLSAPAWHSAIIFVATIASIVAKVLPIGAVGIIGITVFALAYAAGDKTASGAITTALSELNSSLIWLIVVAFMIARGFIKTGLGRRIALQMIRLLGKRTLGLAYGLAFADLILSPAMPSNTARCGGVIYPIADSLARSFDSHPEDESRSKIGTFLITCIGNVNDVTAALFMTGYTGNLLAVKLAANAGVTLSWGSWFIAALLPCLVSFLIVPLLVYWLTRPEIKHTPDAPDLARKELAQMGSMTRGEWLMLATVGVLLVLWILGSSLGVDATTASFVGLSILLLSGVLTWEDVKSEKGAWDTLIWFAALLMMANQLKKLGFTSWFGNLIGDSIGSTMHGTSWIIILLLLNAAYFYTHYFFASGNAQIAALYAVFLGVGLHLNIPAAPMALMLAFTSSLYCSLTQYTHARGPILFGAGYVPTGVWWRTGFIISLFNQAVFLTVGLAWWKVLGLY

SEQ ID NO: 36131 - protein, 524 aa, Oryza sativa Japonica Group
MGLDLGALVLKSGGLLVSDYDSIVAINIFVALLCSCIVIGHLLEGNRWVNESITALVMGLITGGVILLVSGGKNSHILVFSEDLFFIYLLPPIIFNAGFQVKKKQFFRNFMTIILFGAVGTLISFVIISLAIGAIFSATDSVCTLQVLNQDETPLLYSLVFGEGVVNDATSVVLFNAIEDIDIANFDSLVLLAFIGNFLYLFFTSTLLGVVAGLLSAYIIKKLCFARHSTDREVAIMILMAYLSYMLSMLLDLSGILTVFFSGIVMSHYTWHNVTESSRITTKHTFATLSFIAEIFLFLYVGMDALDIEKWKLASSSPKKPIALSATILGLVMVGRAAFVFPLSFLSNLSKKETRPKISFKQQVIIWWAGLMRGAVSIALAYHKFTASGHTELRINAIMITSTVIVVLFSTMVFGFFTKPLLNLLIPPRPDIAADLSSQSIIDPLLGSLLGSDFDVGQPSPQNNLQLLLTIQTRSVHRVWRKFDDRFMRPMFGGRGFVPFVPGSPVERSIHGSQLGTVTEAEHS

SEQ ID NO: 36132 - protein, 288 aa, Myxococcus xanthus DK 1622
MNPQPLPAPAPETPPTAPDSLARPFKLSRRFDRTGRLLGDSAMERLANARVVVFGLGGVGSFAAEGLVRSGIGHLTLVDHDDVCVTNTNRQLHATVKAVGKPKAELMAQRCQEINPAAKVEAVREFYRADVAEQMLQPGQYDFVVDAIDNVKAKLHLLHRCVTLGVPVVSSMGAAGRLDPTAIRVEDLSETHMDPFAKDIRKLLKRKYAVETDKHTGITAVYSIEARRLPVTLQYDDATDGFLCVCPQDNEFHTCDHRTQIDGSVAFVTSCFGMNAAGVVVRRLASAR

SEQ ID NO: 36133 - protein, 127 aa, uncultured marine gamma proteobacterium EBAC20E09
MATSKDDILKAIEEMSVMDLVDLISAIEEKFGVTAAAAVAAAPAAAGGDGDAPAAEEKDEFDVVLSAAGDQKVQVIKAVRAITGLGLKEAKDMVDGAPSTLKEGVKKEEAEGMLAQLTEAGATGELK

SEQ ID NO: 36134 - protein, 316 aa, Zinnia elegans
MAIISISPFSAFILILTVIPFSEAGLSPHYYHQTCPQAEDIIFQTVRNASIYDPKVPARLLRMFFHDCFIRGCDASLLLDSTPANKAEKDGPPNISVRSFYVIEEAKAKIEKACPHTVSCADVLAIAARDVVAMSKGPWWPVLKGRKDGRVSKANETINLPSPFSNATTLIQSFAKRGLDVKDLVTLSGGHTLGFSHCSSFSARIHNSIDPTINSEFAMSLKKKCPLKNKDRNAGEFLDSTSSRFDNDYYKRITMGKGVFGSDQALYGDSRTKGIVDSYAKDEKLFFKEFAASMVKLGNVGVIEDGEIRVKCNVVN

SEQ ID NO: 36135 - protein, 257 aa, Saccharomyces cerevisiae
MSTGITYDEDRKTQLIAQYESVREVVNAEAKNVHVNENASKILLLVVSKLKPASDIQILYDHGVREFGENYVQELIEKAKLLPDDIKWHFIGGLQTNKCKDLAKVPNLYSVETIDSLKKAKKLNESRAKFQPDCNPILCNVQINTSHEDQKSGLNNEAEIFEVIDFFLSEECKYIKLNGLMTIGSWNVSHEDSKENRDFATLVEWKKKIDAKFGTSLKLSMGMSADFREAIRQGTAEVRIGTDIFGARPPKNEARII

SEQ ID NO: 36136 - protein, 111 aa, Brassica napus
QAKKTKDFSGGWRMRIALARALFIMPTILLLDEPTNHLDLEACVWLEESLKNFDRILVVVSHSQDFLNGVCTNIIHMQSKQVKYYTGNFDQYCQTRSELEENQMKQYRWEQ

SEQ ID NO: 36137 - protein, 345 aa, Saccharomyces cerevisiae
MTIDNYDNSKQDSSKYEVSGTGDGRNGDGGLPLVQCVARARIPTTQGPDIFLHLYSNNRDNKEHLAIVFGEDIRSRSLFRRRQCETQQDRMIRGAYIGKLYPGRTVADEDDRLGLALEFDDSTGELLASKATTWDAHNDTLVRIHSECYTGENAWSARCDCGEQFDRAGRLIACDHEPTSNIKGGNGHGVIVYLRQEGRGIGLGEKLKAYNLQDLGADTVQANLMLKHPVDARDFSLGKAILLDLGIGNVRLLTNNPEKIKQVDHAPYLKCVERVPMVPIHWTNSSEGIDSKEIEGYLRTKIERMGHLLTEPLKLHTNPQPTETSEAQNQNRMNSALSSTSTLAI

SEQ ID NO: 36138 - protein, 500 aa, Streptococcus thermophilus
MNKRVKIVATLGPAVEIRGGKKFGEDGYWSEKLDPDASAKNIAQLIEEGANVFRFNFSHGNHAEQGERMDVVRMAESIAGQKVGFLLDTKGPEIRTELFEGDAKEYAYKTGEQIRIATKQGLKSTRDVIALNVAGALDIFDDVEVGKQVLVDDGKLGLRVVDKDAEKREFIVEVENDGIIAKQKGVNIPYTKIPFPALAERDNADIRFGLEQGINFIAISFVRTAKDVQEVRAICEETGNGHVKLLAKIENQQGIDNIDEIIEAADGIMIARGDMGIEVPFEMVPVYQKMIITKVNAAGKIVVTATNMLETMTEKPRATRSEVSDVFNAVIDGTDATMLSGESANGPYPVESVRTMATIHKNAQTLLKEYGRLNSSTFDRSSNTEVVASAVKDATNSMHIQLIVALTESGNTASLIDTYRPEADIWAITFDELTQKSLMLNWGVIPVVTETPSSTDDMFEVAERVALESGLVESGDNIVIVAGVPVGSGNTNTMRIRTVK

SEQ ID NO: 36139 - protein, 287 aa, Oryza sativa
MEGKEEDVRLGANRYTERQPIGTAAQGAEEKDYREPRRRRCSTAEELTSWSFYRAGIAEFVATFLFLYISILTVMGVNKSASKCATVGIQGIAWSFGGMIFALVYCTAGISGGHINPAVTFGLFLARKLSLTRAVFYMAMQCLGAICGAGVVKGFQRGLYMGSGGGANAVNPGYTKGDGLGAEIVGTFVLVYTVFSATDAKRNARDSHVPILAPLPIFAVFLVHLATIPITGTGINPARSLGAAIVYNRAHAWHDHWIFWVGPFIGAALAAIYHVVVIRAIPFKSRD

SEQ ID NO: 36140 - protein, 444 aa, marine gamma proteobacterium HTCC2080
MSDTDFPYGNPADSDAGLLIRREKLLGKNAPLFYEQPLHLVRGEGVHLYDADGQQYLDVYNNVANVGHCHPRVVQALSTQAATLNIHTRYLHETILEYGENLTKTFADPLSMVMFTCTGSEANDLAMRMARHTTGAKGIICTNETYHGNTAAVDALATLFGGGQPRGENVKSVPFPDGYRPQDNLHGRALCDAYLRAIDQAIAEFEEEGVGFAGVLMCPIFANEAVPSVPAGYLSGVADRVRANNGLLIFDEVQSGFGRTGSMWGYEFVGVQPDIVTLGKPMGNGHPIAGVVASPELVNSFRADVMYFNTFAGNPVSCAVAKAVLEVVHEEKLVQNAEDVGHYLRAGLCDLQQHYDAIGDVRGPGLFIGVELVRDRISKAPAPELAARVINKMKAKHVLISKIGPFDNVLKIRPPIVFSKENADQLLETLDLVLKELALEDGVL

SEQ ID NO: 36141 - protein, 654 aa, Glycine max
MAGDDLAGDHTPELLCLVHEIAGMCSAGSSSGADAMFRKDCTDLVRRISLLTHLFEEIKELKNNNDVGGSASSSSSYSSSSSSASSKWSSDLVLALHSARRLLSVARNFRSYCSSDGAAKTIVFQFQCVTWKLEKLLSNLPYDDLDISEEVKEQVDLVRTQLRRATDKYGFMISKMPSHELSQPLAEEISQVLGKSVSRLHKQHSCPENLSELDSIPINYEEKRCSKNPAGTRLERTRSIPTEVEVSLNATDPESQEISETKILPEVKKPEAIVIPEDFLCPISLELMRDPVIVATGQTYERSYIQRWIDCGNTTCPKTQQKLQHLTLTPNYVLRSLISQWCIEHNIEQPTGLTNGKLKKSDGSFRDVTGDIAAIEALVRKLSCRSVEERRAAVTELRSLSKRSTDNRILIAEAGAIPVLVNLLTSEDVLTQDNAVTSILNLSIYENNKGLIMLAGAIPSIVQVLRAGTMEARENAAATLFSLSLADENKIIIGASGAIPALVELLQNGSPRGKKDAATALFNLCIYQGNKGRAIRAGIITALLKMLTDSSKSMVDEALTIMSVLASHQEAKVAIVKASTIPVLIDLLRTGLPRNKENAAAILLALCKRDADNLACISRLGVVIPLSELARNGTERAKRKATSLLEHIRKLQQL

SEQ ID NO: 36142 - protein, 444 aa, Prevotella ruminicola
MKATEVIEKLKAKFPGQPEYIQAVSQVLGTIEEEYNKHPEFEKANLIERLCVPDRILQFRVSWVDDNGNVQTNLGYRVQHNNAIGPYKGGLRFHKSVNASILKFLAFEQTFKNSLTTLPMGGAKGGSDFDPHGKSDMEVMRFCQAFMNELYRLIGPDEDVPAGDIGVGGREVGYMFGQYKKLTHQFQGILTGKGLEFGGSLIRPEATGYGNVYFLEDMLKTRGESLEGKTVLVSGSGNVAQYTIEKLLQLGAKPVTCSDSNGYIYDPDGIDAEKLAFIMELKNVKRGRIKEYAEKYGVKYVENARPWGEKADIATPCATQDEINEAEAKTLIANGVFAVSEGANMPTEPAAIKVFQDAKILYCPGKASNAGGVATSGLEMSQNSERLSWTREEVDTKLHNIMDEIHANCVKYGTEPDGYINYVKGANVAGFMKVAKAMMAQGIY

SEQ ID NO: 36143 - protein, 155 aa, Ralstonia eutropha JMP134
MNKVRKTARQLLADKPRDVISVAPDDFVLAALQLMADKDISTVLVMHGDTLAGILSQRDYARGVELAGRSASATKVRDIMTTKVVCVSPDHTCDQCLALMHARRIRHLPVLESGRIAGVLSSHDILEELLSEDEHLIRDLEHDMLNLTVDTGGCY

SEQ ID NO: 36144 - protein, 412 aa, Bacillus sp. SG-1
MKITVQKYGGTSVRDEIGRKKASAHVMRAIEDGYKVVVVVSAMGRKGEPYSTDTLLSLINGKDTKVSRREQDLLLSCGETVSTVVFTNLLLEQGIKATALTGAQAGFHTNSDHTNAKITDMKCDRLLSELKECQAVVVAGFQGISPKGEITTIGRGGSDTSAAALGAALKAEWVDIFTDVEGVMTADPRVTDKARPLAVISYNEVCNLANQGAKVIHPRAVEIAMEARVPIRIRSTYSDNLGTLVTSLEKKKAKGLESGTVTGIAHVENLSQIKVFAKKEQYNLQSEVFKAMANENISVDFINISPQGVVYTVPSDLTSRAFGVLKNLGHDPLIETECAKVSVVGAGMKGVPGVTAAIVTALSENNIRILQSADSHTTIWVLIKEKDLKTAVNALHDSFQLEADKSTLEIDE

SEQ ID NO: 36145 - protein, 511 aa, Oryza sativa Indica Group
MQVLPLPTPDDDAPAAEDHTADLPDDLLAVVFGLLGSADRKRCSLVCRRWLSVDAASRLRLALDARAPLHAALPGILARFPAVSKLALKCDRRAESVADPTLALLADRLGPALRRLKLRSIRLVTDDGVAALAAAATNLRKLSVGSCTFGAKGIEAVLRSCLHLEELSIKRLRGLAQSEPVAVSSLCLHSLCLKELYNGQCFSSLITNSPNLKTLKIIRCSGDWDPVLQDLPQDAMLAELHLEKLQVSDRGVSALSGLEVLYLAKAPEVTDVGLGKLATRSPRLRKLHVDGWKANRIGDRGLAAVAQKCAALQELVLIGVNLTSASLELIAANCPALERLALCGSDTFGDAEISCVATKCAALRKLCIKACPVSDAGMDKLAQGCPRLVKVKVKKCQGVTPECAERLRASRNGALAVNVDTPGGAGELQDARSVDESGVLENAGSDTLPDDLDDRIGGPDLSCGSSGRPSGWKARMGAFMSRSLSVSMFRRRPRGIFLLHSFKMSPYWDGN

SEQ ID NO: 36146 - protein, 656 aa, Chromobacterium violaceum ATCC 12472
MHSMAPIVLVLLAAVLVVTLCRSLKVPAMLGYLVVGFLTGPGVMNLIPQGKETAFLGEIGIVFMMFTIGLEFSLPRLRAMRQLVFGVGFAQVALTMLLVAMAIAYLTGSPLTGFAIGGALAMSSTAIVSKLLAERLELNQPHGQLAIGVLLFQDIAVVPLLIMLPAFAGGSDTLWLDLAKAGGKVLVVLALLLFFGQRLVRPWFHLVARQRSGELFMINVLLVTLGIAWMTELSGLSLALGAFVAGMLISETEYRYQVEEDIKPFRDILLGFFFITVGMKLELSVLFGRFGEVLLLLALLLPLKLAVVFGLGRLFGHRSNDAMRSALALAQGGEFGFVLLSLALNLKLVAAPMAQAAIAAILISMLAAPFLIMHGERITRRLIKQDWMLQSLDLHQMLVAGMSKDEHVLICGYGRSGQALARLLETEKINMFALDMDPERVREAGEAGDPVVFGDAGKKEVLLAAGLMRAKVVVVTFADTHAALRILHTVREVRPDLPVIVRTIDESELDVLRQAGADEVVAEVMEGSLMLASQALLEAGVPPSRVLRRIRAVREERYDLFRGFFRGSSDETESLEESLVPRLLSVQVCGGAAAIGQPLGALGLDALGVELKAIRRNRVRRTDFDDSFEVAPDDVMVLLGTPEQLALAESRILQGD

SEQ ID NO: 36147 - protein, 293 aa, Zea mays
PRGRPGRALPATADAHELSAQQKRRWLLEASLTGSVATNATRKISSPTAMAAADASRTLLAAVSLALAACCLAQLAAGDTNGVYEPCSDARIQRGDGFTFGVVFAGYNAFFSGNTQLSPCDRRLNLAASGQLAVFRPKVDEISLLTINTTTGFNPASAGGFMVAFAGRKYAARSIPIFVSNTSVTVSSFTLVLEFNKGRLENLHWKKDGCGACSGKSNFVCLGKQTCAIRTQSCKSQGPVDCSVGIQLAFSGTDKHESVLNSWYEVSNLRQYSLYGLYSNLKGTLSGQFNKIF

SEQ ID NO: 36148 - protein, 112 aa, Chlamydomonas reinhardtii
MRFHGRHGVLQEETRLGQPFVVDASLQVDTLQAGATDDLADTVSYADVYKDIKGVVEGEPCKLLEAVAHRACAAVLAQHSGVREMRLAIRKLCIPGVPSVVESVGVEVYRHR

SEQ ID NO: 36149 - protein, 318 aa, Saccharomyces cerevisiae
MSSNAQVKTPLPPAPAPKKESNFLIDFLMGGVSAAVAKTAASPIERVKLLIQNQDEMLKQGTLDRKYAGILDCFKRTATQEGVISFWRGNTANVIRYFPTQALNFAFKDKIKAMFGFKKEEGYAKWFAGNLASGGAAGALSLLFVYSLDYARTRLAADSKSSKKGGARQFNGLIDVYKKTLKSDGVAGLYRGFLPSVVGIVVYRGLYFGMYDSLKPLLLTGSLEGSFLASFLLGWVVTTGASTCSYPLDTVRRRMMMTSGQAVKYDGAFDCLRKIVAAEGVGSLFKGCGANILRGVAGAGVISMYDQLQMILFGKKFK

SEQ ID NO: 36150 - protein, 204 aa, Chlamydomonas reinhardtii
MLERRVSTLELELQDMAAKSKQAVEEAHRLQSEKSLLAETVKRLHKEVARLDAFKKNLLNHLNSEDEPGLEPSVAAADVAGERLVSEVLSSISKPPPPQMGVGGAYGLRGMATAAATPAFPSTSGRPLYGASTPQAGQPPAASGPPYAAMTGMGMPAQAPPPSTYATPHPHAQYGAAPGSPPRVDGKEFFRQARYLSVYKENLH

SEQ ID NO: 36151 - protein, 744 aa, Oryza sativa Japonica Group
MAGQERRTIDLEEGWAFMQKGITKLKNILEGKPEPQFSSEDYMMLYTTIYNMCTQKPPHDYSQQLYDKYRESFEEYITSMVLPSLRDKHDEFMLRELVKRWSNHKIMVRWLSRFFFYLDRYFISRRSLIPLEQVGLTCFRDLIYQEIKGQVKGAVIALIDKEREGEQIDRALLKNVLGIFVEIGLGSMECYENDFEDFLLKDTTDYYSLKAQSWILEDSCPDYMIKAEECLKKEKERVGHYLHISSEQKLLEKVQNELLAQYATPLLEKEHSGCFALLRDDKEEDLSRMYRLFSKINRGLEPIANMFKTHVTNEGTALVKQAEDSASNKKPEKKDMVGMQEQVFVWKIIELHDKYVAYVTECFQGHTLFHKALKEAFEVFCNKGVSGSSSAELLATFCDNILKKGCSEKLSDEAIEDALEKVVRLLAYISDKDLFAEFYRKKLARRLLFDKSANDEHERSILTKLKQQCGGQFTSKMEGMVTDLTVARDHQTKFEEFVAAHQELNPGIDLAVTVLTTGFWPSYKTFDINLPAEMVKCVEVFKEFYQTRTKHRKLTWIYSLGTCNINAKFEAKTIELIVTTYQAALLLLFNGSDRLTYSEIVTQLNLSDDDVVRLLHSLSCAKYKILNKEPANRSISPNDVFEFNSKFTDRMRRIKIPLPPVDEKKKVVEDVDKDRRYAIDASIVRIMKSRKVMGHQQLVAECVEQLSRMFKPDFKAIKKRIEDLITRDYLEREKDNANVYRYLA

SEQ ID NO: 36152 - protein, 488 aa, Listeria monocytogenes str. 4b F2365
MADVRKLKNYINGEWVESRADKYEDVINPATGEVLCQVPISTRAELDQAAVIAEQAFEKWSQVAVPRRARVLFSFQQLLIQHKEKLARLITLENGKNLSEARGEVQRGIENVEFAAGAPTLMMGDSLASIATDVEAANYRYPVGVVGGIAPFNFPMMVPCWMFPMAIALGNSFILKPSERTPLLMEKLVELFSEAGLPKGVFNVVYGAHDVVNGILENEIIKAVSFVGSKPVGEYVYKTGSANLKRVQALTGAKNHTIVLNDADLEDTVTNVISAAFGSAGERCMACAVVTVEEGIADEFLAALRTAAQNVKIGNGLDDGVFLGPVIREENQKRTIAYIEKGLEEGAKLTVDGRETGLSEGHFVGPTILEDVTTDMTIWKDEIFAPVLSVIRVKNLQEAVRVANQSEFANGACIFTNNAKAIRYFREKIDAGMLGVNLGVPAPMAFFPFSGWKSSFYGTLHANGKDSVDFYTHKKVVTARYSLKGYEE

SEQ ID NO: 36153 - protein, 454 aa, Vibrio cholerae O1 biovar eltor str. N16961
MEKVMATHFDYLCIGGGSGGIASANRAAMYGAKVALIEAKDLGGTCVNVGCVPKKVMWHGAQIAEAMHLYAEDYGFDVDVKNFNWAKLVESRQAYIGRIHQSYDRVLGNNKVHVIKGFAKFVDAKTVEVNGELYTADHILIAVGGRPSIPNIPGAEYGIDSNGFFELSEQPKRVAVIGAGYIAVEIAGVLNALGTETHLFCRKESPLRSFDPMIIETLVEVMNSEGPQLHTHSVPKQVVKEADGSLTLHLENGQTYNVDTLIWAIGRHPATDAINLAATGVATNEQGYIKVDEFQNTNVAGIYCVGDIMEGGIELTPVAVKAGRQLSERLFNNKLNAKMDYQLVPTVVFSHPPIGTIGLTEPQAIAQYGAENVKVYKSSFTAMYTAVTSHRQPCKMKLVCAGPEETVVGLHGIGFAVDEMIQGFGVAMKMGATKADFDSVVAIHPTGSEEFVTM

SEQ ID NO: 36154 - protein, 325 aa, Listeria monocytogenes str. 4b F2365
MNLNKHSERKFDLITVGRACIDLNAVEYNRPMEETMTFSKYVGGSPANIAIGTAKLGLKVGFIGKISADQHGRFIEKYMRDLSINTDGMVKDTEGRKVGLAFTEIKSPDECSILMYRENVADLYLTPEEISEDYIKEARVLLISGTALAQSPSREAVLKAVSLARKNDVAVAFELDYRPYTWTNTEETAVYYSLVAEQADVIIGTRDEFDMMENQVGGKNEATKAHLFQHQAEIVVIKHGVEGSFAYTKAGETFQAKAYKTKVLKTFGAGDSYASAFLYGLFSGESIETALKYGSAAASIVVSKHSSSDAMPTADEIKALIAQAE

SEQ ID NO: 36155 - protein, 444 aa, Triticum aestivum
LALVADTAYVGFSAATGVIFTRHYVLGWSFALNGPAPPLDTSKLPSLPRFGPKPRSKVLEIVLPIATAAFVLALAIAFFMFVRTRIRYAEVREDWEVEFGPHRFAYKELYKATKGFKNRRLLGTGGFGRVYKGVLPRSNLEIAVKRVSHDSKQGMKEFIAEVVSLGHLRHRNLVQLLGYCRRQGELLLVYDCMPNGSLDKYLHDKTRPVLDWSQRFRIIRGVASGLLYLHEDCEQVIIHRDIKASNVLLDADMNGRLGDFGLARLYDHGADPQTTHVVGTMGYLAPELARTGKASPLTDVFAFGAFILEVACGRRPVEQAMNDSRLMLVDWVLEHWQKESLLEVVDARLDGNYDAGEVVLALKLGLMCSHPMPGARPSMRQVMQYLEGDMPIPELTPTQMSFSMLALMQSQGFDSFVLSATSDPSSATNTMMTMGTISGLSGGR

SEQ ID NO: 36156 - protein, 534 aa, Oryza sativa Indica Group
MARAARGKAPRPRPRPPRGLAASLRRLLAGAGGGLGVAAAAYVGVDYLRYLSPAWHGRLMPALWAALALAAAARAPFYRHWSAELRAALPFLGSIAFMLGAFLCEAVSVRFVSAVMGLQWHRSVHFSGAMELTDYSVPGVKDAMDLGGDLLSSLIAIYCIFFNLDLGGRLSSLIVEGFYDYSSSKESMPFWNKGPSRSSLGKKAKRLSAAPLPDTGQWLLLALNEKLPQSVVDLLRAHVITLHHYLMLFIMLGFSVLFGCIKAPGLGIATRYMFTMAIGRLLRTMTFVATILPSARPWCAAARYQIPGHPHPWAQKYYVPYASDSDAIRRVIRDDVAYAAVQSYPGEYRPDWGRMSFLVDILRPTPGEGPSWYHLLKKASGGCNDLMYSGHMLVAVLTAMAWTEAYGGWISVAIWLLVLHSAQREIRERHHYTVDCVVAIYVGILLWRMTRFIWSARDASRARRLAKLDEVQNRLIHAAKDSDVDEIRGLLKEVELAGQEKQGVSQRAILAFAAATIIFTLTCVVLALTLTSDG

SEQ ID NO: 36157 - protein, 334 aa, Nocardioides sp. JS614
MKVLVTGGAGYIGSTTAKALEEAGHTPVILDSLLTGPLAFVRDRIFYEGDIADRALVRRVFDEHPDIDATIHMAARIVVPESVEKPYEYYRDNVAKSLELFDELNTLGKGRVLFSSSASIYALKDDFEVSEGDRLEPASPYARTKRMMEEVLQDMSAATDLRAIILRYFNPIGSDPDLESGIYAKEPSHVLGQLVMAARGQKDAFTITGTDHPTRDGTGIRDYIHVWDLARAHVRAVERFDEVIDAAGEPSVIINVGTGSGVTVRELVTAFQNVFGQEVPVREAPPRPGDAVGAFANVDRSGRLLDWRTELSLEDAIASALAWGAKRQEILGYE

SEQ ID NO: 36158 - protein, 414 aa, Bacillus sp. SG-1
MINKYTCSNGLRIVLEEIPTVRSVAIGIWIGTGSRHENKENNGISHFLEHMFFKGTETRSAREIAESFDSIGGQVNAFTSKEYTCYYAKVLDNHAKYALETLADMFFNSAFDEEELKKEKNVVYEEIKMYEDTPDDIVHDVLSKAVYENHPLGYPILGTEETLDTFNGQTLREYMHNMYTPDDVVISVAGNIDASFIKEVEKLFGQYEGGKGHEQNAKPSFHHNKVSKKKETEQAHLCLGYPGLQIGHDDIYSLIVLNNVLGGSMSSRLFQEVREQRGLAYSVFSYHSAYEDSGMLTIYGGTGAKQLNQLFDTVQSTLATLKAEGISSKELSNSKEQLKGNLMLSLESTNSRMSRNGKNELLLKKHRSLDEIVDEIDGVTIDRVNNLGNEIFNNDFSVALISPDGEMPTNIKNS

SEQ ID NO: 36159 - protein, 512 aa, Triticum aestivum
MSLISTALVLLVPLGLYLYLRPCSRRRSNDPAAAVLPTKWPILGMLPGLVANMYNFHEYSYAVLAGSGLNFNGDGPPGAGMRFFITCDPANIQHIFTTNYPNFPKGAEFAAIFDIMAGGLFTIDGELWRRRRVKFVGVISSPRFADRVAAHCHDKVKDHLLPLLARMASTGTSFDMQELMVRLMFDMTAMAVFGVDPGFLSLDMPPIDASIAMDTVMEVGFLRHTMPASLWKAMRWLNIGPERKLHEAKKVLHRFVVDTMERRKTTRENVGHDEDEEVVGDILSSYINDPDFADDDLLRATLINFMIAGRDTIGTTLPWIFYNLAQNPNVVSIIRNELSPIASHKVARGMGATVIFEPEETKSLVYLRATLYETLRLYPPAHMERKTVVTDDTMPSGHEVYAGDAIYISLYSMGRMESLWGKDCLDFNPNRWLLEDGNKIKYVPSNKFLAFNSGPRMCPGKEIAVVQMKTIIAAVVWNFDLELVESQSIQPKLSCLLQMKNGLMMKLKKREA

SEQ ID NO: 36160 - protein, 336 aa, Mycobacterium tuberculosis H37Rv
MKLAIIAGDGIGPEVTAEAVKVLDAVVPGVQKTSYDLGARRFHATGEVLPDSVVAELRNHDAILLGAIGDPSVPSGVLERGLLLRLRFELDHHINLRPARLYPGVASPLSGNPGIDFVVVREGTEGPYTGNGGAIRVGTPNEVATEVSVNTAFGVRRVVADAFERARRRRKHLTLVHKTNVLTFAGGLWLRTVDEVGECYPDVEVAYQHVDAATIHMITDPGRFDVIVTDNLFGDIITDLAAAVCGGIGLAASGNIDATRANPSMFEPVHGSAPDIAGQGIADPTAAIMSVALLLSHLGEHDAAARVDRAVEAHLATRGSERLATSDVGERIAAAL

SEQ ID NO: 36161 - protein, 90 aa, Brassica napus
  misc_feature (34)..(34): Xaa can be any naturally occurring amino acid
LETVSSSLVGGTCVAIAGSDYCVIAVDTRMSTDXDYSKIHKIADKAVLSSSGFQADVKALQKVLNSRHLVYQHQHNKQMSHQVPPRTLKA

SEQ ID NO: 36162 - protein, 248 aa, Oryza sativa Indica Group
MAGLPFLLALHIALLLLLPCSCQVGDSCSSARDCGAGLYCGNCAATGKTRPSCIRDLAIQPTSIVKGLPFNRYSWLVTHNSFSIVGEPSHTGVERVTFYNQEDTVTNQLRNGVRGLMLDMYDFNDDIWLCHSLQGQCYNFTAFQPAIDTLKEVEAFLSENPTEIITIFIEDYVHSTMGLSKLFTAADLTKYWYPISEMPTNGKDWPSVTDMVAKNHRLLVFTSDSSKEASEGIAYQWSYLLENESIAM

SEQ ID NO: 36163 - protein, 336 aa, Pseudomonas putida GB-1
MPQKQAENLGTSGDSVVRRFSVAPMMDWTDRHCRFFLRLLSKQTLLYTEMVTTGALLHNDAQRFLRHDASEHPLALQLGGSVPADLAACARLAEDAGYDEVNLNVGCPSDRVQNNMIGACLMAHPALVADCVKAMRDAVSTPVTVKHRIGINGRDSYAELCDFVGQVREAGCRSFTVHARIAILEGLSPKENREIPPLRYDVAAQLKADFPDLEIVLNGGIKTLDECQKHLETFDGVMLGREAYHNPYLLAEVDQQLFASDAPVVSRSEALAQLRPYIVAHMESGGAMHHVTRHILGLAQGFKGARRFRQLLSADIHKAAEPLAVFDQAMELLQGR

SEQ ID NO: 36164 - protein, 168 aa, Mycobacterium tuberculosis H37Rv
MSPKTHTLSVLVEDKPGVLARVAALFSRRGFNIESLAVGATECKDRSRMTIVVSAEDTPLEQITKQLNKLINVIKIVEQDDEHSVSRELALIKVQADAGSRSQVIEAVNLFRANVIDVSPESLTVEATGNRGKLEALLRVLEPFGIREIAQSGMVSLSRGPRGIGTAK

SEQ ID NO: 36165 - protein, 123 aa, Zea mays
  misc_feature (61)..(61): Xaa can be any naturally occurring amino acid
  misc_feature (69)..(69): Xaa can be any naturally occurring amino acid
  misc_feature (87)..(87): Xaa can be any naturally occurring amino acid
MSTYCGEYKDELIKNADYIGTPGMGILAADESIGTVGRRLSSINVENVEENRRALRELLLXCPGALQYXSGGSLFQETLYQKTKDGXPFVGVLNEGGVLPGFKVDKGTTEVGGSEQDTTTQGH

SEQ ID NO: 36166 - protein, 370 aa, Arabidopsis thaliana
MMMSDLPHDLVEEILSRLPLISLKAMRSTCKTWNVLSKHRSFANKHIGNVTASGKRDLIMIKDCKVYSIGVNLHGIQNNNNIIDLSIKNKGILHLENLDLIFKEIFNVFHCNGLLLLYGSITDDSIRLVVCNPYWGKREWVKRINNFASFDKLAFGYDKSCGCHKILRVFDSYPNRLEIYNLRSNSRMVSSFPLKWDIAFMQDGVSLKGNTYWYAKDRRSEDCYLICFDFTRERFGPRLPLPQPFIDEFLGSLYVVREEKLAVLVKRWRGGKSEIDIWVTNKIEPDEVSWSKFLKVDNTPRFFLTEGYLIYDEEKVVVFFNKEETEGLKSTVHIAYIVGENGYFRRADLREPLYQPLCRLVCSYVPSSVK

SEQ ID NO: 36167 - protein, 744 aa, Chlamydomonas reinhardtii
MADRKPIELAEGWSFMEQKGIQKLIRLLEGEPEDQFNAEQYMHLYTTIYNMCTQKPPHDYSEQLYSKYRDAFNKYINEKVLPSLREHRDEVLLKELYQRWGNHKLMVRWLSRFFNYLDRYYVLRHSLHPLKDVGLLCFKDLVYVEIKKRTKDGVLLLVEKEREGELVDRALVKNILGIFIELGMSNMDCYEKDFEEYLLTETSAFYRRKASQWIEQDSCPDYMLKAEECLRLEEERVDNYLHATTRNKLLKEVETELLSNYETRLLTKEHSGCAALLRDDKTEDLARMYRLFQRIPKGLDPVADIFKEHVDSEGMKLVKEAVELAKEKQAKTGPSRDTGTSAEQQYVRAVIDLHDKYLQYVSTCFCNSSLFHKSLKEAFENFVNKSVAGSTSAELMASFCDNLLKKGGSEKLSDEAIEETLEKVVKLLAYVSDKDMFAEFYRKKLSRRLLQDKSASDDHERSLLSRLKQQCGAQFTSKMEGMVTDLQLAKEKQQHFDDWLKKGSKLPIDLSVTVLTTGFWPTYKSIDVALPREMVEGVEVYRSYYDSDSKHRKLTWIYTLGTAVLRGNFDSKPIEMQMNTLQAALCMLLNDVDELSYGEIQERLRLPDDDLQRLLHSLVCAKYKIIKKDPDGKSIGKSDKFAFNNRFTDKMRRIKIPLPPLDEKKKVMEDVDKDRRYAIDAAIVRIMKSRKVLQHQTLVMEVIQQLQRMFKPDLKLIKKRIEDLIQREYLERDKDNPTLFKYLA

SEQ ID NO: 36168 - protein, 337 aa, Streptomyces kanamyceticus
MSSRAIVVERPGAHRLVTRGTPTPGPGEVLVRVAAAGICGSDREVYDGHRDAAYVRYPVIPGHEWSGTVAAVGEGVDPGLLGRRTVAEGFRACGVCERCRCAETNLCTGGYAETGFTEPGAFADHLTVPARLLHLLRDDADLRAAALLEPAAVVAAAVRAGGLRPGERVAVVGAGTLGLLAVQLLAASGPGELVVVDPRGARGARARECGATSALSPVAAESVRGSFDLVVETAGAPTTAASSCLLARRGGRVVLTGMFTEGAVGIDPVHLSLSQLEVRSVFGASSAAWGDAVRAFGLGLIDPAALITHEFPLERFGEAVSLVGGGDPKTGKVLLRP

SEQ ID NO: 36169 - protein, 324 aa, Streptomyces kanamyceticus
MAAQTLRAAARMRVVELIGDKERTAAEVAAEAGARPEGMIRLLRALAGIGVVAERTPGVFAVTPTGALLDSRRPGNVASLVLMMSDPTMLRGWEHLDEVVRTGEPAFDTVFGTDFFGHLREHPEESARFNEAMSQSTGAAAATLPRAFDFTRFATVADVGGGDGTLLSAVLKEHTGLTGIIYDTAEGLAQAPATLERHGLTERCSSVAGDFFQSAPKGADLYLLKSILHDWPDERAVTILSHCRAVLPPEGRVLILEHVLPEAVDPAAPGFAYLSDLNMLVNLGGRERTRADFDELCGRAGLSIVSVTPMGAPNPLSMIEVAAA

SEQ ID NO: 36170 - protein, 88 aa, Zea mays
MPHPYPALTPDHIKELADIAHRIVAPGKGILAADESTGSTAKRLQSIGSENTEENRRFYRQLLLTADDRVNPCIGRVILFHETLYQKA

SEQ ID NO: 36171 - protein, 588 aa, Vibrio cholerae O1 biovar eltor str. N16961
MEMGMNWTHTPLALSALMFAMAAQATPNQATDAVAPEQATGFEHKSLVKAKNWMVTAANPLASEAGASILRQGGNAIDAMVTTQLMLGLVEPQSSGIGGGSFLVYWDAKKKALTTFDGRETAPLNATPELFLDSTGQPMKFYDAVVGGRSVGTPGTVKLLWETHRQYGKLEWARLIEPVAKLAEQGFEVSPRLAALIAEDKERLGRFPATKAYFFDAQGEPLTAGTLLKNPDYAATLRAIAQQGASAFYQGDIAKDIIATVQNAPGNPGVLAQQDFDTYQVKQRAPVCAAYQSYQVCGMGLPSSGGLTVGQILALTEQYDLKGWGAQDVKSWQVLGDASQLAFADRGLYMADQDYVPVPTQGLLDKTYLAERAKLIQPGKALTSAPAGNPPWHHAQLRSPDQSIELPSTSHFNIVDREGNVVSFTTSIENAFGSRLLVRGFLLNNELTDFSFATQSEGRPIANRLEPGKRPRSSMAPTIVLQDNQPYLAIGSPGGSRIIGYVAQAIVAHTQWGMNIQAAINQPHVLNRFGEIELEQGTSAEQFKPALESLGAKVGIKELNSGLHAIRITAQGLEGAADPRREGVAIGE

SEQ ID NO: 36172 - protein, 582 aa, Synechococcus sp. WH 7803
MRASAFAPVLRLERVSKIYPTGEVLRDVTWEVKDGDRIGLVGVNGAGKSTQMKLIAGLEEPSSGQIVRQGEPRIAFLQQEFDVDPERTVREELFQAFGEAAQVLSEQKQVELAMASEQAASDPDHLDQLIHRLGALQTRFESLHGYELDARIDKLLPTIGFSAEAAEQLVKDYSGGWQMRIALGKILLQDPDLLLLDEPTNHLDVETIQWLEDYLKTQTAALVVISHDRAFLDQVCNQIVSTERGISRAYLGNYTAHLEQKQQEQEATQAAFDRQQKDIAAQQAYIDRFRASATRSTQAKSREKQLEKVERVEAPIESVSGPSFRFPPAPRSGAQVALIDNLTHSYGDKILFLGAELEVERGDRIAFVGPNGAGKSTLLRLVMGLETPDEGSATLGEHNIVASYFEQNQAEALDLSKTVIDTLFEAVPDWTQTQVRSLLGSFCFSNESVFKEVGQLSGGEKARLALALMLLSPCNLLVLDEPTNHLDIPAKQMLEDALCAYEGAALLVSHDRYFISRVANRIVELRDGELVLYRGDYNYYLEKKTEERQAAEEALQKAEQEAKRQAKREKQKERESRRKKAA

SEQ ID NO: 36173 - protein, 353 aa, Saccharomyces cerevisiae
MPKRIVYNISSDFQLKSLLGEGAYGVVCSATHKPTGEIVAIKKIEPFDKPLFALRTLREIKILKHFKHENIITIFNIQRPDSFENFNEVYIIQELMQTDLHRVISTQMLSDDHIQYFIYQTLRAVKVLHGSNVIHRDLKPSNLLINSNCDLKVCDFGLARIIDESAADNSEPTGQQSGMTEYVATRWYRAPEVMLTSAKYSRAMDVWSCGCILAELFLRRPIFPGRDYRHQLLLIFGIIGTPHSDNDLRCIESPRAREYIKSLPMYPAAPLEKMFPRVNPKGIDLLQRMLVFDPAKRITAKEALEHPYLQTYHDPNDEPEGEPIPPSFFEFDHYKEALTTKDLKKLIWNEIFS

SEQ ID NO: 36174 - protein, 521 aa, Prochlorococcus marinus str. MIT 9301
MSNFSRYLSKNWLDDPKSNILSGLVVAFAMIPEAIAFSGIAGVDPKVGLFGAFCLSITIAIVGGRRGMITSATGSTALLMTGLVAYGESQAPGLGVPYLIAAGILTGIFQILWGYLRLAYQMRFVPTGVLSGFVNALALLIFQAQLPQLGIGIKESKGLIEQTLSQYPVNSQIPVVWILVILGLIIIYGLPKITKVVPSQLIAIVVITLISIFLNLDVPTVGDLGKLPDGLPSISLPFGSIENGKVPFSLETLGIILPTSLAISLVGLMETFLTQDILDDVTDTSSNKNKEARGQGIANIVASLFGGMAGCALVGQSVMNTENGGKSRLSTLSSGISLLIMIILLKSWIGAIPMAALVAIMITIAISTADINGLKNIRKIPKSDTAVMLMTFAVTMLTKPHNLALGVIAGVALAAILFSRKVAKVITISRSKENNLTTYKVKGQLFFVSKIYFLQGFDIYEHPENIVIDMSLAHIWDQSGVIALEQIIRKFQNGGSKVEIVGLNKESLNLFERLGGIESAH

SEQ ID NO: 36175 - protein, 366 aa, Zea mays
  misc_feature (212)..(212): Xaa can be any naturally occurring amino acid
MGSTAGDVAAVVDEEACMYAMQLASSSILPMTLKNAIELGLLEVLQKEAGGGKAALAPEEVVARMPAAPSDPAAAAAMVDRMLRLLASYDVVRCQMEDRDGRYERRYSAAPVCKWLTPNEDGVSMAALALMNQDKVLMESWYYLKDAVLDGGIPFNKAYGMTAFEYHGTDPRFNRVFNEGMKNHSVIITKKLLDFYTGFEGVSTLVDVGGGXVGATLHAITSRHPHISGVNFDLPHVISEAPPFPGVRHVGGDMFASVPAGDAILMKWILHDWSDAHCATLLKNCYDALPEKGGKVIVVECVLPVSTEAVPKAQGVFHVDMIMLAHNPGGRERYEREFRDLAKAAGFSGFKATYIYANAWAIEFIK

SEQ ID NO: 36176 - protein, 266 aa, Listeria monocytogenes str. 4b F2365
MKKIGFIGAGNMGTAMIRGLAQANLDNSEAIIVGGRNLEKLKPLEAAFTGLQITTDTEKLVEQADIIILAVKPYTIPEILTSVKEQLTPDKIIISVAAGVTIQDLEELTSAKTKIVRVMPNTPALVGEAMSSISPNINVSSEEINEVTAIFTSFGEAEVVSENLMDAVIGVSGSSPAYVYMFIEALADGAVLSGMPRDKAYKFAAQAVLGAAKTVLETGEHPGKLKDMVTSPGGTTIEAVKSLENDGFRSAVINAVQAAANKNSSM

SEQ ID NO: 36177 - protein, 314 aa, Triticum aestivum
MESGADEVVFDCDDYRIYRSGQMDRLCRPARVPTGLDPATGVTSKDVVLDYDTGLSVRLFLPTSRDPSKRLPILVFFHGGGFLVESAVSPQYHNYVASLAAVAGVVAVSVEYRLAPEHPVPDAYDDTWAALSWAASSQDEWLAEHGDSARLFLAGDSAGGNIVHNVLIRASFQPAPRVEGAILLHPWFGGNTFLEGEVEATAKDMAMIWEFACPGAVGGADDPRMNPMAPGAPGMENLRCERMLVCAGEKDWLAARDRAYYAAVTTSAWRGSVWRGGVAWFESEGEGHVFFLKKPDCAKAKELMARVVAFIAGT

SEQ ID NO: 36178 - protein, 835 aa, Gloeobacter violaceus PCC 7421
MRAVLMAGGSGTRLRPLTCDLPKPMVPILNRPISEHILNLLKRHGVDEVIATLYYLPDVMREYFRDGSDFGLRMTYAVEEEKPLGTAGCVKNIENLLHETFIVISGDSLTDIDLSAAVAFHKEHGSKATLVLARVPDPMEFGVVITDAHGRIVRFLEKPSTSEVFSDTVNTGTYILEPEVLEYLPADTEVDFSKDLFPKLLAKGEPMYGYVAEGYWCDVGSLDTYREAQYDALAGKIRLEHGYRQHAEGIWIGDNTLVDPSVHLEPPLIIGHNCRIGPRARLSAGTIIGDNVTVGAAADLKRPVIWNGAIIGEEVHLRGCTIARGARVGRRAQLLEGSVVGALTTVGDEAVIAPEVRLWPSKKVEVGAHVTMNLIWGTTAIRNLFSQRGVSGLANVEITPEFAVKLGAAYGATLKPGAQVQVSRDQRAISRMISRSLVSGLMSVGVNVQNLEATAIPIARYVAPMLEVNGGIHVRVHPEHNDRTLIEFFDSQGINLGKSREKKIESAFFKEDFRRARIDEIGEITYPSRTLEFYGAGFIDHLSAVALRNSPARVVIDYAYGVSGAVLPTLLGKLGCEAVVLNAALTPNAPPTSKQRESLLTQLGNVVEALQATFGVQIFANGERFTLVDEAGAAIKDEQLTALLVELVLTDSPRAVVVVPTEVSGVVEQIAHRHDGRVVRTKASPTALMEAAAATNNVALAGSAEMGFIFPQLHPGFDAMFAVARLIEMLAEQERSLSQTRQDLPRIHHRHHVIHCPWNAKGAMMRQLVESHPEESLELMDGVKVHFSKEDWVLILPDAGEPLVHIYSNGHNRESVERMARKYREVVQEFTRDRR

SEQ ID NO: 36179 - protein, 299 aa, Geobacter metallireducens GS-15
MTPGMGEANVAQVFIVGCGDIGKRVARLAMDKGVAVTALVRSEESAAKLHELGIETVEGHLDDPESLAGLPLRGATVFYFAPPPGGGITEPRVRAFCAAVRPGDEPAQVVYLSTSGVYGDCGDMIVTEDTPANPQTARAKRRYDAETVFRAWGKERGVPIVVLRVTGIYGPGRLPLQQLTSGQPVLFESEASYTNRIHSEDLARVCMAAAEKGEDGDIFNVSDGNPGTMTEYFNACADALGFPRPRQVTMEEAKKVMTPLMLSYVTESRRMDNAKMVGKLEVKLLYPTLQDGLKASVAK

SEQ ID NO: 36180 - protein, 431 aa, Arabidopsis thaliana
MGEARPRRATTFACLSIRRRRNNNGVSEFEETARFEQVGGKGISVLCGLGYWVQGSRCFPWLALNFHMVHSLALQPSTLQLVQYSCSLPMVAKPLYGVLSDVLYIGSGRRVPYIAIGAGGVLGNLLGGYLLLTTPPKISFLVFSALLSLQLVVSLSSKEESFGLPRIAETSSVLESVKKQISNLKEAIQADEISQPLIWAVVSIAMVPLLSGSVFCYQTQVLNLDPSVIGMSKVIGQLMLLCLTVVYDRYLKTLPMRPLIHIIQLLYGLSILLDYILVKQINLGFGISNEVYVLCFSSLAEILAQFKILPFAVRLASMCPQGCEGSVTSFLASTLCLSQIVSAFLGVGLANLIGITSSNYSNLSSGILIQSLAALAPLCFMHLVPMSEPVIEKEGKRGISKRSRRNRRVGRVVDKESVTYRRERESEEAQR

SEQ ID NO: 36181 - protein, 305 aa, Zea mays
  misc_feature (244)..(244): Xaa can be any naturally occurring amino acid
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGESRFTINGKPIFHFVGTSTFSEYTVIHVGCLAKINPEAPLDKVCVLSCGISTGLGATLNVAKPKKGSTVAIFGLGAVGLAAMEGAKMSGASRIIGVDLNPAKYEPAKKFGCTDFXVNPKDHTKPVPEVLGEMNNGGSHRPVECTGHLHALIPPLRMGPLMGGGGGVAWGGAPPPKE

SEQ ID NO: 36182 - protein, 427 aa, Dechloromonas aromatica RCB
MSSIVDVIAREILDSRGNPTVEADVLLESGVMGRAAVPSGASTGTREAIELRDGDASRYLGKGVMQAVENVNTEISEAIIGLDAQEQAFIDQTMIDLDGTDNKSRLGANAILAVSMAVAKAAAEESGLPLYRYFGGMSPMQMPVPMMNIINGGEHANNSLDIQEFMVMPVGAANIREAIRCGAEIFHALKKLLNKKGHSTAVGDEGGFAPNLGSHAEALQIIMEAIEIAGYVPGQDVLLALDCAASEFYKDGKYKLAGEGLELTSAQFVDYLANLADQFPIVSIEDGMSEADWDGWKLLTDRLGDKVQIVGDDIFVTNTKIFKEGIKKGIGNSILIKINQIGTLSETFAAVEMAKRAGYTAVISHRSGETEDSTIADIAVGLNAGQIKTGSLSRSDRIAKYNQLIRIEEDLGDTASYPGRETFYNLR

SEQ ID NO: 36183 - protein, 308 aa, Shigella flexneri 2a str. 301
MAVAMDNAILENILRQVRPLIGQGKVADYIPALATVDGSRLGIAICTVDGQLFQAGDAQERFSIQSISKVLSLVVAMRHYSEEEIWQRVGKDPSGSPFNSLVQLEMEQGIPRNPFINTGALVVCDMLQGRLSAPRQRMLEVVRGLSGVSDISYDTVVARSEFEHSARNAAIAWLMKSFGNFHHDVTTVLQNYFHYCALKMSCVELARTFVFLANQGKAIHIDEPVVTPMQARQINALMATSGMYQNAGEFAWRVGLPAKSGVGGGIVAIVPHEMAIAVWSPELDDAGNSLAGIAVLEQLTKQLGRSVY

SEQ ID NO: 36184 - protein, 240 aa, Thermobifida fusca YX
MSGEARRAELAANLERVRERVAAACAAAGRKPEEITIVAVTKQYPASDVRLLAELGIRDIGENRDQEAAPKAAECRDLDLTWHFVGQLQTNKARSVARYADVVHSVDRMRLVTELGRRVRAAERTVTCLIQVNLDPDSEQGVLGPRGGADPGDVPALAEAVEAEEGLALGGVMAVAPRQGDPREAFDRLKTVAEELQARYPHATVISAGMSGDLEAAIERGATHLRIGTALLGNRRLIVG

SEQ ID NO: 36185 - protein, 952 aa, Chlamydomonas reinhardtii
MRGGSPASGEKGHRRRKPVGRLLRRRRPRQGRRQARPRTPVQHPPPHSSHIHQRVFIFGKNKSQGDATMKNLLGGKGANLAEMSRIGLSVPPGLTITTDTCAEFHTNGRQLPAGCWEEILAGLRSVEEEMGCRLGDAAAPLLLSVRSGAAVSMPGMMDTVLNLGLNDACAAGLAARSGDERFAYDAYRWRFLDMYGDVVMGIPHHLFEEQLERLKAEQRVSEDTALTAADLRTLVARYKEVYKQLGQVFPEDPYEQLRLAIYAVFDSWRSERADVYRAVNGITGLTGTAVNVQAMAFGNMGPTSGTGVCFTRNPSTGERKLYGEYLINAQGEDVVAGIRTPEPIETLERSLPGAFKELLDNCALLEKHYKDMQDIEFTVQEGKLYMLQCRGGKRTGTAAVRIAVELVDEGLVDEDEAVLMVEPGHLDQLLHPQFANEAAYKSDVLGTGLPASPGAAVGQAVFSAEDAEAWRSSGLPVVLVRRETSPEDVKGMYSAEGVLCQLGGMTSHAAVVARGWGKPCITGCADLQVDEHSKVARINGHEIRQGDWISLNGSTGEIVRGKQPLAPPELAGDLGRFMSWVDKRRRLGVLTNADTPEDAAEARKFGAEGIGLCRTEHMFFASEERIATVRRMIVAQTREARLKALADLLPFQRADFEGILRAMAGLPVTIRLLDPPLHEFLPDGEMTEVCEALARDAGVTVDEVYGTIEKLQEVNPMLGFRGCRLGITYPEITEMQVRAMFEAAVRAGRLRAGAGAGKAMQGRQVGAWCACMRRAASHRPTSCQQPRIPNPFCCAQVMSESGGVRVPYRVGTMIEVPRAALQAGAIAKTAEFFSFGTNDLTQMTFGYSRDDIGKFLPVYLEKGILPYDPFQVLDQEGVGELIRFAVERGRAARPDLKIGICGEQGGEPRTVAFLHEVGLDYVSCSPFRVPIARLAAGQAAVRSQRAAAAAKK

SEQ ID NO: 36186 - protein, 326 aa, Saccharum officinarum
MGLADHGDAFLIPTPYYPGYVCVCVRCFFNSRCKWRPAADWRRAMHVTATYLGLLALVVYRFDRDLKWRTGAEIVPVHCTSGNGFRVTRAALDDAYRRAQKQRLRVKGVLITNPSNPLGTTSPRADLEMLVDFVAAKGIHLVSDEIYSGTAFAEPGFVSVLEVVAARVNAATDADGLLSERVHVVYSLSKDLGLPGFRVGAIYSSNAGVVSAATKMSSFGLVSSQTQHLLASLLGDRDFTRRYVAENTRRIKGRRDQLAEGLAAIRGIECLESNAGLFCWVNMRGLMRTPSFEGEMELWKKVVFEVGLNVSPGSSCHCREPGWFRV

SEQ ID NO: 36187 - protein, 122 aa, Arabidopsis thaliana
  misc_feature (21)..(21): Xaa can be any naturally occurring amino acid
  misc_feature (39)..(39): Xaa can be any naturally occurring amino acid
  misc_feature (47)..(47): Xaa can be any naturally occurring amino acid
  misc_feature (58)..(59): Xaa can be any naturally occurring amino acid
  misc_feature (61)..(61): Xaa can be any naturally occurring amino acid
  misc_feature (69)..(69): Xaa can be any naturally occurring amino acid
  misc_feature (72)..(73): Xaa can be any naturally occurring amino acid
MASSMLSSATMVASPAQATMXAPFNGLKSSAAFPATRKXANNDITSXTSNGGRVNCMXXWXPIGKKKFXTFXXLPDLTDSRIGKTLFRQGGPWGWIIGARILPGSPGEPGLMGRSLPLFTSR

SEQ ID NO: 36188 - protein, 401 aa, Apodachlya brachynema
  misc_feature (180)..(180): Xaa can be any naturally occurring amino acid
SGNPSVEVDLVTEDGLFRAAVPSGASTGEFEALELRDGGKDYMGKGVKTAVHNVNDIIAPALIGKDQNKQTELDTFMVETLDGTKNEWGWCKKKLGANSILAVSLALCKAGAAAEKVPLWQHIANLAGNPTPCLPVPSFNIINGGSHAGNKLAMQEFMILPVGATSFTESMQIGCEVYHXLKKVINKRYGLDATAVGDEGGFAPNIQVNGEALDLIQEAIALAGYTDKVKIGMDVAASEFYTGKEDARYNLDFKNENAQDSDKISADELIDVYQSFITKCKDKSPIVSIEDPFDQDDWESWMKLTAAVGEDIQIVGDDLTVTNPTRVQKAIDQKACNALLLKVNQIGSVTESIQAVTMSKRAGWAIMASHRSGETEDSFIADLAVGLSAGQIKTGAPCRER

SEQ ID NO: 36189 - protein, 388 aa, Apodachlya brachynema
  misc_feature (161)..(161): Xaa can be any naturally occurring amino acid
SGNPTVEVDLITQDGLFRASVPSGASTGIHEAVELRDGGSRFLGKGVLKAVNNVNDIIGPKLEGMDPRKQKDIDHLMIQLDGTDNKGRLGANAILGVSLAVAKAGAKSKGVPLFQHFADMIKNDKLILPVPAFNVINGGSHAGNKLAFQEFMIMPVGASSXSEAMVMGCEVYHHLKGVIKKKYGQDATNVGDEGGFAPNIQSNREGVELLMSAIEKAGYNGQVKIAMDVASSEFYTDAGHYDLNFKNKGSNEKPLTGEELGALYQQLSNEFPIISIEDPFDQDDWSHYKSFTNAIGEKVQVVGDDLLCTNPKRIATAVDTFACNALLLKVNQIGSVTESVQAVADAKKAGWGVMTSHRSGETEDSYIADLAVGLSTGQIKTGAPCRER

SEQ ID NO: 36190 - protein, 283 aa, Citrobacter freundii
RAAQERSDIEIVAINDLLDADYMAYMLKYDSTHGRFNGTVEVKDGHLIVNGKKIRVTAERDPANLKWDEVGVDVVAEATGLFLTDETARKHITAGAKKVVLTGPSKDNTPMFVKGANFDKYEGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAASYEEIKKAIKAASEGPMKGVLGYTEDDVVSTDFNGEVCTSVFDAKAGIAL

SEQ ID NO: 36191 - protein, 363 aa, Buchnera aphidicola (Rhopalosiphum padi)
MKKKFRIAVLPGDGIGPEIMREAYKILNILEKNFSLPLEIREFSVGGIAIDREGIALPEETLRGCENSDAILFGSVGGKKWDYLPIESRPERASLLPLRKHFNLFSNLRPAKLYSDLKNLSPLRSNIVRNGFDILCVRELTGGIYFGKPKGRSKNENGEYSFDTEIYYDFEIKRIAHLAFELASSRRCKVCSIDKSNVLASSILWREIVEEVSKNYPNIILSHLYIDNACMQIIKNPSQFDVLLCSNIFGDIISDECAMITGSIGMLPSASLNSKKFGLYEPAGGSAPDIEGKNIANPIAQILSLSMLIRHSMNLNEIADKIDSSVYRALKAGYRTLDISDGKNYIKTNEMGDIIAKFLINGK

SEQ ID NO: 36192 - protein, 367 aa, Glycine max
MVFSQSAILREEVEEAMSIQELIKKPLTSVPQRYIQLHNNEPSLLAGETFSHALPTINLKKLIHGEDIELELEKLTSACRDWGFFQLVEHGISSVVMKTLEDEVEGFFMLPMEEKMKYKVRPGDVEGYGTVIGSEDQKLDWGDRLFMKINPRSIRNPHLFPELPSSLRNILELYIEELQNLAMILMGLLGKTLKIEKRELEVFEDGIQNMRMTYYPPCPQPELVMGLSAHSDATGITILNQMNGVNGLQIKKDGVWIPVNVISEALVVNIGDIIEIMSNGAYKSVEHRATVNSEKERISVAMFFLPKFQSEIGPAVSLTNPEHPPLFKRIVVEEYIKDYFTHNKLNGKSYLEHMRITDDEKFTNASI

SEQ ID NO: 36193 - protein, 389 aa, Heterosigma akashiwo
SGNPTVEVDIFTDNGMFRASVPSGASTGIYEACELRDGGDRYMGKGVLQAVNNVDTLIKDALIGKDPTQQREIDQIMLDLDGTKNKTKLGANAILGVSLAVSKAGAAAKGVPLYQHYADLAGNTQLVLPVPSFNVINGGSHAGNKLAFQEFMVLPTGAATFSEAMQIGCEMYHTLKKVIKERYGQDATNVGDEGGFAPNIQSNREGVELLMEARSRCGHGDKIVFGMDVAASEFWTEDKEYDLDFKTKDNDGSQKITGAELAQMYKDLAAEFPIVSIEDPFDQDDWEAYTAMTADMGTDCQVVGDDLLVTNPERIQMASEKSACNAPLLKVNQIGSVTEAIDAVKMAKQNGWGVMTSHRSGETEDCYIADLAVGLCTGQIKTGAPCRER

SEQ ID NO: 36194 - protein, 283 aa, Serratia sp. MF 426
RAAQERSDIEIVAINDLLDADYMAYMLKYDSTHGRFNGTVEVKDGHLVVNGKTIRCTSERDPANLKWNEVNVDVVAEATGLFLTDETARKHIAAGAKKVVLTGPSKDDTPMFVMGVNHKSYAGQEIVSNASCTTNCLAPLAKVINDKFGIVEALMTTVHATTATQKTVDGPSHKDWRGGRGASQNIIPSSTGAAKAVGKVIPELNGKLTGMAFRVPTPNVSVVDLTARLAKPASYKEICAAIKAASEGELKGVLGYTEDEVVSTDFNGEKLTSVFDAKAGIAL

SEQ ID NO: 36195 - protein, 215 aa, Hordeum vulgare subsp. vulgare
MAEDTETRPASAGAEEREEGEIADDGDGSAAAAAGRVSAHPLENAWTFWFDNPQGKSRAVAWGSTIHPIHTFSTVEDFWSLYNNIHHPSKLNVGADFHCFKDKIEPKWEDPICANGGKWTISCGKGKSDTFWLHTLLALIGEQFDFGDEICGAVVSVRKNQERVAIWTKNAANETAQISIGKQWKEFLDYKDSIGFVVHEDAKRSDKGAKNRYTV

SEQ ID NO: 36196 - protein, 261 aa, Bacillus megaterium
MYTDLKDKVVVVTGGSKGLGRAMAVRFGQEQSKVVVNYRSNEEEALEVKKEIEQAGGQAIIVRGDVTKEEDVVNLVETAVKEFGTLDVMINNAGVENPVPSHELSLENWNQVIDTNLTGAFLGSREAIKYFVENDIKGNVINMSSVHEMIPWPLFVHYAASKGGMKLMTETLALEYAPKGIRVNNIGPGAIDTPINAEKFADPEQRADVESMIPMGYIGNPEEIASVAAFLASSQASYVTGITLFADGGMTKYPSFQAGRG

SEQ ID NO: 36197 - protein, 307 aa, Sulfolobus solfataricus P2
MRKVIVDSDTATDDTIAILLASRFFQLLGVTIVAGNVNYNQEVKNALFTLEYIGKQDVPVYLGSQRPILGNWRTVEEVHGSNGMSNWNYPEPNKRPEKEHAIDAILRLSKEHEGELEILAISPLTNIALAYLKDPSVVKRVKKIWIMGGAFSKGNTTPIAEFNFWVDPEAAKIVLDAGFDITIVPWEVAEISGSLNERDWEYISKLNTKLSNFFINVNKTLKEYTTKNQGISGSIHPDSLTVSIAHDNSIILDSSLKYVDVELCSKSRGAMLIDWYSLHKNKPNAEIVLKADGGKFKNLLFNSLSQL

SEQ ID NO: 36198 - protein, 374 aa, Isochrysis galbana
STGIYEALELRDGDKDKYMGKGVQKAVDNVNNIISPALEGMSPIDQKAIDDKMVRELDGSKNEWGWSKAKLGANAILAVSMAVCKAGAGAKGIPLYKHIANLSGNPVDKMYMPVPAFNIINGGSHAGNKLAMQEFMILPVGATSFKEAMQMGSEVYHNLKKVIAAKYGQDACNVGDEGGFAPNILDNKEGLDLVVTAIEKAGYTGKVKIGMDVAASEFWKGEEKVYDLDFKTENNDGSQKLSGEKLAELYESFVNDYPMISIEDPFDQDDFASYTATTAKLGEKCQIVGDDLLVTNPTRVLKAIDEKACNALLLKVNQIGSITEAIDAVTMAQKAGWGVMTSHRSGETEDSFIADLAVGLKTGQIKTGAPCRER

SEQ ID NO: 36199 - protein, 283 aa, Enterobacter cloacae
RAAQKRSDIEIVGINDLLDAEYMAYMLKYDSTHGRFDGTVEVKDGHLVVNGKTIRVTAEKDPANLKWNEIGVDVVAEATGIFLTDETARKHITAGAKKVVLTGPSKDNTPMFVRGANFETYAGQDIVSNASCTTNCLAPLAKVINDNFGIIEGLMTTVHATTATQKTVDGPSHKDWRGGRGAAQNIIPSSTGAAKAVGKVLPELNGKLTGMAFRVPTPNVSVVDLTVRLEKAASYEEIKKAIKAASEGAMKGVLGYTEDDVVSTDFNGEICTSVFDAKAGIAL

SEQ ID NO: 36200 - protein, 737 aa, Ostreococcus tauri
MTTARPGTRPVRRFKSSTFDLISARIVPAIALPSITVAVDDAAPMSRAVDRAGVRARGRGDRARGRRRREGSWITLTSDDSSTGPSGCRTPACARTPTSPSVPIRESRLVTYPSRPGPIPSARRPRPWTSKRERATRSPGAVDAGPHGARARCGATRRDARADWLAKNDGKEKKRDGKKPTRDARGRRRPQTSETTSGRSEKDDVTFDGFTNEELRPDFGFRRDLYELYDVPVNDEPLGAGSYGVVRAAVSKKTGEVFALKTLKKAPWIKAPASMQAVNYYHGKIRNEVEVMRTIGGSLSVCYLYEAFEDDENCHLLMELCSGGELLDRVVIGSSEEYREAKVANLVKSVLRTTVQCHRRGIIYRDIKPDNFLFQTEDQDSPLKATDFGLAGKLPPNGENLARRCGTPSYMAPEVIERNYNSPADVWSAGVVTYQLLSGRLPFTDKINPRPNAKEVFRAILEDPIDFETDPWPEVSEDAKDFVKKLLNKDPDARPTARAALLHPWLTKSEALWKAEALKGKDTALNGQVVARLQRFATQGLLKRSVLRLITSEMLSEDMEDAVSLKNADLATLKKLFEKLDTSGDNMVELVELEVGLREIGYDVTGKESKQLLGSLDTSGDGLIDVNEFTAALLDWEKIEKTSDYPKWVERAFKVLDKDGSGEIDADEVAELIFEDWEEDNDSVRTSIIRACIREADKDGNGQIDLEEFAGLLQSDPSDDLDQYDSRIASSFDFDQV

SEQ ID NO: 36201 - protein, 121 aa, Picea sitchensis
MRKANACVYVCVLLVLIAALEWQVVLSTDQGINGSGVTTVHPASSPSPSPSPAPAPAPPLIDCKSECDRRCKVAPRQKACLKFCGICCNACKCVPSGTRGNKDECPCYRDKRSSQGKPKCP

SEQ ID NO: 36202 - protein, 262 aa, Thermotoga maritima
MGSDKIHHHHHHMIRIKTPSEIEKMKKAGKAVAVALREVRKVIVPGKTAWDVETLVLEIFKKLRVKPAFKGYGGYKYATCVSVNEEVVHGLPLKEKVFKEGDIVSVDVGAVYQGLYGDAAVTYIVGETDERGKELVRVTREVLEKAIKMIKPGIRLGDVSHCIQETVESVGFNVIRDYVGHGVGRELHEDPQIPNYGTPGTGVVLRKGMTLAIEPMVSEGDWRVVVKEDGWTAVTVDGSRCAHFEHTILITENGAEILTKEG

SEQ ID NO: 36203 - protein, 124 aa, Pavlova lutheri
ASTGIYEALEMRDGDKSMYMGKGVSKAVHNVNTIIGPALVGMDPVQQKEIDDKMVKTLDGSKNDWGWSKSKLGANAILGVSMAVCKAGAASKGIPLYKHIAELAGNPTDKMYMPVPSFNVINGG

SEQ ID NO: 36204 - protein, 283 aa, Serratia sp. MF 416
RAAQERSDIEIVAINDLLDAEYMAYMLKYDSTHGRFDGTVEVKDGHLVVNGKTIRCTSERDPANLKWNEVNVDVVAEATGLFLTDETARKHIAAGAKKVVLTGPSKDDTPMFVMGVNHKSYAGQEIVSNASCTTNCLAPLAKVINDKFGIVEALMTTVHATTATQKTVDGPSHKDWRGGRGASQNIIPSSTGAAKAVGKVIPELNGKLTGMAFRVPTPNVSVVDLTARLAKPASYKEICAAIKAASEGELKGVLGYTEDEVVSTDFNGEKLTSVFDAKAGIAL

SEQ ID NO: 36205 - protein, 270 aa, Picea sitchensis
MAERGGGFGRGFGRGRGDRGRGDRRGGRRGPRRDEEEKWVPVTKLGRLVKEGKIRSLEQIYLFSLAVKEHQIVEAMLGPQLKDEVMKIMPVQKQTRAGQRTRFKAFVVVGDGNGHVGLGVKCSKEVATAIRGAIILAKLSVIPVRRGYWGNKIGKPHTVPVKVTGKCGSVTVRMVPAPRGAGIVAARVPKKVLQFAGIEDVFTSSRGSTKTLGNFVKATFECLLKTYGFLTPDLWRETRFSKSPFQEYTDLLAKPAKALILEDVDKEALV

SEQ ID NO: 36206 - protein, 630 aa, Digitaria sanguinalis
MPKRDKGARPRVSPPHTPPPGTESEAEGADDEAGASSAAEMGTYKCCIFFTHKFAIDDTTTPEDVRTLFSRYSGGSPYMGPDDLRRYLANWGGAGGEVAEQIVDRVLQDRSRTPRFGRPALTVDDFMHFLFSEDLNPPLRHSKVHQDMNAPLSHYFIHTGHNSYLTGNQLSSDCSDVPIIKALQLGVRVIELDIWPNSSKDDIDVLHGRTLTAPVSLIKCLRSIKQYAFVASPYPVIITLEDHLTPDLQAKVAQMVLEVFGDMLYYPESKHLQEFPSPEALKGRVMLSTKPPKEYLEAKGGTIKDREIEHQFKKGEKEEAAWGVEVPDIQDEMKVADRNEDDILFRERGLDDDDEQKTCKHVAPEYKHLITIKAGKPKGALVDALKNDPDKVRRLSLSEQELAKVASNHGPNIVSFTHRNMLRIYPKGTRFNSSNYNPFLGWVHGAQMVAFNMQGHGRALWLMHGFFQANGGCGYVQKPDFLMQTCPDGKVFDPKADLPVKATLKVKVYMGEGWHKDFKQTHFDTYSPPDFYVEVGIAGVPLDSVMRKTKAVEDNWVPVWEEEFAFPLTVPEIAVLRVEVHEQDVSEDDFGGQTALPVEELRPGICAVPLFDHKGHKFNNVKLLMRFEFT

SEQ ID NO: 36207 - protein, 295 aa, marine gamma proteobacterium HTCC2080
MVTTGALLHGDIDRHLNYGSQEHPLALQLGGSNPQDLARCAKLAEARHYDEVNLNCGCPSDRVQNGRFGACLMAEPELVRDCITAMREAVDIPVTVKQRIGIDHQESFDELRDFVGIVAEGGCNVFIVHARKAWLEGLSPKQNREIPPLNYTWVYALKEQFPQLTIVLNGGIQSLEECEHHLTKVDGVMLGRAAYQTPWLLSSVDSRIFGAEDPAYSRESVIYKLSDYVETYLAQGGRLNHVTRHILGLFHQQPGGRLFRRALSEGAHLSGADATVLLAALAKVTQRHDNESMVE

SEQ ID NO: 36208 - protein, 293 aa, Burkholderia thailandensis E264
MKVTKAVFPVAGLGTRFLPATKASPKEMLPVVDKPLIQYAVEEAIAAGITEMIFVTGRSKRAIEDHFDKSYEIEAELEARGKEKLLSLVRSIKPRHVDCFYVRQAEALGLGHAVLCAQKLVGDSPFAVILADDLLDGRPPVLRQMIDVFNHYHTSVIGVEEIAPQDSKSYGVIDGKRWEDDLFKLSGIVEKPDPAAAPSNFGVVGRYVLTPRIFDHLRALKPGAGGELQLTDALQSLLKDEQVLAHRYDGTRFDCGSKIGYLKATVEFALRHPEVATEFERYLSERFPELVAA

SEQ ID NO: 36209 - protein, 540 aa, Ostreococcus tauri
MGGETRAWTTDARRARDGDGKATAEDERAAKDTVEITGLDDDDHRFNLRTLWRFMGPGFLMCIAYVDPGNFESDLQAGVLFGYKLLWVLLWATAGGWYIQGLTIRLALATGWDLARCLREEYPDPVRYALWVISELGIIASDVPEVIGTALALKLIFSIPTWVGVVLTSMSTMVFLGLQSFGVRKLEAFMASLVGVMSLCFLAECTYVDAAVSSVTAGIIIPRLPGSTALYIAISLVGAVVMPHNLFLHSALVLSRGFVLGEKSLKMAYKYNVVESGLALSVSLFINIAVVVVAAANFAHLTDPQEKNNVRDRPLQYAPQMLKEVLGPAAKGFFAAALLASGQSSTITGTYAGQFVMDGFLELRVNPVLRAFVTRMCAIVPSLAVVLIAGDQYSESLIVISSTILAIQLPFALIPLIKFTASSNIVGPMAVKPKALRYTIALTGTIISANVILVILTVAESGLVHASLAGVFLGMIITALLGLYVVSLVWLAMRPVHQNLTARIAPRMKRPSSASEDPEDAAWTNDELLPDPNEPAVYSL

SEQ ID NO: 36210 - protein, 392 aa, Caulobacter crescentus CB15
MSALMNTYARANIDIVRGEGCWLYDQDGRDYLDLAAGVAVNTLGHGDPRLVQALKTQADILWHASNLYRLPAQEALATKLTDATFADRVFFANSGAEAVEAAIKTARRWQGAKGRPERYRVLTFGNAFHGRTLATISATDQMKVREGFTPLYDAFDTTPFNDIEGAARAITPQTAAILVEPIQGEGGLTPATPGFLAGLRALCDQHDLLLILDEVQTGIGRTGHLFAHELYGVRPDIIAVAKGLGGGFPIGACLATEDAASGMTPGSHGSTYGGNPLACAVASAVLDAVLAPGFLETVRERAALVDALLERLLRRHSDLFVRAQGHGLMRGLQVRASARDVVAHLRDFGVMTVAAGADVVRLLPPLTISELEIAEAEARLLRAAEAWLPIAA

SEQ ID NO: 36211 - protein, 116 aa, Triticum aestivum
MASQEKPITPSPSPPAPPQPPPPEGVPRIRGFGGGAGGGGYPNPPDAALPDAATLRDQWRFAVRQYSRWYSQAWGTAILAGGAFFALGWLVKGSNPLPSRADPRPPSGASADEDKK

SEQ ID NO: 36212 - protein, 298 aa, Bifidobacterium longum DJO10A
MKGIILAGGSGTRLYPLTTVTSKQLLPVYDKPMIYYPLSVLMMAGIRDILIISTPKDLPNFERLLGDGSQYGVSFSYKVQPSPDGLAQAFILGEEFIDGEPCALVLGDNIFYGNGLGRTLRKAATVEHGATVFGYYVDDPERYGVVEFDENKKAISIVEKPEHPASNYAVTGLYFYDERVTEFAKQVKPSPRGELEITDLNKMYLEDGTLNVQTLGRGYAWLDTGTMDSLYEAGEFVRTVQRAQGLPIAVAEEIAFENGWITRDELMEAAVKYGKSPYGKHLKDVAENKIIVKPRDVR

SEQ ID NO: 36213 - protein, 221 aa, Zea mays
MKLDVPARQQSSQDAEQSGKTVAAAVLGTEAWSHPELPLLLRDANTDDALVPPLNFAMVDDGIFRSGLPDAANFRFLLSLNLRSIVYLCPEPYPEENARFLRTNGIRLHQFAVEGSKSGPTVLDTMSAQEPFVHIPEETIREALKVVLDVRNQPVLIHCKRGKHRTGCVVGCLRKLQKWCLSSVFDEYLHFAAAKARTTDQRFMELFDASSLMHLTAASQY

SEQ ID NO: 36214 - protein, 269 aa, Zea mays
MRKRERENPCGICGHYHKYEEGEVCGVCGHRWKPSDGEGAPSRHESAFPTEVLKDFLFLGSYDNASRSEVLRTLSISHILNTVPDCHNLYKNSFTYHSLQRDRPLDFDEANQYLEKCERDKSRVLVHCMTGKNRSAAIVAAFLMKSRGWRLAQSFQWVKDRRPQVQLTDASQKELLEYELKLFGPSTQTLVPTESFASLGFGYTKPAGDMQTPVFNQTTMPSIFERFNPNDRPANFTFGVERKAEANPRDNNSDGRVNPTSMENLMDSS

SEQ ID NO: 36215 - protein, 179 aa, Solanum tuberosum
MAQALEFYNGQIEALMRAMSVAKIIREDKNPCMIEEGLYLGSLGAANNKVALKSLNLTHILTIARDINPPYPNEFVYKVLSVHDRVDVNISHYFEECFDFIEEAKGQGGGVLVHCFAGKSRSATIVIAYLMKKHGMSHSEAFELAKSKRPVVSPNAGFMTQLENYDKTLKDLNTPNVML

SEQ ID NO: 36216 - protein, 758 aa, Azoarcus sp. EbN1
MDELIRSAALDYHRYPQPGKISVTPTKVLSNQRDLSLAYSPGVAAACDAIVEDPAEAATLTARSNLIGVVTNGTAVLGLGNIGPLAAKPVMEGKGVLFKKFAGIDVFDLEIAEKDADKLIDMIAALEPTFGGINLEDIKAPECFYIESKLRERMKIPVFHDDQHGTAIVVGAAVLNGLHLLGKDLKKIKLVTSGAGAAALACLRLLEKLGIPVENIWVTDIEGVVYEGRTALMDPIKARYAKPTPARTLAEIIEGADVLLGLSAGGVVKREMVAKMAPKPLILALANPIPEILPEEVQAVRDDAIIATGRSDYPNQVNNVLCFPFIFRGALDVGATTITDEMQLAAVKAIAELARAEQSDIVAAAYGEKVSGFGPEYIIPRPFDPRLIVKIAPAVAIAGMASGVATRPITDWDAYRGQLNNFVWHSGLIMKPVFAAARGTGQRIIFSEGESERVLRAVQTVVDEGLASPILIGRPDVVATNIERFGLRIRAEHDFELVNPDSDPRFKELWMDYHRLMERHGVSVDYAKKEVRRRTTLIGSLMLKHGYGDGMICGTYGMHRLHLEFIEKIIGRKPGVENCYALNVVSLPGRTMFLADTYVNYDPTPEQIVEMTLLAAEEMSRFGLTPKVALLSHSSFGSADSPTSEKMRAALQLLHERHPDIEVEGEMHGDAALDAELRLRIFPNSRMREPANLLIFPTLDAANIAFNLLKTAAGEGMTIGPILLGAAKPAHILTPSATVRRIINMTALTAVEAAQGRS

SEQ ID NO: 36217 - protein, 125 aa, Triticum aestivum
MADNKDGVTPKSSAAFPLRNPNVTLNERNFAAFTNRSAAAHPWHDLEIGPEAPAVFNCVVEISKGGKVKYELDKNSGLIKVDRVLYSSIVYPHNYGFIPRTICEDSDPIDVLVLMQEPVLTGSFL

SEQ ID NO: 36218 - protein, 242 aa, Saccharum officinarum
MGLAENQVSFDLLEGYLRDHPEAADWGGAAGSGVASFRDNALMRVRAVLLTNPSNPLGTTVKRSVLEDVLDFVVRHNIHLISDEIYSGSVFAAPDLVSVAELVESRARRGDDSGVAERVHIVYSLSKDPGLPGFRVGVVYSYNDAVVTTARRMSSFTLVSSQTQKTLVAMLSDADFADAYIRTNRERLRARHDHIVAGLARAGVPCLRGNVGLFRVDGHEAAARRGDRRRRAQAVGPDAAGG

SEQ ID NO: 36219 - protein, 464 aa, Pseudomonas putida GB-1
MAVYNYDVVVLGSGPAGEGAAMNAAKAGRKVAMVDDRRQVGGNCTHLGTIPSKALRHSVRQIMQFNTNPMFRAIGEPRWFSFPDVLKSAEKVISKQVASRTGYYARNRVDVFFGTGSFADEQTVEVVCPNGVVEKLNAKHIIIATGSRPYRPADIDFHHPRVYDSDTILSLSHTPRKLIVYGAGVIGCEYASIFSGLGVLVELVDNRGQLLSFLDSEISQALSYHFSNNNITVRHNEEYERVEGLDNGVILHLKSGKKIKADALLWCNGRTGNTDKLGLENIGIKVNSRGQIEVDEAYRTTVPNIYGAGDVIGWPSLASAAHDQGRSAAGSIVDNGSWRFVNDVPTGIYTIPEISSIGKNEQELTQAKVPYEVGKAFFKGMARAQIAGEPQGMLKILFHRETLEILGVHCFGYQASEIVHIGQAIMNQPGEHNNLKYFVNTTFNYPTMAEAYRVAAYDGLNRLF

SEQ ID NO: 36220 - protein, 733 aa, Oryza sativa Japonica Group
MRIGLWIPGMRSGIVTGNPADVEHILRTNFANYPKGQHAIGTLEDFLGHGLFNSDGEQWLWQRKNASYEFSKRSLRKFVVDVVQAEVANRLLPLLRRAAGDGVGGDAVVLDLQDVLQRFGFDTICMVAFGHDPRCLADGGVLEEAKSEFMHNFGEALDLVIGRFMDPIEVSWKIKKWLNIGTERRLKKAIADVHAFAMDIVRARRQSASVKDRDDVLSRFVASDEYSDEVLRDIVLSFLVAGRETTSSGLTWFFWLLSSRPDVVARIADEVRAVRKATGTRPGEPFGFDALREMHYLHAALTESMRLYPPVPTDPQSCAADDTLPDGTFVRAGWFVNYSAYAMGRLAAIWGEDCMEYRPERWLGDDGAFQPASPFRFTVFHAGPRMCLGKEMAYVQMKSIVANVIEELVVDVVKEVAGGGVPEHVFSISLRMKGGLPVKIRRKGHMRGTVRPSIQAAAPGPRWLRLAATLRPISPATAAVRYPLFPLACGHQVSAVTMAKEVDRFVELVVVRHGETSWNSSRIVQGQMDPELNEIGKQQAVVVARRLARKARPAAIYSSDLKRAAETVKIIAKVCDVSNLVLIEALRERHMGYLQGLTWDDAMNKSPGVFKGFANFEVKNGLDFDGRNHEFPDGGESLNQLSEQGISYLNKVAQNHIGERVIVVGHGAAILELCRHTDPPNSSIRRKIPNTSLNIFRISGVTGRWILERCGDVGHLSENGFLENAFGGDGASA

SEQ ID NO: 36221 - protein, 535 aa, Burkholderia xenovorans LB400
MHKPKALAHTVGAIIDPFRSHTALRATRMASHDYLKKTLTARVYDVARETELERAPNLSARLRNPVYLKREDNQPVFSFKVRGAYNKMAHIPAEALERGVITASAGNHAQGVALSAARMGVKAIIVVPVTTPQVKVDAVRAHGGPTVEVVQFGESYSDAYGHAVKLQEERDLTFVHPFDDPYVIAGQGTVAMEILSQHQGPIHAIFVPIGGGGLAAGVAAYVKSVRPEIKVIGVQTDDSCAMAASLKAGERVTLNEVGLFSDGTAVKLVGEETFRLCREYLDDVLLVDTDALCAAIKDVFQDTRSVLEPAGSLAVAGAKQYAEREGIENQTLIAITSGANMNFDRMRFVAERAEVGEAREAVFAVTIPEERGSFRRFCELVGTRSVTEFNYRIADANSAHIFVGVQIRNRSESAQIAGAFEAHGFATVDLTFDELSKQHIRYMVGGRSPLAHDERLFRFEFPERPGALMKFLSSMAPNWNISLFHYRNQGADYSSILVGIQVPESEDAAFDQFLATLGYPNWEETRNPVYRLFLA

SEQ ID NO: 36222 - protein, 132 aa, Chlamydomonas reinhardtii
MAGRGKGKTSGKKAVSRSAKAGLQFPVGRIARYLKKGKYAERIGAGAPVYLAAVLEYLTAEVLELAGNAARDNKKNRIVPRHIQLAIRNDEELGKLLGEVTIASGGVLPNIHAVLLPKKTKGGKAEDGSAAV

SEQ ID NO: 36223 - protein, 288 aa, Hordeum vulgare subsp. vulgare
MEGKEEDVRLGANKYSERHAIGTAAQGSEDKDYKEPPPAPLFEPGELKSWSFYRAGIAEFMATFLFLYVTILTVMGYSGAASKCATVGIQGIAWSFGGMIFALVYCTAGISGGHINPAVTFGLFLARKLSLTRAVFYIIMQCLGAICGAGVVKGFQQGLYMGNGGGANVVASGYTKGSGLGAEIIGTFVLVYTVFSATDAKRNARDSHVPILAPLPIGFAVFLVHLATIPITGTGINPARSLGAAIIYNREHAWSDHWIFWVGPFIGAALAAIYHQVVIRAIPFKTKS

SEQ ID NO: 36224 - protein, 387 aa, Phaeodactylum tricornutum
SGNPTVEVEVTTADGVFRASVPSGASTGAYEAVELRDGGDRYMGKGVLQAVQNVNDILGPAVMGMDPVGQGSVDDVMLELDGTPNKANLGANAILGVSLAVAKAGAAAKKVPLYRHFADLAGNNLDTYTMPVPCFNVINGGSHAGNKLAFQEYFVIPTGAKSFAEAMQIGCEVYHTLGKIIKAKFGGDATLIGDEGGFAPPCDNREGCELIMEAISKAGYDGKCKIGLDVAASEFKVKGEDEYDLDFKYDGDIVSGEELGNLYQSLAADFPIVTIEDPFDEDDWENWSKFTTKNGATFQVVGDDLTVTNIEKIERAIDEKACTCLLLKVNQIGSISESIAAVTKAKKAGWGVMTSHRSGETEDTYIADLAVGLCTGQIKTGAPCRER

SEQ ID NO: 36225 - protein, 149 aa, Trichodesmium erythraeum IMS101
MERTFIAIKPDGVQRGLVGQIISRFETKGFTLVGLKIMTVTKELAEKHYDVHKERPFFSSLIEFIKSGPLVAMVWEGEGVVASARKIIGATNPLTAEPGTIRGDYGISLGRNLIHGSDAIETAQTEINLWFKEEELVSWKPTLTSWIVE

SEQ ID NO: 36226 - protein, 224 aa, Oryza sativa Japonica Group
MSERTIPPPVSSHGEDFAEVVVVRHGETSANALCIIQGQMDIELNEAGRQQAVMVARRLAKEAKPVAVYSSDLKRAAETAQTIATACNVSNLVLSPALRERHMGDLHGLKFDDAVRSKPDAYKAFSSEDRSQEIPGGGESLDQLSERCVSYLNTIAGKHKGERVIVVSHGASIEELCRHADPTSSVRRRIPNTSICVFNISGSTGHWILERFGDVAHLNEDDFP

SEQ ID NO: 36227 - protein, 243 aa, Burkholderia xenovorans LB400
MSKTHFGFQSVDEQDKAQKVAGVFHSVAANYDLMNDLMSGGLHRAWKMFTIAQANVRPGYKVLDIAGGTGDLSKAFAKQAGETGEVWHTDINESMLRVGRDRLLDKGVITPALLCDAEKIPFPDNYFDVVTVAFGLRNMTHKDIALAEMRRVLKPAGRLLVLEFSKVWDPLKKVYDVYSFKVLPWLGEHFAKDAGSYQYLAESIRMHPDQETLKTMMEQAGLDGVKYYNLSAGVVALHVGTKY

SEQ ID NO: 36228 - protein, 132 aa, Saccharomyces cerevisiae
MSGGKGGKAGSAAKASQSRSAKAGLTFPVGRVHRLLRRGNYAQRIGSGAPVYLTAVLEYLAAEILELAGNAARDNKKTRIIPRHLQLAIRNDDELNKLLGNVTIAQGGVLPNIHQNLLPKKSAKTAKASQEL

SEQ ID NO: 36229 - protein, 401 aa, Phytophthora palmivora
SGNPTVEVDLVTELGEYRAAVPSGASTGEFEALEMRDGGKAYMGKGVLNAVKNVNEIIAPALVGKDVTQQAELDRFMVETLDGTQNEWGWCKKKLGANAILGVSLALCRGGAAAKKQPLWQYIADLAGNPTPCLPVPSFNIINGGSHAGNKLAMQEFMILPVGATSFTEAMQIGSEVYHNLKKVIKGRYGLDATAVGDEGGFAPNIQSNGEAIDLIEEAIKAAGYTNQVRLGMDVAASEFYTGAADARYNLDFKNENAPDSEKIPADKLQEVYEGFIAKCAGSSKIVSIEDPFDQDDWESWIKFTGKVGKDVQIVGDDLTVTNPTRVKKAIEQKACNALLLKVNQIGSITESIEAVTMAKKAGWAIMASHRSGETEDTFIADLAVGLSAGQIKTGAPCRER

SEQ ID NO: 36230 - protein, 388 aa, Trichodesmium erythraeum IMS101
MKAMILAAGKGTRIRPITYRIPKPMIPILQKPVMEFLVELLRKHGFDQIMVNVSHLAKEIENYFRDGQRFGVNIAYSFEGRIEDGNLIGEALGSAGGMRRIQDFYPYFDDTFIVLCGDALIDLDLTKALQRHKEKGAMATVIMKSIPREQVSSYGVVVTDETGRIQSFQEKPKVEEALSTNINTGIYIFEPEVLDCIPSGVEFDIGSQLFPKLVEIGAPFYGVAMDFEWVDIGKVPDYWQAIRDVLIGKVKNVSIPGKEVSPGIYTGLNVAVNWDKIDIKRPVYIGGMTRIEDGAKIVGPSMIGPNCWICSGATVDSSVIFEYSRLGPGVRLVDKLVFGRYCVDKTGSSIDVQAASLDWLITDTRHPFPSPPPAEHETIKDILQENGG

SEQ ID NO: 36231 - protein, 246 aa, Glycine max
METDRPDGRTPNQLRPLACSCSILHRAHGSASWAQGETKVLAAVYGPKAGTKKNENPEKASIEVIWKPKTGQIGKLEKEYEMILKRTLESICIRTIYPNTTTSVIVQVVHDDGALLPCAINAACTALVDAGIPLKHLAVAICCSVTDSGCIILDPTKEEEEKMKAYINLVFPNTIVSVLPERSSQVGSEPMAHGIMTSVTQGAMSVDDYLHCLDRGRAASARLSEFVRKNIGPKSTWLGRMGFLCR

SEQ ID NO: 36232 - protein, 437 aa, Prymnesium parvum
SGNPTVEVDLITAKGQTYRAAVPSGASTGIYEALEMRDGDKSMYMGKGVSKAVHNVNTIIGPALVGMDPVQQKEIDDKMVKTLDGSKNDWGWSKSKLGANAILGVSMAVCKAGAASKGIPLYKHIAELAGNPTDKMYMPVPSFNVINGGSHAGNKLAMQEFMILPVGATDFTEAMRMGSEVYHNLKSVIKAKYGQDACNVGDEGGFAPNILENKEGLDLLVTSIEKAGYTGKVKIGMDVAASEFWLADKKMYDLDFKTENNDGSQCKSGDDLMKIYEEFVKDYPMVSIEDPFDQDDFASYKAMTELLGERCQIVGDDLLVTNPTRVQKAIDEKVRPNNACCPDAVLSMCTSVQRNFCAGCPLVHDAVALQACNALLLKVNQIGSVSESIEAVNMAKAAGWGVMTSHRSGETEDSFIADLAVGLKTGQIKTGAPCRER

SEQ ID NO: 36233 - protein, 125 aa, Caulobacter crescentus CB15
MGAMRILLVEDDEAIRDLVTGVLEGAGYEVSTAADGQAALDMLPGVAPHAMVVDINMPGMDGLALLHAVRRDPAFAEIPALMLTAQTSPEDIRRSMSLGAADFIGKPFEARVLLRRLERMVRSAS

SEQ ID NO: 36234 - protein, 303 aa, Oryza sativa Japonica Group
MADEVAFETARKIIMHPLYTPRSSPWLDLKVFYVRVSNCEVDESAPDRLTLNHIPLSPDTVIEVNGQRSSMHTEFISSSLRRDRVDKMTEEATFVSTDSIRMTGSVRFQVFDKNDLLLTGDLELCSANGVVGESKNSSKRWNMKCQPASSCNGFLKGKPSTASESVHPVIEVYLAGTFCGTPIILTKTVQHISRRKSQMKLKLDSIPENEATEQQKEELNEDSLQVSESQNPKSEQDVDVDYNSLYSRQDFIEGEDGELSWFNAGVRVGVGIGLGICVGVGLGVGLLVRTYQSTSRNFRRRLP

SEQ ID NO: 36235 - protein, 388 aa, Thraustotheca clavata
SGNPTVEVDLTTEHGLFRASVPSGASTGIHEACELRDGGKRYLGKGVTQAVNNVKNIIGPKIEGMDPTQQKDIDFLMRELDGTENKGNLGANAILGVSLAVAKAGARSKGVPLFQHFADLIKNDKLVLPVPAFNVINGGSHAGNALAFQEFMILPTGAGSFSEAMAMGCEVYHHLKGVIKKKYGQDATNVGDEGGFAPNIQSNREGVELLMLAIEKAGYSGKIEIGMDVASSEFYTDDGRYDLNFKNKSSTDAPLTGAQLGQLYKDLAKEFPIVSIEDPFDQDDWENYQAFTAAVGKDVQVVGDDLLCTNPKRIAKAVELSACNALLLKVNQIGTLTESVQAVSDAKKAGWGVMTSHRSGETEDSYIADLAVGLSTGQIKTGAPCRER

SEQ ID NO: 36236 - protein, 550 aa, Ostreococcus tauri
MDVRDHGARGDAGGFLHQGLGEYRKLPTKKYPALERRETAEWRYWRNFASTTLSEQVNAVTSVSYGGMESGRATLATTSGARVTLHAPSGARKLRTFARFKDVAYSGVLRDDGRALAVGGQQGVVQLFDCGSRAVLRKFSAHVAAVRAVRWSGDKLHLASASDDATVRLWDISTGNCVRRHDGHKDYVRALERSPASGEIWASGSYDHAVKLWDARAGREAVMTFDHKVPVEDIAWYPNGNLLVSVGGEDVCVWDVLGGGRLLQRLRSHQKTITTVHVHDDAGPPSFASGFEMTGNSAIDAKAPRMITGSLDGFVKIHELDTFTVTHSIKYPGPVLSCSLSPDANCLATGLANKVLSVRRRKTPRNKDESSGYQGVRSKKKGYTVKKPRRLDAGHWRYFIRGQNSKTAANATRVLRQRRIHLAAHDRMLKQFRYGDALDAALHMRRSEVIAAVIEEVGRRGGLQKALANRDDESLLPILEYIEKNIAKPRHTAQMVNIANRIIDIYGSDVGASATVDNSLRRIQEKVKTQLRLHESLRQLQGMALMITGA

SEQ ID NO: 36237 - protein, 572 aa, Chlamydomonas reinhardtii
  misc_feature (228)..(228): Xaa can be any naturally occurring amino acid
MSTGVDYLGHGAVKATEGPPVNPSGRKYPYELDSEGKAKSIPVWRFTNPHMGAFHLSWFAFFISFLATFAPASLLPIIRDDLFLTKAQLGNAGVAAVCGAIAARVLMGVFVDIVGPRYGTAATMLMTAPAVFCMALVTDFASFAAVRFFIGLSLCMFVCCQFWCGTMFNVQIVGTANAIAGGWGNMGGGACHFIMPLIYQGIKDGGVPGYQAWRWAFFVPAVFYIATXLATLALGIDHPSGKDYRDLKKEGALKSKGAMWPVIKCGLGNYRSWILALTYGYSFGVELTVDNIIVEYMFDQFGLSLTVAGALGGMFGMMNLFSRASGGMISDLIAKPFGMRGRICTLWIIQTLGGIFCVILGRVHNSLTSTIVIMIIFSIFCQQACGLHFGITPFVSRRAYGVVSGLVGAGGNTGAAITQAIWFAGTAPWQLTLTKYQGLEYMGYQTIGLTLALFFIWFPMWGSMLTGPREGATEEDYYIKEWSAEEVADGLHHTSLRFAMESRSQRGTRTSTQTKVMSVGDGAGSNKAEVVVVAAAQQGAVPMASVEEGSSGRSSSSGGHQQQDARARVQVS

SEQ ID NO: 36238 - protein, 434 aa, Heterocapsa triquetra
MAISKIHARQVFDSRGNPTVEVELTTEKGVFRSIVPSGASTGENEACELRDGGKEFHGKGVRDAVENVKTIIAPALIGKDVCDQEGIDKIMLELDGTENKSKLGANAILGVSMAVCRAGAAAKGVPLYQHINSLAGSPKMVMPVPCFNVINGGVHAGNYLAFQEFFLIPVGAATFEEAMQMGSETYHTLKGIIKTKYGLDSTAVGDEGGFAPAVQDPEESLKLLMEAIGAAGYDGKIVIGSDPASSEFWKGEENVYDLDFKNPNPKKENKRSREEMVATYVRYCETYPIALLEDPFAEEDFEGHAMLTQKVGSKVEIVGDDLYCTNSKRVAMGLEKKATNAMLLKVNQIGSVTESIAAWKLCVDNKWGVFVSHRSGETEDTFIADLTVGLGTGHLKTGAPCRSERLAKYNQLLRIEEESGLKFCGKAFRTPWDA

SEQ ID NO: 36239 - protein, 320 aa, Oryza sativa Indica Group
MGIGRARWVALLVGLAAVAVVATVGASEGDADPLYRACVEECEKTGSLRETSVRHCQVPSDDHPADKSWYEHEPLYLQWKEWNCKSECRYHCMMERESEREQLGLGSVKYHGKWPMKRASVFQEPVSAALSALSLLVQFNGWLSFFLLLSYKLPLRPETQMTYDTVWTEKLYYSSFAAFIGYSLILAILRTLNLKDEASRVMVAAPILAFTTTHILYLNFYELDKGLNTKVCTAASLAQFLLWAVWAVMTKHPSCFKILFVIIGSVFSIILETYDIPPRWGCVDGRVFCVAISIPLTYLWWKFAKEDAEMRTSAIIKKTR

SEQ ID NO: 36240 - protein, 509 aa, Burkholderia thailandensis E264
MVNDGGGTFGRDDLDALERELALASHGAEHDRAAAQDGGAQHHAPPRPLANPYLANWRTHLDGIRERNARALPLRPCGRLTRAAGLVLEAIGLRLSVGAECTIELPAGSSLPYAQAEVVGFAGERLFLMPTTAVAGVLPGARVWPLESAPVADPLAGAKRLPVGWELLGRVVDASGRPLDNLGPLASKVDAPLTAPSINPLDREPIHHVLDVGVRAINGLLTVGRGQRMGLFAGSGVGKSVLLGTMARYTSAEVIVIGLIGERGREVKEFIEQILGEDGLARSVVVAAPADVSPLLRMQGAAYATTLAEYFRDQGKHVLLLMDSLTRYAMAQREIALAIGEPPATKGYPPSVFAKLPALVERTGNGPEGGGSITAFYTVLTEGDDQQDPIADSARAILDGHIVLSRSLAEAGHYPAIDIEASISRAMTALIDDAHLERVRQFKQMLSRYQRNRDLIAVGAYAPGRDAQLDRAIALYPRIESFLQQGFRECAPYAPSLAALDALFESEGG

SEQ ID NO: 36241 - protein, 318 aa, Synechococcus sp. WH 8102
MATAAAGVAAALSPLSGRDYLSSADCSAEETSAVLDLAAQLKSGDRRIDLGNRVLGLIFTKASTRTRVSFQVAMARLGGQTVDLNPKVTQLGRGEPLEDTARVLSRYCDVLAVRTFAQQELVDYAHWATVPVINALTDLEHPCQSLADFLTMREAHGDLPGQTLAYIGDGNNVAHSLMLCGALLGVNVRIGCPQGFEPLPGVLEQARSLAVQGASIEVIHDPREAVRGAQAVYTDVWASMGQEDEQSEREQAFAGFCVDEALMEAADTEAIVLHCLPAHRGEEISPGVMESSASRIFDQAENRLHAQQALLAALMGGL

SEQ ID NO: 36242 - protein, 497 aa, Saccharomyces cerevisiae
MTLSKYSKPTLNDPNLFRESGYIDGKWVKGTDEVFEVVDPASGEIIARVPEQPVSVVEEAIDVAYETFKTYKNTTPRERAKWLRNMYNLMLENLDDLATIITLENGKALGEAKGEIKYAASYFEWYAEEAPRLYGATIQPLNPHNRVFTIRQPVGVCGIICPWNFPSAMITRKAAAALAVGCTVVIKPDSQTPLSALAMAYLAEKAGFPKGSFNVILSHANTPKLGKTLCESPKVKKVTFTGSTNVGKILMKQSSSTLKKLSFELGGNAPFIVFEDADLDQALEQAMACKFRGLGQTCVCANRLYVHSSIIDKFAKLLAERVKKFVIGHGLDPKTTHGCVINSSAIEKVERHKQDAIDKGAKVVLEGGRLTELGPNFYAPVILSHVPSTAIVSKEETFGPLCPIFSFDTMEEVVGYANDTEFGLAAYVFSKNVNTLYTVSEALETGMVSCNTGVFSDCSIPFGGVKESGFGREGSLYGIEDYTVLKTITIGNLPNSI

SEQ ID NO: 36243 - protein, 389 aa, Ostreococcus tauri
MSHEGKPITCKAAVAFAPKQPLEVVDVVVAPPQAGEVRIKIMFTALCHTDAYTLDGFDSEGKFPCVLGHEAAGVVESVGSGVTSCKPGDRVIPCYQAYCADISENPCEHCLHPKSNLCQAVRAWTGRGVMKTDEKPRFTLARDGSEIFHFMGTSTFSEYTVVHEVAVAKVNNDAAPLDKVCLLGCGVSTGWGAVHNTAGVEAGSTVAVFGLGAVGLACIEAAVEAGARQIIGVDTNDEKEAIARQFGATDFVNPTKFPGKDTQSVIVEMTNGGVDYSFECVGNVNVMRSALECCRKGWGTSVIVGVAAAGTEISTRPFQLVTGRTWKGTAFGGYKSRVAVPKLVEKVMSGGDKANLDKYITHRMKFEQINEAFDLLHAGKCLRCVLSMD

SEQ ID NO: 36244 - protein, 347 aa, Oryza sativa Indica Group
MGIGRARWVALLVGLAAAAVVATVGASEGDADPLYRACVDECEKTGSLRETSVRHCQVPTDDHPADKSWYAHEPLYLQWKEWNCKSECRYHCMMERESEREQLGLGSVKYHGKWPMKRASVFQEPISAALSALSLLVQFNGWLSFFLLLSYKLPLMPETQMTYYEYTGLWHIYGLLAMNAWFWRAIYHSCDTVWTEKLYYSSFAAFIGYSLILAILRTLNLKDEASRVMVAAPILAFTTTHILYLNFYELDKGLNTKVCTAASLAQFLLWAVWAVMTKHPSCFKILFVIIGNVFSIVLETYDIPPRWGYVDGRVFCVAISIPLTYLWWKFAKEDAEMRTSAIIKKTR

SEQ ID NO: 36245 - protein, 397 aa, Geobacter metallireducens GS-15
MTMETTTIRVTLNRGEDRRIKGGHPWVFSNEIREAKGERIPGATAEVYDVGGGFLGTGYYNPHSLIAVRLLSREREEIDSPAFFKERINQALKLRRSLYPDMATFRVVHGEGDFLPGLVVDKYGDRLSVQILTAGIEARRGAIVEALVELFAPKGIIARNDVAVRSLEGLAETVEILYREIPETVEAEEHGLRFRVDLAGGQKTGHFLDQKENHLVLKGMAAGKRVLDCFSYSGSWGVHAAAFGAAEVTCLDISERAAALARENAALNGLEGVVSVEVCDAFDRLRSLRHEGRRFDVVVLDPPAFVKNKKALKEAEKGYLTINRRGLELLDAGGYLITCSCSYHMGRELFRDLLAQAARQAGRQVRIVETRSQAPDHPALLAVPETEYLKCFVLQCV

SEQ ID NO: 36246 - protein, 526 aa, Burkholderia vietnamiensis G4
MSNVELFHYLLLLICGAGALTWLAERVSIPPAVVLLVGGCVVAVAGKRVPDMDPALLLAAVLPPLLMSSGFYTAWKEFRHELASIASLALGAVAFTTVAVALAVHAANPALPWAACFTLGAIVSPPDAVAAKAILQRHPLPARLVAVLEGESLVNDASGLLLYQMAVSAALAVTITTAGATALFFSLTLIGIVTGLVCGHAMCWVLQRVREPMLGIVVTFAMAWGSYGIAEAVHGSGVLSVVTCGLVLGVRQHRVFGADLRIKAKATWEAVVFVLDALVFILIGLALHAILARVNQEGAVLMAGLRVALPATAAAIAARVVWVFVAMWLPARLRAPRAGHPPWSWREAVVLGWSGMRGVVSLAAAIALPADFPARDLILFSTFLLIIATLVVQGGTLAPLIRVLKLRPAVRRTMSEHAVRAHTFGAALAALDARGPDGDGLERASRERLLTEYRNRVAFNERAHRDGAQPAQVRARMLGVELEMVGVSRDALLALHRDGRVDDAVLHRIESELDFEELRLQRLLEP

SEQ ID NO: 36247 - protein, 507 aa, Oryza sativa Japonica Group
MAFASILQLALCFLCFSIFSYNHIKSKRKNTAIPVCWPLIGMLPDLLANRHRIHDWITSLLTASQLNFRFTGPPSSNMRLFITCDPANVRHVFTSNFSNYPKGPDFTEIFDIFGDGIFNVDGDSWRRQRAKAQLLTCRPRFRAFVSRCSRAKVEKALLPLLAHFAATGESCNLQDVFMRLTFDTTTMVVSGADTGCLAISLPEVAFARAMDDATRVLLVRHIFPLSWWKLARRLGIGYERTMAEALRACDHFVNETIEKRRAEKAKGEADGSADLLSSYINDDDEEENASSSFLRDTTMNLISAGRDASAMALSWFFYLLTKNPCVVSKILEELDSVNGITTPDGMVTFDPDELRPLVYLHAALSETLRLYPPVPLEHKGVLAADALPSGHDVRPGDKIVVSLFAMARMEAVWGSDCRKFRPERWISKDGKLRYVPSYKFMTFSSGPRTCLGKDMAFVQLKAVAAAVVKNFEIEAMPGHVVEPALSIVLHMKNGLMVRVKRRHVLNN

SEQ ID NO: 36248 - protein, 384 aa, Saccharomycopsis fibuligera
MSSTAGKSIFCKAAVAWDAKKKLSVEEIEVLPPKAHEVRIKVLNNAVCHTDAYTLSGVDPEGVFPAILGHEGAGIVESVGEGVSDIKVGDHVVALYTAECRKCKFCLSGKTNLCGSVRATQGKGVMPDGTTRFRSKDGKEIFHFMGCSTFSQYTVLADVSVAVVNPNAPFDKICLLGCGVTTGSGSVYNVAKVQADEKANTAVFGIGAVGLAVIEGLRLRNASKIIAIDVNDAKEEYARKWGVTHFINPTKLKEGETIVDKLIELTDGGCDYTFDCTGNVDVMRSALEACHKGWGVSVIIGVAAAGKEISTRPFQLVTGRVWRGSAFGGVKGKTQLPGFVDDYLKGDLKLDDYITGYRTLDDVNAAFDDLHKGDVIRTVIKLWE

SEQ ID NO: 36249 - protein, 216 aa, Nostoc sp. PCC 8009
LEPNQPKYRILIVEDKLENRQLLVKILEPLGFDVREAKNGQEGVNIWETWEPHLIWMDMRMPVMDGYEATKKIKASCKGQATVIIALTASAFDEERSMVLSAGCNDFVRKPFREKVILDKMATHLGIRYVYESQAMYTERLAANSDFELVSLEKALTQMPPEWVTQLHQAALCTNEQLIFKLLEQIPPESIHLANTLTDWVNNFRIDKVIDLTQPE

SEQ ID NO: 36250 - protein, 413 aa, Triticum aestivum
  misc_feature (32)..(32): Xaa can be any naturally occurring amino acid
MASFHRPLSAMAVAAFAAVSSIELPDKFSHHXGLPEDVLSLPANKPEATTAPSAPPLSGLQFFPRNLQAFYPAKAPVASLPVIQTVYQYAKFAKTSPEQEAALPAIPSSSSDVLYRWHLPDPRACGGSPDRSQTVVVLLGWLGSKQKHLKRYADWYTSRGFHAVTFTLPMSDIVSYNVGGKAEKNVEMLSEHLGDWVREEDGKKIVFHTFSNTGWLCYGVILENLQRQDPSAVEKIKGSIIDSAPVAVPDSQVWALGFSAAIMKKHSVATKGAAPNTRSDVVVVESQKDIRPAATEAVLLSALEKFFDLVLNYPAVNRRLSGVMELLSSNQPNCPQLYIYSSADRVIPAKSVESFVERQRKAGCEVRSCDFVSSPHVDHYRSNPGLYTSQLTNFLEDCVLARREDLSSPSPSA

SEQ ID NO: 36251 - protein, 538 aa, Arabidopsis thaliana
MADEKNGGRLSDASDYSSEDEGTEDYRRGGYHTVRVGDTFKNGSYVIQSKLGWGHFSTVWLAWDTLNSRYVALKIQKSAQHYTEAAMDEIKILKQIAEGDAEDKKCVVKLLDHFKHAGPNGQHVCMVFEYLGDNLLSVIKYSDYRGVPLHMVKEICFHILVGLDYLHRELSIIHTDIKPENILLCSTIDPEADARKSGIPLVLPTVKDKAVPERPVEKEKPKSYTYSADLTKNQKKKIRKKAKKVEGSEENERDSSNSEARPNGNATVERLEESSERVKDAENVSQKSRGNRRGSQSTRQKLLADVDRKCKLVDFGNACWTYKQFTSDIQTRQYRCPEVVLGSKYSTSADMWSFACICFELATGDVLFDPHSGENFERDEDHLALMMELLGMMPRKIALGGRHSRDFFNRQGELRHIRRLRFWPLSKVLTDKYDFSEEDAIAMQDFITPILQFVPEKRPTAAQCLTHPWLNPVPKSLKPSSSPQNPKEEEEEASDEDKDKEKVEREAMEAGVGNIAIDGSERKTSAREGRQSARDLRT

SEQ ID NO: 36252 - protein, 325 aa, Nostoc sp. PCC 7120
MSNPRVLCLGEVLFDCLADQLGLKLEQVKSWTAYPGGAPANVACALVKLGTPAGFIGAVGEDEPGNVLVKLLQEVGVDTTGVQRHSTAPTRQVYVVRDLAGDRTFAGFGQYDTSEFADTHLQAKQLPESVFQEADFLILGTLELAYPDSEKAIHRALELAEQYDLKIVLDVNWRPVFWHDENIARQKIQEIFKRVDFLKLAKEEAEWLFDTSDPGAITYRLGSIEGVLVTDGENGCGYCLGENEGKIPAFAVSVVDTTGAGDSFLAGFIHQLSEHGIHNLNDAETAKRIITYASAVGALTTTKAGAIASQPTAMEVETFLASNKI

SEQ ID NO: 36253 - protein, 292 aa, Trichodesmium erythraeum IMS101
MLKSTDLKNESEMSRVKVLSEALPYIQKFTGRKIVVKYGGAAMRDSNVKDQVMRDIVLLSCVGIRPIVVHGGGPEINSWLGKLGIEPQFKDGLRVTDASTMEVVEMVLVGKVNKEIVSLINQAGGCAVGLCGKDASLIQARPEGIEGIGFVGEVSNVKIDILQSLVDNGYIPVVSSVATDEQGQAYNLNADTVAGEIAAAMEAEKLILLTDTAGILEDYHNPDSLIVKLDIQEARELIEKGIVSGGMIPKVNCCVRSLAQGVRAAHILDGRVPHVLLQEILTDTGVGSMIVA

SEQ ID NO: 36254 - protein, 319 aa, Glycine max
MMKMQIGVLAFLVALSAIESGIASPNTVPAFLWSPHLQAGNGGMDEAVNYQVMSAKDLVDSVFTQGGWSNILCSEKKVEHPVVDVALVFIGRELLSSDVSSKRNSEPSLVNTLNGLFTASNFSLAFPYISAPEEERMESLLLSGLKQACPHNVGVSNIVFSDSCFVEDGMIQKLSDLQSFKDHLLSRKETRKEGETDLVVLCSEGSGSNSQSGQSHSERESISELVSSVEQSGSKYTALYVSDPYWYTSYKTLQRFLAESGTGNSTVGVATTCDELCKFKSSLLEGILVGIVFLLILISGLCCMAGIDTPTRFETPQDS

SEQ ID NO: 36255 - protein, 496 aa, Nitrosomonas sp. CNS332
MMRRTKIVATLGPASSNPDILRQMIEAGVDVVRINFSHGTKDEHIASAEQVRSLAHSLGRTVGVLADLQGPKIRIGKFAQGKITLKAGDEFILDAECELGNQERVGLDYRELPNDVEAGTVLLLDDGRIVLTVTKVRESEIYCEVLQGGILSNNKGINRKGGGLSAPALTAKDLQDIKTATILRADYLAVSFPRSGEDIRRARALMQEAQGHSLLMAKIERSEAILALDDILSASDAIMVARGDLAVEVGDAAVPALQKRMIRSAREANKLVITATQMMESMISNPIPTRAEVSDVANAVLDGTDAVMLSAESAAGQYPVEAVAAMARVCLEAEKEYTVNLSFRRSPDTQPVSIEDAIARATMYTAGSLKIRAIAALTQSGVTALFMSRRSSKVPIFALSPQEDTLSKVTLFRGVYPIKFGQGLCDPEIILSMAEDELLRRGAVRNEDLIIMTIGEPVGKAGGTNTMKLVRVGGSRGTTQITKEVTQQTFSDPLNL

SEQ ID NO: 36256 - protein, 496 aa, Nitrosomonas sp. OZK11
MMRRTKIVATLGPASSSPEVLGKMIKAGVDVVRINFSHGTQDEHIASVELVRSLARSLGRTVGVLADLQGPKIRIGKFEQGRIRLNAGDEFILDAECQLGNQERVGLDYRTLPNDVEAGAVLLLDDGRIVLTVTKVRGSEIFCEVLQGGVLSNNKGINRKGGGLSAPALTAKDLLDIKTAAVLRADYLAVSFPRSGEDIRRARALMQDAQGHSLLMAKIERSEAILALDDILEASDAIMVARGDLAVEVGDAAVPALQKRMIRSAREANKLVITATQMISPMISNPIPTRAEVSDVANAVLDGTDAVMLSAESAAGQYPVETVEAMARVCLEAEKEYTPNLGARRSPDTQSASIEDAVARAAMYTAASLKIQAIAALTQSGITALFMSRRSSKVPIFALSPQEDTLGKMTLFRGVYPIEFGQGLCDPEIILGLAEDELLKRGAVRDGDLIIMTIGEPVGKAGGTNTLKIVRVGSSKTIKQVMQEATQQPFSDPQNL

SEQ ID NO: 36257 - protein, 321 aa, Gloeobacter violaceus PCC 7421
MPLGRLMEGRWVIEEKDRDAEGKFNRTATTFRHKITRDGSSGFMAEPDRYHLYVSLACPWAHRTLILRKLKGLAAVIGVSIVDAEIRDNGWSFGQEPGSLPDSVNGARYLWEVYCKADSQYTGKVTVPVLWDKFTHTIVNNESREIIRMFDTEFAALAATDADFYPEDRRGQIDETIDAIYQPINNGVYRSGFATSQRAYEEAVGELFAALDHWEQVLSTRRYLCGERITEADWCFFTTLLRFDAVYHGHFKCNLRRIVDYPNLWNYLKDLYQQPGVAETCNLDHIKRHYYRSHTNINPTAIVPAGPLVDFAAPHGRERLG

SEQ ID NO: 36258 - protein, 593 aa, Oryza sativa Indica Group
MEVAGMRKASSHASMAAAAADPDDFDLTRMLNHRPRINVDRQRSFDDRSLAELSISGTASRGGGGGGYPAMMESYESMYSPGGGLRSLCGTPASSTRLSFDPHPLVFDAWDALRRSLVCFRGQPLGTIAAVDHSSDEVLNYDQVFVRDFVPSALAFLMNGEPEIVKNFLLKTLLLQGWEKRIDRFKLGEGAMPASFKVLKDAKRGGAERLVADFGESAIGRVAPVDSGFWWIILLRAYTKSTGDLSLAETAECQRGIRLIMNQCLAEGFDTFPTLLCADGCCMIDRRMVIKRFDFGQNQTALNLIKMGVYGYPIEIQALFFMALRCALLMLKPDAPEGKETMDRVATRLHALTYHMRSYFWLDFQQLNDVYRYRTEEYSHTAVNKFNVIPESIPDWVFDFMPSRGGYFVGNVSPARMDFRWFALGNFVAILASMATPEQAAAIMDLIEERWEDLIGEMPLKISFPAIESHEWEFVTGCDPKNTRWSYHNGGSWPVLLWLLTAACIKTGRLKIARRAIELAEARLARDGWPEYYDGKLGRYVGKQARKLQTWSVAGYLVAKMMVEDPSHLGMISLEEDRAMMKPVLKRSASWTV

SEQ ID NO: 36259 - protein, 205 aa, Oryza sativa
  misc_feature (24)..(24): Xaa can be any naturally occurring amino acid
  misc_feature (143)..(143): Xaa can be any naturally occurring amino acid
  misc_feature (152)..(152): Xaa can be any naturally occurring amino acid
  misc_feature (157)..(157): Xaa can be any naturally occurring amino acid
  misc_feature (174)..(174): Xaa can be any naturally occurring amino acid
MADSHAKASISNKLSVEDLDVKDXKVLIRVDFNVPLDKETGQVKDKQRIEGALPTIKYVLDKGAQAVVLVSHLGRPDGKRVEKESLKPVADELQKLLGKDVKFLNDCVGEEVEQAVNHASNGQVLLLENLRFHLEEEGSVKDXPGYNTKADXEAVDXFRASLSKLGDVYINDAXGTAHRAHSSVVGVKLEQRAAGYFMNKELDYF

SEQ ID NO: 36260 - protein, 328 aa, Penicillium chrysogenum
MSVSSSTFFAPPPPGWLNYTLLWNLSHIDPFSPRNSTVLPPGTYWGQYQDITKSNTQLSVAERLWVAWYAWVQNDVLATGIMSFLIHELFYFGRSLPWIFIDSLDFFNRYKIQSSKVPSLREQWDCAKFVLLSHFTVELPQIWLFHPMAQFFGLSTSIPFPSPWTMTYQIAIFFVMEDTWHYFFHRALHWGPLYKAIHKVHHQYSAPFGLAAEYASPIEVMILGFGTVSSPILWCAFTGNLHILTMYIWIVLRLFQAVDAHSGYEFPWSLHHFLPFWAGADHHDLHHEKFIGNYSSSFRWWDYLLDTDYTPDALKRRREQKVKAKKTQ

SEQ ID NO: 36261 - protein, 231 aa, Triticum aestivum
MAVSELEVDGVVFPPLARPPGSEHAHFLAGAGVRGMEIGGKFIKFTAIGVYLQADAAVPALAAKWAAKPAADLASDAAFFRDVVTGEFEKFTRVTMILPLTGAQYSDKVTENCVAYWKATGVYTDAEAAAVDKFKEAFGPHSFAPGASILFTHSPAGVLTVAFSKDSSVPESGGVAIDNARLCEAVLESIIGEHGVSPAAKLSLATRVAELLKGASHAGGEPAAEPVSVSV

SEQ ID NO: 36262 - protein, 715 aa, Pseudomonas putida GB-1
MIYEGKAITVKALESGIVELKFDLKGESVNKFNRLTLNELRQAVEAIQADASVKGVIVSSGKDVFIVGADITEFVDNFKLPEAELVAGNLEANRIFNAFEDLEVPTVAAINGIALGGGLEMCLAADYRVMSNSAKIGLPEVKLGIYPGFGGTVRLPRLIGSDNAIEWIAAGKENRAEDALKVGAVDAVVAPELLLAGALDLIKRAISGELDYKAKRQPKLEKLKLNAIEQMMAFETAKGFVAGQAGPNYPAPVEAIKSIQKAANFGRDKALEVEAAGFAKLAKTSVAESLIGLFLNDQELKRKAKAHDEIAHDVKQAAVLGAGIMGGGIAYQSAVKGTPILMKDIREEAIQLGLNEASKLLGNRVEKGRLTPAKMAEALNAIRPTLSYGDFANVDIVVEAVVENPKVKQAVLAEVEGQVKDDAILASNTSTISINLLAKALKRPENFVGMHFFNPVHMMPLVEVIRGEKSSEVAVATTVAYAKKMGKNPIVVNDCPGFLVNRVLFPYFGGFAKLVSAGVDFVRIDKVMEKFGWPMGPAYLMDVVGIDTGHHGRDVMAEGFPDRMKDERRSAVDALYEANRLGQKNGKGFYAYETDKRGKPKKVFDATVLDVLKPIVFEQREVTDEDIINWMMVPLCLETVRCLEDGIVETAAEADMGLVYGIGFPPFRGGALRYIDSIGVAEFVALADQYADLGPLYHPTAKLREMAKNGQRFFN

SEQ ID NO: 36263 - protein, 267 aa, Pseudomonas putida GB-1
MFLSELYRYPVKSGRAQSLQTAAVGLLGVQGDRRWMVVEEENGRFLTQRAWPQLGQIDAREDDSGQLLLQAPGQDLLQVPVPPADDALRGVTIWRDTLRVPDAGDAAAAWLSELLGKAVRLVHCPEPRARYLPNGYGFNSDRAAFPDGFPLLLIGQGSLDELNRRIGRPMEMLRFRPNLVVQGAAPFAEDGWKRIRIGSLEFRVLKPSVRCIFTTIDPATGERSADREPMATLKTFREKEGDVLFGQNLAVDGSGRLEVGMQVEVLE

SEQ ID NO: 36264 - protein, 218 aa, Cryptococcus neoformans var. neoformans B-3501A
MSRTVPTIPRDGRLISLILASKGIEDADERVIHQLLDFSRRYTADVLQSAQTLADHAARTGASSNRIEKEDVELAIKMRKLYEFFEAPPRDYLATLAHELNSHPLPALPETFDLVRLPPAHQRLAEVNFDIVPDAELVLTEDEREDGEDSEDEEEDDDGGEDGDEDGKPNGEADGEVDGDGEDEDMEEVGVDGLPSAGVAPEAAPVRQAVDVDEDYDM

SEQ ID NO: 36265 - protein, 357 aa, Cicer arietinum
SHQQAVKAVEKHMQTFHHREKKRVPSFLDWFGWCTWDAFYTDVTAEGVEEGLKSLSEGGTPPRFLIMTMVGNRLKVKQSKGSGCVVQEGAQLLLGDWIRDANSKNKNGQNDEQIPGLKHLVDGVKKHHNVKDVYVWHALAGYWGGVKPAATGMEHYDTALATSAVTRSTWNQPDIVMDSLAVHGLRLVHPRGFTSTNETHAYLASCGVDGVKVDVQTLLRPLVLDTVVESRLHAAIIMRLRLPLLVTLLNNGCIACMCHNTDGLYSAKQTAIVRASDDFYPHDPASHTIHISSVAYNSLFLGEFMQPDWDMFHSLHPAAEYHAAARAIGGCQFMSVISQATTILIFLRSLVLADGSR

SEQ ID NO: 36266 - protein, 467 aa, Oryza sativa
MAAATAAPSIDEAKAKSVLRQVEFYFSDSNLPRDKFLRETVEQREDGLVSLALICSFARMKSHLGLDAAVKPETVPEETVLAVAEVLRRSQMLRISEDGKMVGRASELLKADEIIKQVDSRTVAASPLPYNVKLEDVQSFFAQYAKVNSVRLPRHIANKKHFCGTALVEFSEEDEAKIVLENNLFFAGANLEIKLKKEFDAETESKKEAYEKAHPKKDEQNEGYPKGLIVAFKLKRITVDGGVQQNCADNDTATEEETPKSMKKTSTGESEERTTVNSDMEEQKSSDDMTEAKEVNAGEATESGDKCTVDALLESEKKGDNETSIKDDRGLSGKANSPISREDLKEAFKKFGTVRYVDFSIGDESGYLRFEDSKAAEKARMSAVLADEGGLIVKDHIVTLEPVTGEAEKDYWNTIRGIQGKYKDNRSYKGRTGKSYRGGKQFNGKRGRHSDSSEKGANKTQKVEAAA

SEQ ID NO: 36267 - protein, 64 aa, Zea mays
  misc_feature (46)..(47): Xaa can be any naturally occurring amino acid
  misc_feature (50)..(52): Xaa can be any naturally occurring amino acid
GFSVLFDCIKAPGLGIATRYMFTMAVGRLLRTATFVGTILPSARPXXAAXXXQIPGHPHPWAQK

SEQ ID NO: 36268 - protein, 484 aa, Nitrosospira sp. HBN8222A
MIRRTKIVATLGPASRDAKVLERMINAGVDVVRINFSHGTREEHIEGAELARSLAHAAGHAVGVLADLQGPKIRIGKFENNKILLKTGDQFILDAECELGNQERVGLDYKELPSDVETGATLILDDGRIVLGVSEVKGSQVYCVVEQGGILSNNKGINRKGGGLSAPALTGKDVEDIRTAAALKADYLAVSFPRSGEDMRWARDVMREAGGKSLLMAKIERSEAILALDDILEASDAIMVARGDLAVEVGDAVVPALQKRMIRTARTRNKLVVTATQMMESMVSSPIPTRAEVSDVANAVLDGTDAVMLSAESATGQYPVEAVAAMARVCLEAEKEYLVSSENRRLQGGLPDNIEEAIARATMFTAGGLKIRAIAALTQSGRTVLLMSRRSSTVPIFALSPQEDTRRKMTLFRGVYPVKFGGGLNDPEIILNHAENELLRRGAVRNGDLIIMTIGEPVGKAGGTNTMKIVKVGEHRKQERKVES

SEQ ID NO: 36269 - protein, 983 aa, Oryza sativa Japonica Group
MNSAAAAAACASAPAWVVGGGAGGGARSARGPCGIRVCGLGGEAVALRSLRISQGAAVRRAAVAARAAAENGVAGTGGFDYDLVIIGAGVGGHGAALQAVEEGLKTAIIEGDVVGGTCVNRGCVPSKALLAVSGRMRELHDEHHMKSLGLQVSSPGYDRQAVADHANNLASKIRSNLTNSMKALGVDILSGFGAIVGKQKVRYGKVGFPDKEITARNIIIATGSVPFVPKGIEVDGKTVFTSDHALKLESVPDWIAIVGSGYIGLEFSDVYTALGSEVTFVEALDQLMPGFDPEIAKLAQRVLINPRNIDYHTGVFASKITPAKDGKPVQIELIDAKTKEHKETLEVDAALIATGRAPFTKGLGLENINVVTQRGFIPVDERMRVMDADGNVVPNLYCIGDANGKLMLAHAASAQGISVVEQISGRDHILNHLSIPAACFTHPEISMVGLTEPQAREKADKEGFEISVVKTSFKANTKALAENEGDGLAKLIYRPDTGEILGVHILGLHAADLIHEASNAIALGTRLQDIKFAVHAHPTLSEVLDELFKAAKLQPREGPERKPKHPPQPLLKGGDRKDVFFYQADDQHYIPRALLVDLEPRVINGIQNSEYRNLYNHENIFVAEHGGGAGNNWASGYHQGEQVVDDIMDMIDREADGSDSLEGFVLCHSIAGGTGSGMGSYLLETLNDRYSKKLVQTYSVFPNQMETSDVVVQPYNSLLTLKRLTLNADCVVVLDNTALNRIAVERLHLANPTFAQTNSLVSTVMSASTTTLRYPGYMNNDLVGLLASLIPTPRCHFLMTGYTPLTVERQVNMIRKTTVLDVMRRLLQTKNIMVSSYARNKEASQAKYISILNIIQGEVDPTQVHESLQRIRERKLVNFIEWGPASIQVSGLMLANHTSIRHLFSKCLGQYEKLRKKQAFLDNYRKFPMFEDNDLSEFDESREIIESLVDEYKACESPDYIKWGMEDAGEANVAAALDSKLVV

SEQ ID NO: 36270 - protein, 699 aa, Saccharomyces cerevisiae
MTAQLQSESTSKIVLVTGGAGYIGSHTVVELIENGYDCVVADNLSNSTYDSVARLEVLTKHHIPFYEVDLCDRKGLEKVFKEYKIDSVIHFAGLKAVGESTQIPLRYYHNNILGTVVLLELMQQYNVSKFVFSSSATVYGDATRFPNMIPIPEECPLGPTNPYGHTKYAIENILNDLYNSDKKSWKFAILRYFNPIGAHPSGLIGEDPLGIPNNLLPYMAQVAVGRREKLYIFGDDYDSRDGTPIRDYIHVVDLAKGHIAALQYLEAYNENEGLCREWNLGSGKGSTVFEVYHAFCKASGIDLPYKVTGRRAGDVLNLTAKPDRAKRELKWQTELQVEDSCKDLWKWTTENPFGYQLRGVEARFSAEDMRYDARFVTIGAGTRFQATFANLGASIVDLKVNGQSVVLGYENEEGYLNPDSAYIGATIGRYANRISKGKFSLCNKDYQLTVNNGVNANHSSIGSFHRKRFLGPIIQNPSKDVFTAEYMLIDNEKDTEFPGDLLVTIQYTVNVAQKSLEMVYKGKLTAGEATPINLTNHSYFNLNKPYGDTIEGTEIMVRSKKSVDVDKNMIPTGNIVDREIATFNSTKPTVLGPKNPQFDCCFVVDENAKPSQINTLNNELTLIVKAFHPDSNITLEVLSTEPTYQFYTGDFLSAGYEARQGFAIEPGRYIDAINQENWKDCVTLKNGETYGSKIVYRFS

SEQ ID NO: 36271 - protein, 625 aa, Oryza sativa Indica Group
MAVMEEQQEGAAGVMRRRPKTKIVCTLGPASRSVEMIGRLLRAGMCVARFNFSHGSHEYHQETLDNLRAAMESTGILCAVMLDTKARDFVLGVLILATFYFLQDFCAVVFTVGRCSSLILGFSPPDYSAGQKTISVMFCWLKISLDDDKICVVHDQFSERLCSGFLNGIKPILDLLKIQGPEIRTGFLKDGKPVQLKKGQEITVSTDYSIKGDDNMISMSYKKLAVDLKPGSVILCADGTITLTVLHCDKEQGLVRCRCENTAMLGERKNVNLPGVIVDLPTLTEKDKEDILKWGVPNKIDMIALSFVRKGSDLVEVRKVLGKHAKSIMLMSKVENQEGVANFDDILAQSDAFMVARGDLGMEIPIEKIFYAQKVMIFKCNIQGKPVVTATQMLESMIKSPRPTRAEATDVANAVLDGTDCVMLSGETAAGAYPELAVRTMAKICLQAESCVDHAAVFKSITASAPIPMSPLESLASSAVRTANSAKAALILVLTRGGTTARLVAKYRPSMPILSVVVPELKQTDSFDWTCSDEAPARHSLIVRGVIPMLSAATAKAFDNEATEEALGFAISNAKAMGLCNSGAPSVFAVHGLTIETVKFVIATAAYFAASAATSIKLDSRYVIC

SEQ ID NO: 36272 - protein, 424 aa, Zea mays
  misc_feature (156)..(156): Xaa can be any naturally occurring amino acid
  misc_feature (293)..(293): Xaa can be any naturally occurring amino acid
ASPRLPVTNPKPLTCHRPALCIRFFLRLPFPLQSCTPLPLAAPLSSLDANLSTLLINRHFLLGVMGAPLAPVSVSTAEPLPLAPVKGAPIESSSAQYILQQYLAASGGAKVLRSARNAYAMGKVRMVASEFETATRVVKNRGAAAAAAVEQGGFVXLWRMSPDMWYVELAVGGSKVRAGCNGRLVWRHTPWLGAHAAKGPVRPLRRALQGLDPLSTAGLFAEARCVGEKKVGDEECFILKLSADAETLRQRSEGPAEIIRHVVFGYFSQRTGLLVQVEDSHLTRIQPHAGGDXVYWETTISSFLEDYRAVDGVAIAHAGRSAVTLFRFGETAMSHTKTRMEEAWTIQEAAFDVPGLSTDCFIPPADVRRDSDSVGEPCELPPRGAKAGAVHPACDAVHSRRRRDVAPADGELATRSTGRWRCDF

SEQ ID NO: 36273 - protein, 484 aa, Nitrosospira sp. PJA1
MIRRTKIVATLGPASRDAKVLERMINAGVDVVRINFSHGTREEHIEGAELARSLARAAGHAVGVLADLQGPKIRIGKFENNKILLKTGDQFILDAECELGNQERVGLDYKELASDVETGATLILDDGRIVLGVSEVKGSQVYCVVEQGGILSNNKGINRKGGGLSAPALTGKDVEDIRTAAALKADYLAVSFPRSGEDMRWARDVMREAGGKSLLMAKIERSEAILALDDILEASDAIMVARGDLAVEVGDAVVPALQKRMIRTARTKNKLVVTATQMMESMVSSPIPTRAEVSDVANAVLDGTDAVMLSAESATGQYPVEAVAAMARVCLEAEKEYLVSSENRRLQGGLPDNIEEAIARATMFTAGGLKIRAIAALTQSGRTVLLMSRRSSTVPIFALSPQEDTRRKMTLFRGVYPVKFGGGSNDPEIILNHAENELLRRGAVRNGDLIIMTIGEPVGKAGGTNTMKIVKVGEHRKQERKVES

SEQ ID NO: 36274 - protein, 170 aa, Chrysanthemum x morifolium
MAQREQERTQEARRKLRAPENHAVRQQLADFPGNPATQKPLPELLLGGHGRTTSSAGLSLPSPVLDKRSRQAVRRRWLSLRLLSHRLWRRWPPRSRRRRRRSAKTSAVNRCSRCRKRVGLTGFRCRCGHLFCGEHRYSDRHGCSYDYKSAARDAIARDNPVVRAAKIVRF

SEQ ID NO: 36275 - protein, 770 aa, Oryza sativa Japonica Group
MALIGTVAAEVLIPLAAVIGILFAVLQWYMVSRVAVPPHDGVGGAGKVERESDGGDGDGDGVDDEEDGVDYRGVEARFAEIQHAISRGRDVVPDDGVQVPGRVHGGVRGGHLRLAGLRGAVLHVDGAVPVRRGEAVPPGAGERGVHRGGVLLGATTSVVSGYLGMRVATFANARTALEARRGIGRAFAVAFRSGAAMGFLLASSALLVLFAAVNAFGLYYGDDWGGLYEAITGYGLGGSSMALFGRVGGGIYTKAADVGADLVGKVERNIPEDDPRNPAVIADNVGDNVGDIAGMGSDLFGSYAESSCAALFVASISSFGADHDFAAMMYPLLVSAAGIVACAATTLVATDAGELGAADEVAPALKRQILISTVLMTAAVAAVTFLSLPRSFTLFDFGERKLVKNWHLFICVSAGLWAGLVIGYVTEYFTSNAYGPVQTVAQSCRTGAATNVIFGLAVGYKSVIVPIFAIAGAIYASFRLAAMYGIALAALGMLSTIATGLTIDAYGPISDNAGGIAEMAGMPRRVRERTDALDAAGNTTAAIGKGFAIGSAALVSLALFGAYVSRAGIRTVNVVSPRVFVGLLAGAMLPYWFSAMTMRSVGSAALRMVEEVRRQFDEIPGLAEGLAAPDYATCVRISTDASLREMVAPGALVMASPLVAGTLFGVEALAGLLAGALVSGVQVAISASNSGGAWDNAKKYIEAGATEEARSLGPKGSEAHKAAVIGDTIGDPLKDTSGPSLNILVKLMAVEALVFAPFFAAHGGIVFNHL

SEQ ID NO: 36276 - protein, 528 aa, Saccharomyces cerevisiae
MTKSHSEEVIVPEFNSSAKELPRPLAEKCPSIIKKFISAYDAKPDFVARSPGRVNLIGEHIDYCDFSVLPLAIDFDMLCAVKVLNEKNPSITLINADPKFAQRKFDLPLDGSYVTIDPSVSDWSNYFKCGLHVAHSFLKKLAPERFASAPLAGLQVFCEGDVPTGSGLSSSAAFICAVALAVVKANMGPGYHMSKQNLMRITVVAEHYVGVNNGGMDQAASVCGEEDHALYVEFKPQLKATPFKFPQLKNHEISFVIANTLVVSNKFETAPTNYNLRVVEVTTAANVLAATYGVVLLSGKEGSSTNKGNLRDFMNVYYARYHNISTPWNGDIESGIERLTKMLVLVEESLANKKQGFSVDDVAQSLNCSREEFTRDYLTTSPVRFQVLKLYQRAKHVYSESLRVLKAVKLMTTASFTADEDFFKQFGALMNESQASCDKLYECSCPEIDKICSIALSNGSYGSRLTGAGWGGCTVHLVPGGPNGNIEKVKEALANEFYKVKYPKITDAELENAIIVSKPALGSCLYEL

SEQ ID NO: 36277 - protein, 268 aa, Triticum aestivum
  misc_feature (242)..(242): Xaa can be any naturally occurring amino acid
SPPRLTTAAMACAFSASTVSTAAALVASPKPAGAPQCLSFPRAAARPSRLAAAGSRTARARSFVARAAAEYDLPLVGNKAPDFAAEAVFDQEFIHVKLSDYIGKKYVILFFYPLDFTFVCPTEITAFSDRHEEFEKINTEILGVSVDSVFSHLAWVQTERKSGGLGDLKYPLVSDVTKSISKSFGVLIPDQGIALRGLFIIDKEGVIQHSTINNLGIGRSVDETLRTLRALQYVQENPDEVXCPAGWKPGEKSMKPDPKGSKEYFAAI

SEQ ID NO: 36278 - protein, 473 aa, Oryza sativa Japonica Group
MEPRIGNKFRVGRKLGSGSFGEIYLGTNVQTNEEVAIKLENVKTKHPQLLYESKLYRILQGGTGIPNVKWFGVEGDYNVLVMDLLGPSLEDLFSFCNRKLSLKTVLMLADQMINRVEFVHSKSFLHRDIKPDNFLMGLGKRANQVYVIDFGLAKKYRDTSTHQHIPYRENKNLTGTARYASVNTHLGIEQSRRDDMESLGYVLMYFLRGSLPWQGLKAGNKKQKYEKISERKIATSTEALCRGYPTEFASYFHYCRSLRFEDSPDYQYLKRLFRDLFIREGFQFDYVFDWTILKYQQSQMTSAPPRAIAPATGQSSAMAPIANNNRLSATEEGRRSGWSDMDAMRRQVPPPAINAGSLAKQKSPIGHEQSTSKDAVFSSSTFLGRSSGSSRRPAVSSSREPSTEADQSRSRTTDASPGAFQRSGAPRWSPQMVDSSDNRRTPSGRHPSNAKNYESTIRGIQGLNFDGDDRIQY

SEQ ID NO: 36279 - protein, 484 aa, Nitrosospira sp. TCH711
MIRRTKIVATLGPASRDAKVLERMINAGVDVVRINFSHGTREEHIEGAELARSLARAAGHAVGVLADLQGPKIRIGKFENNKILLKTGDQFILDAECELGNQERVGLDYKELPSDVETGATLILDDGRIVLGVSEVKGSQVYCVVEQGGILSNNKGINRKGGGLSAPALTGKDVEDIRTAAALKADYLAVSFPRSGEDMRWARDVMREAGGKSLLMAKIERSEAILALDDILEASDAIMVARGDLAVEVGDAVVPALQKRMIRTARTRNKLVVTATQMMESMVSSPIPTRAEVSDVANAVLDGTDAVMLSAESATGQYPVEAVAAMARVCLEAEKEYLVSSENRRLQGGLPDNIEEAIARATMFTAGGLKIRAIAALTQSGRTVLLMSRRSSTVPIFALSPQEDTRRKMTLFRGVYPVKFGGGSNDPEIILNHAENELLRRGAVRNGDLIIMTIGEPVGKAGGTNTMKIVKVGEHRKQERKVES

SEQ ID NO: 36280 - protein, 473 aa, Caulobacter crescentus CB15
MLSKRARLQSLRAARRRAGDSDPPPRSTRIKATEQRRSRLPEDRSDAVSRPRRRRLALADTQTIEAIMLSREFLKAGHAPTLFAAFLYFDLSFMVWVILGPLGVAIAKDFNLDPAQKGLMVAVPVLAGAVLRLVNGVLVDRIGPKKTGIIGQLIVLAGLVTAWAVGLHNYQQILALGLVLGVAGASFAVALPLASRWYPQEHQGLALGIAGAGNSGTALAALFAPALAKTFGWQNVIGLAAIPLAFAFVAYLVLAKDAPEQPAPKKLAEYLDVLKVPDAWWLMLLYGVTFGGFVGLASSLTMYFNSEYGLDPVIAGFFTAACVFAGSFIRPVGGALADRYGGVRTLGVVYVLAAIGLTVAGFQLPSAGLALAVLLFAMLALGAGNGAVFQLAPQRFRNEIGVMTGLIGMTGGIGGFYLASTLGLAKKMTGSYQSGFIGFALLAVFALIALFSLKARWRAVWPTLHGDAAPVRV

SEQ ID NO: 36281 - protein, 340 aa, Burkholderia thailandensis E264
MSTKGTILVTGGAGYIGSHTAVELLEHGYDVVIADNLVNSKREAIARIEQITGKTPAFHEADVSDERALARIFDAHPITAAIHFAALKAVGESVAKPVEYYRNNLDSLLSLLRVMRERGVKRIVFSSSATVYGVPERSPIDETFPLSATNPYGQTKLMAEQILRDVEAADPSWRVATLRYFNPVGAHESGLIGEDPAGIPNNLMPYVAQVAVGKLEKLRVFGSDYATPDGTGVRDYIHVVDLARGHIAALDALERRDASLTVNLGTGRGYSVLEVVRAFEKASGRPVPYELVARRPGDVAECYANPAAAAEVIGWKAERDLERMCADHWRWQENNPRGFV

SEQ ID NO: 36282 - protein, 311 aa, Synechococcus sp. WH 8102
MIARKLTWTRRLLATVLVPLVVFGFGLISAQPADAARGGRMGGGSFRAPSMPRSGGGGYRGGGYGGGMRGGGFGFPFIIPIFGFGGGGLFGLLILMAVAGVLVNAFRGGGGAPAIGGGSPMPAVPSKVNMLQVQVGMLASAKSLQEDLRRLAASSDTSSSSGLQRLLQESTLALLRQPELWVYANAESGSVPFSSAESTFNRLSMNERSKLDAELTSNVAGQKFTGGTTENVGDADATNEFIVVTLLVASTATASLKGASTGEELRQTLRILGSTASSELMALEVIWQPEGRGDVLSAEELLTAYPNLQHL

SEQ ID NO: 36283 - protein, 223 aa, Debaryomyces hansenii CBS767
MSQNISNEEGISRPIEDDELEDEFNDNVDEQPGQSESNNIASSEAPTQNTLPTATAAMPDLPELSRKDKSLKEVLDLMDGEFAPIIPDAVTDYYLAKNGFETSDVKIKRLLALATQKFILDVAQDAYEYSRIRNSSSVYNSANPQVRAKQLIQGQQYANQQLITGSVGGSGSGVEGQGDQQQPLQHTGSNAGNQQGKIVLTMEDLSSALNEYGLNTSRPDFYR

SEQ ID NO: 36284 - protein, 394 aa, Saccharomyces cerevisiae
MPPKKQVEEKKVLLGRPGNNLKAGIVGLANVGKSTFFQAITRCPLGNPANYPFATIDPEEARVIVPSPRFDKLCEIYKKTASEVPAHLTVYDIAGLTKGASAGEGLGNAFLSHIRSVDSIYQVVRCFDDAEIIHVEGDVDPVRDLEIINQELRLKDIEFAQKALEGAEKIAKRGGQSLEVKQKKEEMDLITKIIKLLESGQRVANHSWTSKEVEIINSMFLLTAKPCIYLINLSERDYIRKKNKHLLRIKEWVDKYSPGDLIIPFSVSLEERLSHMSPEDAEEELKKLQTISALPKIITTMRQKLDLISFFTCGPDEVREWTIRRGTKAPQAAGVIHNDLMNTFILAQVMKCEDVFEYKDDSAIKAAGKLMQKGKDYVVEDGDIIYFRAGAGKN

SEQ ID NO: 36285 - protein, 425 aa, Synechococcus sp. WH 7803
MHATPALHLDNGLSIYLVAFGGLLLVSVLLDDLAARVRVPGILMVLLLGLLIDNQVEVSNTRELTLLSLDHAQQITQAALVLVLFFGGLTTNWKEVRGVIRPAARLATIGVLITAALITGVGIGFDLARGGAALTQIVPRNLFIGAMVASTDASAVLALLRPLQGRLPQPLMDLIECESGFNDPMAVVLAGLALALVGGDGVGAGVLVTDLVRQFLLGILIGFLGGSLTVQLLGTRMGLNQASMLPVVSLALLMVLSGGTSLLGGSPLLAAYVAGLVLGNSDSLDQAVLEEAHSSYAKMAELLLFLCMGLVVAPQDVVYAAGMAFLLFLVMQLVRLVMVHLLLWRTPFSSGERIFVCWAGLRGAVPIALAINAWSSGVSWGVLMPPLALAVVLYGLFIQGFALVPLARRMNLTLPDPGADSSSAA

SEQ ID NO: 36286 - protein, 484 aa, Nitrosospira multiformis
MIRRTKIVATLGPASRDAKVLERMINAGVDVVRINFSHGTREEHIEGAELARSLARAAGHAVGVLADLQGPKIRIGKFENNKILLKTGDRFILDAECELGNQERVGLDYKELPNDVETGATLILDDGRIVLGVSEVKGSQVYCVVEQGGILSNNKGINRKGGGLSAPALTGKDVEDIRTAAALKADYLAVSFPRSGDDMRWARDVMREAGGKSLLMAKIERSEAILALDDILEASDAIMVARGDLAVEVGDAAVPALQKRMIRTARTKNKLVVTATQMMESMVSSPIPTRAEVTDVANAVLDGTDGVMLSAESATGQYPVEAVAAMARVCLEAEKEYLVSSENRRLQGGLPDNIEEAIARATMFTAGGLKIRAIAALTQSGRTVLLMSRRSSTVPIFALSPQEDTRRKMTLFRGVYPVKFGGGSNDPEIILNHAENELLRRGAVRNGDLMIMTIGEPVGKAGGTNTMKIVKVGEHRKQERKVES

SEQ ID NO: 36287 - protein, 368 aa, Geobacter metallireducens GS-15
MSANSPPDGPIRTMKTLQELRRDIDAIDDQILDLLNSRSRLAIEVGKVKAGENRDFHVPSREREIYERLAAGNSGPFPNEAVRSVFREIISASLALESPMKVAFLGPKATFTHLASLQHFGLSAELVPQKSIPAVFEEVSKGRSLYGVVPVENSTEGMVSHTLDMFMESDLKINAEILLEVSHDLLSRTGRLEDVKKVYSHPQAIAQCRNWLDENLSGVPVVDVASTALAAQIVGEDYTAAAIASEFAAALYDLKVVRHRIEDQVNNFTRFLVVGRKMADRCGDDKTSLMFSVKDEPGILHRMLEPFAKRGVNLSKIESRPLKKKAWEYIFFLDLAGHISDPVVSDAVQELKNYCQFVKILGSYPRAK

SEQ ID NO: 36288 - protein, 401 aa, Haloarcula marismortui ATCC 43049
MTLITDIRLRRVLDSRGNATVEADVLTESGGFGRGKAPSGASTGEYEAIELPANEAIAKAREEALPRLIGEVHAGNQRDVDAALHAADGTDDFSGIGANSAVAISMAAAKAGADVLGAPLYQHLGGTFRGNEYPTPLGNIIGGGEHAADATNIQEFLAAPVGAPSVEEAVFANAAVHQEVHDILADRDLPAGKGDEGAWAPSVSDDEAFEIMDEAVETVADDFGFAISFGLDVAGAELYDDEADGYVYDDGVKSTEEQIEYIAGKVEEYDLVYVEDPLDENDYEAFADLTAQVGDQTLVCGDDLFVTNVERLQAGINADAGNSILIKPNQIGTLTDAVDAIELATASGYESVVSHRSGETEDTTIAHLAVATDAPFIKTGAVGGERTAKLNELIRIEDNAV

SEQ ID NO: 36289 - protein, 288 aa, Glycine max
MAAEVYYQAIGTLQSHSYLNNLNHHQKHQNNLVTLVSRDFISSNGLSTRRSNCTGQRNCSVIRSLASQTSVVDPVLSPSRSNASDTYKKSNEAALILIRHGESLWNEKNLFTGCVDVPLSKKGIDEAIEAGKRISSIPVDVIFTSALIRAQMTAMLAMTQHRRGKVPIMMHNESEQARSWSQVFSEDTKKQSIPVIAAWQLNERMYGELQGLNKQETADRYGKEQVHEWRRSYDVPPPNGEGLEMCAERAVAYFRDQVCGSLEFCNLAISLSSFSPFMLFFMVYDYNS

SEQ ID NO: 36290 - protein, 261 aa, Bacillus megaterium
MYTDLKDKVVVVTGGSKGLGRAMAVRFGQEQSKVVVNYSSNEEEALEVKKEIEQAGGQAIIVRGDVTKEEDVVNLVETAVKEFGTLDVMINNAGVENPVPSHELSLENWNQVIDTNLTGAFLGSREAIKYFVENDIKGNVINMSSVHEMIPWPLFVHYAASKGGMKLMTETLALEYAPKGIRVNNIGPGAIDTPINAEKFADPEQRADVESMIPMGYIGNPEEIASVAAFLASSQASYVTGITLFADGGMTKYPSFQAGRG

SEQ ID NO: 36291 - protein, 399 aa, Synechococcus sp. WH 8102
MAPYRLDVVSLAPQAFAPLLELGVIGRAFGSGIAELHLHNPRDFATDRYRKVDDEPYGGGAGMVLKPEPVFAAVESIPRRSGARVLLMSPQGRPLQQADLQRWAHDHDQLVLLCGHYEGFDERIRSLVDEEVSVGDFVLTGGELPAMTVINGVVRLLPGTVGTAQSLVEESHSALLLEHPHYTRPAEFQGMAVPAVLRSGNHAAIETWRQQQREQRTRDRRPDLYARWRMARDDAGAAMQMRIGNGYDIHRLVQGRPLILGGVTLEHPDGLGLDGHSDADVLVHAVMDALLGALSLGDIGKYFPPTDPQWKGADSLQLLEQVVALVTQRGWQVVNVDAVVIAERPKLKPHIEAMRGNIATRIGIAADAVGVKATTNERLGPEGREEGISCQAVVLLGQP

SEQ ID NO: 36292 - protein, 178 aa, Zea mays
MAVDLTPRQPAKAYGGDGGAYYEWSPAELPMLGIASIGAAKLALAAGGMSLPSYSDSAKVAYVLQGKGTVGIVLPEATKEKVVAVKEGDALALPFGVVTWWHNTPESATELVVLFLGDTSKGHRPGQFTNFQLTGASGIFTGFSTEFVGRAWDLKEDDAAKLVSSQPASGIVKLTAGQ

SEQ ID NO: 36293 - protein, 421 aa, Bifidobacterium longum DJO10A
MEQKDVLKALQRDHAAELKLAAERLKGTARHTEIIPSPVLSEMTGHEILLKPENLQVTGSFKIRGAYNKIASLTEEQIAHGIVTASAGNHAQGVAYAARERGAKATICMPQITPPLKVDATKAYGADVVLYGDVFDESAAHAAELADKEGMIYVPPFDDYEVICGQGTIGLEILEDVPNVTDVVVPLGGGGLGAGVALAIKTFKPEVRVIGAIPEGSPAWKDSLAAGRVSPADHVVTSAEGVAVKHPGDLPFALINEFLDDLVTVTERDINEMILLMLEKHKLVVEAAGAVSLAALEHLNLRSRKFAAATGPHVVVPIMSGGNIDTVTMGAVIQKGMIARGRIMNFEVELPDTPGQLVKVATLLAEQRANVIQLDHDQFKASGHYTNAVSLGVTVETNGPEHIDRILAALREAGFQPKRIY

SEQ ID NO: 36294 - protein, 445 aa, Haloarcula marismortui ATCC 43049
MSKTPPGPKGEPLFGSSRTYARDPFRFISALERAYGDVARFDMGPMDTVMLCDPTAIERVLVSEADRFRKPDFQGDALGDLLGDGLLLSEGETWEQQRKLANPAFSMARLSGMADRITGHAEDRIADWSHGDVIDAEQSMTRVTLDVILDLMMGVELSEQRVQTIEEQLLPLGQRFEPDPIRFAMPQWMPMPDDAEFNRAVRTLDEVLDDIIEVREDSLGTDEDGPMDFLSVLLRARDDGNQSPEQLRDEMMTMLLAGHDTTALTLTYTWFLLSEHPEVEQRVHEELDDVIGDDRPGMEHVRELDYLEWVIQEAMRLYPPVYTIFREPTEDVTLSGYEVEAGTTLMVPQWGVHRSERFYDDPETFDPERWKPERASERPRFAYFPFGGGPRHCIGKHLAMLEAQLITATTASQYRLEFQGETPLELLPSLTAHPRQKMSMRVQER

SEQ ID NO: 36295 - protein, 631 aa, Gibberella zeae PH-1
METQFPLNRYRAGGGHPSGQRNGIEETLEESFLSHYTQLFNKYAGADGKWRRDQIGLFMHHVQAENPNGLAAYLTDNEELNLHELIKYLTSPCGNILEMAAPQDLSWPLNNYFISSSHNTYLTGNQLSSDSSAEAYKDALLRGCRCIEIDVWDGEEKWKPGFEDDDGDDDGNNREVGAEQKKIGLRQRAFIKFGRWAMNKFDPVDPDGRTFDDRLGDCIHAEPRVLHGFTMTKEVSFRNVCETVREYAFTTSELPLIVSLEVHCSPLQQNTMVDIMKETWSDYLLGEPECDPAHLPSPHELRKKILIKVKYVPEDKTESDASDDGSLLEVVTEGNEKKTKKVKAPKITSRLSRLGIHTRGISFKSLDEPEATMPNHIFSLSEDAASAIQRRLPKALFSHNRRYLMRTYPHGMRVDSSNYDPVLFWRAGVQVVALNWQSWDVGMILNEGMFMGSDGYILKPKGYCHEGHSNDDDVLIPSKTLERLAITVVAAQNLPLLKSTDDPAKFIPYVKIGFHTEPNAFSAMTDEDQSPEKMKQVGYSGQTCKSKGTSPSFNEETIEFLNVQGVVPELSFLSFRVMNDVPGPDVMAAWACVRLDRLRLGYRFLRLLDKDGMPSKGILLMKVTMREVSTS

SEQ ID NO: 36296 - protein, 355 aa, Metarhizium anisopliae
MSRSNPPNAGGSRKISFNVSEQYDIQDVVGEGAYGVVCSAIHKPSGQKVAIKKITPFDHSMFCLRTLREMKLLRYFNHENIISILDIQKPRGYDTFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEEALKHPYLEPYHDPEDEPTAPPTPEEFFDFDKHKDTLSKEQLKQLIYQEIMR

SEQ ID NO: 36297 - protein, 136 aa, Photobacterium profundum SS9
MVNIRARVPFKVGQKSNIPADLLSFNGLESGKEHVAVIFQDADTKPAVPLVRMHSECLTGDVFHSSRCDCGEQLDETIEKMGEMGGVILYLRQEGRGIGLYNKIDAYELQSQGMNTMKRITTLALATISVILQKRL

SEQ ID NO: 36298 - protein, 340 aa, Glycine max
  misc_feature (31)..(31): Xaa can be any naturally occurring amino acid
  misc_feature (188)..(188): Xaa can be any naturally occurring amino acid
MGKVKIGINGFGRIGRLVARVALQRDDVELXVAVNDPFITTDYMTYMFKYDSVHGHWKHHDVTVKDEKTLLFGDKAVTVFGHRNPEEIPWGSTGADIIVESTGVFTDKDKAAAHLKGGAKKVIISAPSKDAPMFVVGVNEHEYKPELDIISNASCTTNCLAPLAKVINDRFGIVEGLMTTVHSITATXQKTVDGPSAKDWRGGRAASFNIIPSSTGAAKAVGKVLPALNGKLTGMAFRVPAVDVSVVDLTVRLEKETSCDENKNAIKEESEGKLKGILGYTEDDVVSTDFIGDSRSSIFDAKAGIALNKNFVKLVSWYDNEWGYSSRVIDLLVFVAKKSL

SEQ ID NO: 36299 - protein, 465 aa, Vibrio cholerae O1 biovar eltor str. N16961
MFIPVIMAGGSGSRLWPLSRSAFPKQFLSLDSSSQHTMLQATIERLQGLPIAEPIVISNEDHRFIVAEQIRRYGKKSRIILEPAGRNTAPAIALAAFTAIEQEDDPVLLVLAADHFVKNKSAFQAAISQAAQQAEAGKLATFGIVPTTPETGYGYIHRGEEVTQGTYEINSFVEKPQLNIAEQYLASGEYYWNSGCFMFKASVFLNELKQHSPEIYRQCELAMQGLSHDYDFIRVGVEEFLKCPDDSIDYAVMEHTKLGVVVSMDAGWSDVGSWSALWEVSDKDADGNVCQGDAILSGTSNCYIYAPNKLVAAVGLKDIVVVETKDAVLVADKNQVQEVKKIVEHLKAENRAEYREHRERYRPWGKSDAIDKGERYKVNRITVEPGKKQSLQMHYHRAEHWVVVSGTAKVTCEGNVKVITENQSLYIPIGTNHMIENPGKIPLELIEIQSGSYLNEDDVVRFEDK

SEQ ID NO: 36300 - protein, 254 aa, Triticum aestivum
  misc_feature (241)..(241): Xaa can be any naturally occurring amino acid
  misc_feature (245)..(246): Xaa can be any naturally occurring amino acid
MATQTMKAVNYQGPYKVTVEDVELPKLEHPDDVIVKVTTAAICGSDLHMYEGRTAAQPGITFGHENMGIVEQLGEGVTLLKKGDRVVMPFNVADGRCRNCEEGKTAFCTGVNPGFAGGAYGYVAMGPYRGGQAQYIRVPYADFNALKLPAGKEHEADFILLADIFPTGWHGVEISGFRSGESVAVFGAGPVGLMAAYSAVLRGASRVFVVDRVPERLQAAEKIGCTPIDFSQGDAVDLIIXANGXXRVDRSADA

SEQ ID NO: 36301 - protein, 453 aa, Oryza sativa Japonica Group
MPVSRMMMESNTMAKEMAVRHHLLPGSPRRRTAHNLSSSSLRKSSDASLLHKVPCAALRSLLANLNDVLLTTRLFLLFPAVLLAIAATYLHFGQVWVFVLSLIGLVPLAERLSFLTEQIAFYTGPTVGGLLNATFGNVTEVIIALLALREGKIEVVKCSLLGSILSNLLLVLGTSLFLAGIANLRAHQPYDTKQAHVNTALLMLAVLCHSLPLMLRYAVTSGDHAIVSGDAALHLSRACSILMLIAYLAYLFFQLNTHRQLFEPQQVEDDDDDDLVIAQDDEPVLGFSSAMIWLALMTLLTALLSGYVVSTIEAASESWELSVSFISIILLPIVGNAAEHAGAVIFALKNKMDITLGVSLGSATQISMFVVPVSVIVAWTMGIPMDLDFNLLETGSLFLAILVTAFTLQEGESHYLKGLILVLCYAVISVCFFVIRRRSAGGTDGVHHLDVIV

SEQ ID NO: 36302 - protein, 591 aa, Populus trichocarpa
MESTLKEMRDGASVLDMDPKSTVGGGVEDVYGEDRATEDQLVTPWTISVASGYTLLRDPHHNKGLAFTEKERDAHYLRGLLPPTTISQQLQEKKLMNTIRQYQLPLQKYTAMMELEERNERLFYKLLIDNVEELLPVVYTPTVGEACQKYGSIFKRPQGLYISLKEKGKVLDVLKNWPQKSIQVIVVTDGERILGLGDLGCQGIGIPVGKLSLYTALGGVRPSACLPVTIDVGTNNEQLLKDEFYIGLRQRRATGQEYSELLHEFMTAVKQNYGEKVLIQFEDFANHNAFDLLAKYGTTHLVFNDDIQGTAAVVLAGLISALKLLGGSLADHTFLFLGAGEAGTGIAELIALEMSRRSKTPLEETRKKIWLTDSKGLIVSSRKESLQHFKKPWAHEHEPVKGLLEVVKAIKPIVLIGTSGVGKTFTKEVIEAMASFNEKPLILALSNPTSQSECTAQEAYTWTKGKAIFASGSPFDPVEYEGKVFVPGQSNNAYIFPGLGLGLVISGAIRVHDDMLLAAAEALAGQIKEEYLAKGLIYPPLSNIRKISVQIAANVAAKAYELGLATRLPRPENLVKHAESCMYSPAYRYYR

SEQ ID NO: 36303 - protein, 484 aa, Nitrosospira sp. KAN8
MIRRTKIVATLGPASRDAKVLERMINAGVDVVRINFSHGTREEHIEGAELARSLARAAGHAVGVLADLQGPKIRIGKFENNKILLKTGDQFILDAECELGNQERVGLDYKELPTDVETGATLILDAGRIVLGVSEVKGSQVYCVVEQGGILSNNKGINRKGGGLSAPALTAKDVEDIRTAAALKADYLAVSFPRSGDDMRWARDVMREAGGKSLLMAKIERSEAILALDDILEASDAIMVARGDLAVEVGDAVVPALQKRMIRTARTRNKLVVTATQMMESMVSSPIPTRAEVSDVANAVLDGTDAVMLSAESATGQYPVEAVAAMARVCLEAEKEYLVSSENRRLQGGLPDNIEEAVARATMFTAGGLKIRAIAALTQSGRTVLLMSRRSSTVPIFALSPQEDTQRKMTLFRGVYPVKFGGGSNDPEIILNHAENELLRRGAVRNGDLIIMTIGEPVGKAGGTNTMKIVKVGEHRKQERKVES

SEQ ID NO: 36304 - protein, 385 aa, Streptococcus pyogenes str. Manfredo
MKITVVGIGYVGLSIGLLLAKEHDVTFFDIDNKKIDLINKRQSPLKEAAINKLLCKAKNINATSSEELAYKDATFIILSLPTNLKVNKLDTSIIEISVSNILKINKKATIVIKSTVPIGFTEYLRNRFHYNDIIFSPEFLREGSTIHDQLYPSRTIVGNESRNSQLFLDILTDISVEKDSPSLLVGSSEAEAIKLFSNAYLAQKIAFFNELDTFAEMQNLDSKKIIEAMGYDQRIGNSHNNPSFGFGGYCLPKDIKQLEYHFKEIPAPIITSISESNLLRKIHIAKMILNSSAKTIGIYRINSKKDSDNCRESSTIDVAKLLKSSGKDVIIFEPLINQKKLLGCPLINDFNEFIKYSDIIVANRIDDALRKCNSKVFTRDIFQYD

SEQ ID NO: 36305 - protein, 996 aa, Nostoc sp. PCC 7120
MVLQVQTSTYEAKTQEIARQLLGATQENRSFFASLRDQMRWDDKLLAWAMSNPGLRVQLFRFIDTLPALHSKAEIAAHLQEYLGDESVELPAALKGMLNFANPDSVPGQVAATTVSTAVETLAHKYISGENIKQVIKTVERLRKEKMAFTIDLLGEAVITETEAQSYLERYLELIAQLTEASKNWGTIAAIDEADGEQLAKVQVSVKLTAFYSQFDPLDAKGSEEKVSDRIRILLRRAKELGAAIHFDMEQYAYKDLTLNILQKILLEDEFRQRTDIGITIQAYLRDSEQDARNAIAWLKQRGYPLTIRLVKGAYWDQETIKAAQKHWPQPVFNDKAATDANFEAITQLLLENHQYVYSAIGSHNVRSQALAMAIAETLNVPRRRFEMQVLYGMGDKLAKALVDRGYRVRVYCPYGDLLPGMAYLIRRLLENTANSSFLRQNLENRPVEELLAAPKVDLAQAKVHSPEAFPQGKHFVGAADTDYAEEEDRTKAARAFAVVRGELGKTYLPLINGEYVQTAEVIDSVNPSNFSEVIGKVGLISVEQAEQAMQAAKAAFPGWRRTSVKERAGILRRAGDLMEQRRAELSAWIVLEVGKPVKEADGEVSEAIDFCRYYADEMERLHQGINYDVDGETNRYIYQPRGIVVVISPWNFPLAIACGMTVAALVTGNCTLLKPAETSSVITAKLTEILVEAGIPKGVFQYVPGKGSQVGAYLVSHPDTHLIAFTGSQEVGCRIYAEAATLKPQQRHMKRVIAEMGGKNAIIVDESADLDQAVVGVVQSAFGYSGQKCSACSRVVVVEAIYDAFIHRVVEATKSLNIGEAELPSTQVGPVIDANARDRIREYIEKGKAESQVALELSAPNHGYFVGPVIFGEVPPHGTIAQQEIFGPVLAVIKAKDFAQALAIANDTDYALTGGLYSRTPSHIQQAQEEFEVGNLYINRNITGAIVARQPFGGFKLSGVGSKAGGPDYLLQFLEPRTITENIQRQGFAPIEGAE

SEQ ID NO: 36306 - protein, 322 aa, Synechococcus sp. WH 7803
MAIAPDITALVGCTPMVRLNRLPKAWGCTAEIVAKLESFNPTASVKDRIAGAMVEAAESAGTIAPERTVLVEPTSGNTGIALAMVAAARGYRLILTMPDTMSTERRAMLRAYGAELQLTPGMEGMQGAIERARELVDEIPGAYLLQQFDNPANPAVHAASTAEEIWADTEGSLDAVVAGVGTGGTITGCARVLKERQPKLSVVAVEPAASPVLAGGVAGPHRLQGIGAGFIPPVLEMDLIDEIIAVSDDEAMDVGRRLAREEGLLCGVSSGAAVAAALRLGQRPAMEGRRIVVILASFGERYLSTPMFSTAAPLPARRDAQL

SEQ ID NO: 36307 - protein, 141 aa, marine gamma proteobacterium HTCC2080
MATERTLSIIKPDAVGKNVIGEIYTRFESAGLRIVASRMMQLSDTTAGGFYAEHKGRPFYDDLVKFMTSGPVVVQVLEGEGAIAKNRDLMGATNPQEAAAGTIRADFATTIDANAVHGSDSPESAAREIAYFFAANEVCER

SEQ ID NO: 36308 - protein, 484 aa, Nitrosospira sp. PM2
MIRRTKIVATLGPASRDAKVLERMINAGVDVVRINFSHGTREEHIECAELARSLARAAGPAVGVLADLQGPKIRIGKFENNKILLKTGDQFILDAECALGNQERVGLDYKELPSDVETGATLILDDGRIVLGVSEVKGSQVYCVVEQGGILSNNKGINRKGGGLSAPALTGKDVEDIRTAAALKADYLAVSFPRSGDDMRWARDVMREAGGKSLLMAKIERSEAILALDDILEASDAIMVARGDLAVEVGDAVVPALQKRMIRTARARNKLVVTATQMMESMVSSPIPTRAEVSDVANAVLDGTDAVMLSAESATGQYPVEAVAAMARVCLEAEKEYLVSSENRRLQGGLPDNIEEAIARATMFTAGGLKIRAIAALTQSGRTVLLMSRRSSTVPIFALSPQEDTRRKMTLFRGVYPVKFGGGSNDPEIILNHAENELLRRGAVRNGDLMIMTIGEPVGKAGGTNTMKIVKVGEHRKQERKVDS

SEQ ID NO: 36309 - protein, 484 aa, Nitrosospira sp. GS832
MIRRTKIVATLGPASRDPKVLERMINAGVDVVRINFSHGTREEHIESAELARSLARAAGHAVGVLADLQGPKIRVGRFEKGNILLKIGDKFILDAECELGNQERVGLDYKELPNDVETGSTLILDDGRIVLGVSEVKGSKVYCVVEQGGILSNNKGINRKGGGLSAPALTAKDVEDIRTAAALKADYLAVSFPRSGDDMRWARDVMRDAGGKSLLMAKIERSEAILALDDILEASDAIMVARGDLAVEVGDAVVPALQKRMIRTARANNKLVVTATQMMESMVNSPIPTRAEVSDVANAVLDGTDAVMLSAESAAGQYPVESVAAMARVCLEAEKEYLVSSELRRLQGGLPETIEEAIARATMFTAGGLKIRAIAALTQSGRTVLLMSRRSSNVPIFALSPQEDTRRKMTLFRGVYPVKFGGGSNDPEIILNHAENELLKRGVVRNGDLIIMTIGEPVGKAGGTNTMKIVKVGEHRKLERKPGS

SEQ ID NO: 36310 - protein, 1151 aa, Arabidopsis thaliana
MSLFHVLGFGVKIGHLFWMLCCWFVSWFVDNGIEDKSGLLVGSVGDLEKTKMTTLKKKNKMWFWNKISSSGLKIPSFSYQFLGSVKFNKAWWRKLVVVWVVFWVLVSIWTFWYFSSQAMEKRKETLASMCDERARMLQDQFNVSMNHVQAMSILISTFHHGKIPSAIDQRTFSEYTDRTSFERPLTSGVAYAMRVLHSEREEFERQQGWTIRKMYSLEQNPVHKDDYDLEALEPSPVQEEYAPVIFAQDTVSHVVSLDMLSGKEDRENVLRARSSGKGVLTAPFPLIKTNRLGVILTFAVYKRDLPSNATPKERIEATNGYLGGVFDIESLVENLLQQLASKQTILVNVYDITNHSQPISMYGTNVSADGLERVSPLIFGDPLRKHEMRCRFKQKPPWPVLSMVTSFGILVIALLVAHIIHATVSRIHKVEEDCDKMKQLKKKAEAADVAKSQFLATVSHEIRTPMNGVLGMLHMLMDTELDVTQQDYVRTAQASGKALVSLINEVLDQAKIESGKLELEEVRFDLRGILDDVLSLFSSKSQQKGVELAVYISDRVPDMLIGDPGRFRQILTNLMGNSIKFTEKGHIFVTVHLVDELFESIDGETASSPESTLSGLPVADRQRSWENFKAFSSNGHRSFEPSPPDINLIVSVEDTGVGIPVEAQSRIFTPFMQVGPSISRTHGGTGIGLSISKCLVGLMKGEIGFSSTPKVGSTFTFTAVFSNGMQPAERKNDNNQPIFSEFRGMKAVVVDHRPARAKVSWYHFQRLGIRVEVVPRVEQALHYLKIGTTTVNMILIEQEIWNREADDFIKKLQKDPLFLSPKLILLANSVESSISEALCTGIDPPIVIVKPLRASMLAATLQRGLGIGIREPPQHKGPPALILRNLLLGRKILIVDDNNVNLRVAAGALKKYGADVVCAESGIKAISLLKPPHEFDACFMDIQMPEMDGFEATRRIRDMEEEMNKRIKNGEALIVENGNKTSWHLPVLAMTADVIQATHEECLNRAAVQGSFSLFQFAFRYRIIRGDGAGRRTAKETQKLVSPMHLEVVEKQIDDCKKSVYRKADESSSWNIFRVALDREESIITTSKRLADRKIEKFDKNILKRGFVPETTTKKGKDYPVGPILLGFFVFVVIGSSLFQIIRTATSGGMA

SEQ ID NO: 36311 - protein, 225 aa, Geobacter metallireducens GS-15
MFARLHEDIQSVKERDPAARSSVEVFFCYPGLHAIWFHRFAHWFWMREFFFLGRFLSHIGRFFTGIEIHPGATIGRRLFIDHGMGVVIGETAEIGDDVTIYHGVTLGGVSLEKKKRHPTVDNNAVIGSGAKVLGPFTVGVGAKIGSNSVVVKEVPANATVVGIPGRVVMAADEPAKKADFEHGKLPDPEAKAISCLFDQLRELERKYADLADEHAALRRRVESGK

SEQ ID NO: 36312 - protein, 484 aa, Nitrosospira sp. NRS527
MIRRTKIVATLGPASRDPKVLERMINAGVDVVRINFSHGTREEHIESAELARSLARAAGHAVGVLADLQGPKIRVGRFEKGNILLKIGDKFILDAECELGNQERVGLDYKELPNDVETGSTLILDDGRIVLGVSEVKGSKVYCVVEQGGILSNNKGINRKGGGLSAPALAAKDVEDIKTAAALKADYLAVSFPRSGDDMRWARDVMRDAGGKSLLMAKIERSEAILALDDILEASDAIMVARGDLAVEVGDAVVPALQKRMIRTARANNKLVVTATQMMESMVNSPIPTRAEVSDVANAVLDGTDAVMLSAESAAGQYPVESVAAMARVCLEAEKEYLVSSELRRLQGGLPETIEEAIARATMFTAGGLKIRAIAALTQSGRTVLLMSRRSSNVPIFALSPQEDTRRKMTLFRGVYPVKFGGGSNDPEIILNHAENELLKRGVVRNGDLIIMTIGEPVGKAGGTNTMKIVKVGEHRRHERKPGS

SEQ ID NO: 36313 - protein, 439 aa, Glycine max
  misc_feature (135)..(135): Xaa can be any naturally occurring amino acid
MQKMMKPPSNSSFPSFLRVKPRLSSYLFTLLAFILFAAILYGHDFVFIFRPHLYSNEHTAQTLFFSTPVDVRSPPTEENKTVLTKTKREEEEQECDVFSGMWVRDELTRPLYEESECPYIQPQLTCQEHGRPEKXYQRWRWQPHGCNLPTFNARLMLEKLRGKRMIFIGDSLNRSQYVSLICLLHQIIPENAKSMETFDSLTVFTAKEYNATIEFYWAPFLLESNSDNAVIHRVTDRIVRKGSINTHGRHWKGADIVVFNTYLWWITGSKMKILLGSFNDKVKEIIDMPTEDAYRMAMKSMLRWVRLNMDSNKTRVFFTSMSPSHAKSIEWGGEAGGNCYNETTTIDDPTYWGSDSKKSIMQVIGEVFRKSKVPITFLNITQLSNYRKDAHTSIYKKQWNPLTPEQLANPASYADCVHWCLPGLPDTWNELLFVKLFYP

SEQ ID NO: 36314 - protein, 470 aa, Gibberella zeae PH-1
MAPSTIADFQDVPCHQAYTPIKPIHREGALMHRSLVQHPYMVESAQGIELKLSTGQTIIDGCGGAAVALIGHGREEVIHAITEQARKVSYVHTQSYTTAPAEELANVLLQGNPYGLEKAFFVGSGSEAVESALKLARQYHYEKGGLEKVHIISRRQCYHGNTMATMSISTNIARRAPYHGFLYPNVSHVSPAFAYHYKDSSESEDQFTARLLVELEEEFLRVGPQKVAAFIAETVVGATSGCVAAPAGYFQGVRALCDKYDVVMILDEIMCGIGRTGTFFAFEQEGVVPDITTVAKGLGGGYAAIAGVLIHKRVVDVLRQGSAAFNHGHTYQAHPISCAAALAVQRIVRRDNLVERCAEMGLVLEKMLKEDLSGCRSVGDIRGRGLFWGVEFVKDRQSKQPFDPAAKFGLLVQQLAFEKGVALYPGGATIDGVKGDHILLAPPFTVTEGSGGGGKNSLLGLTTAHKNMTI

SEQ ID NO: 36315 - protein, 494 aa, Arabidopsis thaliana
MEKKQGFFSSLRDEVVRGLSPSRSRPRSRSASPSRSTTPHMKALLWGRKKLIASSGCSGGGGVIGGERGGYYLSQPEPFIGRSSSLRPVMEGPDPDNGEVSGVDSKRLGSGLSHWVKGQWSRAPSVTSTTPAYRKSDLRLLLGVMGAPLAPINVSSSSHLLHLTIRDSPTETSSAQYILQQYTAACGGHKLHNAIKNAYAMGKLKMITSELETPTGTVRNRNSTKSETGGFVLWQMNPDMWYVELSVGGSKVRAGCNGKLVWRHTPWLGSHTAKGPVRPLRRALQGLDPRTTATMFAESKCVGERKVNGEDCFILKLCTDPETLRARSEGPAEIVRHILFGYFSQRTGLLAQIEDSQLTRIQSNDGDAVYWETTINSSLDDYKQVEGIMIAHSGRSVVTLFRFGEVAMSHTRTKMEERWTIEEVAFNVPGLSLDCFIPPADLRSGSLTEACEYSGQEEKGKSSLALASTTAHRAKVAALEKGSFDNDPVWHIDV

SEQ ID NO: 36316 - protein, 484 aa, Nitrosospira sp. TYM9
MIRRTKIVATLGPASRDPKVLERMINAGVDVVRINFSHGTREEHIESAELARSLARAAGHAVGVLADLQGPKIRVGRFEKGNNLLKIGDKFILDAECELGNQERVGLDYKELPNDVETGSTLILDDGRIVLGVSEVKGSKVYCVVEQGGILSNNKGINRKGGGLSAPALTAKDVEDIKTAAALKADYLAVSFPRSGDDMRWARDVMRDAGGKSLLMAKIERSEAILALDDILEASDAIMVARGDLAVEVGDAVVPALQKRMIRTARANNKLVVTATQMMESMVNSPIPTRAEVSDVANAVLDGTDAVMLSAESAAGQYPVESVAAMARVCLEAEKEYLVSSELRRLQGGLPETIEEAIARATMFTAGGLKIRAIAALTQSGRTVLLMSRRSSNVPIFALSPQEDTRRKMTLFRGVYPVRFGGGSNDPEIILNHAENELLKRGVVRNGDLIIMTIGEPVGKAGGTNTMKIVKVGEHRKLERKPGS

SEQ ID NO: 36317 - protein, 127 aa, marine gamma proteobacterium HTCC2080
MAYSEKVIDHYENPRNVGKFDDEDENIGTGMVGAPACGDVMRLQIKVNDNGVIEDAKFKTYGCGSAIASSSLLTEWVKGRKLEDAEQITNTEIAQELSLPPVKIHCSVLAEDAIKAAVKNFREKQDD

SEQ ID NO: 36318 - protein, 158 aa, Brassica napus
MSQHNILEALNVRVVGTGDRILVLAHGFGTDQSAWHLILPYFTQTYRVVLYDLVCAGSVNPDYFDFNRYTTLDPYVDDLLSIIDSLGIQTCAYVGHSVSAMIGIIASIRRPELFTKLILIGASPRFLNDEDYHGGFEEGEIEKVFSAMEANYEAWVQG

SEQ ID NO: 36319 - protein, 346 aa, Haloarcula marismortui ATCC 43049
MSERHQQVEDAIVARRDRVNDALPEDLPVQKPDHLYEASRYLLDAGGKRLRPTVLLLVAESLLDVDPLTADYRDFPTLEGGQADMMSAALAIEVIQTFTLIHDDIMDDDALRRGVPAVHKEYDLSTAILAGDTLYSKAFEFLLETGAAHERTVDANKRLATTCTRICEGQSLDIEFEQRDVVTPEEYLEMVELKTAVLYGAAASIPATLLGADEQTVDALYNYGLDVGRAFQIQDDLLDLTTPSEKLGKQRGSDLVENKQTLVTLHARQQGVDVGDLVDTDSVEAVSEAEIDDAVERLREVGSIEYARQTGQDLIASGKQNLEVLPDNEARYLLEGIANYLVERDY

SEQ ID NO: 36320 - protein, 245 aa, Brassica napus
  misc_feature (160)..(160): Xaa can be any naturally occurring amino acid
  misc_feature (203)..(203): Xaa can be any naturally occurring amino acid
  misc_feature (205)..(205): Xaa can be any naturally occurring amino acid
  misc_feature (207)..(207): Xaa can be any naturally occurring amino acid
  misc_feature (211)..(211): Xaa can be any naturally occurring amino acid
  misc_feature (216)..(216): Xaa can be any naturally occurring amino acid
  misc_feature (222)..(222): Xaa can be any naturally occurring amino acid
  misc_feature (236)..(236): Xaa can be any naturally occurring amino acid
SEILSLVSGAVSGSRDMDNNNNKNNEENGNTSKTASDDEGVGSVGRQMSESSLCVTEEEEEDDSKLHLGPQYTIKEHLEKDKDDESLRKWKEQLLGSVDVTNIGETLDPEVRIISLVILSPGRPDIVLMVPENGNPKGMWFTLKEGSRYCLKFTFHVNNXNIVSGLRYTNTVWKTGVKVDRTKEMLGTFSPQLEPYNHVMPEXTXPXGLFXRGSYXARTKFXDDDNKCYLEINYSXDIRKEWPAV

SEQ ID NO: 36321 - protein, 579 aa, Haloarcula marismortui ATCC 43049
MDDELRDRITEAAETNALLNAVKHDSEAQVGAIMGPLMGENPEFREYGDEIPGVIAPVVERVNGMDAEERRERLAELAPEKLEELEAEDEGEDHPLPDLPSAEEYDTVRMRVAPNPNGPWHIGHARMAAVVGTYKQRYDGEFICRFDDTDPETKRPDLDAYDAILDAIDYLGFEPDDVVNASDRVETYYEYARKLIDKGGAYTCSCPQGEFSDLKNNGEACPHRDKDAETTRSEFEAMVDGEYDSGEMVLRVRTDITHKNPALRDFVAFRMVDTPHPREAAEQYRCWPMLDFQSGLDDHLLGVTHIIRGIDLQDSAKRQQFVYDYFDWEYPEVIHWGHVQVDEYDVPLSTSSIAELIEDGELAGWDDPRAPTVASLERRGIRGEAVVDAMIQLGTSTSNVDLAMSSIYSNNRDLIDDDSDRAFFVRDSDDHGGLVERQIVGGPDAGEPPLHPDYEERGRREIPVTSGVVVEGDDLPDHGDRIWLKGYGCVRHTRDAFEYTGDDIDAVREEGVDVIHWAPADGPALRLRTMDGDVSGVAEPGLRNYDTDDVVQFERIGFARLDKVADDSDTESVAYFTHP

SEQ ID NO: 36322 - protein, 336 aa, Porphyromonas gingivalis W83
MDLIQDVIRRAQENKQRIVLPEGLEPRTLEAADRLMADKVVNIILIGNVDSVKAKVAELGLKNLAEAVIIDPNNHPKKQQYTDLLLQIRQKKGLTPEKAAELVENPLYLGCLIVKSGDADGLIAGAQNTTGDVLRPALQVIKTAPGMTSVSGTFLLFTKAKEYGKDGLLLVADCAVIPNPTADELAQIAVATARTAKAIADIEPRVAMLSFSTKGSAKHEMTDKVVEATRMAQEMAPDLLIDGEMQADAALVERVAALKAPGSNVAGKANVLVFPTLEVGNIAYKLVERLGHAEAVGPILQGMAAPVNDLSRGCSVEDIYRMVAITANQAIAAKEQ

SEQ ID NO: 36323 - protein, 469 aa, Azoarcus sp. EbN1
MNAQEVMKMIQENEVRFVDLRFTDTRGKEHHVGLPVSAFEEDHFEHGHPFDGSSLAGWKGIQASDMILLPEAGSAYIDPFFDETTVVLTCDVIEPSDGKGYDRDPRSIAKRAEAYLKSTGVGDTAFFGPEPEFFIFDSVEWSVDMSGVYSKIISEEAAWSTADKFEGGNTGHRPRIKGGYFPVPPVDSLNDIRAAMVLALEACGVPVEVHHHEVANAGQCEIGTKFSTLTKRADWTQVLKYIVHNVAHQYGKTATFMPKPIVGDNGSGMHVHQSIWKDGQNLFAGNGYAGLSEMALYYIGGIIKHARALNAITNPGTNSYKRLVPHYEAPTKLAYSARNRSASIRIPYVANPKGRRIEARFPDPLANPYLAFSALMMAGLDGIQNKIHPGDPADKNLYDLPPEEDAKIPTVCTSLDQALEYLDNDREFLTRGGVFSNDFIDAYLALKGEEVDRMRITTHPVEFDMYYSL

SEQ ID NO: 36324 - protein, 635 aa, Fulvimarina pelagi HTCC2506
MKTPLLDQIDTPADLRRFKEKDLRQIADELRSDLIDAVSQTGGHLGAGLGVVELTVALHYVFNTPDDRLIWDVSHQAYPHKILTQRRERMRTVRQEGGLSGFAKRTESEYDPFGAGHSSTSISAGLGMAVARDLAGAKNNVVSVIGDGAMSAGMAYEAMNNAGALDARLIVILNDNDMSIAPPTGAMSHYLARLVSGKTYRTLRNRARDFTQRLPDFFREGARKTEEYTRGFFTGGTLFEELGFYYIGPIDGHDLDALVPVLKNVRDAETGPILVHVVTKKGKGYEPAESSADKYHGVSKFDVITGAQSKSKGNAPSYTNVFASSLIEEARHDDKIVAVNAAMPAGTGLDKFGEAYPTRTFDVGIAEQHAVTFCAGLATEGYKPFAAIYSTFLQRAYDQVVHDVAIQHLPVRFAIDRAGFVGADGATHAGSFDTAYLCPLPGFVVMASSDEAELRHMVRTAAAYDEGPISFRYPRGNGTGVDMPERGEVLEIGKGRLIKEGSKVAILAFGTRLTDSLAAAEELDGYGLSTTVADARFAKPLDTDLVERLARNHEVLITVEEGSSGGFAAQVLQHLASVGLLDMGLKIRPIVMPDAFVDHGVPAKMNAEAGLDKAGIVSTVFRALGREESEAARRA

SEQ ID NO: 36325 - protein, 492 aa, Mycobacterium tuberculosis H37Rv
MATIHPPAYLLDQAKRRFTPSFNNFPGMSLVEHMLLNTKFPEKKLAEPPPGSGLKPVVGDAGLPILGHMIEMLRGGPDYLMFLYKTKGPVVFGDSAVLPGVAALGPDAAQVIYSNRNKDYSQQGWVPVIGPFFHRGLMLLDFEEHMFHRRIMQEAFVRSRLAGYLEQMDRVVSRVVADDWVVNDARFLVYPAMKALTLDIASMVFMGHEPGTDHELVTKVNKAFTITTRAGNAVIRTSVPPFTWWRGLRARELLENYFTARVKERREASGNDLLTVLCQTEDDDGNRFSDADIVNHMIFLMMAAHDTSTSTATTMAYQLAAHPEWQQRCRDESDRHGDGPLDIESLEQLESLDLVMNESIRLVTPVQWAMRQTVRDTELLGYYLPKGTNVIAYPGMNHRLPEIWTDPLTFDPERFTEPRNEHKRHRYAFTPFGGGVHKCIGMVFDQLEIKTILHRLLRRYRLELSRPDYQPRWDYSAMPIPMDGMPIVLRPR

SEQ ID NO: 36326 - protein, 220 aa, Helicobacter pylori
SLSLDYSKNRLNDTTLKLLFELANDCSLKEKIEAMFKGEKINTTEKRAVLHTALRSLNDTEILLDNMEVLKSVRSVLKRMRAFSDSVRSGKRLGYTNQVITDIVNIGIGGSDLGALMVCTALKRYAHPRLKMHFVSNVDGTQILDVLEKLSPASTLFIVASKTFSTQETLTNALTARKWFVERSGDEKHIAKHFVAVSTNKEAVQQFGIDEHNMFEFWDF

SEQ ID NO: 36327 - protein, 392 aa, Prochlorococcus marinus str. MIT 9301
MSQVNLSDRALSIEPSLTLQISAKANQLSAEGVDICNLSAGEPDFDAPKEVIEATSKAIFDGFTKYGPAAGNLDLRKAIANKLQIQNDLNYEFENVMVTNGAKQAIYNLFQVLLNTGDEVIIPSPYWLSYPQMVRLAGGKPIFTNSSAEDGFKINIEDLKSKISSKTKFIIINSPNNPTGRVMSKEELLQIADLARENPNINILSDEIYELILKKEFKHYSLSSLANDLKNRIFIINGFAKGWAMTGWRIGYLVGPKDVIKASSALQSQSTSNVCSFVQKGALEALKINNEFFSMINSHYDQRRRILYEGLNNINGIYIEEPNGAFYAFPKLPNSSITSVDFCNKALQDYGLVVVPGKAFGADQCIRISCAASEIKIKDGLQRIEKAISEYY

SEQ ID NO: 36328 - protein, 566 aa, Ostreococcus tauri
MNMVTKYPHWVFGKVFGYSGIRIDPTGSTTTTTTRVAGVLEAVSDGSARSPLYPSVNVWAELCLDSNITRVGSRRIPPESTTRRSTKPRFNEIHKFVRHRTLARPLPKSIPFPLNCPARAQAWRNASARLPCASPRPPSLAIRRNTRERQRHCTVRRVARKKHPSTLARVRSTRPRAPVAAHLRVRVARSRFAPPLEHHPSPLDRAFRSPRSPVDHAFRSTAVARRPRTATGAMSTATDARASVPSALEVTRAHAGALELDLGSLLAEDVVFDVRAVAAATGTTLDGAARERGRDVLQRVIAELFALPSESDGNGRFAQLPEPTTGFPRARALPPSETPLTKWEAFAKEKGIKKRKRSKETFDEQSEEWKRRYGYKRVNDANDVIIAPAKMTDVRERTQKNREKQDKNLMRAVQEKGVKALPPTLRLAVTGQKDSVGSGKLGKREMVHVASRVAQSTASMGKFNAPVAGDEKIKLKKGARRQFDDNLDTEKTRKKSQEIVEKLLLKEKAGGMVDVNMAARKIQQEKEKANRKNKSSGKSTEKKIGGKTGGKTGGKTGGKVGSKSKK

SEQ ID NO: 36329 - protein, 478 aa, Nitrosovibrio sp. RY3C
MIRRTKIVATLGPASSDPKTLERMIHAGVDVVRINFSHGSREEHIALAELTRSLARSAGPTVGVLADLQGPKIRIGRFEHGKITLKAGDKFVLDAECELGNQERVGLDYKELPNDVETGSTLMLDDGRIVLGVANVKGRQVYCVVEQGGVLSNNKGINRKGGGLSAPALTKKDMDDIRTAAVLKADYLAVSFPRSGDDIRWARDLMREAGGKSLLMAKIERSEAIPALKDILQASDAIMVARGDLAVEVGDAVVPALQKQMIRAARAANKLVVTATQMMESMITSPIPTRAEVSDVANAVLDGTDAVMLSAESAAGQYPVESVEAMARVCLEAEKEYLVTQELRRMPDTVPETIEEAIARATMFTAGSLKIRVIAALTHSGVTALLMSRRSTNVPIFALSPQEDTRRKTTLFRGVYPMKFGGGQSDPEIILNQAEDELLKRGAVHNGDLIVMTIGEPVGKAGGTNTMKIVKVGEYRKA

SEQ ID NO: 36330 - protein, 351 aa, Staphylococcus epidermidis ATCC 12228
MSIKKYSKGIDKSSPFFKGDGNTVKNGDIVKQPQLTKTLKGIKNNGPNYFYDKLAKHLTTELNGQIDKTDFNNYKSKQKKPSETKYLNTHVYSSSNPLGGGLMLQGLKLDEMLNNGQSDEQYLNSVLSGRDLMYSNRDIVNAKTNFSQEYLSNMYISNKYNNQNTSDSISDNSVKKTSTLHFVVVDKQGQMTSTTNTLSGYFGSGKYMDEGFYMNNSMTNFSDNKDSNNYHAKNTVPRSYISPTIIVGPDYYMGIGSPGGNKIPTILNEVIIDYLRGNGSLQDSIYKPRFYNDGNTVHFEKGMNKKYLDILQNQGYNIKEEKDNPNFGSVQAGIYHIKNKKTEIANDVGTR

SEQ ID NO: 36331 - protein, 318 aa, Saccharomyces cerevisiae
RAAAAQKGITLYKYIAELADARQDPFVIPVPFFNVLNGGAHAGGSLAMQEFKIAPVGAQSFAEAMRMGSEVYHHLKILAKEQYGPSAGNVGDEGGVAPDIDTAEDALDMIVKAINICGYEGRVKVGIDSAPSVFYKDGKYDLNFKEPNSDPSHWLSPAQLAEYYHSLLKKYPIISLEDPYAEDDWSSWSAFLKTVNVQIIADDLTCTNKTRIARAIEEKCANTLLLKLNQIGTLTESIEAANQAFDAGWGVMISHRSGETEDPFIADLVVGLRCGQIKSGALSRSERLAKYNELLRIEEELGDDCIYAGHRFHDGNKL

SEQ ID NO: 36332 - protein, 478 aa, Nitrosovibrio sp. RY6A
MIRRTKIVATLGPASSDPKTLERMIHAGVDVVRINFSHGSREEHIALAELTRSLARSAGHTVGVLADLQGPKIRIGRFEHGKITLKAGDKFVLDAECELGNQERVGLDYKELPNDVETGSTLMLDDGRIVLGVANVKGRQVYCVVEQGGVLSNNKGINRKGGGLSAPALTKKDMDDIRTAAVLKADYLAVSFPRSGDDIRWARDLMREAGGKSLLMAKIERSEAIPALNDILQASDAIMVARGDLAVEVGDAVVPALQKQMIRAARAANKLVVTPTQMMESMITSPIPTRAELSDVANAVLDGTDAVMLSAESAAGQYPVESVEAMARVCLEAEKEYLVTQELRRMPDTVPETIEEAIARATMFTAGSLKIRAIAALTHSGVTALLMSRRSTNVPIFALSPQEDTRRKTTLFHGVYPMKFGGDQSDPEIILNQAEDELLKRGAVHIGDLIVMTIGEPVGKAGGTNAMKIVKVGEYRKA

SEQ ID NO: 36333 - protein, 478 aa, Nitrosovibrio sp. FJI82
MIRRTKIVATLGPASSDPKTLERMIHAGVDVVRINFSHGSREEHIALAELTRSLARSAGHTVGVLADLQGPKIRIGRFEHGKITLKAGDKFVLDAECELGNQERVGLDYKELPNDVETGSTLMLDDGRIVLGVANVKGRQVYCVVEQGGVLSNNKGINRKGGGLSAPALTKKDMDDIRTAAVLKADYLAVSFPRSGDDIRWARDLMREAGGKSLLMAKIERSEAIPALNDILQASDAIMVARGDLAVEVGDAVVPALQKQMIRAARAANKLVVTATQMMESMITSPIPTRAEVSDVANAVLDGTDAVMLSAESAAGQYPVESVEAMARVCLEAEKEYLVTQELRRVPDTVPETIEEAIARATMFTAGSLKIRAIAALTHSGVTALLMSRRSTNVPIFALSPQEDTRRKTTLFRGVYPMKFGGGQSDPEIILNQAEDELLKRGAVHNGDLIVMTIGEPVGKAGGTNTMKIVKVGEYRKA

SEQ ID NO: 36334 - protein, 483 aa, Staphylococcus epidermidis ATCC 12228
MVEKLKSEWFNQPRKNILAGIVVALALIPEAIAFSIIAGVDPMVGLYAAFIIATVTAIVGGRPAMISGATGAVALLVTPLVKEHGVEYLFAATILMGLIQLLLGILKVGRLMKFIPRPVMIGFVNALGIMIFMSQIEHIFNISIATYIYVIITLLIVYVIPRFYKAIPAPLIAIIVLTALYMYTGSDVRTVGDLGNIKQTLPHFLIPNIPFNLETLQIIFPYSLSMAIVGLVESLLTAKIVDDATDTHSSKNKESRGQGIANIITGFFGGMGGCAMIGQSVINVKSGANSRLSTFTAGIVLMFMIIVLGGVVVQIPMPILAGIMVMVSIGTVDWNSFKYIKKAPKTDAFVMVLTVIIVLITHNLAIGVVVGVVFSAIFFATKISKVEVIYKELGKQHRFSFKGQIFFVSIDSMMEKIDFNIEDSVIVLNFDHAHLWDDSAVNAIDTIVRKFEEKNNVVYVEKLNADSRKIISELSYLNETHLN

SEQ ID NO: 36335 - protein, 480 aa, Synechococcus sp. WH 8102
MSDASFDFDVIVIGAGYGGFDAAKHAAEHGLKTAIIESRDMGGTCVNRGCVPSKALLAASGKVRELADDQHLASFGIHAAPVRFERQKIADHANQLVQTIRTNLTKTLERAGVTILRGHGRLEGSQRVGLREPSGVDRVLSARDVIVATGSDPFVPPGIETDGRTVFTSDEAINLEWLPRWIAIVGSGYIGLEFADVYTALGCEVTMIEALDRVMPTFDPDIAKIAGRHLIDGRDIDARSGVLASKVTPGCPVRIDLADFNSRELVETLEVDAVLVATGRVPSSKGLNLESLNIETNRGFVPIDDSMRVLVNGQPVPHLWAVGDVTGKLMLAHTAAAQGTVAVDNILGQNRTIDYRSIPAATFTHPEISSVGLTEAEAKQLAETDGFQLGSVRSYFKANSKALAELESDGLMKLLFNKSSGEVLGAHIYGLHAADLIQEVANAVARRQSVRQLSTEVHTHPTLSEVVEVAYKQAASQLTA

SEQ ID NO: 36336 - protein, 420 aa, Synechococcus sp. WH 8102
MVDAADSKSAGHWSWGFKSPGSHPEAVMNTYNRFPLTLVRGRGCWVWDDQGRRHLDAVAGIATDTLGHSDRALRRSLGRQLRRLQHVSNLYRIPEQDALATWLVQHSCADSVFFCNSGAEANEAAIKLARKHGHLKRGIDRPRILTASASFHGRTLAAVSATGQPRYHQGFEPMVEGFDYFPYNDIHAFESLLERHEANGPAVAAVLLEPLQGEGGVHPGDAGFFQRLRHLCSERNILLILDEVQVGMGRSGRLWGYEQLGIEPDAFTLAKGLGGGHAIGALLVNAKADVFEPGDHASTFGGNPFACTAGLTVAQEIQRRGLLRNVEERGQQLQQGIQGLVARYPQLLQGVRGWGLLQGLVLHQDCGVTAPQLAKAAIEQRLLLVAAGATVLRMVPPLVISANEVRQLLRRLDATLAELV

SEQ ID NO: 36337 - protein, 363 aa, Azoarcus sp. EbN1
MSLKCGIVGLPNVGKSTLFNALTKSGIAAENYPFCTIEPNVGIVEVPDPRLDALSTIVKPQKVQPAIVEFVDIAGLVAGASKGEGLGNQFLANIRETDAIVHVVRCFADENVVHVSGSVDPIRDIEVIDTELALADMATVDKALARYKRPAAAGDKDAKVLVAVLEKCIAQLDQAKPVRALDLAKEEWASLKPFCLITAKPVLYVANVKEGGFENNPHLDAVVAHAAAEKAEVVAICAAIEAEIAELDDADKSEFLADLGLEEPGLNRLIRAGYKLLGLQTYFTAGVKEVRAWTIHVGDTAPQAAGVIHTDFERGFIRAQTIAFDDFIAYKGEQGAKEAGKMRAEGKDYVVKDGDVLNFLFNV

SEQ ID NO: 36338 - protein, 220 aa, Zea mays
MGQQSLIYAFVARGTVVLAEYTEFTGNFTTIASQCLMKLPASNNKFTYNCDGHTFNYLVEDGFTYCVVAVESMGQQIPIAFMDRVKEDFTKRYGGGKAATAAANSLNREFRLKIKEHMQHCVDHPEEVSKLAKVKAQVSEVKGVMMENIEKVLDRGEKIELLVDKTENLRSQAQDFRQQGTNVRRKMWLQNMKIKLIVLGIIIALILIIILSVCHGFKCH

SEQ ID NO: 36339 - protein, 404 aa, Physcomitrella patens subsp. patens
MGSEAENFGVQESKEGAQTLIPSSVVPSKSHSIRIVHLALVIVQLGYAGLQMFSRVALNAGLNQFLLSLYRNMVALAILGPIAYYYERYTCPHFFSPFRMTSKVALLRHLVGSQQLFLAGLQLTSPLMAAVSQNMIPVFTFLLAATLGFEEVNMRRREGIAKVIGTVICIGGAITMSVYKGIAVFNGGSDMPEADLKLPFGDFDAFLPHYIVQFSVNKYQLGIAFLLMNCISWSVYLTAQGSILRLYPALLSMTAATYFFGILQLGVVAVASTGRLHFAEFSLTSWQQIVGVLYAGLIASTINLLLQTWCVQKGGPFIVSLYVPLQMLMVAVLSVLLLQDTLYMGIVLGGLLTVAGFYLVVWGQGLERRRKRSLLAQLLEPEHDIYKVGIRKLSLDLKERLIAN

SEQ ID NO: 36340 - protein, 485 aa, Thermobifida fusca YX
MADPKGFLKITERELPSHRPVPVRIQDWREVYEDFDRAALIRQASRCMDCGIPFCHNGCPLGNLIPEWNDLVYRHDWRDAIERLHATNNFPEFTGRLCPAPCESACVLGINQPAVTIKNVEVSIIDRAWEEGWVRPQPPAQHTGKKVAVVGSGPAGLAAAQQLTRAGHTVTVYERADRIGGLLRYGIPEFKLEKRHLERRLAQMRAEGTEFRTGVNVGVDLTADQLRADHDAVILAGGATVWRDLPIPGRHLAGVHQAMEYLPLANRVQEGDFATPPITAEGKHVVVIGGGDTGADCVGTAHRQGARSVTQLEIMPKPPTTRPPHQPWPTMPLLYKVTSAHEEGGERLYSVNTLEFLDDGTGAVRGLKVVDVTRTAEGFAPVPGTEREIPAQLVVLALGFLGPQREGLLEQLGVALDERGNVQRGPDYATSVPGVFCAGDMGRGQSLIVWAIAEGRSAAAAVDAYLCGETALPTAIPPTARPLTL

SEQ ID NO: 36341 - protein, 857 aa, Vigna angularis
MAPPNDPVNATLGLEPSEKVFDLSDGKLTVKGVVLLSHVPENVTFSSFSSICVPRDAPSSILQRVTAASHKGGFLGFSHVSPSDRLINSLGSFRGRNFLSIFRFKTWWSTQWVGNSGSDLQMETQWILIEVPETESYVVIIPIIEKSFRSALHPGSDDHVKICAESGSTQVRASSFGAIAYVHVAETPYNLMREAYSALRVHLDSFRLLEEKTVPRIVDKFGWCTWDAFYLTVNPVGVWHGLKDFSEGGVAPRFVVIDDGWQSVNFDDEDPNEDAKNLVLGGEQMTARLHRFEEGDKFRKYQKGLLLGPNAPSFNPETIKELISKGIEAEHLGKQAAAISAGGSDLAEIELMIVKVREEIDDLFGGKGKESNESGGCCCKAAECGGMKDFTTDLRTEFKGLDDVYVWHALCGGWGGVRPGTTHLDSKIIPCKLSPGLVGTMKDLAVDKIVEGSIGLVHPHQANDLYDSMHSYLAQTGVTGVKIDVIHSLEYVCEEYGGRVEIAKAYYDGLTNSIIKNFNGSGIIASMQQCNDFFFLGTKQIPFGRVGDDFWFQDPNGDPMGVFWLQGVHMIHCSYNSLWMGQIIQPDWDMFQSDHECAKFHAGSRAICGGPVYVSDSVGSHDFDLIKKLVFPDGTVPKCIYFPLPTRDCLFRNPLFDQKTVLKIWNFNKYGGVIGAFNCQGAGWDPKGKKFKGFPECYKAISCTVHVTEVEWDQKKEAEHMGKAEEYVVYLNQAEVLHLMTPVSEPLQLTIQPSTFELYNFVPVEKLGSSNIKFAPIGLTNMFNSGGTIQELEYIEKDVKVKVKGGGRFLAYSTQSPKKFQLNGSDAAFQWLPDGKLTLNLAWIEENDGVSDLAIFF

SEQ ID NO: 36342 - protein, 176 aa, Zea mays
  misc_feature (81)..(81): Xaa can be any naturally occurring amino acid
QGGGKVLNVGLGMGFVDEAIQRYGPEEHTIVEAPPEGYERMLKLGWGDKKNVRIVFGGWQDVMPQLGFYDGIFFDTYGEYXEDMREFPQPLPKLLKPGGIYWYFNGFWGDNGFFHPVYCHLVARELGNLGYSTQFIPFPVKNSLAEEVWKGVKRKYWQRDPYYLPACQSESEFTIK

SEQ ID NO: 36343 - protein, 188 aa, Zea mays
MAKARRPPFAAAERFLGFPRGGPSPGAVAPAPAALDDLPDLAEADVWYSAADPGSPYPAASRHAAAEGRSAGQRGPRRGVQGGLSRAFGDGSGSGSGRQAAASAPVEVAAWPARFSVPDAEPTLLFEMEMGDDDDDKGEGDAGWVPPHVYLARRQARASVVEGAGRTLKGRDMSRVRDAVWSRTGFDG

SEQ ID NO: 36344 - protein, 605 aa, Oryza sativa
MSGVASLGLRSSGSYGSLQQSNGQSPAPAPSPPLAARKAGKMSFGGAGAGGRGLLFARICKLTSRRRRMLLLLLVAAAVLFCFLFSSLVSKDEDAPPGIETMLGISDQVRSFVNPVWTSSGRPITQGDSLNGNGLNTASRPEKQSDSDSSHKKLQGLSWSFPPSIVLEHHPCENFSFFPPPIDRKRTGPRPCPVCYVPVEQALALMPGAPSASPVLRSLNYLSGDNLISKESNHGSLFGGYPSLEERDKSYDIKDSMTVHCGFARGKIPGVNTGFDIDRADLSEMWQCQGIVVASAIFGNYDIMQQPKNISVFSKDTVCFFMFLDEETEAAIKNTTTIDNSKRIGLWRVVVVRNLPYSDARRNGKVPKLLLHRLFPNVRYSIWIDGKLKLVRDPYQLLERFLWRKNVSFAISRHYRRFDVFEEAEANKVGGKYDNASIDYQIEFYKREGLTHYSSAKLPITSDVPEGCVIIREHIPITNLFTCLWFNEVDRFTSRDQLSFSTVRDKIRKRVNWTADMFLDCERRDFVVQAYHRELWEQILRSPPPPQPRLVRQQPRKMLPDNTAKEPGKASGSKRVSAKRTRDKKSGSKRAHRSKVTGGKEFIQL

SEQ ID NO: 36345 - protein, 239 aa, Oryza sativa Japonica Group
MSKLCQSACKAAKSLLSATAAASSPRTSLLAEGRNAALATLTNLGRKTLPTAYAYSYHHNSSAAAAGWLAAIPAAVYMLQDQEAHAAEMERTFIAIKPDGVQRGLISEILSRFERKGFKLVAIKLVVPSKEFAQKHYHDLKDRPFFNGLCDFLSSGPVLAMVWEGEGVIKYGRKLIGATDPQKSEPGTIRGDLAVVVGRNIIHGSDGPETAKAEIGLWFEPRELVSYTSNEEKWIYGVN

SEQ ID NO: 36346 - protein, 688 aa, Ehrlichia canis str. Jake
MDIDNNNVTTSSTQDKSGNLMEVIMRILNFGNNSDEKVSNEDTKVLVESLQPAVNDNVGNPSSEVGKEENAPEVKAEDLQPAVDGSVEHSSSEVGKKVSETSKEESTPEVKAEDLQPAVDGSIEHSSSEVGEKVSKTSKEESTPEVKAEDLQPAVDDSVEHSSSEVGEKVSETSKEENTPEVKAEDLQPAVDGSIEHSSSEVGEKVSKTSKEESTPEVKAEDLQPAVDDSVEHSSSEVGEKVSETSKEENTPEVKAEDLQPAVDGSVEHSSSEVGEKVSKTSKEESTPEVKAEDLQPAVDDSVEHSSSEVGEKVSETSKEENTPEVRAEDLQPAVDGSVEHSSSEVGEKVSETSKEESTPEVKAEDLQPAVDSSIEHSSSEVGKKVSETSKEESTPEVKAEDLQPAVDGSVEHSSSEVGEKVSETSKEENTPEVKAEDLQPAVDGSVEHSSSEVGEKVSETSKEENTPEVKAEDLQPAVDGSVEHSSSEVGEKVSETSKEESTPEVKAEDLQPAVDDSVEHSSSEVGEKVSETSKEESTPEVKAEDLQPAVDGSVEHSSSEVGEKVSETSKEESTPEVKAEVQPVADGNPVPLNPMPSIDNIDTNIIFHYHKDCKKGSAVGTDEMCCPVSELMAGEHVHMYGIYVYRVQSVKDLSGVFNIDHSTCDCNLDVYFVGYNSFTNKETVDLI

SEQ ID NO: 36347 - protein, 171 aa, Synechococcus sp. WH 8102
MLTLLLSLLLPLLVLVLPATALDTSAGVGLQDRALFQETVDYTLTNQSGGDFHGQHLANTSFAGAVGRGANFSGADLHGAIFTQGAFAEADFSGADLSDALMDRADFAGTNLRDAVLTGIIASGSSFSDAQIAGADFSDALLDLDDQRRLCRDADGVNPVTGVATLDSLGC

SEQ ID NO: 36348 - protein, 76 aa, Triticum aestivum
  misc_feature (46)..(46): Xaa can be any naturally occurring amino acid
  misc_feature (60)..(60): Xaa can be any naturally occurring amino acid
  misc_feature (69)..(69): Xaa can be any naturally occurring amino acid
MAPAVMASSATTVAPFQGLKSTAGLPVSRRSGSAGLSSVSNGGRIXRCMQVWPIEGIKKXFETLSYLPXPLSTEAS

SEQ ID NO: 36349 - protein, 514 aa, Ipomoea batatas
MGNRTSRHKHGEKHRSEAGSHQTHIEYTKSPGQGAGLPVRPPSIPKSVSKSDAILGKAYEDVRAHYSLGKELGRGQFGVTYLCTEIRTGKQYACKSISKKKLVTKGDKDDMRREVQIMQHLSGQPNIVEFKGAYEDANSVYLVMELCAGGELFDRIIAKGHYSERAAASLCRSIVNVVHTCHFMGVMHRDLKPENFLLSDKTENAALKATDFGLSVFIEEGRVYKDLVGSAYYVAPEVLGRKYGKEADVWSAGVMLYILLSGVPPFWAETERGIFNAILKGELDFQTKPWPSISSIAKDLVRGMLAPDPKRRLTAAQVLEHPWMREDGEASDRPLDSAVLSRMKQFRAMNKLKKLALKFIAENLSEEEIHGLKAMFTNIDTDNSGTITYEELKKGLAQLGANLTEAEVKQLMEAADVDGNGSIDYIEFITATMHKHRLEREENLYKAFQYFDKDSSGFITRDELETAMKEHGIADAATIKEIISEVDADHDGRINYEEFCTMMRSGTKQQAKLF

SEQ ID NO: 36350 - protein, 251 aa, Ashbya gossypii ATCC 10895
MSAPEQRRGGFGARNKGRQGRKGRREVEEKGWVPVTKLGRLVKAGKVTSVEEIFLHSLPVKEFQIVDTLLPGLKDEVMNIKPVQKQTRAGQRTRFKAVVVVGDSNGHVGLGIKTAKEVAGAIRAGIIIAKLSVIPIRRGYWGSNLGQPHSLATKTSGKSGSVTVRLIPAPRGSGIVASPAVKKLLQLAGVEDVYTSSTGSTRTLENTLKAAFVAIGNTYGFLTPDLWPENQLPASPLDVYADEAVAQKKRF

SEQ ID NO: 36351 - protein, 120 aa, Haloarcula marismortui ATCC 43049
MPVYVDFDVPADLEDDALEALEVARDTGAVKKGTNETTKSIERGSAELVFVAEDVQPEEIVMHIPELADEKGVPFIFVEQQDDLGHAAGLEVGSAAAAVTDAGEADADVEDIADKVEELR

SEQ ID NO: 36352 - protein, 380 aa, Ehrlichia canis str. Jake
MENLFNSFRSNKYITEKSIAELRCGIPILLYNNNDSLLIFPSELANNELLSALKKKFQDINILVTGNRLNFIFQSPGNRLSRIKIKTHHDLEYISSLLIDQEFHKKSSLTADDIIVSTNSLDKTAISIIKLTKLLPSAIVIDINSANILQWCSQNNITPVKQEIIDNYNEEYEIQEVCSSPLFLKDCPNAKIKVYRSYTGELDHYAIIIGNPDYSNPIVRIHSSCYTGDLLNSLSCDCRCQLHTAIKLMTENKGGIILYLAQDGRGIGLANKIRTYQLQTKHNFDTVDANRFFGFEDDERVFTPAIKILQKLGISRLQLLTNNPNKISEIQKNNIQVTKILPIFVDTNQHNINYINTKAKRLGHVSWKCFLCYFYILMLI

SEQ ID NO: 36353 - protein, 154 aa, Haloarcula marismortui ATCC 43049
MSEHERTFVMVKPDGVQRGLIGDIVSRFEDRGLKMVGGKFMQIDQELAEEHYGEHEDKPFFDGLVDFITSGPVFAMVWEGQDATRQVRTMMGETDPAESAPGTIRGDYGLDLGRNVIHGSDHEDEGANEREIELFFDEAELVDWDQIDSSWLYE

SEQ ID NO: 36354 - protein, 434 aa, Porphyromonas gingivalis W83
MKQIPLAERMRPKTLADYVGQQHLIGSGAVLRQMIEQGQTPSMILWGPPGVGKTTLAEIIAHEVDAPFYTLSAVSSGVKEVREVIADIESNRGNLFDKGGRAILFIDEIHRFSKSQQDSLLAAVERGIVTLIGATTENPSFEVIRPLLSRCQVYVLKPQSDEDLLLLAHRAIDRDELLAAKHPVLEETEALLLYAGGDARKLLNILDLLATSEVEDRLVITNEKIRQRLQENPAAFDKGGELHYDIASAFIKSIRGSDPDAAIYWLARLIDGGEEPSFIARRLIISASEDIGLANPNAMLIAMACAEALDRIGWPEGRIPLAEATIYLATSEKSNSAYLAIDSALEYVRQSGNLPVPLHLRNAPTRLMADLDYGKGYKYSHDFPEHFVSQQYLPDKAANTSFWTPQMHTVHEAKLGERMKRWWKREKSQKDTAE

SEQ ID NO: 36355 - protein, 331 aa, Cicer arietinum
MSNKIWPPPPSNNPYEYLKIHHNPNDTLTRNLVDPHTSPSSNTTLPINVLTKDLTINQSHQTWLRLFLPKNSTNPNQNNKLPLIIFFHGGGFILLSAASTIFHDFCVELADTVEAVVASVEYRLAPEHRLPAAYDDAMEALTFIKSSEDEWLQNYVDFSTCYLMGNSAGATIAYNAGPMCNLKKVNDFEPLKIQGLILSQPFFGGTQRSESELRLENDPVLPLSVGDLMWELALPIGVDRDHKYGNLTAENDLDEKFDKIKDQGWRVLVSGNGGDPLVDRYKELVELMEKKGVEIVKDFEEEGFHGIEFFEPSKAKKLIGLVKGFISSFVV

SEQ ID NO: 36356 - protein, 217 aa, Fulvimarina pelagi HTCC2506
MTDQNGRGSNPKLFGQPWVFVRGVPAMKFLPPEGPPEVAFAGRSNVGKSSLINALLGQKGLARTSNTPGRTQELNFFVPDGFGGETTELPPIAIVDMPGYGYAQAPKEKVDAWTELVFDYLRGRPTLKRVFVLIDARHGIKANDEEVLKLLDKAAMSYQIVLTKIDKIKPTGVPKLIAATEEAIRKRPAAYPGILATSSEKRSGLDELQAALGMLAE

SEQ ID NO: 36357 - protein, 254 aa, Symbiobacterium thermophilum IAM 14863
MQLFSLEGRVALVTGAGRGIGRALALGLADAGADVVCLARTGSEVEAAAEEVRARGRRALAVTADVTSQAQVTEAVEAALDRFGKIDILVNNAGINIRKPALEVAEADWDRVVQTNLKGPFLVAQTVGRHMCERGYGRIINVASVGGAVALRTGVAYGASKAGLMHMTRILAMEWARYGVTVNGIGPWYFRTPLTEKLLQDEQYVAEILARTPMRRIGDLAELVGPVVFLASDASSYVTGQVLMVDGGMSVYGF

SEQ ID NO: 36358 - protein, 254 aa, Symbiobacterium thermophilum IAM 14863
MGMLDGKVAIITGAAMGMGAATAELFAREGARVVIADLNEELGRAQARKIQDAGGAAAFVRADVSRAGDVEAMVQFAVDTFGRLDVAVNNAAHSPDTRPLADLDEAVWDAVIGVDLKGVALCLKYELRQMLKQGGGGSIINISSVSGIRPQPGTPAYVAAKHGVIGLTKQAAMDYSPHGIRVNAVAPGAVDTPMLQKALVEFNLEPVSYAKQLSLLGRFAQASEVAEVNLWLASDRSSYVTGAVYTVDGGYTAM

SEQ ID NO: 36359 - protein, 316 aa, Zea mays
  misc_feature (5)..(5): Xaa can be any naturally occurring amino acid
  misc_feature (22)..(22): Xaa can be any naturally occurring amino acid
  misc_feature (55)..(55): Xaa can be any naturally occurring amino acid
  misc_feature (107)..(107): Xaa can be any naturally occurring amino acid
MGSSXFSWTLPDHPKLPKGKPXAVVVLDGWGEANPDQYNCIHVAQTPVMDSLKNXGAPEKWRLVKAHGTAVGLPSDDDMGNSEVGHNALGAGRIFAQGAKLVDQALXASGKIYDGDGFNYIKESFESGTLHLIGLLRDGGVHSRLDQLQLLLKGVSERGAKKIRVHILTDGRDVLDGSSIGFVETLENDLLELRAKGVDAQIASGGGRMYVTMDRYENDWDVVKRGWDAQVLGEAPYKFKSALEAVKTLRAQPNANDQYLPPFVIVDDSGKAVGPVLDGDAVVTINFRADRMVMLAKALEYADFNNFDRVPRPRPR

SEQ ID NO: 36360 - protein, 476 aa, Thermobifida fusca YX
MLHVTRRAKIVATLGPATSSPEVLRKLVDAGLDVARLNLSHGTHDDHQTMYRNVRAAAEASGRNVGILADLQGPKIRLGTFVDGSVTLSPGDEFTITIDDVPGDRHRVSTTYKGLPGDVRPGDRVLIDDGRVVLECVKSTSTDVHTRVIVGGPVSNHKGLNLPGVSVAVPALTEKDERDLRWALEQGVDMVALSFVRSPADAEDVHRVMDEMGVHVPLIAKIEKPQAVERLQDIIEAFDGVMVARGDLGVELPLENVPMVQKRAIERCRDKAKPVIVATQMLESMIHNPRPTRAEASDVANAVLDGADAVMLSGETSVGKYPVETVQTMARIIAAAEQESLRASHILHRVPETVGGSIARAAAEVGATVGAKALVAFTSSGETARRLARYRSPIPLLAFTTEPATRAQLSLTWGVETHLVPWVDNTDDMVRQVENELLDMDYQKGDKVVIVAGSPPGTRGSTNMLRVHRMGDAISN

SEQ ID NO: 36361 - protein, 361 aa, Leuconostoc mesenteroides subsp. mesenteroides ATCC 8293
MKKRYLLLENGSVYEGEAFGADVDIMAELVFNTGMSGYQESITDLSYRGEIIVFTYPLIGNYGVNRDDFESLRPAASAIVVHEIARRPSNWRKTMSLPEWAEKTGMPGITGIDTRALTKELRNQGSMKAALVDEITDEVVARLKAFETSKTMVADATTKTQYQNPTDGVSIALIDFGLKNSILRSLAKRGVNVMVFPANVDAETVLAANPDGILLSNGPGDPKDVKYAIPTIQKLQKHLPLMGICLGHQLFAIANGAETYKMKFGHRGFNHAVRTISKARLDFTSQNHGYAVERASLEKTDLVVTHEEINDQTVEGVRLKGYNAFSVQFHPDAAPGPHDAEYLFDEFLDMIADSKKETTNA

SEQ ID NO: 36362 - protein, 491 aa, Physcomitrella patens subsp. patens
MTIARYKPAWAEHFQFVSAVKVDIDVSCLHVLPHEGDDGMSRYVAVGDSAGRIFIFFIQGDLLVDYATLSQAPVTAMLSFTLRKNETWLVTGHADGAVLVHRIWEIMQRGSPSSEEVHQLVLEYVHSFVLGGVESKSKLITHLEMYRVGKMRYVLVADSNGKMEMFRENGTLFGVADSLSRPLAFLQTPNTQRLLFLTKTGGGSLDLRTMTVRTCPCDGLNGSTVVAYAFDAAGRSRAYGFKEKGDLVYVILSGDTLHFECHARTTKRKLDVEGPVSLHGITGYLVVATPKSVFVYNTTLQLGFSYANIRGGAGHRPLFSASLDDISLSFLPTPIAAGKLPMMACNRDKLIVVGFGGGYVGIYRSTLPVHKLPDFNAKFWSSPIFVSVILLLLAWQLLSRKRDPAPTDSSKLVMQIAPNSTASGFGYRENLDGAGSLKSRNRYESPSRSYSTKPVAYGQSSMNYRSTAADPSYSTRREPLFANQTVGDLRH

SEQ ID NO: 36363 - protein, 506 aa, Hordeum vulgare subsp. vulgare
MAFFLLLCILVSVAIVSYAHHAIRRRRQGCAHGRHEQAALKLPPGSMGLPYVGETLQLYSQDPSVFLSSKQKRYGEIFKTHLLGCPCVMLASPEAARFVLVSRAHLFKPTYPRSKERLIGPSALFFHQGDYHLRLRRLVQGPLGPEALRKLVPDIEAAVRSTLAAWADGDVASTFHAMKRLSFDVGIVTIFGGRLDERRKEELRRNYAVVEKGYNSFPNSFPGTLYYKAIQARRRLNGVLSDVVHERRERGEHGDDLLGCLMRSRAGGDDADDEGALLTDEQVADNVIGVLFAAQDTTASVLTWIVKYLHDRPKLLEAVRAEHAAIHEANDGGRRPLTWAQTRSMTLTHRVILESLRMASIISFTFREAVADVEYKGFLIPKGWKVMPLFRNIHHSPDYFQDPHKFDPSRFKVAPRPNTFTPFGSGVHACPGNELAKLEMLVLIHHLVTGYRWEVVGSSDDVEYSPFPVPRHGLLARVRRDDGVCAGRKGCPTDEDDNYDDDEVIV

SEQ ID NO: 36364 - protein, 312 aa, Symbiobacterium thermophilum IAM 14863
MTVAMRDAYGEALAQLGGLRPDVVVLDADLGNSVRCDGFGRLYSDRYIQVGIAEQNMVGVAAGLAACGLVPVVNSFAAFAVCRALDQIRVSVCQTGLPVKVVGSYSGLAVSKGGSTHASVEDIAVMRALPGMTVIVPGDAEEAAQVTRMLPDIPGPVYLRLYRNAVPPVVPAGYRFRPGKAVLLRPGTDVAIVSTGTMTARALEAAGRLAGRGVGAAVLHVPTVKPLDEEAVVDVAARCRAVVTAEEHSVIGGLGAAVAECLGERHPMPVHRVGVPDRFGESGPDDELLAHLGVDEAAIERRVLAALGEGGG

SEQ ID NO: 36365 - protein, 249 aa, Enterococcus faecalis V583
MKHKKMLAVASVAAFTLLLAGCNTTNNKGTTATSDSVAKSSESKTKDSVDLNSLDLPQLDDKVAEDQDLVQMVTSMGNIEIKLFPKQAPKTVENFMKHAKDGYYDGLTFHRVINNFMIQGGDPSGDGTGGNSIWNKPFEDEFSNQLYNIRGALSMANAGPNTNGSQFFIVQNTDDQSDGLLYDDYPKAIIDAYKKGGYPSLDKKHTVFGQVTKGMDIVDKIAKVEVGANDKPKTDVKIEKINILQEAKK

SEQ ID NO: 36366 - protein, 231 aa, Azoarcus sp. EbN1
MPRIAPSLLSADFARLGEEVRNVVAAGADWIHFDVMDNHYVPNLTIGPLVCEAIRPHTSAPIDVHLMVKPVDRIVPDFAKAGANIITFHPEASEHVDRTLQLIRDCGCQAGLVFNPATPLHHLDHVLDSIDIVLLMSVNPGFGGQKFIPGTLPKLRAAREKLDAYEAASGRRILLQIDGGVKVDNIAQIAAAGADTFVAGSAVFGAGRDADPHRYDSVIAALRAELAKVGA

SEQ ID NO: 36367 - protein, 972 aa, Pseudomonas fluorescens Pf-5
MLLATLIHRASLPSPQVLAQQALELLESHYGLHGTLHSLGSQQDLNYRVDSPQGRFVLKICRGDYSVLELQAQHAGLKHLQQHPELRVPRVIPATNGADLLSLEIAGQALHVRLLDYIEGRSLTQLPHLGGELVAGLGRLCGQMDLALADFEHPGLERTLQWDARHAQALIGHLLPVIADPQQRAVIASAAQRAERRLHPLLEQLPVQAIHMDITDDNVVWQRDEARHWQVQGVIDFGDLIRTWRITDLSVTCAALLHHAEGDPLRILPAIQAYHQVNPLQRAELLALWPLIVARAAVLVLSGEQQVSIDPGNAYSRANLSHEWEIFQVANSVSFEFMEAAILTAVGHALPAIGAEGFAPLLPSLVGREFALIDLGVLSPHFEAGNWEQPGIDDRLLAEACAAHGLAASRYGQYRLSQTRPDSAEEPSTCPLHVQLQVPPGTAVEAPFAGVLHRAEQGLLRLDGPTLSMHLWGVEPSLQPGAALVKGQVLGAVAADGRLKVQLCRAAELDPPLFCTPSRAPAWQALCPSPAALLGLACDAEPELDPQTLLERRDASFARSQKHYYVDPPRIERGWRNHLIDMQGRSYLDMLNNVAVLGHGHPRMAAEAARQWSLLNTNSRFHYAAIAEFSERLLALAPDSMDRVFLVNSGTEANDLAIRLAWAYSGGRDMLSVLEAYHGWSVAADAVSTSIADNPQALTSRPEWVHPVTAPNTYRGEFRGQDSTPHYLRSVDQQLHKLDEQQRQLAGFICEPVYGNAGGISLPPGYLQQVYERVRARGGVCIADEIQVGYGRMGQFFWGFEEQGVTPDIITMAKGMGNGQPLGAVITRREIAEALEAEGYFFSSSGGSPVSCRIGIAVLDVMQEEKLWENAQVVGEHFRQRLEALKENHPLVGAVHGSGFYLGLELIRDHATLEPATEETTLLCERLRELGIFMQPTGDHLNILKIKPPMVTTRQSVDFFVDMLAKVLSEEL

SEQ ID NO: 36368 - protein, 368 aa, Pseudomonas fluorescens Pf-5
MSTLHSTPRADGFYMPAEWATQTQAWMIWPERPDNWRLGGKPAQAAHAAVAKAIARFEPVTVAVSAAQYENARARLDVPNIRVVEMSSDDAWVRDTGPTFVINASGEVRGVHWGFNAWGGFEGGLYSPWNRDEQVASKVLEIERCQEYRTEGFVLEGGSIHVDGEGTLITTEECLLNHNRNPHLSREEIEAVLREHLAVEQIVWLPDGLYNDETDGHVDNFCCYVRPGEVLLAWTDDPQDPNYPRCQAALQVLENTRDAKGRTFKVHKMPIPGPLYATEEECAGVDAVEGSQERNPSVRLAGSYVNFLIVNGGIIAPSFDDPMDAQAKAILQQLFPEHEVVMVPGRELLLGGGNIHCLTQQQPAPQRI

SEQ ID NO: 36369 - protein, 578 aa, Thermoplasma volcanium GSS1
MIHENKIYDHVVNYSMGDLNSASTDANISYSENQDRKLRKALSTWDLLMLSVGGIIGSGWLFAAYAASVLSGPASILAWVLGGIIVIFIALVYAELGAMIPRSGAIVRYGHLSHGSFAGFLFGWAYFLSAVSVPAIEAEAVVTYAASYVTKPALIANGIMTVFGTLIAMLLMIAFFFLNYAGIHLMGKTNQGITWIKVIIPVITVIVLIAVHFNPSEIVPPNGFLPYGWAPVFAAISSTGIVFSYFGFRQAIDYGGEAKNPQRSIPIATIGSVLIGILLYSLLQVVFVGGIDWSKMGLEPGQWTLLNAYATAAHASTEHPLAYQLMNAPFATIALSAGLVWLTYTLYASAYIAPSGTLNVYLGTSTRTLYGMAVNGHLPKIFAKVADRNKIPVIPLITTLLVGFLFFLPFPSWYKMVGFISGATVFTYIVGGAALMNLRKQAPELKRPFKLWSANVLAPIAFILASEAVYWTGWPTTLYLAIAIFLGLVLYGALVGLHKIEQTFDKKNVKAGLWVPVFIVILTILSYLGEYGGINVLHFPLDLIVVAIASAIIYVWAIKSGIKTEEIAAMIANEDQYV

SEQ ID NO: 36370 - protein, 286 aa, Microcystis aeruginosa PCC 7806
MWTQIARHITQTTEKPFEIEKSHPVSGGCINQGYAVSGNGLIYFVKINQANQEAMFAAEALGLKQIHATKTIRVPEPICWGIAEKSSYLVLEWLEFGGGNSQSWEKMGRNLAHLHQVSLSDRFGWQCNNTIGSTPQINTISNNWADFFAHQRIGYQLRLAKERGGNFPDEDQVIPAISEILSQHQPHPSLVHGDLWSGNAAITVDGEPVILDPATYWGDREVDLAMTELFGGFPAAFYRGYNDVFPLDAGYQKRKTLYNLYHILNHFNLFGGGYASQANRMLQEIL

SEQ ID NO: 36371 - protein, 192 aa, Nostoc sp. PCC 7120
MSTDSPIKPETTAGERLRNFLVAIVAIALTVALVLGLRTETAAVSLDKLYAASTPLEVAISNGKPSMVEFYANWCTVCQKMAPDIAEFEQQYADKMNFVMLNVDNTKWLPEMLKYRVDGIPHFVFLNKTGESLAQAIGDQPHTIMASNLEALVTGSALPHAQTSGQVSQVSTPVAPIGSQDDPRSHGSQVVN

SEQ ID NO: 36372 - protein, 429 aa, Microcystis aeruginosa PCC 7806
MTAILGKPATLNTPILHRLANGLTIIAESQPVEAVNLNVWLQVGSALESDQINGMAHFLEHMVFKGTPNLDSGEFERAIESRGAVTNAATSQEYTHYYITTAPQDFARLAPLQLEVVLEALIPDEAFERERQVILEEIRRSQDNPRRRTFYRTMETCFQVLPYRRPVLGPMAVIENLTAQQMRDFHRTWYRPEWMTVAVVGNLPVDDLIAIVRDSLDNLGSKGNSGMISHPIANLQPEAPFNEIIRQEYEDENLQQARLILFWKVPGLRDLEKTYPLDVLAAILGQGKVSRLFQSLRQEKGLVSQITASNMSQAVQGVFSVSAQLASANIEQVEREVIAQIGQIQQEAVTVSELERVKTQVANRFIFSNERPSDRANLYGYYHTQIGDLQPAFCYPQHIEALTLEDIQNACQEYLNPHAYGVVVVRPIQ

SEQ ID NO: 36373 - protein, 134 aa, Haloarcula marismortui ATCC 43049
MSESEEELPDNDEEWREILSDEEYRILRESGTEPRFSSDLIDVEDEGVFTCAGCGTELFDSDRKFESETGWPSFWDVYQEGNVETRADNSHGMERTEVVCAECGGHLGHVFDDGPEPSGKRYCINGAALDFESE

SEQ ID NO: 36374 - protein, 394 aa, Ehrlichia canis str. Jake
MLRSHDFTFCNMKKIQDFSCSGKTVLLRADLNVPMDNGVVLDDTRIVRLTTTIKYLLSNDAKIVIMSHYGRPKSYDKEFSLKFLIEYLNKIFTTNVIFIDGVIGDYVEQTIQSASLGSILLLENLRFYAEEETNDLAFAKQLALLADIYVNDAFSCLHRKHASIDAITRLIPSFIGFNFQEEMKYLNCVVSNSEKPVAVIVGGSKISTKIHMLKNLTKKVDFLIVGGAIANNFLLSQGLKIGRSLYEELEKDLVKEIMDLAKRHECKIIVPVDYVVAKNSIYGKSSIKDNDTIESDDVILDIGPQTINIVTATVNKCRTILWNGPCGMFEKEQFSKGTFSVANLLAKLTKAGKLKSIVGGGDSICAIKLSGLSNDDFTYISTGGGALLHFLSIA

SEQ ID NO: 36375 - protein, 475 aa, Fulvimarina pelagi HTCC2506
MASDTDKPDICVIGAGSGGLTVAAASAAFGVSVMLIERDKMGGDCLNYGCVPSKALIAAGKTAQTFRKAERFGVTSTEPQIDFAAVNRHVRDVIGAIAPNDSVERFEGLGVDVVKGDARFLDGETLEVNGRRIKARRFVVATGSRPFVPPITGLKETPHLTNETLFDLTDCPKHLIVIGGGPIGMEMAQAHRRLGADVTVIEGAKPLGKDDPELAEVVLKRLAEEGIRIEVEAKVVDVGGSPGAINVTAERGGERFTVSGSHLLVAVGRQPNVEGLGLEAAGIDFARSGITVGKDLRTTNKRVYAVGDVAGGPQFTHVAGYHGGLVLRPLLFRLPIKTKHEQIPHVTYTDPELGQVGPTEVEARDAGQDVTTVSWPYAENDRAQTERETEGLIKIVVGKRGKIVGAGVAGAKAGEMTNLLALAVAQGMKLSDLQGFVSPYPTLSEIAKRAATSYYSSYTTKPIVRSAIAFLRRFG

SEQ ID NO: 36376 - protein, 93 aa, Physcomitrella patens subsp. patens
RKRGLFNKDLRLMMYGFGDDPDPMPETVLLMEDILIDYITDTVHKSQNVASRRGKLTTEDVMFLVRKDSRKFSRVKELLAMNEELKRARKAFE

SEQ ID NO: 36377 - protein, 745 aa, Triticum aestivum
MDRTSNFMPTPDQDVLDIQPLRTLAPMFPAPLGVNTFNVPNTTPPLIFVTSAGQFPGGVGAPGHPAFRSFAAAFGAQDAYGGQPASSGGQHDGGGHPASSRRQDGGGGQATTFADKYAANGGQTAANGATNLGASADSPIDVIPISAYRPTPPPVIPLDDDDDDNEHFTGNQTSASGRKIKRPSHLSGYKMSGGLGSDDNNGVKTKRNKTSHRKAGADNEFTSVPLSSSNPREAVEEVLMNFEALRRRHLQLDAAQESTKRPDLKIGAVMMANNLRANIRKRIGVVPGVEIGDIFYFRMELCIIGLHAPTMAGIDYMTHTFGDKDDDSVAVCIVAAGVYENEDDATDTLVYSGSGGSSKNNEEMHDQKLERGNLALQMSLSRKNVIRVVRGFKDPGSLGGKVYMYDGLYKIHESWKERTKTGINCFKYKLLREPGQPEGMSIWKMSRKWVENPATRGRVLHPDLSSGTENLPVCLVNDVDSEKGPGLFTYITQVKYPKPLSSMKPLQGCSCLNACLPSDTDCDCAEFNGGNLPYSSTGLLVCRKNRLYECGESCQCSVNCRNRVTQKGIRVHFEIFRTGNRGWGLRSWDPIRAGSFICEYVGEVIDESKRNLDGEDEDDYLFQTVRPGEKTLKWDYVPELMGEQITNNSADTFEPLPIKISAKKMGNISRFMNHSCSPNAFWQPVQFDHGDDGHPHIMFFALKHIPPMTELTYDYGEIGADSGGIGSPGAKRCLCGSSNCRGYFC

SEQ ID NO: 36378 - protein, 195 aa, Oryza sativa Japonica Group
MMYMRATHRDEEGKKVTEKVAVPETRHPDTARHFERKLDQQGLHRMERHPANGSRGIGAPPPKSGRGGKFTWEGPDSIVDSQLDPLPAAIGPQRPQLRGGGRRPRARGRRRRRGGGRQGRRRRQGWCRQGRRRRAAAAARETAAAAAVGAPSRHLSGVFEVLDDDHGAVVYPVRRAYQINKNAHAAGGLILSIFF

SEQ ID NO: 36379 - protein, 250 aa, Schizosaccharomyces pombe
MARKFFVGGNFKMNGSLESMKTIIEGLNTTKLNVGDVETVIFPQNMYLITTRQQVKKDIGVGAQNVFDKKNGAYTGENSAQSLIDAAITYTLTGHSERRTIFKESDEFVADKTKFALEQGLTVVACIGETLADREANETITVVVRQLNAIADKVQNWSKIVIAYEPVWAIGTGKTGTPEEAQEVHAEIRKWATNKLGASVAEGLRVIYGGSVTGGNCKEFLKFHDIDGFLVGGASLKPEFPTNIVNVHSL

SEQ ID NO: 36380 - protein, 521 aa, Zea mays
MATAMMTMRRAAALGARHIPPAAAFSRHMSADASAAMEKIRAAGLLKTQGLIAGQWVDAYDGKTIEVQNPATGEVLANVSFMGSRETSDAIASAHSTFYSWSKLTASERGKALRKWYDLIISHKEELALLMTLEQGKPMKEALGEVNYGASFIEYFAEEAKRIYGDIIPPTLSDRRLLVLKQPVGVVGAITPWNFPLAMITRKVGPALACGCTVVVKPSELTPLTSLAAADLALQAGIPAGALNVVMGNAPEIGDALLQSTQVRKITFTGSTAVGKKLMAESANTVKKVSLELGGNAPCIVFDDADIDVAVKGSLAAKFRNSGQTCVCANRILVQEGIYEKFASAFIKAVQSLKVGNGLEESTSQGPLINEAAVQKVEKFINDATSKGANVMLGGRRHSLGMSFYEPTVVGNVSNDMLLFREEVFGPVAPLIPFKTEEEAVHMANDTNAGLAAYIFTKSIPRSWRVSESLEYGLVGVNEGIISTEVAPFGGVKQSGLGREGSKYGVDEYLELKYICMGNLG

SEQ ID NO: 36381 - protein, 362 aa, Synechocystis sp. PCC 6803
MSQTYNVTLLPGDGIGPEIMAVAVAVLGKVADQFGFAFNFQEALIGGAAIDATGQPLPEATLAQAKDSDAVLLAAIGGYAWDNLPRSQRPETGLLAIREGLGLFANLRPATIFPQLIDASSLKREVVEGVDIMVVRELTGGIYFGKPKGIFETETGEKRGVNTMAYTVGEIDRIAKVAFETARKRRGQLCSVDKANVLDVSQLWRDRVMAIAVDYPDVELSHLYVDNAAMQLVRSPRQFDTIVTGNLFGDILSDIAAMLTGSIGMLPSASLGSDGPGLFEPVHGSAPDIAGQDKANPLAQVLSAAMMLRYGLDQPQAADRLEDAVKKVLEQGYRTGDILSPGTQLVGCRQMGEQLLSILDEM

SEQ ID NO: 36382 - protein, 343 aa, Zea mays
MANSAAPGGVRSFLQAVSTVTEETRTPLRVVQMEGLAVLKIIKHCEEFAPALVTGQLLGLDVGSVLEVTNCFPFPMREEDDEADADGANYQLEMMRCLREVNVDNNTIGWYQSCLLGSFQTVELIETFMNYQESIRRCVCIVYDPSRSSQGVLALKALKLTDSFMDLYRNNGLTGEKLREKKLSWVDIFEEIPIKVSNSALVSAFMKELEPESPVTQCDLDRLKLSTAPFMERNLEFLIGCMDDLSSEQNKFQYYNRNLSRQQSQQQAWLQKRRQENMARKAAGEEPLPEEDPSNPIFKPIPEPSRLEGYLVTNQISSYCNHINGVAGQNFDRLYLMKALHED

SEQ ID NO: 36383 - protein, 310 aa, Ashbya gossypii ATCC 10895
MVRVMQKEDCHFRRLSDGTQIPSVGLGVYQVSEQTVQDLVYEALEVGYRLFDSAQAYHNEDGVARGIAAWLKHAPGRRREDVYFTTKINTQNHGYEATKKSLEKSLHAAGPLGYIDLVLVHAPMSDRTRRLGTWQALEEAVVEGQVRSIGVSNYGQQHLSELLGWEGLKIRPVVNQVEINPWLCRQELVQYCRENNIAVQAFSPLMRGKRLDDPILQKVAHQYDKGVAQILVRWSIQMGFIVLPKAAKKERLAPNFDIWDFELSAETMSELTHSDDYFVTVPGGIPRLMKAEVISTITDLQHETLVDMEA

SEQ ID NO: 36384 - protein, 410 aa, Magnaporthe grisea 70-15
MSAEAGSSSDQSVTQKTPKTVRAVFHDAVGKVSVRHVPFPELKEPEDAIVRITTSAICGSDLHNYRGFYGPENYPYRAGHEAMGVVHKIGPAVDSLKVGDRVVIAFPDDHPIRTENTTVPDIDFFFDPEFGLQTEYARVPFADSSLIPIPNRLPDKEWLFLGDIFTTGWMVLNGAGFEAGDSVAVFGAGPVGLMAAYSACIRGASRIYVVDHVQQRLDKAREIGPGVVPIDFTKPGQSASEQILALDGGGVNRAVDCVGQECLNRELVVQQDYVLRECVAVTAAGGGVGVAGVHIVLPPAPGRPNVGQVQPEILFGFPEFWLRGLKLGAVLADPAKMAPTLSRLVDAGRARPGFIVDEGPFDLDEAPELYRRFNEQKIIKVLFKGAPRPEEWEEWEKDEVLEDFKKVNGH

SEQ ID NO: 36385 - protein, 512 aa, Ashbya gossypii ATCC 10895
MMCGEVTRTDAFEKDVIITVFGASGDLAKKKTFPALYGLYREGYLDDSTKIIGYARSELSDAELRERVKPYLSKPDDAASEAKQAEFLERMSYVAGPYDKEEGYVQLREQIEAYERERGVEKPHRLFYLALPPSAFVSVAEKIKQFLYAEGGVTRLIVEKPFGHDLESSRKLQKQLEPLFREEEIFRIDHYLGKEMVKNLLPLRFGNAFFNASWNKENIQMIQISLKEPFGTEGRGGYFDSTGIIRDVMQNHLLQVLTLLTMERPVSFDPESIRDEKVKVLKAIVPLDHEDILIGQYGRSEDGTKPAYLDDETVSKDSKCVTFAALTFNIQNERWDGVPIVMRAGKALNEGKVEIRILYKRVARGIFNDIPNNELVVRVQPDEAIYLKFNAKTPGLDSNSQITELDLTYSKRYRDYWIPEAYESLLRDALLGDHSNFVRDDELDISWKLFTPLLNYLEGPDSPRPEIYKYGSRGPDGLTKYLEKHQYVFEKSGLYQWPVSSPKEKASLEPRL

SEQ ID NO: 36386 - protein, 344 aa, Synechococcus elongatus PCC 7942
MAQSTTSETHTRDLDRDCTTLSRHVLEQLQSFSPEAQDLAALMQRIGLAAKLIARRLSHAGLVDDALGFTGEINVQGEAVKRMDVYANQVFISVFRQSGLVCRLASEEMEKPYYIPENCPIGRYTLLYDPLDGSANVDVDLNVGSIFAVRRQEFYDESHEAKDLLQPGDRQIAAGYVLYGASTLLVYSMGQGVHVFVLDPSLGEFVLAQSDIQLPNSGQIYSVNEGNFWQWPEGYRQYIREMHRREAYSGRYSGALVADFHRILMQGGVFLYPETVKNPTGKLRLLYEAAPMAFLAEQAGGKASDGQKPILLRQPQALHERCPLIIGSAADVDFVEACLAESVP

SEQ ID NO: 36387 - protein, 482 aa, Streptococcus equinus
MENEILVTISFPIMIQMDVKTKYKAKKTKIVFFDIDDTLRVKVTGYMPESIKYVFKSLKEKGIMTGIATGRALYGVVPEIRDLNPDYFVTINGTYVVDKKEAEIVSDPLPRDLVEKYVNWAKAEGIEYGFTGKDKPVVSKRCDLIDDAMKPIYGICDVEPDFYLTNDVYQMWTFAENNADLQLPEDLASEIRLVPWHEHSSDVVKVGVSKASGVAHVLESQNLKPLNAMMFGDGPNDMEIFDYVGLKIAMGNAVPELKEKADFVTKTVEEDGILYALEELGLVEKQLNFPQVDLSTVEGPVATIKTNHGDMKIKLFPDHAPKTVANFIALSKDGYYDGIIFHRIIPEFMIQGGDPTGTGMGGQSIYGDSFEDEFSEELYNVRGALSMANAGPNTNGSQFFIVQNSKIPYAQKELERGGWPKPIAELYAAKGGTPHLDRRHTVFGQIMDEESYKVLDEIANVETGAQDRPVEDVVIETIEVVD

SEQ ID NO: 36388 - protein, 230 aa, Oryza sativa Japonica Group
MAGRNNHELKLLGTWPSPFVVRVRLALGLKGLSYEYVEQDIRDKSELLVVSNPVHKKVPVLIHGGKPVCESQIIVQYIDEAFPGAGASLLPSDPHERAVARFWATYIDDEFATKFRAMGEAKEEEEKDEAAAQVFAALETLEEAMKGKVFFGGDSAGYVDVALGGFLGWIKAAEALAGVAFLDGARTPLLAAWAARFSALEAAKEAIPSVERLREFHGAMHAAAATVAGN

SEQ ID NO: 36389 - protein, 524 aa, Synechococcus elongatus PCC 7942
MTPKLLENPLRIGLRQDKVPEPQILVIFGATGDLTQRKLVPAIYEMHLERRLPPELTIVGVARRDWSDDYFREHLRQGVEQFGGGIQAEEVWNTFAQGLFFAPGNIDDPQFYQTLRDRLANLDELRGTRGNRTFYLSVAPRFFGEAAKQLGAAGMLADPAKTRLVVEKPFGRDLSSAQVLNAILQNVCRESQIYRIDHYLGKETVQNLLVFRFANAIFEPLWNRQYIDHVQITVAETVGLEGRAGYYETAGALRDMVQNHLMQLFSLTAMEPPNSLGADGIRNEKVKVVQATRLADIDDLSLSAVRGQYKAGWMNGRSVPAYRDEEGADPQSFTPTYVAMKLLVDNWRWQGVPFYLRTGKRMPKKVTEIAIQFKTVPHLMFQSATQKVNSPNVLVLRIQPNEGVSLRFEVKTPGSSQRTRSVDMDFRYDTAFGSPTQEAYSRLLVDCMLGDQTLFTRADEVEASWRVVTPLLESWDDPRQAAGISFYEAGTWEPAEAEQLINRDGAVGVVSRIPATQLNSSGDV

SEQ ID NO: 36390 - protein, 303 aa, Ehrlichia canis str. Jake
MNKQNIHSFIDLNLHTKEELNTILNYGAIIKKNPNQYSKHLSNKNIALIFLQPSTRTRISFEVGVNQLGGNAITLNGKDTQLIRGECIHDTAKVLSRYVDLIVIRILEHDSLLELNKYSTVPVINSLTQHSHPCQVLADIMTYEEKMGPIENATVSWIGDFNNMLVSWIHAATVLNFKLNISTLEYSENLDLLLKLVNEKGANVVYNKNPYDIIPDADIITTDSWVSMGFENKIKTEFFNYQVNAKLLEKAKPNYMFLHCLPAHRGEEVTSEIIDGLNSYIFDEAENRLHIQKAIMLWCLNLL

SEQ ID NO: 36391 - protein, 110 aa, Triticum aestivum
  misc_feature (58)..(58): Xaa can be any naturally occurring amino acid
  misc_feature (66)..(66): Xaa can be any naturally occurring amino acid
  misc_feature (68)..(68): Xaa can be any naturally occurring amino acid
  misc_feature (70)..(70): Xaa can be any naturally occurring amino acid
  misc_feature (73)..(73): Xaa can be any naturally occurring amino acid
  misc_feature (79)..(79): Xaa can be any naturally occurring amino acid
  misc_feature (83)..(83): Xaa can be any naturally occurring amino acid
  misc_feature (90)..(90): Xaa can be any naturally occurring amino acid
MKLNIANPTTGCQKKVEIDDDMKLRNLYDKRISQEVVGDLLGEEFEGYIFKIMGGCEXARAFPMKXGXLXPGXVRLLFXRGTXFFRGHGXRVGERRRKSVPGCQPKTLFT

SEQ ID NO: 36392 - protein, 70 aa, Glycine max
  misc_feature (64)..(65): Xaa can be any naturally occurring amino acid
DIAEIFRAKPVDVSDHTVTLQLTGDLDKMVALQRLLEPYGICELARTGRVALVRESKVDSKYLXXYSLPL

SEQ ID NO: 36393 - protein, 419 aa, Wolinella succinogenes DSM 1740
MKTLAIIGLGYVGLPLAVEFGKQYKVWGFDINKARIEELKSGYDRTLEVEKEELLESKNLHYSCNLEEIKEAQIFIVTVPTPIDQYNKPDLTPLIKASESVGKVLKKGDIVIYESTVYPGCTEEDCVPVLERFSGLKFNVDFFCGYSPERINPGDKEHRVTTIKKVTSGSTPEIANEVDALYRSIIKAGTHKASCIKVAEAAKVIENSQRDINIAFVNELSIIFDKMGIDTLDVLEAAGTKWNFLPFRPGLVGGHCISVDPYYLTHKAESLGYHSQVILAGRHINDNMGIVVANKVVKLMIKKGQKIEGTRVLMMGITFKENCPDIRNSRVIDIIKELKEFGCEIDIYDPWADKAEVMHEYGVELKSLAELHKGNYGAIVMAVGHKEFREMEIKPFGAKDSVIYDIKGILDREMVDARL

SEQ ID NO: 36394 - protein, 322 aa, Propionibacterium acnes KPA171202
MSGTTRPNNKHLMICSGRAYPELAEQIAAELGVELVPSRQVTYANSEIYVQFQESVRGCDAFVIQSHSAPVNEAMMEQLIMIDALKRASAKRITVVSPFYPYARQDKKHLGREPISARLMADLYQAAGADRIMSVDLHAAQIQGFFDGPVDHLWALPVLADYVTSKYDNSDMVVVSPDAGRVRLADMWTDKIGCQLAIIHKRRDPNKANETTTHEVVGEVEGKTCLLVDDMVDTAGTMCQAALALKKHGAKRVIAAATHPILSDPAAERINNSPIEELIVTNTLKIRDDIDIPAMTLLSIAPLIAKAIQEVFEDGSVTSLFR

SEQ ID NO: 36395 - protein, 320 aa, Trichodesmium erythraeum IMS101
MRIAHNITELVGRTPLVQLNSIPKAEGCLAKIIVKLEGMNPAASVKDRIGVNMINVAEREGLIKPGKTTLVEPTSGNTGIALAMVAAARGYKLILTMPETMSMERRVMLRAYGAELVLTPGSEGMKGAITKAQEIVDLSSNGYYMLQQFQNPANPEIHSKTTALEIWEDTDGKVDILVAGVGTGGTVTGVAETIKARKPEFQAIAVEPSNSPVLSGGKPGPHKIQGIGAGFVPDVLDTKIIDEVIQVPDSEAMVYGRRIAKEEGILSGISTGAALCAAIEVGKRPENDGKLIVMIQPSFGERYLSTPLFQELGPTLAEVR

SEQ ID NO: 36396 - protein, 559 aa, Magnaporthe grisea 70-15
MNRIALWTVASFLLVPFTAHACLQTWHILAGTSSPTGKWRSRATYILSGLLLKVQYDLFVKLTLELRARRLGCLPAKLYPHKDPVLGLDYFFKALRAAGAGQFFPFARENLKTIGHTHYAMALGTWVLHTDEPENIKSILATDFDSWEIAGPRLLPVLDVLGPKSIFTSNGEGWHQARSMLRPSFVRDQVADLACFDRHISHLLKKIRSSCQEGMVAFDLQKLFFLMTMDSSTDFLLGRSTDLLVKASPEAEDFLRAFDYVLFQGAKMARLGPIMMKLPHRKFDAEVQTVRSFVRKYVSKAMAEKGYQKERSYLFLHELVASGASVEYITDQVLSIILAGRDTTAAALAAAFYFLSKSPDIVDKLRQEMLEMGEENPDWETLRGMKYLQNVIKEGKFSQKIWSWDETTLLLTPSRVFPALRLAPPVATNSRTSCKETTLPRGGGPDGKSPVLIPKGTSCRWSNYSAYRRADIYGPDADEFRPERWEDLRVAWEYTPFSGGPRICIGQQFALTQMSLAIFRILQNFDKIKSKNEGPMGMRAGVTVSLADPGCLVSMTPIA

SEQ ID NO: 36397 - protein, 259 aa, Synechococcus sp. CC9605
MQSKSQPEQITKTVVGVTTVFIGGIALISSVFVVPAGEVGVVTTLGKVSKTPREPGLNLKLPFIQATHNFSVRTQVIPEKFSTLTKDLQVIEATATVKYAVKPGEAPRIYSTIATDDSAIYARVIQPSLLKSLKSVFSKYELDTIATDWNNISTLVQESVSNELSKFDYVAVKGLDITGLKIAEEYRAAIEQKQIAQQQLLRAKTEVQIAEQEALKFQTLTRSLNDSVLYKLFLDKWDGKTKVVPPIRGGSTPPVIVGQ

SEQ ID NO: 36398 - protein, 379 aa, Hordeum vulgare
MATAGKVIKCKAAVAWEAGKPLTMEEVEVAPPQAMEVRVKILFTSLCHTDVYFWEAKGQIPMFPRIFGHEAGGIVESVGEGVTDVAPGDHVLPVFTGECKECPHCKSAESNMCDLLRINTDRGVMIGDGKSRFSIGGKPIYHFVGTSTFSEYTVMHVGCVAKINPEAPLDKVCVLSCGISTGLGASINVAKPPKGSTVAIFGLGAVGLAAAEGARIAGASRIIGVDLNAVRFEEARKFGCTEFVNPKDHTKPVQQVLADMTNGGVDRSVECTGNVNAMIQAFECVHDGWGVAVLVGVPHKDAEFKTHPMNFLNERTLKGTFFGNFKPRTDLPNVVEMYMKKELEVEKFITHSVPFSEINTAFDLMAKGEGIRCIIRMDN

SEQ ID NO: 36399 - protein, 779 aa, Saccharomyces cerevisiae
MGSFPLAEFPLRDIPVPYSYRVSGGIASSGSVTALVTAAGTHRNSSTAKTVETEDGEEDIDEYQRKRAAGSGESTPERSDFKRVKHDNHKTLHPVNLQNTGAASVDNDGLHNLTDISNDAEKLLMSVDDGSAAPSTLSVNMGVASHNVAAPTTVNAATITGSDVSNNVNSATINNPMEEGALPLSPTASSPGTTTPLAKTTKTINNNNNIADLIESKDSIISPEYLSDEIFSAINNNLPHAYFKNLLFRLVANMDRSELSDLGTLIKDNLKRDLITSLPFEISLKIFNYLQFEDIINSLGVSQNWNKIIRKSTSLWKKLLISENFVSPKGFNSLNLKLSQKYPKLSQQDRLRLSFLENIFILKNWYNPKFVPQRTTLRGHMTSVITCLQFEDNYVITGADDKMIRVYDSINKKFLLQLSGHDGGVWALKYAHGGILVSGSTDRTVRVWDIKKGCCTHVFEGHNSTVRCLDIVEYKNIKYIVTGSRDNTLHVWKLPKESSVPDHGEEHDYPLVFHTPEENPYFVGVLRGHMASVRTVSGHGNIVVSGSYDNTLIVWDVAQMKCLYILSGHTDRIYSTIYDHERKRCISASMDTTIRIWDLENIWNNGECSYATNSASPCAKILGAMYTLQGHTALVGLLRLSDKFLVSAAADGSIRGWDANDYSRKFSYHHTNLSAITTFYVSDNILVSGSENQFNIYNLRSGKLVHANILKDADQIWSVNFKGKTLVAAVEKDGQSFLEILDFSKASKINYVSNPVNSSSSSLESISTSLGLTRTTIIP

SEQ ID NO: 36400 - protein, 222 aa, Ehrlichia canis str. Jake
MLKKKRIVEVSSSILSADFANLSKSIEVLENASVDYIHIDVMDGNFVPNITIGPVVVSAIRECTKIPFDVHLMINSPSNYIETFVNAGADMITVHAESEVHLDRVIKKIKSYGKDAGLSLVPTSHYSILEYIIFELDLVLIMTVNPGFSGQQFIVSQLDKISRVRSMIEKYSLKTKIAVDGGVNIDNAKSVIEAGADILVVGSAIFKAKNVLDYVQKLKSFL

SEQ ID NO: 36401 - protein, 488 aa, Ralstonia metallidurans CH34
MSFPHPAARDARADTHRRVPLTHPVLDSGGGDTSLAARSQRAVWHPCTRLRPDASANEPPLAIVRGEGPWLIDAGDKRYFDAISSWWVNLFGHANPAINAAIGEQLQTLEHVMLAGCTHAPAVELAERLTALTGGALGNAFYASDGASAVEIALKMSFHYWRNTGLTAKREFICLRHGYHGETVGALAVTDVEIFRDAYDPLTRRAHVVMSPDARQAARSESAADVATRALAELEALLRERAGQIAALIVEPLVQGAAGMAMYDPSYLEGARALCDRYRVHLIADEIAVGCGRTGTFFAWEQARGGDAVPAHAWPDFLCLSKGITGGYLPLSLVLSRPEIQRAFVADDIARSFLHSHSYTGNPLACRAALATLDLFESEDVLARNRERAQWLGTAMAGIAADPRVSHVRQRGMIWAADIDPQAAGANFAGRFHLAARERGVLARPIGHTLYVMPPYVFDAELANWLGEQLLDTLQAVLDPAEEARHAA

SEQ ID NO: 36402 - protein, 387 aa, Debaryomyces hansenii CBS767
MVSDGEFTRTQIFGTVFEITNRYTDLNPVGMGAFGLVCSAIDKLTGQNVAVKKIMKPFLTSVLAKRTYRELKLLKHLRHENLITLDDIFLSPLEDIYFVTELQGTDLHRLLTSRPLEKQFIQYFTYQILRGLKYVHSAGVIHRDLKPSNILINENCDLKICDFGLARIQDPQMTGYVSTRYYRAPEIMLTWQKYDTEVDLWSVGCILSEMIEGKPLFPGKDHVHQFSIITELLGSPPPDVIETICSENTLRFVQSLPHRDPIPFSERFAQCSHVEPEAIDLLAKMLIFDPKKRISALDALSHPYMEPYHDPTDEPVCEVKFDWSFNDADLPVDTWRVMMYSEILDFHQIIGAGANGTTQEQMAQIQQEGIQAPSSQYQQTNQEQKVE

SEQ ID NO: 36403 - protein, 330 aa, Haloarcula marismortui ATCC 43049
MYSTHSILGALLRGPIVFSRCMQSYAQRDDDGTVPASVTDLIGDTPLVCLDSFAGNLLGKVEAANPYSVKDRIALYMVEAAAESGDLTDDGMVVEATSGNTGIGLAAVCAARGYDCVLTMPESMSEERRQLLSGLGADLELTPADGGMSGAIERANELADAPGTVRARQFENEANPRAHRETTGPEIWADTDGDVDAVVAGVGTGGTITGISEYIKERVGADLTSVAVEPEQSKLLSAADPDSHDIQGIGPGFVPDILRRDLIDEVRTASKAESVAASQRLASQAGIMVGISSGAALHAAAEYATEHPEETVVVVLPDTGERYLSTDLWE

SEQ ID NO: 36404 - protein, 509 aa, Nostoc sp. PCC 7120
MVSLLENPLRVGLQQQGMPEPQIIVIFGASGDLTWRKLVPALYKLRRERRIPPETTIVGVARREWSHEYFREQMQKGMEEAHSSVELGELWQDFSQGLFYCPGDIDNPESYQKLKNLLSELDEKRGTRGNRMFYLSVAPNFFPEAIKQLGGAGMLDDPYKHRLVIEKPFGRDLASAQSLNAVVQKYCKEHQVYRIDHYLGKETVQNLLVFRFANAIFEPLWNRQFVDHVQITVAETVGVEDRAGYYEKAGALRDMLQNHLMQLYCLTAMEAPNSMDADSIRTEKVKVLQATRLADVHNLSRSAIRGQYSAGWMKGQQVPGYRTEPGVDPNSSTPTYVGMKFLVDNWRWQGVPFYLRTGKRMPKKVSEISIHFRDVPSRMFQSAAQQRNANILAMRIQPNEGISLRFDVKMPGAEFRSRSVDMDFSYGSFGIEATSDAYDRLFLDCMMGDQTLFTRADEVEAAWQVVTPALSVWDSPADPATIPQYEAGTWEPAEAEFLINQDGRRWRRL

SEQ ID NO: 36405 - protein, 552 aa, Ashbya gossypii ATCC 10895
MKTCYYELLGVDSGASDTDLKKAYRRKALQYHPDKNIGNVQQATEIFASIRAAYEVLSDAQERAWYDAHREQILNDDFENDEEDYTVDSAVTGVTTEEILHFFNSGLYTRIDDTPAGLYQIAGKVFAKLAKDELICGRRQGLAEYSALNDDQFEKDIIELGYVQACEKYQYPDQTVFPVFGYSATSYEDLRAFYKAWGSFNTVKSFSWEDEYMYSRNYDRRTKREINKRNEKKRTQAKNEYNKTVRRFVTFIKKFDRRMKEGAKRAEAEKKRKLQETLRKQIEKDRLANEQSTGQFKLQSWQTVDQQCLDDLEKHFAGSESELKSADEEVTVLIYDCFVCNKNFKSERQLQNHNNTRSHRKAVRQIQWEMKKDSLELGLDEISDLEEFDSAYEDAMSSGPLQAAPASDLADIMAELAEIEQQLQQPASPSAQPCFEIDDQVESGEPSVAGDTEEPAVKHTDPELDRLLASLVADEQSDDWDALPNKRSRKKQTKSAKRASATQTASRPFTAAGHRCASCSQSFESRNKLFQHVQSLGHGAPPQKVKKQQRKA

SEQ ID NO: 36406 - protein, 399 aa, Leuconostoc mesenteroides subsp. mesenteroides ATCC 8293
MKGTPLMTKNINKNVHNTGLSGIRLVSNFIKKPVNEVIQLTVGEIDLPTPFATKQAGIKAIEQDHTKYTDNMGILALRRIITEYAQEFYSEPYNPVTEVLVTVGASEGIDLAIRALVNPGDEVILVSPGYTAYTQAVTLAGGVPVVVDTRSSNFRLLPNQLEEVISEKSKLVILNYPNNPSGVVLSSQELVELANVIKRHDLYVLTDDVYNRLVYDQDFAPSIASVPDMKERTLVLNGLSKSHSMTGWRIGYLLGPECLIHELYKIHQTDVGCASSISQEAAMTALTVDRDNPSEIVPIFRERRDYVLKRLDEIGISYIKPEGTFYVFANIEKFGMTSLDFVKFLIETVDLAVVHGSAFTEFGEGFIRISYAMDLSILKEALDRFQAAVAKLNNQKSLS

SEQ ID NO: 36407 - protein, 186 aa, Zea mays
MGLLGRRPWLLLLALASAAVAVEASEGDADPLYSDTIWTEKLYFSSAAAFLGYSLILAILRTSSLRDEASRVMVAAPILAFVTTHILYLNFYELDKGLNMKVCTVISIAQCLLWALWAVMSGHRSRLKIISVAVGGAVAVLVEAYDIPPRWGYADGRAICERFRKGIKMVLSVFASWLLALGVYKF

SEQ ID NO: 36408 - protein, 387 aa, Spinacia oleracea
METSMACCSRSIVLPRVSPQHSSALVPSSINLKSLKSSSLFGESLRMTTKSSVRVNKAKNSSLVTKCELGDSLEEFLAKATTDKGLIRLMMCMGEALRTIGFKVRTASCGGTQCVNTFGDEQLAIDVLADKLLFEALNYSHFCKYACSEELPELQDMGGPVDGGFSVAFDPLDGSSIVDTNFSVGTIFGVWPGDKLTGVTGRDQVAAAMGIYGPRTTYVLALKDYPGTHEFLLLDEGKWQHVKETTEINEGKLFCPGNLRATSDNADYAKLIQYYIKEKYTLRYTGGMVPDVNQIIVKEKGIFTNVISPTAKAKLRLLFEVAPLGFLIEKAGGHSSEGTKSVLDIEVKNLDDRTQVAYGSLNEIIRFEKTLYGSSRLEEPVPVGAAA

SEQ ID NO: 36409 - protein, 213 aa, Symbiobacterium thermophilum IAM 14863
MCAHFGNLAHEVAELEAAGIDMFHLDVMDGRFVPNFGMGLQDIEFIAAHATKPADVHLMIEDPGNYVEKFAKLGIKVIYTHPEADYHPARTLLKIADAGAAPGIAINPGTPVEAIEPLLHLAQYVLVMTVNPGFAGQPYLSFVDEKVDRLAELKERYGYRIVIDGACTAAVVERLAPRGVDGFVLGTKGLFGRGKPYGEVIAELRSRSGDCRR

SEQ ID NO: 36410 - protein, 468 aa, Photobacterium profundum SS9
MDNKLGLGAMTALVIGSMIGAGVFSLPQNMASVASPAAVMIGWSITGVGMIFLALAFQHLSHLKPEIESGVFGYAQAGFGDFIGFCSAWGYWLSAMLANVSYLVILFSTLGMFFDQPDMVLFGEGNTWLALAGSSILLWLVHALVLRGIQTAAIINMVTTIAKLVPLFMFIAFAFVAFKWDTFIFDFTGLHFGEEHDLLSQVKSTMLITVWVFIGIEGAVVVSSRARHRRYIGRATILGLLTALSIYVLVTLLSMGVITTQELATYKNPSMAQVLTHILGPWGGIIIGCGLLISVCGAFLSWTVLASEAPYLAAKDKMFPKCFATQNKAGSPVKSLLLTNISIQVSLFFVMYAGGTYDTLLAIASEMILVPYFLVGAYTLQLAIQTKNRGSLLFVGICASSYGLWLLYASGLNYLLLSALLYLPGLYFYVKAKREQGVKVFIGKEKAAAGVLTVAACFAVGMLWTGIL

SEQ ID NO: 36411 - protein, 365 aa, Mycobacterium marinum
MKTTDVRVRRAITAIAAGRPVVVTHDHAAQGYLVFAAEAATSSLVAFTVRHTAGYVRVALPGAECARLNLPPMCHHNPTHRVSVDVRATGTGISARDRARTIAALASAGSQAADFLRPGHVAPLLAEPHGVLAKCEPAEAAVDLARLAGHRPAAALCEIVSRRNPTLMAHGAELVEFAVEHGLAVVSIAELLAYRQRTEPQVIRLTETTLPTWAGNSRVIGFRDLGPANPGGEHLAVIIGAPDSGVPVALHVHIECLTGDVFGSTGCRCGGELNGALSAMSAQGSGVVLYLRPPGPPRACGLFASDEETPADFMSETVTWMLRDLGVYAIKLSDDMPGFGLVMFGAIREAGAAAGPADTPLAAAG

SEQ ID NO: 36412 - protein, 302 aa, Triticum aestivum
  misc_feature (281)..(281): Xaa can be any naturally occurring amino acid
MVISNASSSAGEAVYSTFSSRYVREELPRYRMPSGSIPKEAAYQIISDELMLDGNPRLNLASFVTTWMEPECGKLMMDSVNKNYVDMDEYPVTTELQNRCVNMIAHLFNAPIGEDETAIGVSTVGSSEAIMLAGLAFKRKWANKMKEQGKPCDKPNIVTGANVQVCWEKFARYFEVELKEVKLTEGYYVMDPKKAVEMVDENTICVAAILGSTLTGEYEDVKLLNDLLVAKNKETGWDVPIHVDAASGGFIAPFLQPELEWEIRLALAESIKVRGHTYGLXYHGLGWATWRRNPSARGLFFP

SEQ ID NO: 36413 - protein, 351 aa, Propionibacterium acnes KPA171202
MKAALVEQYHEPLAIRDIPEPAHDSDGVVVEVKACGVCRSDWHGWQGEWPGFTGGSLPHIFGHEFVGLVSDIGNNVSRYRVGDRVIVPFTLGCGHCEYCRSGHSNVCPTVSMPGFSYDGGFAQYVTVPDADANLVKLPDAVDFTDAAGMGCRLMTAYHGIVEVGQIHPGDWLVVYGAGGVGLSATLVATSAGANVIAVDIADDKLALARKVGAIATINSRETDPVEAVRELTDGGADKSVDALGISETLHNAVNSLRSRGTHIQIGMTAEGPVGDVALTINDLIAKEIDFRGSFGMPAVEFRYLLNQVAAGKMKPGQLVTKTIALSEVNDALTAMSTYNTVGTTVITDFTR

SEQ ID NO: 36414 - protein, 380 aa, Pisum sativum
MSNTVGQIIKCRAAVAWEAGKPLVIEEVEVAPPQAGEVRLKILFTSLCHTDVYFWEAKGQTPLFPRIFGHEAGGIVESVGEGVTHLKPGDHALPVFTGECGECPHCKSEESNMCDLLRINTDRGVMLNDNKSRFSIKGQPVHHFVGTSTFSEYTVVHAGCVAKINPDAPLDKVCILSCGICTGLGATINVAKPKPGSSVAIFGLGAVGLAAAEGARISGASRIIGVDLVSSRFELAKKFGVNEFVNPKEHDKPVQQVIAEMTNGGVDRAVECTGSIQAMISAFECVHDGWGVAVLVGVPSKDDAFKTHPMNFLNERTLKGTFYGNYKPRTDLPNVVEKYMKGELELEKFITHTVPFSEINKAFDYMLKGESIRCIIKMEE

SEQ ID NO: 36415 - protein, 426 aa, Propionibacterium acnes KPA171202
MATIEFIEAREILDSRGNPTVEVEMILDDGTQARAAVPSGASTGQFEAVELRDGDKKRYSGKGVLKAVENVNEKIAEEVLGCDASEQRIIDQIMIELDGSDNKGKLGANAILGVSLAAAHAAADCAELPLYQYLGGPNSHVLPVPMMNILNGGAHADSDVDIQEFMIAPIGAESFKQAYEWGAAVYHSLKKVLKDKGLATGLGDEGGFAPNLPSNAAALDLILDAIKAAGFEPGKDVALALDVAASEFFEDGKYTFEGQAKTSAEMIAYYEGLIAKYPLVSIEDPLDEEDWDGWAEFTKKLGEKIQIVGDDLFVTNPKRLAKGIETKAANALLVKVNQIGSLSETIDAVELAHRNGYRCMMSHRSGETEDTTIADLAVALSTGQIKSGAPARGERIAKYNQLLRIEEELGDSAEYAGASAFPRFQA

SEQ ID NO: 36416 - protein, 379 aa, Pennisetum glaucum
MATAGKVIKCKAAVAWEAGKPLSIEEVEVAPPQAMEVRVKILYTSLCHTDVYFWEAKGQTPVFPRIFGHEAGGIIESVGEGVTDVAPGDHVLPVFTGECKECPHCKSAESNMCDLLRINTVRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEAKKFGCTEFVNPKDHNKPVQEVLADMTNGGVDRSVECTGNINAMIQAFECVHDGWGVAVLVGVPHKDAEFKTHPMNFLNERTLKGTFFGNFKPRTDLPNVVELYMKKELEVEKFITHSVPFSEINKAFDLMAKGEGIRCIIRMEN

SEQ ID NO: 36417 - protein, 382 aa, Petunia x hybrida
MSSNTAGQVIRCKAAVAWEAGKPLVIEEVEVAPPQKMEVRLKILFTSLCHTDVYFWEAKGQTPLFPRIFGHEAGGIVESVGEGVTDLKPGDHVLPVFTGECQQCRHCKSEESNMCDLLRINTDRGVMIHDGQTRFSKDGKPIYHFVGTSTFSEYTVCHSGCVTKIDPQAPLDKVCVLSCGISTGLGATLNVAKPTKGSTVAIFGLGAVGLAAAEGARIAGASRIIGVDLNPSRFNDAKKFGVTEFVNPKDHGDKPVQQVIAEMTDGGVDRSVECTGNVNAMISAFECVHDGWGVAVLVGVPNKDDAFKTHPMNLLNERTLKGTFFGNYKPKSDIPSVVDKYMKKELELEKFITHQVPFSEINKAFDYMLKGESIRCMITMEH

SEQ ID NO: 36418 - protein, 135 aa, Gossypium barbadense
RLRIITSFTCLGCGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYGDWTGFPTTLLTRVEGWLNWYAI

SEQ ID NO: 36419 - protein, 380 aa, Solanum tuberosum
MSTTVGQVIRCKAAVAWEAGKPLVMEEVDVAPPQKMEVRLKILYTSLCHTDVYFWEAKGQNPVFPRILGHEAAGIVESVGEGVTELGPGDHVLPVFTGECKDCAHCKSEESNMCSLLRINTDRGVMINDGQSRFSINGKPIYHFVGTSTFSEYTVVHVGCVAKINPLAPLDKVCVLSCGISTGLGATLNVAKPTKGSSVAIFGLGAVGLAAAEGARIAGASRIIGVDLNASRFEQAKKFGVTEFVNPKDYSKPVQEVIAEMTDGGVDRSVECTGHIDAMISAFECVHDGWGVAVLVGVPHKEAVFKTHPMNLLNERTLKGTFFGNYKPRSDIPSVVEKYMNKELELEKFITHTLPFAEINKAFDLMLKGEGLRCIITMED

SEQ ID NO: 36420 - protein, 541 aa, Pseudomonas fluorescens Pf-5
MRHFVLQVSRPVTKWRNAIVLNDLGFPSVGSPTLVARGSVTFWRNSCVRYKERPVGFFLRERMQTGWSYSFFVAKVLFMSGTQLSNDLEQGLKPRHVTMLSIAGVIGAGLFVGSGHAIAEAGPAVLLAYAAAGTLVVLVMRMLAEMAVASPDTGSFSTYADRAIGHWAGFTIGWLYWWFWVLVIPLEANAAATILHAWFPNVAIWVFTLVITLLLTATNLFSVKNYGEFEFWFALIKVVAIIGFVILGLAAICGLLPNSQVSGVSHLVDTQGFMPNGMGAVLAAMLTTMFSFMGTEIVTIAAAESHNPGKQISKATNSVIWRIGLFYLVSIFIVVALVPWNDPSLAQVGSYQTVLDRMGIPNAKLIVDLVVLVAVTSCLNSALYTASRMLFSLGKRGDAPAAAKRTNASGTPYWAVILSTAAAFLAVFANYVAPAAVFEFLLASSGAIALLVYLVIAVSQLRMRHKRMAAGEKIAFRMWLFPGLTYAVIVFIVAVLGIMLFQEEHRVEILATGLLSVIVIAAGLMVARRRKAERNGALALN

SEQ ID NO: 36421 - protein, 635 aa, Nostoc sp. PCC 7120
MHLSEITHPNQLHGLSIRQLQQIARQIRDKHLQTVAEFGGHLGPGLGVVELTLGLYQTLDLDRDKVIWDVGHQAYPHKLITGRYSDFHTLRQKDGIAGYLKRGENKFDHFGAGHASTSISAALGMALARDMNGEKFKAVAVIGDGALTGGMALEAINHAGHLPKTNLLVVLNDNEMSISPNVGAIPRYLNKMRLSPPVQFIKDNFEEQFKHIPFVGESLSPELGRIKEGMKRLAVPKVGAVFEELGFTYMGPVDGHNLEELIATFQQAHQIAGPVLVHVATIKGKGYELAEKDQVGYHAQTPFNLTTGKAIPSNKPKPPAYAKVFSHTLVKLAEQNPKIIGITAAMATGTGLDKLQAKLPNQYIDVGIAEQHAVTLAAGLATEGMRPVAAIYSTFLQRAYDQIIHDVCIQNLPVFFCLDRAGIVGSDGPTHQGMYDIAYLRCIPNIVMMAPKDEAEMQRMVVTGIEHTTGPIAMRFPRGNGYGVPLMEEGWEPLEIGKGEILRNGDDVLIIGYGTMVYPSMQAAEILSEHGIEATVINARFVKPLDTELIVPLAQKIGRVVTLEEGCVMGGFGSAVAEALLDADVVVPVKRIGIPDVLVEHATPDESKAELGLTSRQIAERVLQAYFQKQPSPVS

SEQ ID NO: 36422 - protein, 380 aa, Trifolium repens
MSNTAGQVIKCRAAVAWEAGKPLVIEEVEVAPPQAGEVRLKILFTSLCHTDVYFWEAKGQTPLFPRIFGHEAGGIVESVGEGVTHLKPGDHALPVFTGECGECPHCKSEESNMCNLLRINTDRGVMINDNKSRFSIKGQPVHHFVGTSTFSEYTVVHAGCVAKINPDAPLDKVCILSCGICTGLGATVNVAKPKPGSSVAIFGLGAVGLAAAEGARMSGASRIIGVDLVSSRFELAKKFGVNEFVNPKDHDKPVQQVIAEMTDGGVDRAVECTGSIQAMISAFECVHDGWGVAVLVGVPKKDDAFKTHPMNFLNERTLKGTFYGNYKPRTDLPNVVEQYMKGELELEKFITHSIPFSEINKAFDYMLKGESIRCIIRMEE

SEQ ID NO: 36423 - protein, 522 aa, Oryza sativa
MAPPRAQRTMLVVAGDAPPTAGGGARFAAPPPERDHTQDLPDEILSLVFASLTPTDRNACSLTCARWKEVDASTRHRLSLDARAALGYAAQGIFARFTAVSKLALRCARGSGTDSLSDDGARQVAAALPSARLARLKLRGLRQLSDDGLASLAGATPVIRKLSVASCSFGPKAFVAVLRSCPLLEDLSVKRLRGLPDTAGATTAITEEILFPPASSLRSVCLKDLYSALCFVPLVASSPNLRSLKILRCSGSWDLPLEVIAARVPGLVELHLEKLQVGDRGLSAVSACANLEVLFLVKTPECTDAGIISVAEKCHKLRKLHIDGWRTNRIGDHGLMAVARGCSDLQELVLIGVNPTVQSLRMLGEHCRSLERLALCGCETVGDPEIICLAERCAALKKLCIKGCPVSDRGMWALNGGCPSLVKVKLKRCRGVSYECIENLKVVRGGSFSISLDIVLERDAGGAIENGGQEAGQVQITELTDQMAAMDLPTNASNAQSSAQASSRMRSVMSALRRRFGNPPAL

SEQ ID NO: 36424 - protein, 396 aa, Escherichia coli
MFENITAAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFAFAYQGFARGLEEDAEGLRAFAAMHKELIVASSYSKNFGLYNERVGACTLVAADSETVDRAFSQMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 36425 - protein, 246 aa, Frankia sp. EAN1pec
MSGTRTASSSQPLAGLPDGRLLVDVSVWSADLACLRAEIERASPVADLFHFDVGDSQFVPDLLFFPDLLAALRPLTTVPFHAHLMVRRPAPLAALFAQAGADLITVHAETGDDVHPALDTIRQHGKAAGLALTLDTPVMAVRPYLDAVDVIVLVGTPIGTRGTGLAPAAFDRLRTLRGLLHETGRDQAVKILADGGIHQPTVGPLADAGADGVVAGSLLFGSDDLTATIRWLHQHVPPRATTKRPR

SEQ ID NO: 36426 - protein, 449 aa, Pseudomonas putida
NMPEHAGASLASQLKLDAHWMPYTANRNFLRDPRLIVAAEGSWLVDDKGRKVYDSLSGLWTCGAGHTRKEIQEAVAKQLSTLDYSPGFQYGHPLSFQLAEKITDLTPGNLNHVFFTDSGSECALTAVKMVRAYWRLKGQATKTKMIGRARGYHGVNIAGTSLGGVNGNRKLFGQPMQDVDHLPHTLLASNAYSRGMPKEGGIALADELLKLIELHDASNIAAVFVEPLAGSAGVLVPPEGYLKRNREICNQHNILLVFDEVITGFGRTGSMFGADSFGVTPDLMCIAKQVTNGAIPMGAVIASTEIYQTFMNQPTPEYAVEFPHGYTYSAHPVACAAGLAALCLLQKENLVQSVAEVAPHFEKALHGIKGAKNVIDIRNFGLAGAIQIAPRDGDAIVRPFEAGMALWKAGFYVRFGGDTLQFGPTFNSKPQDLDRLFDAVGEVLNKLLD

SEQ ID NO: 36427 - protein, 522 aa, Porphyromonas gingivalis W83
MGQACIGSRPISFLWEVRKCRRFIGSYTIIRRVIVSHVLSGSRHYIPATGRGNSRLSLDKASPFYLTFVPKNSISYYNMDIAVVGIGYVGLVSATCFAELGANVRCIDTDRNKIEQLNSGTIPIYEPGLEKMIARNVKAGRLRFGTEIEQAVPEADIVFIAVGTPAGEDGSADMGYVLDAARSIGRAMSRYILIVTKSTVPVGSYRLIRKVIQEELDKREVLIDFDIASNPEFLKEGNAIDDFMKPDRVVVGVDSDRARELITSLYKPMLLNNFRVLFMDIASAEMTKYAANAMLATRISFMNDVANLCERVGADVSMVRLGIGSDSRIGSKFLYPGCGYGGSCFPKDVKALIRTAEDNGYRMEVLEAVERVNEKQKSILFDKFSTYYKGNVQGRCVAIWGLSFKPGTDDMREAPSLVLIEKLLEVGCRVRVYDPVAMKEAQKRLGDKVEYTTDMYDAVRGAEALFHVTEWKEFRMPDWSALSQTMAASLVIDGRNVYELPADSDFTLLNIGNSAIESASSK

SEQ ID NO: 36428 - protein, 235 aa, Microcystis aeruginosa PCC 7806
MTQNGSSKSIVVSPSILSADFSKLGADIEAVDKAGADWIHVDVMDGRFVPNITIGPLIVSAIRPYTKKPLDVHLMIVEPEKYVADFAKAGADIISVHAEHNASPHLHRTLCQIRELGKQAGVVLNPSTPLDLIEYVLHLCDLVLIMSVNPGFGGQSFIPEVVPKIRQLRQICDEKGLDPWIEVDGGLKPANTWQVLEAGANAIVAGSAVFNAPDYAAAIEGIRNSKRPQPQLATV

SEQ ID NO: 36429 - protein, 403 aa, Ehrlichia canis str. Jake
MPIEILMPALSPTMKNGTIRKWYKSEGDIIKSGDIIADIETDKAVMEFEYTDEDGIIGKIFFAEGSKDIAVNQLIALIAVDEHDLVNVQSYKKRDDVSQNNSNALQVNQQVVSSNEEVLVNQSNVSERIKISPLAKKIAADLCVDINLIKGTGPYGRIIKADVLDAASQKKEHVSSSPMSFTEISSMRRVIAERLVYSKQSIPHFYVSIDCIVDDLLKLRLEINAENSDTKVTVNDFIIKAVAMSIKKFPEINVSWSDDKIVVFHNVDISVAVSIDSGLITPIIFNADKKSLLEISSEVKTLASKAKSGKLRSEEFQGGGFTISNLGMFGIKEFCAIVNPPQSCIMAVGCSEKRAIVVDDQISISNVITITLSVDHRVIDGVLAAKFLSCFKSYLEKPFLMLI

SEQ ID NO: 36430 - protein, 396 aa, Escherichia coli
MFENITAAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAFQGFARGLEEDAEGLRAFAAMHKELIVASSYSKNFGLYNERVGACTLVAADSETVDRAFSQMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 36431 - protein, 248 aa, Debaryomyces hansenii CBS767
MVKLILVRHGQSTWNEKNLFTGWVDCRLSDIGEKEAARAGELLKEANLKGDVLYTSKLSRAIQTANIALNTADQLYIPVKRSWRLNERHYGALQGKDKAATLEEYGQEKFQTWRRSFDVPPPVIADDSEFSQAGDERYRDVDPSVLPKTESLKLVIDRLLPYWQDEISKDLLEGKTVIVAAHGNSLRALVKHLDNISDDDIAGLNIPTGIPLVYELDEKLQPTKPAYYLDPEAAAAGAAAVAAQGSKK

SEQ ID NO: 36432 - protein, 705 aa, Ehrlichia canis str. Jake
MLTMFVLSLLAVSAIFGFAAAALLESMIGGSGEEKERESKTIAESDGNQGVVKVSGRVRHRDTASDKRKKAGKNKKLKHGKYNARKSSKSGQGEKNADKVLAGTDVVSQEEDKEKHNSRKQRAGKRVGVRSSDKVDQGQDKECTTEISSDRSVKSAAKGKEVLEQKVPVEDDKSDKDVQSPGKSSKKLEQSPGKEQHLPSGGDIPLQSAGEHADIPTESKDASAVSSGVSQAFDGQDKYLALGARPKKRAEPVKSKKSEPTKKSDVQVAMAVDSDQVKKDDKSSDRSVKAGSKDKEELEKKKQSKSSKEAVIVQSANGVTADKVSQRQDEKHSAETSSSEDVESAKESKEVLEQEKSVGGDESNKGVQKDSEQSEGTKKDVQSSEKQDNASKDDIKASSDEKGGGGKPSKNVGASDLESTGDDAASGVQEQYLRQGTRPKVRASKTVKAKKHKSPKTSVEPAVQFFDWDSGTYDEKDPFLVREAAKKLSKDTKPTTGVVQPQALPDDSERKDKESGKLGIIEQSFDDTEEQLVELVKEISLGELGAAAPLESDEQSGTGTIDPDTRIAGVSAVSVLVDPHKPSKKNIFYGKASLQSFRQSQYLASSIVEYRCKVQELKEKLSVFRGMQLQYCCHMMQNMFCLVVDNKVCVNESVEGLLRNKVTDYSILVFLLKLGCLMNCAAILGKVKFLIFLLMMHNCVGRKLC

SEQ ID NO: 36433 - protein, 308 aa, Salmonella enterica subsp. enterica
INGFGRIGRIVFRAAQKRSDIEIVAINDLLDAEYMAYMLKYDSTHGRFDGTVEVKDGHLIVNGKKIRVTAERDPANLKWDEVGVDVVAEATGIFLTDETARKHITAGAKKVVLTGPSKDNTPMFVKGANFDKYEGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFGKLVSWYDN

SEQ ID NO: 36434 - protein, 437 aa, Pseudomonas fluorescens
MAERLNNDFQFIDVGRKDPKKKLLRQRKKEFVEIYEPFKPQQSADQAHRCLGCGNPYCEWKCPVHNFIPNWLKLVAEGNILQAAELSHQTNTLPEVCGRVCPQDRLCEGACTLNDGFGAVTIGSVEKYITDTAFAMGWRPDMSKVKPTGKRVAIIGAGPAGLGCADVLVRGGVTPVVFDKNPEIGGLLTFGIPEFKLEKTVLSNRREVFTGMGIEFRLNTEVGKDVTMEQLLEEYDAVFMGMGTYTYMKGGFAGEDLPGVYDALDFLIANVNRNLGFEKSPEDFVDMKGKKVVVLGGGDTAMDCNRTSIRQGAKSVTCAYRRDEANMPGSRKEVKNAKEEGVKFLYNRQPIAIVGEDKVEGVKVVETRLGEPDARGRRSPEPIPGSEEIIPADAVVIAFGFRPSPAPWFEQFSIQTDSQGRVVAPEQGQYKHQTSNP

SEQ ID NO: 36435 - protein, 359 aa, Symbiobacterium thermophilum IAM 14863
MQNVSVAVIPGDGIGNETVRAGRRVLDAAAELDGGIKFEYTEFEWGCAYYLRHGEMAPKGFLNTLANFDTILLGAVGYPGVPDHVSLWGLLLPIRRGFEQYVNLRPVRILRGVVSPLRGRNPGDVNFVCIRENTEGEYSNMGGRLHAGLPHEVVVQNTVFTRVGTERIIRYAYQLAANAPRKRLCGATKSNGINYTMPYWDEIFNEIGEREFPEVNRWLCHIDALAANFVLKPDEFDVVVASNLFGDILTDLGGAIMGSIGMAASANINPERRYPSMFEPVHGSAPDIAGRGIANPVGQIWSVSLMLEHLGRADLGKAVLDAVEDVLEEGRVRTPDLGGRNTTDEMTDAVIARLAQRLR

SEQ ID NO: 36436 - protein, 177 aa, Zea mays
MAIELDLQETMSLTDKHLLIAGAVLLVTTISMLKLLVWSGSRVRSRRRLPPTIPAMPIIGGLIRFMRGPITMIREEYARLGSVFTLSTLGHRITFLIGPEVSEHLFNGPESEMSQQEVYRFTVAAFGRGVAFDVPYSVRQEQIRIFAEGLRGNKLRGYVNLMVCEAEVIYFILVQFF

SEQ ID NO: 36437 - protein, 457 aa, Fulvimarina pelagi HTCC2506
MTSTTFDGFGLAEPLTRALARLELTTPTPIQERAIPHALAGRDMLGIAQTGTGKTAAFALPLLHHLMTVGGKPTTRTTKALILSPTRELAVQIAESIADLSEGTPISHCVVFGGVSVRPQIQALARGVDILVATPGRLLDLMEQRAIDLRETRHLILDEADRMLDMGFVRDVMKIVGKCPDDRQSMMFSATMPKPIEDLSKKILTNPQKVSVTPAVVTVEKIAQSVFSVPQRAKKHWLIDFVSKNDTGRIVVFTRTKHGANRLTSDLDKAGIQALAIHGNKSQTARQKALGAFQDGEIDVLVATDIVARGIHVDDISHVVNFDLPEEPESYVHRIGRTARAGRSGQAIALVDPSERAKLKQIIKLTGIDLTPQATDYTVNVLAGELDADDGKRRGPRNQQPRNGRPRNRGKNGNGGRPNGGAKRQNAGGETANRSSQRPSGKPRRSRRSGDRSAANA

SEQ ID NO: 36438 - protein, 793 aa, Oryza sativa
MALLFVPFLFSLLITTFPPAATDTVTAGRPLAGGDKLVSGNGKFALGFFQMAGGNGSSSTAPKWYLGVWFNTVSKFTPAWVANRENPLADGGASWQLAISGDGNLVISNRANNNSMTAAAWSSQANTTTSNNTVAVLLNSGNLVLSDASNSSIIFWESFSHMTDTFLPGAKMGWNKATGFTHGLVSSKNSGDLSPGVYSATPSSDFANPGLFLAWNSSVVYWSTGPWNGDYFSNTPELTARALFTFDFVSNDHEEYFTYRLRNDTMVTRYVLAASGQAKNMIWSSVSEDWVTFYAKPGAQCDVYAVCGAFALCREDMLPFCNCMEGFSIRSPQDWELGDQTGGCVRNVPLNCGVTDRFYAMSDVRFPANAKNMEAGTADGCKQACLNDCSCTAYSYNGSCNVWSDGLFNVARQYNYNQSSSGGILYLRLAAEDDVSESSKHTRGLIIGVVAVASVLILSLFTIVIMFVRRNKRNCSSVGRIICGTVAFRYKDLQHATKNFSERLGGGSFGSVFKGVLTDSTVIAVKRLDGARQGEKEFRAEVRSIGIIQHINLVRLIGFCCEGSNRLLVYEYMPNGSLDSNLFGSKVASLDWSTRYKIALGVARGLAYMHGNCLDCIIHCDIKPQNILLDASFVPKIADFGMSKLMGRDFSQVLTTVRGTIGYLAPEWISGMAISSKVDVYSYGMVLLEIVFGRRNFRGECTSNATYFPVQVVGKLLQGNVQCLLDQNIQSDINSEEVERACRVACWCIQDDELNRPTMAQVVHILEGVLEVDMPPMPKLLQAISGNMDSTKT

SEQ ID NO: 36439 - protein, 654 aa, Gibberella zeae PH-1
MPRIKKKGQAGASKNYVTRNQAIRKLQISLPDFRKLCIWKGIYPREPRSRKKVSKSSTSSTTFYYTKDIQYLLHEPLLQKFRDQKVLEKKISRALGRGDVTDAARLEGNAARPEKTGKPRYTLDHVIRERYPTFIDAIRDLDDCLSMLFLFANLPSTSSVPAKMIARCERLCLEFQHYLIVSKSVTKSFLSIKGIYYQANIQGEEVLWLVPYKFNQRVVGDVDFRIMGTFIEFYMTLLGFVNFRLYTTLGLKYPPKFDQAKDEAGAELGAFTLEGKTLVGADEKEQKTLEASEHKPDPKVQAAVNKVIKKIKGNADDESTDATEVEGEEQSGAIDKFEPAAPGGDILPQPSNTGSNPNSLFSNITVYLSRETPRQPLEFLLKSFGCRRVGWDAVLGDGAFTTNELDPNITHQIVDRPPIEATGDEEEANGDDNQTSQKLAANRRVPGRTYIQPQWVWDSVNDGELKEAHLYAPGAALPPHLSPFVRNVQGAYDPTVPLEEQEPEAEAIEAQSDGEDEVDDTAEGMDVADSEEEGEDDEFGGFSADEQEEDEEEEEEDAEQRQDELEAELTGGAVKSKNTNAKAKAKEEARKALSKKAKEEAEDLDRAKGMLSKKKRKLYEQMVYTNNKKSAEDQKLRAKRRKFEKEKSKGKAKA

SEQ ID NO: 36440 - protein, 542 aa, Oryza sativa Japonica Group
MELTTLLLLALISFFFLVELIARYASPSGRESALRLPPGPSQLPLIGSLHHLLLSRYGDLPHRAMRELSLTYGPLMLLRLGAVPTLVVSSAEAAAEVMRAHDAAFAGRHLSATIDILSCGGKDIIFGPYTERWRELRKVCALELFNHRRVLSFRPVREDEVGRLLRSVSAASAEGGAACFNLSERICRMTNDSVVRAAFGARCDHRDEFLHELDKAVRLTGGINLADLYPSSRLVRRLSAATRDMARCQRNIYRIAESIIRDRDGAPPPERDEEDLLSVLLRLQRSGGLKFALTTEIISTVIFDIFSAGSETSSTTLDWTMSELMKNPRILRKAQSEVRETFKGQDKLTEDDVAKLSYLQLVIKETLRLHPPAPLLIPRECRETCQVMGYDVPKGTKVFVNVWKIGREGEYWGDGEIFRPERFENSTVDFRGADFEFIPFGAGRRMCPGIALGLANMELALASLLYHFDWELPDGIKSEELDMTEVFGITMRSIMKRELHPISAFIVYFCNILDGNGMGAGVLHHLMSLLLWKGQGTDPVIR

SEQ ID NO: 36441 - protein, 373 aa, Hordeum vulgare
MATAGKVIKCKAAVAWEAGKPLSMEEVEDAPPQAMEVRDKILYTALCHTDVYFWEANGQTPVFPRILGHEAGGIVESVGEGVTELVPGDHVLPVFTGECKECAHCMSEESNLCDLLRINVDRGVMIDDGQSRFTIDGKPIFHFLGTSTFSEYTVIHVGCVAKIDPEAPLDKVCLLSCGISTGLGATLNVTKPKKGMTVAIFGLGAVGLAAMEGARMSGASRIIGVDLNPAKHEQAKKFGCTDFVNPKDHTKPVQEVIVEMTDGGVNRAVECTGNADAMISAFECVHDGWGVAHKEAVFKTHPMNFLNERTLRGTFFGNYKPRTGLPGVVDMYMRKELELDKFITHSLPFSQINTAFDLMLRGEGLRCVIRSEE

SEQ ID NO: 36442 - protein, 403 aa, Glycine max
MASATLSVAKPALQANGKGFSEFSGLRSSSGFLPFSRKSSEDFHSVIAFQTYAVGSSGGYKKGVTEAKLKVAINGFGRIGRNFLRCWHGRKDSPLDVIAINDTGGVKQASHLLKYDSILGTFDADVKPVGSNVISVDGKEIKVVSDRNPANLPWKDLGIDLVIEGTGVFVDREGAGKHIQAGAKKVLITAPGKGDIPTYVVGVNEYDYSPDEPIISNASCTTNCLAPFVKVLDQKFGIIKGTMTTTHSYTGDQRLLDASHRDLRRARAAALNIVPTSTGAAKAVALVLPTLKGKLNGIALRVPTPNVSVVDLVVQVSKKTFAEEVNAAFRESADNELKGILSVCDEPLVSVDFRCTDVSSTVDSSLTMVMGDDMVKVIAWYDNEWGYSQRVVDLADIVANKWK

SEQ ID NO: 36443 - protein, 380 aa, Solanum tuberosum
MSTTTGQVIRCKAAVAWEAGKPLVMEEVDVAPPQKMEVRLKILYTSLCHTDVYFWEAKGQNPVFPRILGHEAAGIVESVGEGVTELAPGDHVLPVFTGECKDCAHCKSEESNMCSLLRINTDRGVMINDGQSRFSINGKPIYHFVGTSTFSEYTVVHVGCVAKINPLAPLDKVCVLSCGISTGLGATLNVAKPTKGSSVAIFGLGAVGLAAAEGARIAGASRIIGVDLNASRFEQAKKFGVTEFVNPKDYSKPVQEVIAEMTDGGVDRSVECTGHIDAMISAFECVHDGWGVAVLVGVPHKEAVFKTHPMNFLNERTLKGTFFGNYKPRSDIPSVVEKYMNKELELEKFITHTLPFAEINKAFDLMLKGEGLRCIITMED

SEQ ID NO: 36444 - protein, 238 aa, Festuca pratensis
MCPIKKEMSGESGLSCSGEYHSPSTSPEQQQGHSQKQTAWTKRPAGRTKFRETRHPVFRGVRRRGNAGRWVCEVRVPGRRGSRLWVGTFDTAEIAARAHDAAMLALAAGDACLNFADSAELLAVPASYRNLAEVRHAVTEAVEDFERRQELGEKDALSGTSSSTPSSSSLTDDEEASSQNDNSPFELEVLSDMGWDLYYSSLAQGMMLMAPPFLAASAAFGDYGEVNLADVPLWSYQS

SEQ ID NO: 36445 - protein, 215 aa, Synechocystis sp. PCC 6803
MTAYHLIDISVAVHPQLPRWPGSPAIEFQPELDLANGDIATDTTIHMSVHTGTHVDAPSHFLQGGKTVETLPLETLLGPVTVIDLSHVDAIEPHHLAQAPIPDRTQRLLIRTRNSLHWQQNQSEFDPNFVALTAQAAQWVVEQGIKLIGIDYLSVQRFRDDATTHQILLGAEVIIIEELNLYAVQPGEYELICLPIKLQGLEGAPARVILKTVSN

SEQ ID NO: 36446 - protein, 540 aa, Aspergillus oryzae
MSNTEIEPLLDSAAPGYDTVHDPSYDSPPDALHSGFQNKLPEAPSHRKALNWSSAYILVISRVIGSGVFATPGSIVKSTGSIGLTLLLWLVGTILAACGMAVSMEFGCMLPRSGGDKVYLEYAYRRPKFLASTLIAVQAVLLGFTASNSIIFAKYILFAFNIEPTEYQHKALAVGLLTLITIVHGCFLKTGIWIQNILGWVKIFLIMAMSLTGIWVILLRPYDESMSESDRVVTNNPFAWDTLWEGSNWSWSLISTSIFKIFYSYAGLNNVNNVLNEVKDPIKTVKTVCPAGLLTAGALYFLANISYFLVVPLDEIKNSGELVAGLLFERLFGAHVGRVLFPLAIAISAAGNVMVVTFALARVNQEIARQGFLPWSHLLSSSRPFNSPLGGLLVHYIPSILVISLPPQGDVYNFILDVEGYPGQIFALAITVGLLIVRRREPFLHRPFKAWTWAIWLRIVVCIALLAAPFFPPPDRKGDVHFFYATYAIVGAGVILFGIVYWYIWTVLLPRWGNYQLEEEKGVLEDGTGITKLVRSYRIT

SEQ ID NO: 36447 - protein, 297 aa, Polaromonas sp. JS666
MPIDDADGLLAHIAAQVRPLLPQGQLPQYIPQLGRVDKMQFGMALLMLDGREAFVGDADVPFSIQSISKLFALMLALERVQVDQEAGATRNPFINAGALVVTDVLCSSFAQPELALLQTLRQSADDERVDIDQIVMRSERESCHRNAAIAHLLKSYGRICNSVDTVLDTYCRQCALTMNTRQIARCALPLAISGRLSAHRARERLSAVQRHSVTALMLTCGTYNAAGDFAARVGLPMKSGVGGGIVAVIPGVGSVCAWSPGLDGAGNSLAAGRAIELFAKHTGLSVLGSPARTFKAL

SEQ ID NO: 36448 - protein, 425 aa, Physcomitrella patens subsp. patens
MAATQAVHQVLCSSAAVATTSSEVQSCKGGLTANSLSLLPGSSFHGSCAGLRAQNSRAVTDPRQAAGARAAISVEPTSLPTAKKGQYEITTFTTWLLKQEQAGVIDGELTIVLSSISLACKQIASLVQRAGISNLTGLQGVANIQGEDQKKLDVISNEVFSSCLRSSGRTGIIASEEEDTPVAVEESYSGNYIVVFDPLDGSSNIDAAVSTGSIFGIYKPNEECLTDLGENPTIDEVAQNCVVNVCQPGSNLLSAGYCMYSSSVILVLSVGHGVYGFTLDPLYGEFVLSHEEIKIPKSGKIYSFNEGNYALWDDKLKKYVDSLKDPGPSGKPYSARYIGSLVGDFHRTMLYGGIYGYPRDSKSKNGKLRLLYECAPMSYLAEQAGGKGSDGHQRILDIQPEQVHQRVPLYVGSTEEVEKLEKFLA

SEQ ID NO: 36449 - protein, 249 aa, Synechocystis sp. PCC 6803
MKPVVLITGIAGGIGQATAELFAQQGWLVTGIDRQADPKCPYIDHYQQADCGDPKALAAAFDNLVGETQNLHSLINNVALQICQPILETSLDDWDQVMAVNLRAAFLLAKMSHPYLQQTHGSIVNISSVHALATSANIASYAASKGGLIALTRAMAIEWAADQIRVNALLPGAVNTPMLREGLSRGHLVEQSPQHQLQELGSKTVMGRVGQPSEIAQAIAFLADNEQSSFMTGQTITIDGGAIARLSTE

SEQ ID NO: 36450 - protein, 218 aa, Physcomitrella patens subsp. patens
PPAAATKVEEKLCHCDVLPEDVLAQCLSHLDSFQDMASVSRACKRWREGIQQSLACQTKLSFAGWRPDDGAISRLVKGAGSLKELNISNGRWGCRITDVGLIQVSIAKCCPNLASISLWGVTAITDEGVVQLVRRAASLEHFNVGGTFITDVSVLALASHCKLLKSINLWCCRHVTETGLLAVVKGCQKLESINVWGMSISPSCRRRLKLLNPKLHLK

SEQ ID NO: 36451 - protein, 622 aa, Schizosaccharomyces pombe 972h-
MNKFFSFPILGLLLTCVRFVVAKERLFEWNVTDVYDVDPDGSGNSRWVIGVNNKWPIDPLVVDYGDQVIIKMTNSLANNRTTSLHSHGLFQKFTPYMDGVPQSTQCEIPPGATFYYNYTALQNGTYWVHSHDMSQYPDGLRTPFIINALEEPYDYDEEYIISMTDWYYTPFNILVPDEFKTWKNPTGAEPVPDTGLFNDTANATFAMEPGKTYRLRFINIGAFNNYDVMIEDHNMTIIEVDGEYTEPQEVSSIHLTVAQRYSVLVTAKNSTDRNYAITAYMDESLFDTIPDNYNPNVTAWLSYNSDASYDLGPDIDEIDSYDDAELNPLYSWDVTESNHSINIWFDFFTLGDGANYAEINDSSYVFPKVPSIMIANSTNVDGYNLEPVTYGPYTNAYIFEYGDVVDVIIDNHDTGKHPFHLHGHTFQVLERGEENAGLYSDQESHTYYDNPMRRDTVEIEPGSFIVIRFIADNPGAWVIHCHIEWHMESGLLATFIEAPEMIPSISSPDFVKEQCMLDGVPTIGNGAGNYKNISDLSGAPSPPGEMPAGWTSKAIGTMAACVISACIGMGSIIFYGASIHPVPTEELDENDDLQEAALENAAMFLDTDKAVEKVVEGKDEIK

SEQ ID NO: 36452 - protein, 258 aa, Brassica napus
KPKLVSGSQEGYTGHVDGKLKEAKMNRPRGLAIDDSGNIYVADTNNMAIRKISDAGVSTIATGGRFSDDFDLIYVSSTCSLLVIDRGNQVIREIQLHDHDCSHHEPETDLHLGTALLVAAAFFGYMFALLVRRVRSLFSSFRHDSKRHHVAKPNMTMAPYQRYPRPVRQPLIPPQHEPEKEEGFLGSLGKLVVKTGSSVSEMISGSRNVTPQDFQYHHQQQPNQWPPVQETFAIPEEDGPPGLEPRSGTNQDKPYLRV

SEQ ID NO: 36453 - protein, 224 aa, Zea mays
MSQDQENGGTNGQHAADVMEVEPKRRAPRLNERILSSLSRRSVAAHPWHDLEIGPEAPAVFNVVVEITKGSKVKYELDKKTGLIKVDRILYSSVVYPHNYGFVPRTLCEDNDPMDVLVLMQEPVLPGAFLRARAIGLMPMIDQGEKDDKIIAVCADDPEYRHYNDISELSPHRLQEIRRFFEDYKKNENKEVAVNDFLPAAAAREAIQYSMDLYGQYIMQTLRR

SEQ ID NO: 36454 - protein, 372 aa, Physcomitrella patens subsp. patens
MISCCPLRQDPTSAAALGNPRVLSKLQGNGSLLSTCNSDFECGSGLYCFSCLAGRIIEIQFKCIRRRVKPIYAFPKGTSLPFNKYSWLTTHNSFSIFGSSPQTGAPIVTFFNQEDSVLDQLNNGVRGLMLDMYDFRNDVWLCHSFGGHCHEFTAFRPANETLAEIRTFLEANPTEVVTIFIEDYVLTLNAITKLFTSAGLTKYWMPVAVMPSNGSLWPTLEEMIQRNHRLVVFTQNETKEATEGVAYQWRYTTENQYGDSGLWSGSCPRRINSTVLNDTSRSLIVQNYFPTNPNAINACRDNSEGLFNMLRTCYIAAGDRWSNYVAVDFYKRSTGGGAFHAVDFLNEQMQCSCQDATKPCSVSFHPSPLHSS

SEQ ID NO: 36455 - protein, 662 aa, Propionibacterium acnes KPA171202
MSDLSSSSAPARRPGTSVRELTFRGIVLGGLMTLIFTAANVYLGLKVGLTFATSIPAAVISMAVLRHFKGHSVEENNIVQTIASAAGTLSAIIFVLPGLIMVGWWSGFPYWTTLAICLVGGILGVMYSIPLRRALVTGSDLPYPEGVAGAEVLKVGDSAGAAEANKVGLRVIIVGSVVSAAYALLSDLKLVKSALTKPFKTGDSSGSMVGVSMSMALIGVGHLVGIAVAAAILVGLFISYGAILPWRVSGKVGSDLTVIQDVFTSDVRFVGAGTIGVAAIWTLVKVIGPIVKGISDSISSSKTRHEGGEVPLTERDLPVSVVLTVVLISMIPIGFMLWGFARDMVVSRSMTGVIIVSLAFILLVGLAVASVCGYMAGLIGASNSPISGVGILVVLVAALLIKLTYGAVGGGETVKLVAYTLFTASIVFGIATISNDNLQDLKTGQLVGSTPWKQQIALIIGVIFGSAIIPPVMQLMQSAFGFQGAPGAGPNALQAPQATLISSLATGVFGGSLDWGLMGIGALVGIGVIVVDEILTHTTKKFSLPPLAVGMGMYLPMTLSLTIPIGAALGWLFDKWAAHTAGDVEGKKRTGILLATGLIVGESIFGVIYAAMIAAAGSEDAIAIAPESWDSGAGIVGVITFAAAIAFLYRWTKRQAKERVEA

SEQ ID NO: 36456 - protein, 482 aa, Oryza sativa
MEKSELLLGSYSYAALCGVTLIIGWLAHWIYKWMNPPCIGRLPPGSMGFPIIGETFQFFRASPSIDMPSYYKQRLERYGPLFKTSLVGRPVIISLDPEVNRFIFQQEGKLFQSWYPETAINIFGKKSLTTYNGTIHKFIRGVAAKLFGLENLKESLLPELENSMRESFASWTGKPSVEVQDGVSDMIFDLVAKKLIGLDVTNSRELRKNFQDFFQGMVSFPIYFPGTSFYRSMQGRRNVRNTLTDIMKERLSAPGKKYGDLVDLIVEELQSEKPMIDENFAIDALAALLFTSFATLSSTLTVAFKYLTDNPKVVEELKEEHGTILKKREGVNSGFTWEEYRSLKFSTQVMNEITRISNVTPGVFRKTLTDVQVKGYTIPSGWLVMISPMAVHLNPKLFEDPLKFDPWRWREEKRSSMLKNYMPFGGGVRLCLGAEFSKLFIALFLHILVTEYSWTEIEGGEVLRISEIMFPQGYHIQLVPQT

SEQ ID NO: 36457 - protein, 1994 aa, Gibberella zeae PH-1
MSSAALQTAPHQHTALASSPLGTPSSRQYRPSQSSPNSQAYNAQQTSTASSSSRRPPSRKTNDSAPSPSYHLTPGFGSPVTASVANHQEPVASDWQGNMPPVAPPRSSSNHQSGSSRRSHYPNEKPPSSPRRNESTRTGSRGEQAAAENGYRSSKADTAARASSRDGKAAPSQLPVRSTHSTPSKPVHDATDSLTKAIAAAQDTIDRDRNHASNQHNGDDTAAPPPAVATGEHGEERRQRSRHDHSRSNKGNTKFGDFILGNTIGEGEFGKVKLGWKQDSSVQVAIKLIKRDTVGSNPSRFAKIYREVAILRGVQHPNIVRLIDKVETDRHIGIILEYASGGELFDYILNHRYLKDNAARRLFAQLVSGVGYLHKKGIVHRDLKLENLLLDRNRNIIITDFGFANTFDAHEELTKEEELNLTDKEFVKRMGLDRVKMNGSRKGDLMQTSCGSPCYAAPELVVSDSLYTGRKVDVWSCGVILYAMLAGYLPFDDDPANPEGDNINLLYKYIVTTPLTFPEYVTPHARDLLRRILVPNPRKRADLFEVARHSWLSEYANLVEFITSTTTLPSEVPDSGVSPDDYAEAPTVARSNSVREASKHKQPHPPVVGGLAKTHGSVDPDSEATHRGTPKDAKRRTVQVEYVAPTTKTQRGADVAPSKPSSHSLQQQQPANTPEPVTEKPLPREPPLTKDNPSRAQQSRRPQSSHKNAPPPHRPSRDTRATSDNAFMTGGTTTTRPRTQGSMQSSTSMGLQSQTNYGQPAPPTIADTNAHGRIQQPQNPEEEGNIAKDVGSVPPKVMKMTTFQNETKAAGRGHKRSNTLGDIGSKIMGRSGSIFGGRSKKRPEQQQQQQQQQAEKSSRKYPPVSMSNTMLPGEDAGPRPSMDSKASRRSFSIGLGKKRSGSVQGSSDKQNRRFSLAKAMGLGRNEGSVTGSEADSQQDLPIQHPRTEQLRGYSAHDEPRHSEPYFDAPYEQYPQRDTAQSSPVYNTRYGSQQQDGRRPSAIPTYIQGGSHLNTGSDSSVDMRRPNDPRSRPYQEDFSGSEGYDGRPVGSSREDRPGVLHKSHKKFADAYDGENYRGHEGSSGAAKRVMDFFRRRGKARGATSNEGRTPRALDDAHSQLGDHPGQLILTTYARDWLCFDCYNHINWRSVVCFDGNETRDDETTISSLTVPFAKQITSHELAGKLTERAKKLSSQRVATIAYLEYMYMRPGSVSLPDTYVTWAKLAFAYSGIQTHRRIDLNLPFGSDASYTRMLSPLRHVTSNVGFASYGSRSVAQPTAPTAQGLSEQPRLQEFDEKKTRLDNQNGRKTKSLHKIPSAGGVSSPAAGSGSVLEAPSKAEEPAQGETPSTTSKNAGFFAELKRSVRIVITYSWLNVFMVFVPVGIAVSQVPGVPAGLIFGMNAIAIIPLAGLLAFATESVALKMGDALGALLNVTFGNAVELIIFILALVKNEIRVVQSALLGSILANLLLILGMSMLLGGLRFREQVYNSTVTQMSACLLSLSVISLVLPTAFHASFKDNDKADRESLKISRGTSVVLLIVYVIYLTFQLKSHAYMYESTPQHIIDAELAPGPAAGFLDSSSSDDSSSSSSDSSDSDSSHGTMRKRMKKVLRNRRHRRSSAASADTADTKGTRSASFATNNTTTPQEEVSEAKASRQRVPRSASYEGSEHAVDDDDEEEAERSHRRRRYRRHRHRRSKKEARKAKKEAKNAQSQNGVPESIPENKGEGEPRRVDFAVQDDLEAGPSTNGGKRPFPLRGISVKALAPVFTEKPPTASGPAPHVRYGIRRTNSLPDRLQFRAPGAMLPAQIPPMLNAPGVKSTDSDEEDEEEHLSQFSAVILLLVSTALVAVCAEFLVDSIQEVVKTSHINQVGIGLIILPIVGNAAEHVTAIKVAYKNNMDLAIGVAVGSSIQIALLLTPFMVILGWIMNKEMTLYFTLFETVCLFVSAFIVNFLVLDGRSNYLEGALLCAVYIIIAVVAFFYPDSEDASVWGGGT

SEQ ID NO: 36458 - protein, 484 aa, Oryza sativa
MYAYVGLVGAAAALVLLLRHQARRWRNPRCGGQLPPGSMGLPLVGETFQFFSSDASLDIPPFIRHRLARYGPIFKTSLVGHPVVVSADEELNHMVFQQEGQLFQSWYPDSFVEILGKDNVGEQQGAMFRYLKNMVLRYFGPESLKEGIIRDVERAVSSSLCTWSTLPAVELKEAVSTMVFDLAASKLLGLEPSRSKILRKSFFDFVRGLISFPLYLPGTAYYSCMQGRRRAMVVLEQVLEERKQSTGLQRGGEAQQHGDFLDYVIQEITKEKPVMTEKMALDLMFVLLFASFHTTSLALTLAVKLLADHPLVLEELTVEHETILKDREAGSELDRITWKEYKSMAFTSQVINETVRLANIAPVIFRKALKDIRFNGYTIPAGWGVMVCPPAVHLNPYIYPDPLTFIPSRFKDKPEINRGSKHFMAFGGGLRFCVGADFSKLQLAIFLHFLVTKYRWIPLGASRVVRTPGLEFPDGYRIKVIQRH

SEQ ID NO: 36459 - protein, 323 aa, Streptomyces coelicolor A3(2)
MDTRPLVSTPFTASSTADEVLEDVDLTGVRAIVTGASSGLGIETARALTAAGAEVTLAVRNTAAGASAAETIARSTGAAPPRVVRLDLADRAGVTRFVDAWDGPLHLLVNNAGVVTGGLERTPEGWELHFATNHLGHFALATGLHQALARGAAERGGARIVSVSSTAHMRSGIDFDDLHFERRSHDPQTAYAQSKTANSLFAVEATRRWGSAGIVANAVNPGGVATGLQRNFTPEQKASLDAAEAAGVFTYKTVEQGAATSVVAAVAPEFAHSGGHYLDDGQEAYTVPNDADLAQHPHGVKEWALDPAAAKRLWTVSTDLLRS

SEQ ID NO: 36460 - protein, 379 aa, Hordeum vulgare
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGLSTGLGATLNVAKPKKGSTVAIFGLGAVGLAAMEGARMAGASRIIGVDLNPAKYEQAKKFGCTDFVNPKDHTKPVQEVLVEMTNGGVDRAVECTGHIDAMIATFECVHDGWGVAVLVGVPHKEAVFKTHPMNFLNEKTLKGTFFGNYKPRTDLPEVVEMYMRKELDLEKFITHSVPFSQINTAFDLMLKGEGLRCITRTDQ

SEQ ID NO: 36461 - protein, 405 aa, Triticum aestivum
  misc_feature (48)..(48): Xaa can be any naturally occurring amino acid
  misc_feature (53)..(53): Xaa can be any naturally occurring amino acid
  misc_feature (202)..(202): Xaa can be any naturally occurring amino acid
  misc_feature (208)..(208): Xaa can be any naturally occurring amino acid
  misc_feature (211)..(211): Xaa can be any naturally occurring amino acid
  misc_feature (243)..(243): Xaa can be any naturally occurring amino acid
  misc_feature (268)..(268): Xaa can be any naturally occurring amino acid
  misc_feature (274)..(274): Xaa can be any naturally occurring amino acid
  misc_feature (278)..(278): Xaa can be any naturally occurring amino acid
  misc_feature (281)..(281): Xaa can be any naturally occurring amino acid
  misc_feature (299)..(299): Xaa can be any naturally occurring amino acid
  misc_feature (301)..(301): Xaa can be any naturally occurring amino acid
  misc_feature (304)..(304): Xaa can be any naturally occurring amino acid
  misc_feature (310)..(311): Xaa can be any naturally occurring amino acid
  misc_feature (328)..(328): Xaa can be any naturally occurring amino acid
  misc_feature (338)..(338): Xaa can be any naturally occurring amino acid
  misc_feature (341)..(341): Xaa can be any naturally occurring amino acid
  misc_feature (346)..(348): Xaa can be any naturally occurring amino acid
  misc_feature (351)..(351): Xaa can be any naturally occurring amino acid
  misc_feature (357)..(357): Xaa can be any naturally occurring amino acid
  misc_feature (365)..(365): Xaa can be any naturally occurring amino acid
  misc_feature (370)..(370): Xaa can be any naturally occurring amino acid
NKFVQKSRLVPVRNSRDIVDPRVRAELKGCHNDVDRMHKCLVDRFGFXEENVXVLLDRGSSGPQPTGANIRHALAKLVGDARRGDFLFFHYSGHGTRLPAETGQDDDTGYDECIVPSDMNLIADQDFRDLVQKVPDGCIFTIVSDSCHSGGLLDKAKEQIGNSTRQNQTQSREPEEERSHSGSGFRSFLKETVRDAFESHSXHGGEDXDEXQLGDGLTKNRSLPLSTLIEMLKEQTGKDDIEXGSIRADSVLTSFGGRMPPPKIQKFXKVMLDXFHEXGSXEQGGVMGMVGSLAHQFLXAXLEXNEEETXXANDITTIWAMLKKRMPXTKSWAPKQTXSSXSGWQXXXDIXQDATIXGGTPFGPXNNASXAFLMIGRYNKSFLKHPRNKQGQKLAPRMITFWVHA

SEQ ID NO: 36462 - protein, 425 aa, Magnetococcus sp. MC-1
MADKSKNGVANLNEAIRQSLILVLAGGRGSRLKNLTDTEAKPAVPFAGKFRIIDFALSNCVNSGMRRVGVLTQYRAHNLIQHVQRGWGSFRAEFDEFVEVWPAQQQTAAESWYSGTADAVYQNIDLIESHHPKYVVILGGDHIYKQDYSVMLDHHITSGAQVTVACLEVPVAEAREFGVMDVDEQDQIVKFLEKPQTPPELPNRPGWALASMGIYIFDHELLVEQLERDALLEDSSHDFGKDLIPYLVPKVKVMAHRFSHSCVGLDGKKEPYWRDVGTLDAYWEANMDLTHVTPELDLYDPKWPIWTYQVQRPAAKFVFNDDSRRGYAVDSLVSAGCVVSGSAVERSLLFTDVRVNSYSFVSDSVILSHADIGRKCTLIKCIVGPNTVIPDGMVIGKDPQLDAQRFYRTEGGVTLVTQEHIDKLK

SEQ ID NO: 36463 - protein, 380 aa, Solanum tuberosum
MSTTVGQVIRCKAAVAWEAGKPLVMEEVDVAPPQKMEVRLKILYTSLCHTDVYFWEAKGQNPVFPRILGHEAAGIVESVGEGVTELAPGDHVLPVFTGECKDCAHCKSEESNMCSLLRINTDRGVMINDGQSRFSINGKPIYHFVGTSTFSEYTVVHVGCVAKINPLAPLDKVCVLSCGISTGLGATLNVAKPTKGSSVAIFGLGAVGLAAAEGARIAGASRIIGVDLNASRFEQAKKFGVTEFVNPKDYSKPVQEVIAEMTDGGVDRSVECTGHIDAMISAFECVHDGWGVAVLVGVPHKEAVFKTHPMNFLNERTLKGTFFGNYKPRSDIPSVVEKYMNKELELEKFITHTLPFAEINKAFDLMLKGEGLRCIITMED

SEQ ID NO: 36464 - protein, 286 aa, Triticum aestivum
  misc_feature (199)..(199): Xaa can be any naturally occurring amino acid
  misc_feature (207)..(207): Xaa can be any naturally occurring amino acid
  misc_feature (224)..(224): Xaa can be any naturally occurring amino acid
  misc_feature (233)..(233): Xaa can be any naturally occurring amino acid
  misc_feature (240)..(240): Xaa can be any naturally occurring amino acid
  misc_feature (257)..(257): Xaa can be any naturally occurring amino acid
MAAATSHNAIVSTQSHRWNGKNSRLDKRTANVRLVSVGSCCPGSRKLGLVCASGSQSSVIDPVHLPSNGKGDHSPKKSSESSLILIRHGESMWNEKNLFTGCVDVPLTPKGVEEAIEAGKRICNIPIDVIFTSAMIRSQMTAMLAMMQHRRKKVPIITHKESEQAQSWSKIYSEDTKEQPIPVITAWQLNERMYGELQXGLIKQETXDRFGKEQGPEWRRSYQXPPPNGETLXMCADRAXSYFKDQGCPHLHGWKDXMVVGIAKSLRTNIMALKKLLPRKVNGFNC

SEQ ID NO: 36465 - protein, 155 aa, Triticum aestivum
  misc_feature (104)..(104): Xaa can be any naturally occurring amino acid
  misc_feature (119)..(119): Xaa can be any naturally occurring amino acid
MNYGPSDSSGTDDDLPPPYPNNPNNRSIRGSGRASGNGRAIVPVSGNGRAIAPASSYPRAQTDMETQIQQLEQEAYCAVLRAFKAQSDALTWEKEGLITELRKXELRVSDKKHKEVLNXVNGDDIIRSIRKWRSTGGLQASYPISGYHMTRGYPT

SEQ ID NO: 36466 - protein, 344 aa, Ralstonia metallidurans CH34
MTRCFPDGYCRNAGLARPLPVRRTISHDTCSTSHGMSKAMNADNPEPATKSVAAIAPSLKAEILAEALPYIRKFHGKTIVVKYGGNAMTEEKLKHGFARDVILLKLVGMNPVVVHGGGPQIDEALKKVGKVGTFIQGMRVTDEETMEVVEWVLGGEVQQDIVMLINQYGGQAVGLTGKDGGLIRAKRLQMPDRENPGTFIDIGYVGDIEAINPAVVKALQDDAFIPVISPIGFSDDGQAYNINADVVAGKMAEILKAEKLVMMTNIPGVMDKKGNLLTDLSAREIEELFADGTISGGMLPKISSALDAAKSGVHSVHIIDGRIEHSLLLEILTEQAFGTMIRSH

SEQ ID NO: 36467 - protein, 198 aa, Physcomitrella patens subsp. patens
MTKAKKTRKFAQVKRMLAPKAIKQYKDDVLNPKRKDTSLEKLPRNVPNTSSALFFKHNTALGPPYQVLVDTNFINFSIQNKLDLEKAMMDCLYAKCTPCITDCVMAELEKLGQKYRVALRVAKDPRFETLPCTHKGTYADDCIVERVTRNKCYIVATCDRDLKRRIRKIPGVPIMYISQHQYSIERLPEATIGGAPRK

SEQ ID NO: 36468 - protein, 168 aa, Burkholderia pseudomallei K96243
MIQVGDTLPDAQLFEYLDDARAGCTPGPNAFGVREQTAGKRVVIFGLPGAFTPTCSAQHVPGYVAHAEPLRSAGIDEIWCVAVNDAFVMGAWGRDLHTAGKVRMMADGSAAFTHALGLTQDLSARGMGIRSRRYAMVVDDGVVKTLFVEAPGKFEVSDAASVLAGLTR

SEQ ID NO: 36469 - protein, 713 aa, Yarrowia lipolytica CLIB122
MMLTKTLVALVAAALAPHTAAGHAHHAHHDTRDVSSAAYGPAPGHPRLLFDEAELYQKMGILGDRDTVNVTEQELHRRTITKEHTRHSHHEHKKRGGQCAFPTNEGLVSVDPSGENAGWAMSPDQPCEPGKYCPYACPPGQLMGQWDPKATSYSYPLSMNGGMFCNKNGEMEKPFPNKPCCYEGTGTFVARNKCGKQVSFCQTVLPGNEAMLIPTEVGSGSTAVLAVPDTNYWAGTAAHFYINPPGVDTATACVWGTLNNPWGNWSPYVAGANQDGNGNTFVKIAWNPIYLEPATPFRNTLPNWGVRVVCDEGSNCNGLPCSIDPRKNKVNEVTAEDAAQGDGASFCVVTAPKGSKAYIEVFEIGNDGNSGGNGGNGGNSGSSSSSSSAPASSSSAPASSSSAASTGMNTMLAHAAGFAAAGQVENLENVESSSSEEPVSSSEGPTSSPPPPPPTTSSSTPPPPSTTSSSTPPPPPPTTSSSAPPPPPTTSSSAPPPPPTTSSTPPPPPPTTSSTPPPPPPTTSSTPPPPPPTTSTTPPPPPTTSSTSPPPPPSSTYVPPSSSPTSSYVFPSAELAKEMAQLMMFNAESATVVSSTSSTKVSTFSSSKTTSTSSSSSRLSLSSTFKPTIKTVAHLRSHDSAAMNVANNGTVGVASSSSTLAATSVSVQEAPAAPTPPPVTVPQGVATIEVSANTSGSSKLAVPLMTLVLVLLL

SEQ ID NO: 36470 - protein, 382 aa, Methanosarcina acetivorans C2A
MATKRDYYEILGLPKDASVEDIKKTYRKLALQYHPDRNKDPGAEDKFKEISEAYAVLSDTEKRAQYDRFGHAGIDNQYSAEDIFRGADFGGFGDIFEMFFGGGRRGGPMGPRRGSDLQYDLYITFEEAAFGVRKDIDIPRTERCSTCSGTGAKPGTSPKRCPTCGGTGQVRTTRSTLGMQFISTTTCSTCHGRGQIIESPCPVCGGAGRVRNKRTITVNVPAGADSGMSLRLSGEGDSGEPGAPSGDLYIIIHVMEHRHFKRVDYDVISELSITFTQAALGADVMVDTLYGKVKMNIPAGTQTHSVFRLRDKGIQRLHGHGKGDQLVRVIIKTPTKLNQEQKELLRQFENLSKGKKPQEEEKSKAEKHKKGIFEKVKDAFES

SEQ ID NO: 36471 - protein, 156 aa, Prochlorococcus marinus str. AS9601
MISLLLFKNFFFRSTYLLKSFGELSVDPEIAFVNNKPTFLEFYAEWCEVCKETAPQVSAFKDEYEKDINFVFLNVDNQKWGNYIQKFAVNGIPQVNLFDKKGNLISTFIGKQDEIKIRESINNLKKGEKPFEEIINSEFSIIQENKNNEVSPRSHG

SEQ ID NO: 36472 - protein, 187 aa, Fulvimarina pelagi HTCC2506
MFIQTEVTPNPATLKFLPGRVVLEQGTEEFTSIDEAAQRSPLAARLFEVDGVTGVFFGFDFVTVTKDQGDWAHLKPAILAGLMEHFVANRPVMAETSAMNSEPGEEFFDEGDKETVATIKELIETRVRPAVAQDGGDITFRGYRDGIVYLNMRGACSGCPSSTATLKHGIQNLLRHFVPEVEEVEAA

SEQ ID NO: 36473 - protein, 174 aa, Rhizobium etli
ARKPSIVPIVEPECLMDGKPGDHNIDRCAEVTESTLQIVFEELAEARVSLEGMILKPNMVIDGKNARKASVAEVAERTVQVLKRTVPSAVPGIAFLSGGQTTEEATAHLSAINGFDLPWLVTFSYGRALQDSALKAWNGKPENVAAGQREFTHRAEMNSLAAKGSWKKDLEQAA

SEQ ID NO: 36474 - protein, 182 aa, Zea mays
  misc_feature (48)..(48): Xaa can be any naturally occurring amino acid
  misc_feature (82)..(82): Xaa can be any naturally occurring amino acid
  misc_feature (96)..(96): Xaa can be any naturally occurring amino acid
  misc_feature (174)..(174): Xaa can be any naturally occurring amino acid
PAKFPPPPPSFVTCESPPFPPFFPPFSHLSISLAPKSPSPPSFWGGFXIPPPQETPGFWAPPPPPFFVPGPPIFGGGPPIPXFDPGSPGTPSIPAXPPIPWDLGFPGEPPSPLIGGFLGWGGPFGGLFGPAIFPSTFPGFGGSFKKKKTQKKKKKKKKKKKKKKKKKKEKKKKXSRGGPVPN

SEQ ID NO: 36475 - protein, 68 aa, Zea mays
  misc_feature (62)..(63): Xaa can be any naturally occurring amino acid
IRHEGGFIFGPAIALAIGAKFIPLRKPKKLPGDVFSESYVLEYGMDCLEMHVGAIETRERVXXGDDLV

SEQ ID NO: 36476 - protein, 381 aa, Wolinella succinogenes DSM 1740
MPIDLNEHLRKKNRTFNPDENRGEDRNDSEGKGKGGGFGGGGGGGGFQPPFQTPDLFKGMGKKAGFIYALIIAIVLIALTKPFTIINSGEVGIKVTAGKFDNIPLQPGLHFFIPVLQKIILVDTKVRIINFSSTEDMGIRGRSEGILSNDAISVLDARGLPVSIEITVQYKLNPLGAPQTIATWGLTWEQKIINPVVRDVVRNVVGRFPAEELPTRRNEIADMIDTLVRENVDRLDNSPVQLSSIQLREIVLPVKIKEQIERVQVARQEAERTRYEVERARQEAEKQVALAKGEADAKRINAQGLADATLIEAEAQSKANKSIAESLSARLLELRQIEVQGRFNEALKVNQDAKIFLTPGGSTPNLWLDTKDRQKSSSKGE

SEQ ID NO: 36477 - protein, 383 aa, Arabidopsis thaliana
MVAEAEVVFQQSLPAVLEIELFDGVSSAVKSPVSSPKLGFTQSTASVSGSLTTSPVADIFPEGDCDPSVLDYIPTIRSGSFADIGPKRNMEDEHIRIDDLSSQVGSLFELPKPSAFYAVFDGHGGPEAAAYVRENAIRFFFEDEQFPQTSEVSSVYVEEVETSLRNAFLQADLALAEDCSISDSCGTTALTALICGRLLMVANAGDCRAVLCRKGRAIDMSEDHKPINLLERRRVEESGGFITNDGYLNEVLAVTRALGDWDLKLPHGSQSPLISEPEIKQITLTEDDEFLVIGCDGIWDVLTSQEAVSIVRRGLNRHNDPTRCARELVMEALGRNSFDNLTAVVVCFMTMDRGDKPVVPLEKRRCFSLSPEAFCSLRNLLDG

SEQ ID NO: 36478 - protein, 128 aa, Zea mays
VNGGVLFGQGKKADDMGGVGGFDNQGVVVLWGQILKEQEGGFGKLEGTGGGPKHFALAVKEEFPLPPRLIEALEDHVGVPNSRFRGGQKGVAFLGKGPKGGGSGMGRFFFVVALGIFAVIVWFFVKFL

SEQ ID NO: 36479 - protein, 472 aa, Saccharomyces cerevisiae
MGCTVSTQTIGDESDPFLQNKRANDVIEQSLQLEKQRDKNEIKLLLLGAGESGKSTVLKQLKLLHQGGFSHQERLQYAQVIRADAIQSMKILIIQARKLGIQLDCDDPINNKDLFACKRILLKAKALDYINASVAGGSDFLNDYVLKYSERYETRRRVQSTGRAKAAFDEDGNISNVKSDTDRDAETVTQNEDVDRNNSSRINLQDICKDLNQEGDDQMFVRKTSKEIQGQNRRNLIHEDIAKAIRQLWNNDKGIKQCFARSNEFQLEGSAAYYFDNIEKFASPNYVCTDEDILKGRIKTTGITETEFNIGSSKFKVLDAGGQRSERKKWIHCFEGITAVLFVLAMSEYDQMLFEDERVNRMHESIMLFDTLLNSKWFKDTPFILFLNKIDLFEEKVKSMPIRKYFPDYQGRVGDAEAGLKYFEKIFLSLNKTNKPIYVKRTCATDTQTMKFVLSAVTDLIIQQNLKKSGII

SEQ ID NO: 36480 - protein, 284 aa, Zea mays
MAGGPAAVSFLTNIAKVAAGLGAAASLASASLYTVDGGERAVIFDRFRGVLPETVGEGTHFLVPWLQKPFIFDIRTRPHNFSSNSGTKDLQMVNLTLRLLSRPDVQHLPTIFTSLGLEYDDKVLPSIGNEVLKAVVAQFNADQLLTDRPHVSALVRDALIRRAREFNIILDDVAITHLSYGIEFSLAVEKKQVAQQEAERSKFLVAKAEQERRAAIVRAEGESESARLISEATAMAGTGLIELRRIEAAKEIAAELARSPNVAYIPSGENGKMLLGLNATGFGR

SEQ ID NO: 36481 - protein, 513 aa, Pseudomonas fluorescens Pf-5
MTTTPKPLVLMILDGFGHSESHESNAVYAAKKPVLDRLCASMPNGLISGSGMDVGLPDGQMGNSEVGHMNLGAGRVVYQDFTRVTKAIRDGEFFENPTICAAVDKAVDAGKAVHILGLLSDGGVHSHQDHLIAMAELAFKRGAEKIYLHAFLDGRDTPPKSAQSSIELLDETFKTLGKGRIASLIGRYFAMDRDNRWDRVAQAYNLIVDGQGQFNAATAQEGLQAAYAREESDEFVKATTIGEPVKVEDGDAVVFMNFRADRARELTRVFVEDDFKDFERPRQPKLAGFVMLTQYAASIPAPSAFAPGSLENVLGDYLAKNGKTQLRIAETEKYAHVTFFFSGGREEPFPGEERILIPSPKVATYDLQPEMSAPEVTDKIVDAIEHQRYDVIIVNYANGDMVGHSGVFEAAVKAVECLDLCVGRIVDALEKVGGEALITADHGNVEQMSDESTGQAHTAHTTEPVPFIYVGKRALKVREGGVLADVAPTMLKLLGLPKPAEMTGTSILVDPAH

SEQ ID NO: 36482 - protein, 203 aa, Chlorobium tepidum TLS
MLQSGEWAYTEKLKEHFESPKNVLQGNDTSAFDGVGMEGNLQCGDQMMVAIKVDKESEKITDCQWKTYGCASAIASTSILSEMVKGMTLDQAFNISPKEVAKELGGLPENKIHCSVLGDKALRAAINDYFIRNGMSDRVQKVQARTVCQCMNVTDHDIEEAVLEGARTFYELQEHTKISTVCGQCREDAENELQKYIHLHFGS

SEQ ID NO: 36483 - protein, 350 aa, Triticum aestivum
  misc_feature (278)..(278): Xaa can be any naturally occurring amino acid
MDNLPLTTMAGAAASSLEGGGRVVDTYKKALATAASVAAYAMLVRSMARELLPEELRAAVRWGAAFVRARLGAGDKERHTIVIRRHLDAGYNENHLFEAARAYLATKIDPTAMRRLCLARTRYKEPDGSSSWSTLLCMDDGGSTTDTFDGVDFKWTSIETGGDEGKKGKGHRAAPRETLELSFDAEHTEAALERYVPFIMSTAEQLQRRDRALKIFMNEGRSWHGINHHHPATFDTLAMDPALKQAVTDDLDRFLKRKEYYRRIGKAWKRGYLLFGPXSSLVAAMANYLRFNLYDLDLSEVRLNSALQRLLIAMANKSILVIEDIDCCFDAKSREDRTMPVQADDGSSSD

SEQ ID NO: 36484 - protein, 400 aa, Chlorobium tepidum TLS
MPSRQIYFDNNATTPLHPEVKKELVAAMEMYGNPSSMHAFGREARANVEDARHRVAAFMGADESEIVFTGSGSEGNNTVLSLFACGTSQCFPGMKPKIVTTKIEHPCVLETSQCLVHRGVDVSYLDVDAYGKIDLGQLEEYLKSDGVGLVSVMMANNEIGTIQDIPAISALAHQYGALMHTDAVQAFGKIPVDVNELGVDFLTISGHKIYGPKGIGALYVRKGTPYCPFIRGGHQERGRRAGTENTLGIMGLAMAVDMRKIEMAAEAERLRGFREMLREGISARIDDALFNGHPTDSIPNTLNVSFPGAEGESILLYLDLAGIAVSTGSACASGSLDPSHVLLATGVDAERAHGSIRISMGRSTTVEDVEYMLDVLPGIIERIRNMSTAYIKGGPHAAIR

SEQ ID NO: 36485 - protein, 493 aa, Yarrowia lipolytica CLIB122
MRTRQTPRTPVRETASLPDMDSLSLKDDCARAKRFCDFMDTSPTTYHAVHYLSKDLENAGFRPLNERDSWEDEFHTHDKFYVTRNGSSIIAFVVGKDWTPGNGAGVVGTHIDALCAKVKPISKKTPVDGYTLLGAAPYSGAFSDTWWDRDLGIAGRIICRDGNNKVTSKLVHVPYPIARIPTLAPHFGAPANPPFNKETQMTPVIGLTSSKEISEPTEDEKLSPLVGKHSIDLLRTLSKHSGVAVKDMLQMDMELFDTQKAALGGLNQDFIFCPRIDDKVCTYTAVQGFIESVPDMDPRALNIVVCFDNEEVGSNTRQGAQGGLLESVVERVISHGMDASVANLAEEYKRKTYANSFFCSADVNHAVNPNFSNIYLEHHKPQLNYGMTLAVDPNAHMTTDAVSLGFIEEVARRGKNKTQYFQIRNDSRSGGTIGPYISSSTGMRSIDLGIAQLSMHSIRATIGSKDVALGTKFFKNFYELWFGVDEEFNKGGI

SEQ ID NO: 36486 - protein, 501 aa, Arabidopsis thaliana
MSILLYFFFLPVILSLIFMKKFKDSKRNLPPSPPKLPIIGNLHQLRGLFHRCLHDLSKKHGPVLLLRLGFIDMVVISSKEAAEEVLKVHDLECCTRPKTNASSKFSRDGKDIAFAPYGEVSRELRKLSLINFFSTQKVRSFRYIREEENDLMVKKLKESAKKKNTVDLSQTLFYLVGSIIFRATFGQRLDQNKHVNKEKIEELMFEVQKVGSLSSSDIFPAGVGWFMDFVSGRHKTLHKVFVEVDTLLNHVIDGHLKNPEDKTNQDRPDIIDSILETIYKQEQDESFKLTIDHLKGIIQNIYLAGVDTSAITMIWAMAELVKNPRVMKKAQEEIRTCIGIKQKERIEEEDVDKLQYLKLVIKETLRLHPPAPLLLPRETMADIKIQGYDIPRKTILLVNAWSIGRNPELWENPEEFNPERFIDCPMDYKGNSFEMLPFGSGRKICPGIAFGIATVELGLLNLLYYFDWRLAEEDKDIDMEEAGDATIVKKVPLELVPIIHH

SEQ ID NO: 36487 - protein, 1208 aa, Magnaporthe grisea 70-15
MEVRPQARVPPRPVLEEASMRTNYSISQNSATPPNYQHGGLKTENIRPAQPQKTRRDIPVSSSHVPLNPRLYEIREEAQSTPQSKRESQASTASYKSSSSNTFRKPKTHVGPWQLGKTLGKGSSARVRLARHTSTHQYVAVKIVAKSTCKMTQAGSLAKLDEIDSAAPEKVEGMRRMPIALEREVAILKLIEHPNIVKLYDIWENSNEIYLILEYVERGDLFDFISKHGPMPEEEAIFVFRQIMSALEYCHSYGICHRDLKPENILLKSNGQVKIADFGMAALHQGPRTPLWTFCGSPHYAAPELLREKAYRGEKSDIWSMGVILFAMMAARLPFDDEDMNLMFAKARKAIYHMPSFFSDEAKDLIHRLLQVDPRKRLSMRQMWQHPVVWKYGYLDELGGEGIPEVPNPRTRQEIKPLDLCDIDPQILRPIQSMWHTLSEDELVKKLISDDYRERQLENYDPSLTHSPSDYHHIRPPLWLTKVSTRQFMTNKANGQGRSISKFTVISNVTETGTGANLGTVRSYDPYKSPAVKQPQATHARIVIHRDSTDTDRNAASLGSTSHRRPRANSTGSWKRPARRSQLGSRILTPRSTASSVQSSRKFHARSRTSSRQKRAMDFSTARRKAAAAKLSNQQTLLGTDGSKTVTGWNIQCSSDPDIPGDTADSSNARLRSKDRLHEELRHFSSSIAKDCDEAFNSSLLSVSQFDGDRSRQGSPFSLSLGTPVSATPVTPVVTPTIPRPSARPWDSRPLPPTPPSSSHEKESAVNFGENPSILARRGQPPTQGYNLRSGPVAMTPTPSDRRVVSAPVHGGQYGGCATGKLPSIEEATPNTIQDEVNRSRIVSLPAKPVATAPTSNEARGLEFLSNAEQTIRIVHSPSAQRESGITRRPHPIQANAKPSKMVGTSTGPVKQASIDLYHADDSIISHRNAQLAQTSSHGSASTFAMRKKTSSWFKRLSRESKGSKGSLCDELDDTKSIDVPHGLTSGPIKNERDNSSINMSHRPPEKTSNKKKSFFLPFWRHKSEPRMSLAEPDFEESPSPETNAAVKSHKTSGNNLLNFGDAESAERMIKPQQNWLARLFRVKPVTRVICLSISRRRARQEVAILLRDWRKYGIRDVEVDKKRNVVFARLSSKNHLNIKEVALACEIITVIEHGKRNHLSIVRFTQEKGAASSFQRVVDTMRDVLGNRNLLVTDKSKAKMMIKTLNS

SEQ ID NO: 36488 - protein, 399 aa, Azotobacter vinelandii
MAIDIKAPTFPESIADGTVATWHKKPGEPVKRDELIVDIETDKVVMEVLAEADGVIAEIVKNEGDTVLSGELLGKLTEGGAATAAPAAAPAPAAAAPAAAEAPILSPAARKIAEENAIAADSITGTGKGGRVTKEDAVAAAEAKKSAPAGQPAPAATAAPLFAAGDRVEKRVPMTRLRAKVAERLVEAQSSMAMLTTFNEVNMKPVMELRAKYKDLFEKTHNGVRLGFMSFFVKAAVEALKRQPGVNASIDGNDIVYHGYQDIGVAVSSDRGLVVPVLRNAEFMSLAEIEGGINEFGKKAKAGKLTIEEMTGGTFTISNGGVFGSLLSTPIVNPPQTAILGMHKIQERPMAVNGQVVILPMMYLALSYDHRLIDGKEAVTFLVTMKDLLEDPARLLLDV

SEQ ID NO: 36489 - protein, 803 aa, Vibrio cholerae O1 biovar eltor str. N16961
MPTLQAAMFLEKDMQKNTLWFDSLSMQDVDKVGGKNASLGEMVSNLANAGVSVPNGFATTAYAFNQFLDFEGLDERIHQLLDELDVDDVDALRKTGATIRQWILQAPFPAELEQEIRTNYNQLIDGNSELSVAVRSSATAEDLPDASFAGQQETFLNVKGIDAVLEATKHVYASLFNDRAISYRVHQGFDHRGIALSAGIQRMVRSDKAASGVMFTLDTESGFDKVVFITAAWGLGEMVVQGAVNPDEFYVHKPLLEAGYPAIVKKTFGSKLSKMIYANSQVIGKQVEVVDTSAHERNQFSLTDAEIQELAKQALIIEKHYQRPMDIEWAKDGIDGKLYIVQARPETVCSQSEQNVIERYELSHKASVLLEGRAIGQRIGSGTVRLVDSLDQMSLVQQGDVLVTDMTDPDWEPVMKKAAAIVTNRGGRTCHAAIIARELGIPAIVGCGDATRRLSDGAQVTVSCAEGETGYVYAGQLDFAVRRSSVDELPMLPTKVMMNVGNPDRAFDFAQIPNEGVGLARLEFIINKMIGIHPKALLNFDTQSAELQTQILDRIRGYRDPIDFYVSKLTEGIATIAAAFWPKRVIVRMSDFKSNEYSNLLGGSEFEPHEENPMLGFRGASRYISPVFEDCFELETQAIKRVRHEMGLKNVEVMIPFVRTTGEAEAVIDLLAKFGLRRGEQGLKVIMMCELPSNAVLADEFLKFFDGFSIGSNDMTQLTLGLDRDSGDVAHLFDERNPAVKIMLKMAIDAATRAGKYVGICGQGPSDHDDLAQWLMEQGISSVSLNPDTVIDTWLKLGAVSKC

SEQ ID NO: 36490 - protein, 181 aa, Oryza sativa Indica Group
MRGALERARMLVGMEVDEESAPEEQSFFDDVTRNCALTTTQASSIPTPPTQPGSIRVPRSDLRLYGFAICLAAGLTCTFLSMLVFFNPVKFGVTFTLGNLMALGRWGFNLLNYVYINVNLYFNFAMVHSKLLTLLAIILEFGALVWLLLDFPASQVLPECNFGIYLVWLSSTRQTLSVGDN

SEQ ID NO: 36491 - protein, 428 aa, Vibrio cholerae O1 biovar eltor str. N16961
MIKSTPAIIRPTLFFEYSGIQPMSFSSLALSADLIQALPKAITEPSAIQTLVIPAMLTGKDVFALANTGSGKTLAYGLPLLERLKTSPEQQALVLVPTRELAMQVSEVLTHVGTALGLNTLCLCGGVDKTEQQNALAENPNILVATTGRLFDLTQSGLRLNRVTTLVLDEADRLLDMGFWPQVQALASQTAGVRQTVMCSATFSDDLKLKAQQLMRAPTQVSANPENSINQAVQETLYLVNKGSKTQALVALLKQHQWPQVLVFIGAKENADSLTKKLNKAGIVATVLHGDKSQSEREAALAEFKNGTTQVLIATDLLARGIHIELLPVVINFELPMHAETYVHRVGRTARAGQHGIALSLVCHGEMDALNATRTLTQRELPVQNLEGFPVTDQPSTGESKRAPRDKQANRRTQNKKSVKQFQGKSRT

SEQ ID NO: 36492 - protein, 207 aa, Candidatus Protochlamydia amoebophila UWE25
MSHSSHPRPEMSLTPYVIEDTGRGERSMDIYSRLLKDRIIFIGTEITDQVANVVVAQLLFLKMEDPKKDVHIYINSLGGYITSGLAIYDTMQYLGCDINTYCIGQAASMGALLLTAGTKGKRFALPNSRIMIHQPYGGVGGTSADVALQAKEILELKKRLNHIMADSTRQPLEKIAADSERDFYMSAVEAKDYGLIDEVVVPKKKTT

SEQ ID NO: 36493 - protein, 270 aa, Zea mays
  misc_feature (241)..(241): Xaa can be any naturally occurring amino acid
LDPAVRSGIFLNPRVRRYFTACATQAIVSVLLNSPGITLSDELKKLKEFAKDLPPELKGLAIVNCASIRMLNNSFARSEASEEQKPPSGDDDVYHFINYVPVDGVLYELDGLKEGPISLGKCPGGVGDAGWWLRLAQPVIKEHIDLFSQNEIRFSVMAILKNRKEMFTVEIKELQRKREGLLQQMGDPNASRHVEQSLAEVAAQIESVTEKIIMEEEKVKKWKAENLRRKHNYVPFLFNFXLKILEEKQQLKPLIEKAKAKQKSHGPSAR

SEQ ID NO: 36494 - protein, 423 aa, Pseudomonas putida
MGTHVIKMPDIGEGIAQVELVEWFVKVGDIIAEDQVVADVMTDKATVEIPSPVSGKVLALGGQPGEVMAVGSELIRIEVEGSGNHVDVPQAKPAEVPAAPVAAKPEPQKDVKPAAYQASASHEAAPIVPRQPGDKPLASPAVRKRALDAGIELRYVHGSGPAGRILHEDLDAFMSKPQSAAGQTPNGYARRTDSEQVPVIGLRRKIAQRMQDAKRRVAHFSYVEEIDVTALEALRQQLNSKHGDSRGKLTLLPFLVRALVVALRDFPQINATYDDEAQIITRHGAVHVGIATQGDNGLMVPVLRHAEAGSLWANAGEISRLANAARNNKASREELSGSTITLTSLGALGGIVSTPVVNTPEVAIVGVNRMVERPVVIDGQIVVRKMMNLSSSFDHRVVDGMDAALFIQAVRGLLEQPACLFVE

SEQ ID NO: 36495 - protein, 257 aa, Bacillus subtilis
MRTKKRTKEMLPIFDQKKVAFIGAGSMAEGMISGIVRANKIPKQNICVTNRSNTERLAELELQYGIKGASPNQICIEDMDVLILAMKPKDAESALSSLKTRIQPHQLILSVLAGITTSFIEQSLLNQQPVVRVMPNTSSMIGASATAIALGKYVSEDLQKLAEALLGCMGEVYTIQENQMDIFTGIAGSGPAYFYYLMEFIEKTGEEAGLDKQLSRSIGAQTLLGAAKMLMETGEQPEVLRDNITSPNGTTAAGLQA

SEQ ID NO: 36496 - protein, 452 aa, Arabidopsis thaliana
MYLSGPSHCHQSYTDEFSSSIPYKRTSNARNRVFDGCGSANLSVLSSRCKIPFFGSAFHVSSGGHDLGLTKVSVAADYSDSVPDSSFYGYHPLEDLKPSKRVQETKLSASEVARTTVEANSSAVLVFPGAIHCEPHDHNSWSEFKYVIDDYGDIFFEIPDDENILEDPGASNPVKAFFGMDVPRYENTRHHEEYNISDIGNLDQIIFDDHYFEIMDSEARDIPIDWGMPDTSNGVHPIYFAKHLSKAISMDYDRKMDYPSNGVSILGCLRPAFLDEESYIRRLFLSEDRDDYSWEVQGDDNPITSSRRDENDMSSSLYRLEIVGIELLSLYGAESSISLQDFQDAEPDILVHSTSAIIERFNNRGINSSIALKALCKKKGLHAEEANLISVDSLGMDVRVFAGAQVQTHRFPFKTRATTEMAAEKKIHQLLFPRSRRRKLKCHDESLKDAFR

SEQ ID NO: 36497 - protein, 914 aa, Oryza sativa Indica Group
MSGGGPPKKRNFKIELFKHRVELEPKYAERTWKVLEHAIHEIYNHNASGLSFEELYRSAYNMVLHKYGEKLYDGLERTMTWRLKEISKSIEAAQGGLFLEELNAKWMDHNKALQMIRDILMYMDRTYVPQSRRTPVHELGLNLWRDHIIHSPMIHSRLLDTLLDLIHRERMGEMINRGLMRSITKMLMDLGAAVYQDDFEKPFLDVTASFYSGESQEFIECCDCGNYLKKSERRLNEEMERVSHYLDAGTEAKITSVVEKEMIANHMHRLVHMENSGLVNMLVDDKYDDLARMYNLFRRVFDGLSTIRDVMTSYLRETGKQLVTDPERLKDPVEFVQRLLNEKDKHDKIINVAFGNDKTFQNALNSSFEYFINLNNRSPEFISLYVDDKLRKGLKGATEEDVEVILDKVMMLFRYLQEKDVFEKYYKQHLAKRLLSGKTVSDDAERSMIVKLKTECGYQFTSKLEGMFTDMKTSQDTMIDFYAKKSEELGDGPTLDVHILTTGSWPTQPCPPCNLPTEILAICDKFRTYYLGTHSGRRLTWQTNMGTADIKATFGKGQKHELNVSTYQMCVLMLFNSTDGLTYKDIEQDTAIPASDLKRCLQSLACVKGKNVLRKEPMSKDISEDDTFYFNDKFTSKLVKVKIGTVVAQKESEPEKQETRQRVEEDRKPQIEAAIVRIMKSRRVLDHNSIVAERARNETHPPPYMSGCPRLKTSVLRSQLDRFESGNRDMEPPTQAQLEAEVEGNYCRSGVPEGRRAFAMKRHLYTYAHASNMIVQNRFGVWSHRDQGYIRRTRYFKFVKIGWGLSRLRRVCQQHGVFAWYQCTPRREELEAAEAGVRRLFSRHTPAWMKKQKRLQRRERERDERRLNKQKRPLALKQQQLKAQAPMTRAVLLFAYVYACVVKLCCYLRRIIRA

SEQ ID NO: 36498 - protein, 483 aa, Synechocystis sp. PCC 6803
MVAVKEATNVGKITQVIGPVIDAQFPSGKLPRIYNALKVQGRNSAGNEVAVTCEVQQLLGDNQVRAVAMSSTDGLVRGMDVVDTGAPISVPVGTGTLGRIFNVLGEPVDNKGPVPAGETFPIHRPAPKLVDLETKPQVFETGIKVIDLLTPYRQGGKIGLFGGAGVGKTVIMMELINNIAIQHGGVSVFGGVGERTREGNDLYNEMIESNVINADKPEESKIALVYGQMNEPPGARMRVGLTALTMAEYFRDVNKQDVLLFIDNIFRFVQAGSEVSALLGRMPSAVGYQPTLGTDVGDLQERITSTKEGSITSIQAVYVPADDLTDPAPATTFAHLDGTTVLSRGLAAKGIYPAVDPLDSTSTMLQPSIVGSEHYDTAREVQSTLQRYKELQDIIAILGLDELSEEDRLTVDRARKIERFLSQPFFVAEVFTGAPGKYVSLADTIKGFKAILAGELDDLPEQAFYLVGDIEEAKAKGAKLKEG

SEQ ID NO: 36499 - protein, 258 aa, Schizosaccharomyces pombe 972h-
MLAPTAAVNVTNEGENGMFSPKFSLNYSLTTVSDNVMIDTTRGEIEFSDSAVNGTMDIEGAPKFAPAKTSAEKKRGAKPQMRRVPIPPHRMTPLRNVWPKLYPPLVEHLLLQVRMNTKSRSVELRESKATKDPGALQKGMDFVQAFALGFDIDDAIALLRLDDLYIDTFEIKDVKTLQGDHLSRAIGRIAGQGGKTKFAIENASRTRIVLADSKIHILGGFTNIRIAKDAVVSLILGSPPGKVYANLRNAAARAKERI

SEQ ID NO: 36500 - protein, 399 aa, Mycobacterium sp. MCS
MTSRMNGISSLDAGVMVGALIGGDGVESRPGPGHAPLTKPVRLPPARLARIVETLRTALHRVRFKVVPPFAGILDLTMGFAVAQAIYAAARLGVADVLRDGPMTAADVADRVHADPSAVHRLMRVLAAHQIFRERRDGPFEMTALSQALCSDAAVSIRPLLLMLSHPFYWQHFGRLTDVVRTGRTSLETEYGKGLFECLDEDPEVARVFNDAMSCVTAMSIPPVLAAYDFSRFRTIIDVGGGDGHMLTAILEVATASRGVLFELPALAEQARETVRSVGLTDRATIESGSFFDHVPRGGDLYVLKHVIHDWRDDRAREILRHVRDAMSPRAVLLLVETVIPPGNGMHFGKLLDLDMLIFAGGRERTRAEFSSLLFETGFHLDRIVPTVTHLSLIEATAC

SEQ ID NO: 36501 - protein, 361 aa, Schizosaccharomyces pombe 972h-
MNSHELIEESNNSGTPATKSSSKPTKKIRPRNDLVHYSKALSKVLRHTAKANGLQIREDGYIEVDSILKLPQFRGMGMELLLSIVKGNDKKRFTMEEVEGVLYIRANQGHSIKAVQVPMARIDNASSIPKVVHGTKKELWPVISKQGLSRMKRNHIHCATGLYGDPGVISGIRKSCTLYIYIDSAKAMQDGVEFYRSENGVILTEGVNGLLSSKYFSRVETSDGEVLLDAKASPKNNRSDESDQSDPESIDPFCDNLQALSMHELELLEEKHSNFGYSEGIIKGKMQVAQSGFDDGFKHGSRLGFQMGKTIGTLKAKLYIFEENEQMEILKQELDRLQESAEFHIFVANHKEEILKCIREK

SEQ ID NO: 36502 - protein, 199 aa, Schizosaccharomyces pombe 972h-
MSLFSTSLWTTTVMSIIVGLYMLFHNSGESFDFGSFLLDTSPYTWGLLGIASCVAFGIIGAAWGIFICGTSILGGAVKAPRIKTKNLISIIFCEVVAIYSLIIAIVFSAKINDINPAGFYTKSHYYTGFALFWGGITVGLCNLICGVCVGITGSSAALADAQDASLFVKVLVVEIFGSVLGLFGLIVGLLIGGKASDFS

SEQ ID NO: 36503 - protein, 359 aa, Triticum aestivum
  misc_feature (193)..(193): Xaa can be any naturally occurring amino acid
MAVDLTPRQPAKAYGGDGGAYYEWSPAELPMLGVASIGAAKLSLAAGGMSLPSYSDSAKVAYVLQGKGTCGIVLPEATKEKVVAVKEGDALALPFGVVTWWHNTPESATELVVLFLGDTSKGHRPGQFTNFQLTGSSGIFTGFSTEFVGRAWDLKEDDAAKLVSSQPASGIVKLTAGQKLPVPVDADRKDMAXLNCLEAKLDVDIPNGGRVVVLNTANLPLVKEVGLGADLVRIDAHSMCSPGFSCDSAYQVTYIVRGSGRVQVVGPDGKRVLETRIEGGSLFIVPRFHVVSKIADASGMEWFSIITTPNPIFSHLAGKTSVWKAISPEVLEASFNTTPEMEKLFRSKRLDSEIFFAPN

SEQ ID NO: 36504 - protein, 156 aa, Wolinella succinogenes DSM 1740
METRRIISVTVINEHGVLSRISGLFAGRGYNIESLTVAPLPESDLSKITISTYGDERVLEQIIKQLHKLIPVLTVVEHNEMVEKEMAMVKLPLETNLAELEALCRAYHGEITSTNDKYVIVMATDNPTRITHFLHAIKRFHPKDMIRSGVVAMERL

SEQ ID NO: 36505 - protein, 428 aa, Propionibacterium acnes KPA171202
MVVMADKSVPTSDHIRDIISFVEASPTSYHAVAELTRRLEQAGFQRLEETESWPSVEGRRYVVRDGAVIAWITPEKVTPQLGARIVGSHTDSPSFKLKPNATVTNQGWQQVGMEVYGGGLLNSWLDRDLGLSGRLVTCDGQAHLVRTGPILRISQLAPHLDRTVNDDLKLDRQRHLMPILSVGKPDLDVEDLLCEAAGIKRDELAFHDVFAHLTQSPAVIGPYGEFLASQRMDNLSSVHSSVAAFVDVKPTSDVAVMACFDHEEVGSATRSGACGPFLEDVLVRIAEGFGMTGAAYRAMIAKSSCVSSDAGHGVHPNYVEKFDPANHPLLNEGPLLKINAHQRYATDGVGGALWQRACAAAGVPTQNFVSNNSVPCGSTIGPLTATRLGMLTVDVGVPLMSMHSTRELAGTADLTYLSKALGAYWAGA

SEQ ID NO: 36506 - protein, 625 aa, Leuconostoc mesenteroides subsp. mesenteroides ATCC 8293
MKQFRVDNLKSTYGEKVLFNDISFLITEGDRIGLIGVNGSGKTSLLNAISGKKPADAGTITKQNDYTIGYLAQDPYLDDHSLLMDAILSGDQPVFQTIRQYEYTLRKYGEQPTDEKVAQNFEKAQDAMDRDDAWTTESQVKTILTQLHMPELHKKVSELSGGQRKRVGLAQVLIQEPDLLILDEPTNHLDFDSISWLEKYLAAYKGAVLVVTHDRYFLDAVTTRIFELSFGDLYEYQGNYQDYMSGKSQRIEQGKVAEHKQQQLYKQELAWMRKSARARTTKQKGRENAFAELEANMGTLQLDEDVAVNLGQQRLGKKVIVIEDATIQFDNKKIFENFNLRVSSGDRIGITGANGAGKSTFLNAIAGRVPLTSGIIELGETVKMAYYTQVTEEIPDDKRVIAYLSDVATTVKDKDGNQISVSDLLEQFLFPPFMHGTLIRQLSGGEKRRLYLLKLLLQQPNVLLLDEPTNDLDIGTLTVLEDFLSGFAGAVITVSHDRYFLDKVANQLYMFEGDGVIKRFDGLFSDYLAMDLAKSAPAQKEEKVVDDKKPQKKKLTYNEKKEWQTIEDDIASIEQRISEIPEEMAQNGTNYVLLGDLQKELDSLNEDLEEKMNRWEYLSEIVEGL

SEQ ID NO: 36507 - protein, 515 aa, Solanum lycopersicum
MEGFCFQWLCVILFLYVLLLCIQKAFVHLWWTPKIIQKHFKKQGITGPKYHFLFGNLKEIASFTTPSWPSTFTSHDILPNVLPFYHHWKKIYGSIFVIWFGPTARVTISDPALIRDIFVLKSDNFEKNESPALVKKLEGDGLLSLKGEKWAHHRKIITPTFYIENLRLMIPMMGKSMKEMLDKWSKMSNASGKVEIEVSEMFSTLAEDVITRIVFGNSYEDGKAIFELQAQQMIYATEAYQKVFIPGYRFLPSKKNRICWRLDKQVRKSLMKLIEERRKKEEVLSEECPNDLLEVMIKAGSDDEYRNTITVNDIVEECKTIFFAGKHTTSNLLTWTTILLAMHPKWQELARDEVLTVCGARDPPSKQQISKLKTLGMIINESVRLYPPAVAAIRRAKVDTQLGDFTLPRGTELLIPIIAIHHDQTLWGQDANEFNPARFGLGVAQAAKHPMAFMPFGLGARRCVGQNLAVLQAKLAIAMILQRFSFDLSPNYRHAPTILMLLCPQYGAPIIFQKL

SEQ ID NO: 36508 - protein, 520 aa, Mycobacterium smegmatis str. MC2 155
MASESPRPVLVIDYGAQYAQLIARRVREARVYSEVVPHTAGVEEIKAKDPQAIVLSGGPASVYSEGAPQLDPGLFDLDVPVFGICYGFQAMAQALGGTVERTGTSEFGRTELQVTGGDLHSELPATQPVWMSHGDAVTAAPEGFDVVASSAGAPVAGFENRARRLAGVQYHPEVLHSPHGQQVLSRFLHDFAGIDATWTPANIADQLIEAVREQIGDGRAICGLSGGVDSAVAAALVQRAIGDRLTCVFVDHGLLRAGERAQVQRDFVAATGAKLVTVDVADRFLEALTGVTNPEGKRKIIGREFIRAFEGAVRDLVEDEGSGDIDFLVQGTLYPDVVESGGGSGTANIKSHHNVGGLPDDLKFKLVEPLRLLFKDEVRAVGRELGLPEEIVARQPFPGPGLGIRIVGEVTAERLETLRRADAIAREELTAAGLDNQIWQCPVVLLADVRSVGVQGDGRTYGHPIVLRPVSSEDAMTADWTRVPYEVLERISTRITNEVREVNRVVLDITSKPPGTIEWE

SEQ ID NO: 36509 - protein, 357 aa, Propionibacterium acnes KPA171202
MALTIGIVGLPNAGKSTLFNALTKNDVLAANYPFATIEPNVGVVGVPDKRLDVLTEMFHSAKTIPATVSFVDIAGIVKGASKGEGMGNEFLSNIREADAICQVTRCFADDDVTHVNGHVDPSDDIETITTELVLADLQTMEKQLPKLQKEAAIKKESRPKVEAWEQAKAVLEEGKTIFSAGLDPEPLHDLFLLTTKPFIYVFNCDQDQLADADFQAKMEKLVAPAEAIFLDAEFEAELAEMEPEDAAEFLADAGIEEPGLDKLARVGFDTLGLQTFLTAGEKESRAWTIHKGDTAPEAAGVIHTDFQKGFIKAQVVSFGDLVEFGGEKEAQAAGKLRLEGKEYVMQDGDVVEFRFNV

SEQ ID NO: 36510 - protein, 555 aa, Solanum lycopersicum
MENLLKIIGVILLLSILMIRVFGYLWLRPRKIEKHFAKQGIRGPPYKFFIGNAKEIVSLMLKASSQTMPLSHNILPRVLSFYHHWKKIYGATFLVWFGPTPRLAVADPDLIREIFTTKSEFYEKNEAHPLIKQLEGDGLLSLKGEKWAHHRKIITPTFHMENLKLLVPGAASKVIEMLDKLTPNLKNGEIEIEVSEWFQTLTEDIVAQTAFGHSYEQGKAIFRLQAQQMVLAAEAFQKVFIPGYRFLPTKRNIKSWKLDTEVKKLLMRLIQERTDNWDKNEMQENNGPKDLLGLMIQASIKESLQLSSSINSPIHHNSSTHNHNHNHNNNHNNNPSMITPNDIAEECKTFFFAGEQTTSNLLTWTTVLLAMHPQWQDLARDEVIKVCGSRAIPSKDDLAKLKMLSMILNESLRLYPPIVATIRRAKAMWISEDAKIPLGTEVLIPILAIHHDQAIWGNDANEFNPSRFSEGVARAAKHPVGYIPFGLGVRQCIGQNLAILQTKLTLAIILQRYVLRLSPQYKHAPTVLMLLHPQYGAPVIFKQRLTHDPTFDKSS

SEQ ID NO: 36511 - protein, 80 aa, Glycine max
  misc_feature (17)..(17): Xaa can be any naturally occurring amino acid
  misc_feature (31)..(31): Xaa can be any naturally occurring amino acid
  misc_feature (52)..(52): Xaa can be any naturally occurring amino acid
  misc_feature (57)..(57): Xaa can be any naturally occurring amino acid
SQTDTTVNRTDAGAIAXLTGLKSMAGLRTRXTNTDITFIASNCGRTQCMQVXSPIGXKKSETSFYLPDLDDAQLAKEVEY

SEQ ID NO: 36512 - protein, 384 aa, Magnaporthe grisea 70-15
MSTNDIKLPEPFASIPRETFLFGPSPIQHLERISEALGGKVNVYAKRDDCNSGLAYGGNKTRKLEYLAAEAKAQGADTLVSIGGVQSNHTRQVAAVSTKLGLKAVLVQEHWVPDWSDPVYGKVGNIQLSRLMGADVKLDPSGRRERRPYAIPAGASDHPLGGLGFARWAFEVEEQERQMGVFFDTVIVCAVTGSTMAGMVAGFKLAQKKCGSKPRRVIGIDASATVPQTKEQVLRIAQVTGRKIGLEDGVDNVTTEDVELDDRYHAGIYGVPDQQTKDAIRFGASTEAFITDPVYEGKSLAGMMDMIRKGEIKPGSNVLYAHLGGQLALNAYSDIFIVHRRQSSLGNPMANPWPKHAMHLAEYSPANTWWWSKATMCGCKKHTL

SEQ ID NO: 36513 - protein, 140 aa, Chlorobium tepidum TLS
MERTLTILKPDCVRKQLIGAVTNMIERAGFRIVAMKKTRLTKETAGAFYAVHKERPFYGELVEFMSSGPCVPMILEKENAVADFRTLIGATDPAQADEGTIRKLYADSKGENIIHGSDSAENAAIESAFFFAAEEVVRVD

SEQ ID NO: 36514 - protein, 540 aa, Zea mays
MGLGVDAETVRLGVLSSTSDHASVVSNNFFVALLCACIVLGHLLEENRMVNESITALLVGLGTGTVILMISRGVSIHVLVFSEDLFFIYLLPPIIFNAGFQVKKKQFFRNFITIILFGAIGTLISFVIISLGAMGLFKKLDVGPLELGDYLAIGAIFSATDSVCTLQVLNQDETPLLYSLVFGEGVVNDATSIVVFNALQNFDITHINAEVVFHLLGNFLYLFLLSTVLGVATGLISALVIKKIYFGRHSTDREVALMMLMAYLSYMLAELFALSGILTVFFGCIVMSHYTWHNVTESSRITTKHAFATLSFLAETFIFLYVGMDALDIEKWRSVSDTPGKSIAISSILMGLVMLGRAAFVFPLSFLSNLAKKNEHEKISWKQQVVIWWSGLMRGAVSMALAYNKFTRAGHTEVRGNEIMITSTITVVLFSTVVFGLLTKPLIRLLMPHRHLTMLSDDSTPKSLHSPLLTSQLGSSIEEPTQIPRPTNIRGEFTTMTRTVHRYWRKFDDKFMRPMFGGRGFVPFVPGSPTERNPHDLSKP

SEQ ID NO: 36515 - protein, 141 aa, Oryza sativa Indica Group
MGGATSPAAPCLSVCLLPLLFLFLHGCWSCVAIERERTLAMIKPDGLSGNYTERIKEVILESGFDIVKEAVVQLDAERASLFYAEHSGRSFFDSLVKYMTSGPVLVMILERPDAISHWRVLIGPTDARKAKISNPNRYCGT

SEQ ID NO: 36516 - protein, 489 aa, Gibberella zeae PH-1
MALADKLDVRRIAIIGAGPSGLAAAKYLLAEKKFSKVRIFEQRATAGGVWNYTPLAREQGFSVPRTQPSYAADQALWPNDHGDVEFMSPIYDLLETNIPHSLMRYSDKEFPKGSSLFPRHSVVLQYLKDYAQEITPHISFQTQVLNIDKPRSDHSQSWSVEVLDLKSNKVIKEEYDAVVVASGHYNDPFIPDITGLTEFDKKYSGVISHSKFYRRPNDFKDKKVIVVGNSASGVDVSAQLSNVAKHPIFISEKEKSTVVAPTKEPWAAGVPEIVEFLPEQRGVRFANGQVENDIDAVIFCTGFHYSYPFLKSLDPPVVVPSGGHAAHLWEHILYTADPTLSFLSVPQRIVPFPVAEAQSAVIARIWSGRLSPPSEAMMEAWVEEQHEKKGEGKAIHVMAFPEDVDYVNRLHGLSKAAPRAPELGLENEGQGKLPPYWGLDKRWVRERVPKIKLASRAAGEKRHELRRLEDLGFDYEEWKRTVEEGERLF

SEQ ID NO: 36517 - protein, 296 aa, Saccharomyces cerevisiae
QQEKEFLESYPQNCPPDALPGTPGNLDSAQEKALAELRKLLEDAGFIERLDDSTLLRFLRARKFDVQLAKEMFENCEKWRKDYGTDTILQDFHYDEKPLIAKFYPQYYHKTDKDGRPVYFEELGAVNLHEMNKVTSEERMLKNLVWEYESVVQYRLPACSRAAGHLVETSCTIMDLKGISISSAYSVMSYVREASYISQNYYPERMGKFYIINAPFGFSTAFRLFKPFLDPVTVSKIFILGSSYQKELLKQIPAENLPVKFGGKSEVDESKGGLYLSDIGPWRDPKYIGPEGEAPE

SEQ ID NO: 36518 - protein, 457 aa, Prochlorococcus marinus str. NATL2A
MVLTPLVSALNTHDVEVAETLIGVINFLMIFVAARTLAEILVRLSLPTIVGELLAGVLIGASGLHLLLPPSAHAELNQGFVSVISTLASVPKEAVPDIYFETFPSLQAVATLGLYALLFLTGLESELEELVAVGAQAFTVAMAGVILPFAFGTFGLMFIFQVDIIPAIFAGASMTATSIGITASVFGELGYLKTREGQIVIGAAVLDDILGIVILAVVVALATGGSLQIAPIVKLVLAATVFVFAAIALSRTAAPAFDWLLERLKAPGAVVVASFVILVLSCFVATAIGLEAALGAFAAGLILSSSKNNHAIQQSVLPLVSLFATIFFVLVGAGMDLSVINPLDPQSRSALIVAGFLFIVAIVGKIAAGWCFVIDKPTNRLVVGLGMMPRGEVGLIFLGLGTSAGLLTPSLEAAILLMVIGTTFLAPVLLRVVLKDKPPSGGNSIPDEIAADPVGLV

SEQ ID NO: 36519 - protein, 344 aa, Microcystis aeruginosa PCC 7806
MTKVRVAINGFGRIGRLVFRAGIQNPDFEFVGINDLVPPDSIAYLLKYDSTHGRFQGTVEAKEDGIVVDGKFIPCYSIKDPAQLPWGATGADYVVESTGLFTTAEGAGKHLEAGAKRVVISAPTKDPDKIRTIVLGVNDNEYDPAKDLIVSNASCTTNCLAPITKVINDNFGLAEGLMTTVHSMTATQPTVDGPSKKDWRGGRGAGQNIIPSSTGAAKAVTLVIPSLKGKLTGMAFRVPTPNVSAVDLTFKTEKATSYEEICAAMKAASEGPMKGILGYTDEEVVSSDFITDPRSSIFDAKAGIQLNANFFKVVSWYDNEWGYSCRMLDLMKMMAAKEATLVTA

SEQ ID NO: 36520 - protein, 445 aa, Saccharomyces cerevisiae
MDDKVSEKESSPKQTEEDSEGKMAHVQPASYVNKKKYVFGKTLGAGTFGVVRVRKNTETGEDVAVKIVIKKALKGNKVQLEALYDELDILQRLHHPNIVAFKDWFESKDKFYIITQLAKGGELFDRILKKGKFTEEDAVRILVEILSAVKYMHSQNIVHRDLKPENLLYIDKSDESPLVVADFGIAKTLKSDEELLYKAGTALGYVAPEVLTQDGHGKPCDIWSIGVITYTLLCGYATIDRKVQDFLDECTTGEYPVKFHRPYWDSVSNQAKQFILKALNLDPSKRPTAAELLEDPWIICTELKTHNLLPGLKEGLDARQKFRNSVERVRLNMKIQKLRDLYLEQTESDSDFDEGSQANGSVPPLKATDTSQLSKKLSEEEQSKLKSELTSKAFAQLVNTVLAEKEKFLNINRVCSSDSDLPGSDIKSLDEAKEKPEGKDTKTEE

SEQ ID NO: 36521 - protein, 502 aa, Vibrio sp. Ex25
MSGWLAITNRKNKERTMTFINNVQAEKSLYIAGEWQSGMDTIANINPSDISENIGDFAQASVSQVEQAIQAAKSAQPEWEKTPIERKQAVLQAIGDELIARCDELGTLLSREEGKPFAEGRGEIYRAGQFFQYFAAEVLRQIGDNAASVRPGVSVEVTREAVGVIAIISPWNFPTATAAWKIAPALAFGNSVVWKPANLTPASAVALTEIIHRQGLPAGTFNLVLGSGSQVGNTLINSKDVNGVSFTGSVDTGRKVAAATAPNFVRCQLEMGSKNALVVADDADIQIAVEATIAGSFSGAGQKCTASSRLVVMDGIHDAYVEALIKRMSELKVGHALEEGVFMGPVVDGNQLNANFEWIENARQAGAELAFGGERLSLEHDGYYMSPTLFLNTQNNWEVNQEEVFAPMASVIRVSDLDEAIAVANDTRFGLTGGIITQSLRNSAIFKQQVQTGCVMVNLPTAGTDYHVPFGGRKESSFGPREQGQYAKEFYTVVKTAYQRPY

SEQ ID NO: 36522 - protein, 638 aa, Azotobacter vinelandii
MSEIIRVPDIGGDGEVIELLVKTGDLIEVEQGLVVLESAKASMEVPSPKAGVVKSVSVKLGDKLKEGDAIIELEPAAGAAAAPAEAAAVPAAPTQAVDEAEAPSPGASATPAPAAASQEVRVPDIGSAGKARVIEVLVKAGDQVQAEQSLIVLESDKASMEIPSPASGVVESVAIQLNAEVGTGDLILTLRTTGAQAQPTAPAAAAAASPAPAPLAPAAAGPQEVKVPDIGSAGKARVIEVLVKAGDQVQAEQSLIVLESDKASMEIPSPAAGVVESVAVQLNAEVGTGDQILTLRVAGAAPSGPRARGSPGQAAAAPGAAPAPAPVGAPSRNGAKVHAGPAVRQLAREFGVELAAINSTGPRGRILKEDVQAYVKAMMQKAKEAPAAGAASGAGIPPIPPVDFAKYGEIEEVPMTRLMQIGATNLHRSWLNVPHVTQFESADITELEAFRVAQKAVAEKAGVKLTVLPLLLKACAYLLKELPDFNSSLAPSGQALIRKKYVHIGFAVDTPDGLLVPVIRNVDQKSLLQLAAEAAELAEKARSKKLGADAMQGACFTISSLGHIGGTAFTPIVNAPEVAILGVSKASMQPVWDGKAFQPRLMLPLSLSYDHRVINGAAAARFTKRLGDLLADIRAILL

SEQ ID NO: 36523 - protein, 447 aa, Saccharomyces cerevisiae
MPKESEVINSEFHVDVQDPERLNGHPVAKFINKLSGQPESYVNRTNYIFGRTLGAGSFGVVRQARKLSTNEDVAIKILLKKALQGNNVQLQMLYEELSILQKLSHPNIVSFKDWFESKDKFYIVTQLATGGELFDRILSRGKFTEVDAVEIIVQILGAVEYMHSKNVVHRDLKPENVLYVDKSENSPLVIADFGIAKQLKGEEDLIYKAAGSLGYVAPEVLTQDGHGKPCDIWSIGVITYTLLCGYSPFIAESVEGFMEECTASRYPVTFHMPYWDNISIDAKRFILKALRLNPADRPTATELLDDPWITSKRVETSNILPDVKKGFSLRKKLRDAIEIVKLNNRIKRLRNMYSLGDDGDNDIEENSLNESLLDGVTHSLDDLRLQSQKKGGELTEEQMKLKSALTKDAFVQIVKAATKNKHKVLAGEEEDDSKKTLHDDRESKSED

SEQ ID NO: 36524 - protein, 332 aa, Pseudomonas syringae pv. syringae B728a
MGLLVEGHWQDQWYESSKDGAFQRENAQRRSWVTPDGQPGPSGAGGFAAQAGRYHLYVSLACPWAHRTLILRKLKGLESLIDVSVVSWLMLENGWTFDQQKGSSGDALDDLQFLHQRYTADDPRYTGRVTVPVLWDKQQQCIVSNESAEIIRMFNSAFDELTGNTLDFYPQALRASIDELNEQIYPKVNNGVYRAGFATSQGAYEEAFDDVFAELDVLENLLGEKRYLTGKHLTEADIRLFTTIVRFDAVYYSHFKCNLRRIADYPNLSNWLRELYQWPGIAETVSFEHIKGHYYGSHRTINPTGIIPKGPALDLQADHDRERLSGEGVWNN

SEQ ID NO: 36525 - protein, 428 aa, Geobacillus stearothermophilus
MAFEFKLPDIGEGIHEGEIVKWFVKPGDEVNEDDVLCEVQNDKAVVEIPSPVKGKVLEILVPEGTVATVGQTLITLDAPGYENMTFKGQEQEEAKKEEKTETVSKEEKVDAVAPNAPAAEAEAGPNRRVIAMPSVRKYAREKGVDIRLVQGTGKNGRVLKEDIDAFLAGGAKPAPAAAEEKAAPAAAKPATTEGEFPETREKMSGIRRAIAKAMVHSKHTAPHVTLMDEADVTKLVAHRKKFKAIAAEKGIKLTFLPYVVKALVSALREYPVLNTSIDDETEEIIQKHYYNIGIAADTDRGLLVPVIKHADRKPIFALAQEINELAEKARDGKLTPGEMKGASCTITNIGSAGGQWFTPVINHPEVAILGIGRIAEKPIVRDGEIVAAPMLALSLSFDHRMIDGATAQKALNHIKRLLSDPELLLMEA

SEQ ID NO: 36526 - protein, 401 aa, Nicotiana plumbaginifolia
NGLSPDMIYRYSRHLLLPSFGVQGQANLLKSSVLVIGAGGLGSPALLYLAACGVGRIGIVDHDVVELNNLQRQIIHTEAYIGKSKVKSAAAACRSINSSTQIVEHKEAFRTSNALEIVSKYDVVVDATDNAPSRYMINDCCFVLGKPLISGAALGLEGQLTVYNYNGGPCYRCLFPTPPPTNACQRCADSGVLGVVPGVIGCLQALEAIKVASLVGEPLSGRMLLFDALSGRIRIVKIRGRSLQCEACGEHSSIDKQTFPDFDYEKFTQTPLSTGPLRLNLLSQDARISYNDRVTKGEKHVLVDVRPAHHYKIVSLPNSVNIPLSTLEGRLAEISAALEKEADKETFDSGSGASLHTICRRGNDSQRAVQLLHKAGFTSAKDIIGGLESWAHNVDPKFPTY

SEQ ID NO: 36527 - protein, 449 aa, Clostridium symbiosum
SKYVDRVIAEVEKKYADEPEFVQTVEEVLSSLGPVVDAHPEYEEVALLERMVIPERVIEFRVPWEDDNGKVHVNTGYRVQFNGAIGPYLGGLRFAPSVNLSIMKFLGFEQAFKDSLTTLPMGGAKGGSDFDPNGKSDREVMRFCQAFMTELYRHIGPDIDVPAGDLGVGAREIGYMYGQYRKIVGGFYNGVLTGKARSFGGSLVRPEATGYGSVYYVEAVMKHENDTLVGKTVALAGFGNVAWGAAKKLAELGAKAVTLSGPDGYIYDPEGITTEEKINYMLEMRASGRNKVQDYADKFGVQFFPGEKPWGQKVDIIMPCATQNDVDLEQAKKIVANNVKYYIEVANMPTTNEALRFLMQQPNMVVAPSKAVNAGGVLVVGFEMSQNSERLSWTAEEVDSKLHQVMTDIHDGSAAAAERYGLGYNLVAGANIVGFQKIADAMMAQGIAW

SEQ ID NO: 36528 - protein, 230 aa, Oryza sativa Indica Group
MGSGSGSFLKVVVKNLDVLAGPIVSLAYPLYASVRAIETKSAVDDQQWLTYWVLYSFITLFELTFSPVLEWLPLWSYAKLFFNCWLVLPYFNGAAHVYEHFVRPLVVNQQIVNIWYIPRKDESDRPDDVISAAQRYIEQNGSQAFESLVNKFKASNTRRSILEEVEAERRAKAELEAEARDENPFFNQNYRVHRIKFMLMGYVFKRSWISVNRFKDSSILATLVDAGFLP

SEQ ID NO: 36529 - protein, 521 aa, Simmondsia chinensis
MKAKTITNPEIQVSTTMTTTTTTATLPNFKSSINLHHVKLGYHYLISNALFLVFIPLLGLASAHLSSFSAHDLSLLFDLLRRNLLPVVVCSFLFVLLATLHFLTRPRNVYLVDFACYKPHPNLITSHEMFMDRTSRAGSFSKENIEFQRKILERAGMGRETYVPKSVTKVPPEPSIAAARAEAEEVMYGAIDEVLEKTGVKPKQIGILVVNCSLFNPTPSLSSMIVNHYKLRGNILSYNLGGMGCSAGLISIDLAKDLLQVYRNTYVLVVSTENMTLNWYWGNDRSMLITNCLFRMGGAAIILSNRWRDRRRSKYQLLHTVRTHKGADDKSYRCVLQQEDENNKVGVALSKDLMAVAGEALKANITTLGPLVLPMSEQLLFFATLVARKVFKMTNVKPYIPDFKLAAKHFCIHAGGKAVLDELETNLELTPWHLEPSRMTLYRFGNTSSSSLWYELAYAEAKGRIRKGDRTWMIGFGSGFKCNSVVWRALRSVNPAREKNPWMDEIENFPVHVPKIAPIAS

SEQ ID NO: 36530 - protein, 45 aa, Triticum aestivum
ETATGDKKDCLCFIEVVAHKDDTSKELLEWGSRVSAANSRPPNPQ

SEQ ID NO: 36531 - protein, 249 aa, Glycine max
MKFNIANPTTGCQKKLEIDDDLKLRAFWDKRISQEVLGDALGEEFKGYVFKITGGCDKQGFPMKQGVLTPGRVRLLLHRGTPCFRGYGRRNGERRRKSVRGCIVSPDLSVLNLVIVKKGESDLPGLTDVEKPRMRGPKRASKIRKLFNLSKEDDVRKYVNTYRRTFTTKAGKKVSKAPKIQRLVTPLTLQRKRARIADKKKRIAKAKSEAAEYQKLLASRLKEQRDRRSESLAKRRSKLSSAAKPTVTA

SEQ ID NO: 36532 - protein, 479 aa, Arabidopsis thaliana
MESTRSDPELDDDFSEIYKEYTGPASAVTNNNIQDKDKPVKQRSEERCDEEEEQLPDPNSVPTDFTSREAKVWEAKSKATERNWKKRKEEEMICKICGESGHFTQGCPSTLGANRKSQEFFERVPARDNNVRVLFTEKVMESIERETSCKIKLDEKFIIVSGKDRLILRKGVDAVHKVKEDGEMKSSSVSHRSRSRSPRRTSVGPSRARNSEPQRQQLPSHGSSSFPERSGRQDKFVDNRFREETRVRENQRNVPRGSPQAYGSDRARSRSTHSKSPGRPRYSGWDKPYDRQKPEVSGYRSERWDQERMGGSSDIQVSHQFERPPFPQTLEELELEYTRDALELEKKRDKEEDEENNKHRETIRELRESYMKKLAGLRGMNAKQWDDFLQLDAQRRQQQARQQNSGLSYGNYRQFPPYAEFDDGYSSNPPPYGGNNMPMDSKGRYPNHGDNYSSRHQDNNYGGFQRQRREEYGKAYNRY

SEQ ID NO: 36533 - protein, 278 aa, Stereocaulon urceolatum
  misc_feature (95)..(95): Xaa can be any naturally occurring amino acid
  misc_feature (100)..(100): Xaa can be any naturally occurring amino acid
  misc_feature (157)..(157): Xaa can be any naturally occurring amino acid
  misc_feature (167)..(167): Xaa can be any naturally occurring amino acid
  misc_feature (214)..(214): Xaa can be any naturally occurring amino acid
  misc_feature (263)..(263): Xaa can be any naturally occurring amino acid
VEHKDVKVVAVNDPFIEPHYAAYMLKYDSQHGQFKGTIEVEGSDLIVNGQRVKFYTEKDPANIPWKDTGAYYIVESTGVFTTTDKAKAHLKGGAXKVVIXAPSADAPMYVMGVNQETYKSDVEVISNASCTTNCLAPLAKVMHDNFTIIEGVMTTIXSYTATQKTVXGPSAKDWRGGRTAAQNIIPSSTGAAKAVGKVIPSLNGKLTGMSMRVXTSNVSVVDLTCRIEKSVTYDEIKEVMKKASNGDLKGIMSYSEDDLVSTXLNGDNHSCIFDAKAG

SEQ ID NO: 36534 - protein, 304 aa, Leuconostoc mesenteroides subsp. mesenteroides ATCC 8293
MLIKNIHQLIGQTPLIELQIPVPNQSRIFAKLEMFNPGGSIKDRLGQFLISDAWQRNLINQNSTIIEPTAGNTGIGLALAAQQYKLPTILVVPEKFSAEKQQLMKALGATIINTPSNEGIKGAISKAKSIAAEIENSYLPMQFANPANPETYYKTLAPEIVTDLKNEKIDAFVAGAGSGGTFAGIAKYLSEYDATIKNIVVEPEGSILNGGPAHAHRTEGIGVEFVPPFFESIHIDKTLTISDDNAFQQVRYAAENLGLFIGSSSGAALAASLQMAETLPPQSNIVTIFPDSSERYMSTNIYGN

SEQ ID NO: 36535 - protein, 334 aa, Propionibacterium acnes KPA171202
MAFNLKNRHLLSLAHHSTEEIKFLVGLAADLKEAKYCGTEQPLLKGKNIALIFEKASTRTRCAFEVAAHDQGAHVTYLGPSGSHIGHKESMKDTARVLGRMYDGIEYRGFHQSVVEELAEYAGVPVFNGLTDEFHPTQMLADALTMREHAEKPFHEIKFAYVGDGRNNMGRSLLLLGAKLGMDVRIGAPEGLQPEAELVERCREWAEQSGGKVLVTASAEEAVRDVDFIHTDVWVSMGEPVESWSERVGTLLPFQINDALVKAAGNPRVKVMHCLPAFHNSETAVGAEVAKTYPELANGIEVTESVFESPACIAFDQAENRMHTIKAVLVSSLA

SEQ ID NO: 36536 - protein, 278 aa, Stereocaulon urceolatum
  misc_feature (95)..(95): Xaa can be any naturally occurring amino acid
  misc_feature (109)..(109): Xaa can be any naturally occurring amino acid
  misc_feature (114)..(114): Xaa can be any naturally occurring amino acid
  misc_feature (139)..(139): Xaa can be any naturally occurring amino acid
  misc_feature (146)..(146): Xaa can be any naturally occurring amino acid
  misc_feature (157)..(157): Xaa can be any naturally occurring amino acid
  misc_feature (167)..(167): Xaa can be any naturally occurring amino acid
  misc_feature (214)..(214): Xaa can be any naturally occurring amino acid
  misc_feature (274)..(274): Xaa can be any naturally occurring amino acid
VEHKDVKVVAVNDPFIEPHYAAYMLKYDSQHGQFKGTIEVEGSDLIVNGQRVKFYTEKDPANIPWKDTGAYYIVESTGVFTTTDKAKAHLKGGAXKVVISAPSADAPMXVMGVXQETYKSDVEVISNASCTTNCLAPLXKVMHDNXTIIEGVMTTIXSYTATQKTVXGPSAKDWRGGRTAAQNIIPSSTGAAKAVGKVIPSLNGKLTGMSMRVXTSNVSVVDLTCRIEKSVTYDEIKEVMKKASNGDLKGIMSYSEDDLVSTDLNGDNHSCIFXAKAG

SEQ ID NO: 36537 - protein, 164 aa, Leuconostoc mesenteroides subsp. mesenteroides ATCC 8293
MFFTAKSILKRDPAAKSLMMVILTYPGLHALWFHRVAHWLHIHHRYLLAAIISRWSAKRTDIFIAPGAQIGRGVFIDHGVGVVIGETAIIDDGVTILHGVTLGARHAVTERRHPHIESYSFIGAHAQILGNITIGANSKVGANAVVLNDVPAYSTAVGNPARLV

SEQ ID NO: 36538 - protein, 1222 aa, Crocosphaera watsonii WH 8501
MITTTYEITPTVKRETAFILWFEEVGSKDVDLVGGKNSSLGEMIQQLQPKGVNVPTGFATTAHAYRYYIESAGLESRLRDLFTDLDVNDVTNLQERGQLSRSLILNTPFPKELEAAIIEAYKMLCDRYSHECSKLQEKYREECKIETQNLDVAVRSSATAEDLPEASFAGQQETYLNIHSVKGVLEACHKCFASLFTDRAISYRHHNGFDHFAVALSVGVQKMVRSDLASAGVMFSIDTETGFKNAALITAAYGLGENVVQGAVNPDEYYVFKPTLQDGYRPILEKRVGTKAIKMIYDTGGSKLTKNVDVLPEEQEQFCLNDEEILKLANWACIIEDHYSRVRETYTPMDIEWAKDGRTGELYIVQARPETVQSQKAANVLKTYKLQDHSTVVAVGRSVGASIGQGEARVILEASKIDQFKPGEVLVTNRTDPDWEPIMKKASAIVTNQGGRTCFDGKTKILTNQGFMTLRQVYEQGYEGLSTLSLNTKTHKIEWKPILDTMKRQSEMIDISVSQTGRITDNTLRLTPDHKMVNLRGGKYTKTEIQDLLKQQEMLTVAQTIPSLGNNKHQEADLAYFLGGIITDGSIYTSSTRGEVQFIQKDVPEKQAFISKMNDLANSLYGKSFTAHIKPVSSSYIRGQKVTGQATAYRLHSKAIAYDVKERENNITQLLLENEAELSYHFLGGVIDGDGCYHKNRLHIYISEENLLQAVIIACLKMNTVPQVTKNRNIYHLQIVEKLEVILRYTQRVKGEVTPRTIQTRFFATRQLFENQETGQIKLRQDNNCLISDKQLREMGEFEELIDGDTRMQRVIQVGEKSDGDVYNITVAEHHNYVVFTAKYTPVVVCNCHAAIIAREMGIPAIVGCGDATDKIKTRQEITVCCSEGEKGRVYDGLLPFEVEETPLDNLPVTRTQILMNVGNPEKAFSLANIPAQGVGLARLEFIIANHIKAHPLALMKFDELEDEAVKEQIAELTKRYDNKPQFFVDKLAHGVATIAASFYPKPVIVRMSDFKSNEYANLLGGQGFEPKEDNPMIGWRGASRYYDPMYREAFALECQAMKTVRDDMGLVNVIPMIPFCRTPEEGKKVIAEMAKNGLKQGVNGLQIYVMCELPSNVILADQFADVFDGFSIGSNDLTQLTLGLDRDSALVAQLFDERNEGVKRMVKLAIETAKKKGRKIGICGQAPSDYPEFAKFLVELGIDSMSLNPDSVLKTLLMVAEVEKG

SEQ ID NO: 36539 - protein, 247 aa, Pilophorus cereolus
  misc_feature (2)..(2): Xaa can be any naturally occurring amino acid
  misc_feature (35)..(35): Xaa can be any naturally occurring amino acid
  misc_feature (231)..(231): Xaa can be any naturally occurring amino acid
  misc_feature (239)..(239): Xaa can be any naturally occurring amino acid
AXNDPFIEPHYAAYMLKYDSQHGQFKGTIEVEGSXLIVNGQKVKFYTEKDPANIPWKDTGAYYIVESTGVFTTTDKAKAHLKGGAKKVVISAPSADAPMFVMGVNEKTYKSDIEVISNASCTTNCLAPLAKVIHDNYTIIEGLMTTIHSYTATQKTVDGPSAKDWRGGRTAAQNIIPSSTGAAKAVGKVIPSLNGKLTGMSMRVPTSNVSVVDLTCRIEKSVSYDEIKEAXKKASSGEXKGIMAYSE

SEQ ID NO: 36540 - protein, 129 aa, Zea mays
QTRAGPGNSRTSRAHRHRQAHSAITVSPRSRTARSCTHPSPSSSGVAIPSVDRRVRPRQPDLCQSPWRLADRKISRFEKNITKRGSVPETAKKANDYPVGPILLGFFVFVVVGSSLFQIIKTASNAGLF

SEQ ID NO: 36541 - protein, 537 aa, Zea mays
MAADTSKPFFPAAPHSALRPSRSAASRAFPESSYWRAFRSSELLSDAGFPVTDLTFASSVEDRAAPTLAASWSTSVHVFSSDPLEKLRRISVAGDLAFSPSFRCDGALLATGDKKGVVRVFRADKAATGALRTLRAHAAETRVVRYPVAGGDKLHLLTAGDDALLAYWDVPSETPVFSIPAAHQDYIRGGAASPADHNIFATGSYDRSVKLWDARTSNTGPSLSFSHGELVESVLFLPSGGLLATAGGNVVKIWDVIGGGRLVHSVESHVKTVMDLTLGKMVNTGEMRLLSAGIDGYVKSFDFGKLKMTHSLRYPQPLLSVAVSPCGSVVVAGSAKGKIYMRNRKKKAVDEEEQGMKSVGGEIDWVSPEPEKSVLRPNYFRYFRRGQNEKAKEGDFVIEKPKKVKYAEHDKLLRKFRHKDALVSALVKNNPRSVVAVMEELVSRRKLIRCIGNLDNEELGLLLEFLHRNATLPRYAKLLLCLANKVVEMREADIRSDEKLKVHMRNLKRMVAEEIQIQHMLQGIQGMISPMLALATR

SEQ ID NO: 36542 - protein, 474 aa, Propionibacterium acnes KPA171202
MDGELKRGLSSRHMNMIAIGGAIGTGLFVASGATISQAGPGGALVAYFAMGLMVFLLMQSLGEMSSYLPVPGAFETYATRFVSPSFGFALGWNYWFNWAITVAAELAAASIVMAYWWPGVPAWMWSVGFLALLFLLNVLSARAYGESEFWFAIIKVTAVIVFLVLGILMIAGVMGTSPGLSHWRRGDAPFVHGFGGILTVFLIAGFSFQGTELIGIAAGESKDPRMTIPKATRQIFWRIMIFYIGAIAVIGLLLPYTDPHLLAGEVTDVAVSPFTLVLKRAGVAAAAAVMNAVILTSVLSAGNSGLYASTRMLYALAREGKAPRILGRTSRRGVPVPALIVTTLVGAACFATSLVGSGQAYTWLVNISGLCGFIAWIGIAICHIQFRRAFQAQGHDLSELPYRARWYPAGPIVAGVLCVIVTLGQGRDAVLSGDVTDMIVAYISIPVFLALWVGHKIVTKAPHADLSTADLHHD

SEQ ID NO: 36543 - protein, 259 aa, Oryza sativa
  misc_feature (168)..(168): Xaa can be any naturally occurring amino acid
MADSAPAGKRDGFKSGFGGDRKERGDRGGRGGRGGRGGRGGRGGAGGGRKDDSKGWTPVTKLGRLVKDGKISSLEEIYLFSLPIKEAEIVDRFVDPSVLKDEVLKIKPVQKQTQAGQRTRFKAIVAVGDHNGHVGLGVKVSKEVATAIRGAIILAKLSIIPVRRGYWXNKIGAPHTVPCKVTGKCGSVTVRLIPAPRGTGLVCAPMPKKLVTLAGIQDCWTCSRGITCTFGVTRQGSFQCHWLTLPLLGFLMGGGEPGL

SEQ ID NO: 36544 - protein, 388 aa, Propionibacterium acnes KPA171202
MKIAVAGLGYVGMANAVLLAQHNSVVAIDIDAERVDMVNNRHTTIVDPLIAEYLAHHNLDLRATTDPQEAYRGADFVVIATPTNYDPGQNYFDTSSVDEVLDLVQELAPHTTTVIKSTIPVGFVEGVRKERSGLDVIFSPEFLREGKALFDNLHPSRIVVGADSPKAHLFADLMAAGAVDTNVPVLFVGATEAEAIKLFANTYLAMRVSFFNELDTYASQRGLSTRQVIDGVCLDPRIGNHYNNPSFGYGGYCLPKDTRQLLANYQDVPQTLIQAIVDSNTVRKDFIASDIIARDPKRVGIFRLVMKAGSDNFRSSSIQGVMKRIKAKGIEVVVYEPTFDGDEFFHSEVTKNLAFFKANCDVIIANRMSPDLSDVADKVYTRDLFGGD

SEQ ID NO: 36545 - protein, 242 aa, Zea mays
  misc_feature (226)..(226): Xaa can be any naturally occurring amino acid
MSEAAVRVIGLWPSPFVIRVLIALKLKHVEYEFVEEVVGSKSELLLASNPVHKKIPVLLHHGKPLSESLIIVQYIDEVWSSGAPAAILPADPYARAVQRFWAQYVDDKMHPAIRVLKGTYDGDKEQAAGQLSAALQLLEEAFAQLGQGKRYFGGDSVGYLDIALVSHVGWVKAVEKIAGVTLLDEAKVPNLVAWADRLCAHPAVVDAIPDADKFVEFSVTYGSFSXPINAPKVSKMAPHCAL

SEQ ID NO: 36546 - protein, 336 aa, Pseudomonas fluorescens Pf-5
MSRVTLSRYLIEQTRSNNTPADLRFLIEVVARACKEISHAVSKGALGGVLGSMGTENVQGEVQKKLDVISNEILLEANEWGGHLAGMASEEMDNAYQIPGKYPKGAYLLVFDPLDGSSNIDINAPVGTIFSVLRCPNEYLSQNEALNEKAFLQPGTQQVAAGYAIYGPQTMLVLTLGDGVKGFTLDREMGSFVLTHEDIKIPESTQEFAINMSNERHWEAPVKRYVEELLAGDTGPLKKNYNMRWVAAMVADVHRILTRGGLFMYPRDSREPEKPGKLRLMYEANPMSFLVEQAGGASTDGHKRILDIQPEGLHQRVAVFLGSKEEVARVTGYHKE

SEQ ID NO: 36547 - protein, 485 aa, Prochlorococcus marinus str. NATL2A
MNITDHSIIPVILSGGSGTRLWPLSRESYPKQFLALDSRTKKTLLQKTYERLLGLEGLENPILICNEDHRFIVAEQFREINTDPQAIILEPVGRNTAPAIAVAALQAISLGKDPLLLILAADHLIENNVEFQRVIQSAKIYANQGSLVTFGIVPTSAETGYGYIETKEFPTKENQKIGLEINKFIEKPNKDIAEKLIKDSRYTWNSGMFLFKASTIISELKKFAPEILNYCKIALEKDIEDLDFLRLETESFKQCPKISIDVAVMEKTNLGIVLPLNVGWNDIGSWKSLWDISKKNNDGNYINGRIIAEKSKNCYLKSEQRLIVGIGIENLIVVDTNDAILVANRDQSQNIGNIVKNLTSTAFPEGKMHKKIYRPWGNYTTIVEGNRWLVKLIEVKPNASLSLQMHHHRAEHWVVVNGTALIEKNGEQQLLSENESTFIPLGCKHRLSNPGKMRLELIEVQSGTYLDEEDIIRFEDSYGRIKNQN

SEQ ID NO: 36548 - protein, 111 aa, Glycine max
  misc_feature (65)..(65): Xaa can be any naturally occurring amino acid
MDLAKGKWKQNMIFKAWERCRLTSRPHLKLKSLSENDDDDHHEKKKKKNSQIAPHGCFSVHVGPXEKKVVVKTKYVNHPLFQMLLEEAEHEYGFESDGPIWLPCNVDLFYK

SEQ ID NO: 36549 - protein, 80 aa, Prochlorococcus marinus str. NATL2A
MSQEAILEKVRSIVAEQLSVEAGEVKPDSNFQNDLGADSLDTVELVMALEEAFDIEIPDEAAEGIATVGDAVKYIEEKQS

SEQ ID NO: 36550 - protein, 243 aa, Burkholderia pseudomallei K96243
MTFFRLATHPTRPPLMTQFRIAPSILSADFARLGEEVRNVVAAGADWIHFDVMDNHYVPNLTIGPLVCEAIRPHVQVPIDVHLMVRPVDRIVPDFAKAGANLISFHPEASDHIDRTLGLIRDHGCKAGLVFNPATPLNYLDHVMDRVDLVLIMSVNPGFGGQSFIPEALNKLREARARIDAYTARTGREIHLEIDGGVKAENIAEIAAAGADTFVAGSAIFGKPDYRQVIGEMRDALATVGRA

SEQ ID NO: 36551 - protein, 233 aa, Escherichia coli
ARSEKRVPMTRLRKRVAERLLEAKNSTAMLTTFNEVNMKPIMDLRKQYGEAFEKRHGIRLGFMSFYVKAVVEALKRYPEVNASIDGDDVVYHNYFDVSMAVSTPRGLVTPVLRDVDTLGMADIEKKIKELAVKGRDGKLTVEDLTGGNFTITNGGVFGSLMSTPIINPPQSAILGMHAIKDRPMAVNGQVEILPMMYLALSYDHRLIDGRESVGFLVTIKELLEDPTRLLLDV

SEQ ID NO: 36552 - protein, 302 aa, Arabidopsis thaliana
MDTNAKTIFFMAMCFIYLSFPNISHAHSEVDDETPFTYEQKTEKGPEGWGKINPHWKVCNTGRYQSPIDLTNERVSLIHDQAWTRQYKPAPAVITNRGHDIMVSWKGDAGKMTIRKTDFNLVQCHWHSPSEHTVNGTRYDLELHMVHTSARGRTAVIGVLYKLGEPNEFLTKLLNGIKAVGNKEINLGMIDPREIRFQTRKFYRYIGSLTVPPCTEGVIWTVVKRVNTISMEQITALRQAVDDGFETNSRPVQDSKGRSVWFYDPNDFSNFMFFSSLMYQVSCYYFSMKMKEIQSMEWKHEN

SEQ ID NO: 36553 - protein, 652 aa, Zea mays
MASVSVVLLQRSSSRVRGYIRLQRIASSSVTLVLEGEGHWWWSNSRGRDERFGARTVHHMAGSGEGENGGVPAGGQVAMAPGVVTGGVEDAYGEDRATEDQTVTPWAICIASGHSLLRDPRHNKGLSFTEKERDTHYLRGLLPPVVLSQDLQEKRMLQNVRQFQIPLQRYTALMDLQERNERLFYKLLIDNVEELLPVVYTPTVGEACQKYGSIFRRPQGLYISLKEKGRILEVLRNWTEKSIQVIVVTDGERILGLGDLGCQGMGIPVGKLALYTALGGVRPSACLPVTIDVGTNNKDLLKDEFYIGLKQRRATGQEYSEFLDEFMAAVRQNYGQKVLVQFEDFANHNAFILLEKYRTNHLVFNDDIQGTAAVVLAGIVAALKSVGGTLADHTFLFFGAGEAGTGIAELVALEISRQANVSVEEARKKIWLVDSKGLIVASREETLQPFKKRYAHEHEPVKDLLGAVKAIRPTALIGSAGVGQSFTKEVIEVMSSINERPIVLALSNPTSQSECTAEQAYTWSQGRAIFGSGSPFDPVKYNDKLFVPAQANNAYIFPGFGLGVVISGAVRASNDMVLAAAEALAEQVTPEHIEKGLIYPPFSIIRKISANIAARVAAKAYDLGMATQLPRPKDLVKYAESCMYSPVYRSYR

SEQ ID NO: 36554 - protein, 126 aa, Zea mays
MAASAAAAATPVAPTEGTVIAIHSLEEWSIQIEEANSAKKLVVIDFTATWCPPCRAMAPIFADMAKKSPNVVFLKVDVDEMKTIAEQFSVEAMPTFLFMREGDVKDRVVGAAKEELARKLELHMAS

SEQ ID NO: 36555 - protein, 460 aa, Azoarcus sp. BH72
MTTDALLDLDRKHLIHPVAAWRGHEQRGTTVLASGHDGVWLRDIHGKEVLDAFAGLWCVNIGYGHESVVQAAAEQMRKLPYATGYFGFGSEPAIRLAAKLAEIAPKSLRHTYLTLGGSEAVDAAIRLITHYYNATGRPQKKHFIAIERGYHGSSSVGSGLTALPAFHRGFDVPLPNQHYIASPYPYRSPVGDDPQAVIAASVAALRAKVAELGADNVAAFFCEPVQGSGGVIVPPKGWLKAMREASRELGILFVVDEVITGFGRTGPMFACLAEDVEPDLMTMAKGLTSGYVPMGALMISDEVYNGIADGAAPNVLVGHGATYSGHPVSAAVALEVIRLYEEGGILAHAQAMEPGFAAGLGEMLDHPLVGDVRHRGLLGAVELVADKASKRAFDPALGLADRLFRSGYQNGLIFRSFGDHILGFAPALCFTEDNFAQLFARLKRTLDEVLDAPDVRRALA

SEQ ID NO: 36556 - protein, 180 aa, Yersinia pestis biovar Microtus str. 91001
MCDSIRPYLHHSPTLGKRVMIDRSSVIIGNVILGDDVSVWPLVAIRGDVNQVIIGARSNIQDGSVLHVTHQSEHNPEGYPLIIGEDVTIGHKAMLHGCTIGNRVLVGMGSILLDGTIIEDDVMIGAGSLITPGKRLVSGYLYVGSPAKQIRPLTPLELEGLLYSAGNYVRWKDDYLAESK

SEQ ID NO: 36557 - protein, 352 aa, Physcomitrella patens subsp. patens
MLLRSQQRRTVTYMPRPGDGRPRAVTLLPGDGIGPLVTGVAVQVMKAMHAPVYFEEYEVSGKMDKVPNEVMDSIRRNKVCLKGGLATPVGGGVSSLNVQLRKELDLFASLVHCFNLPGLKTRHDNVNIVVIRENTEGEYSGLEHEVVPGVVESLKVITKFCSERIAKYAFEYAYLNNRKTVTAVHKANIMKLADGLFLESCREVAKKYPAIKYNEVIVDNCCMQLVSKPQQFDVMVTPNLYGTLVANTAAGIAGGTGVMPGGNVGAEHAIFEQGASAGNVGNERLVAGRSANPTALLLSSAMMLRHLQFPSFADRLEQAVMSVIAEGTFRTRDLGGTSSTQDVVDAVISKLN

SEQ ID NO: 36558 - protein, 454 aa, Candidatus Protochlamydia amoebophila UWE25
MSLFSIYYCFQLRVNFMFFNDQIDKLLDDLDELQLTTVNGRITEIVGMLIKAVVPQVKIGEVCLIKRAGDPLRAEVVGFTKDEVLLSPLGEMTGIGPSSEVIPTHLPLHIKVGPQLLGRILNGLGEPLDEETKGPLILEETYPVIQAPPDPVKRMPIHNPISVGIRAIDGVLTTGLGQRVGIFAAAGGGKSTLLGMIARNAVADVNVISLIGERGRELREFIEKDLGPEGLKRSVLVVSTSDQASQLRLNAAYVGTAIAEYFRDQGKSVILMMDSVTRFARALREVGLAAGEPPARAGYTPSVFSTLPKLLERAGNSDKGSITAFYTILVAGDDMNEPVADEVRSILDGHIILSSELARQYHYPAIDVLSSASRVMNAIVPKEHLQLVGKLKEVLANYKKNELLIKIGEYKRGADKAGDFAIDYIEKVLKFLKQGVDEKCSFQETVQLLKSLFR

SEQ ID NO: 36559 - protein, 151 aa, Cucumis sativus
VVSHSQDFLNGVCTNIIHMQNRKLKIYTGNYDQYVQTRSELEENQMKMYKWEQDQIASMKEYIARFGHGSAKLARQAQSKEKTLAKMERGGLTEKVVRDKVLVFRFVDVGKLPPPVLQFVEVTFGYTPDNLIYRNLDFGVDLDSRVAFEGP

SEQ ID NO: 36560 - protein, 266 aa, Gibberella zeae PH-1
MPQKIEYNSNDIPIPDSFLTSPSQTPITSHQIDFANSPLPQYDGHTALVLDNVISPAECRELLSLAEASVPRDDESQSAWKPALVSGGDGYETRAPGYRESDRIIWDQQTIVDRLWERCLQADGLRDLLAVVPHEPWMKGGKWVFSRLNDRMRFLKYSPGQYFKPHCDGAYFYTEGPGKEFETFYTVHLYLNDSAENDPASELQGGATSFLDRRGEKRVDVNPKAGSVLIFQHKGLFHEGALVNKGVKYTMRTDILYEWIADKDEE

SEQ ID NO: 36561 - protein, 166 aa, Pseudomonas putida KT2440
MANNDQKRDEGYIEKLVQVNRVAKTVKGGRIFTFTALTVVGDGKGRVGFGRGKSREVPAAIQKAMEAARRNMIQVDLKGTTLQYATKAAHGASKVYMQPASEGTGIIAGGAMRAVLEVAGVQNVLAKCYGSTNPVNVVYATFKGLKAMQSPESIAAKRGKSVEEIF

SEQ ID NO: 36562 - protein, 322 aa, Ashbya gossypii ATCC 10895
MGVWAAVTWKGGEKSAGSRDLSSLQAPAAMRMGLSVLAGLRSSPCVASRRALSAAAVRRSGDGGMTHFGSRTVPKDEKAKLVGNVFSSVASKYDVMNDVMSLGVHRLWKSHFISKLDAGKRPNASEPLHFIDVAGGSGDIAFGLLDHAEAKFHDTESTMHVVDINPDMLREGEKRAAEQGKYYNDPRVTFLVQNGETLEDIPTASKDVYTISFGIRNFTDIQKGLNTAHRVLKPGGIFYCLEFSKIENPVVDIAYQQWSKLLPVMGSMVANDYDSYQYLVESIQRFPSQDEFKGMIEKAGFASVGYENLTFGTCAIHWGIKV

SEQ ID NO: 36563 - protein, 371 aa, Physcomitrella patens subsp. patens
MPFKVEEETAIETSKARHKGRVGTYIREGNVSLASFGIKVKRDKKGKKVDLTKSLSQMLPYVVLATAVSALIQPASFAWVSKDYYAPALGGIMLSIGVQLSVSDFALVIKRPLPVLVGYVAQYIVKPLLGLLVCAALSVSPAFSSGLILTSCVAGAQLSSYAAFLSEGDVALSIILTSLTTITSVIITPLLTKFLIGSVVPVDVIAMGKSILQVVILPIVLGLSLNTYAKNFVDKIRPFMPLMAMVCTSLCIGSPLALNKSRIVSMEGFLLLFPVLAFHISAFVLGYWVPRLPFWKQDEKVSRTVSLCTGMQSSTLAMLLATQFLGDSHAVPPACSVVVMAIMGLSLASFWGKGHQIRNIRRVLPGDVSYA

SEQ ID NO: 36564 - protein, 446 aa, Mycobacterium smegmatis str. MC2 155
MSHPEQSRHLATAIPGPRSQALIDRKGTAVARGVGTTMPVYAVRAGGGIVEDVDGNRLIDLGSGIAVTTVGNSAPKVVEAVRSQVGDFTHTCFMVTPYEGYVAVCEQLNRLTPVRGDKRSALFNSGSEAVENAVKIARSHTHKPAVVAFDHAYHGRTNLTMALTAKVMPYKDGFGPFAPEIYRAPLSYPFRDAEFGKELATDGELAAKRAITVIDKQIGADNLAAVVIEPIQGEGGFIVPADGFLPTLLDWCRKNDVVFIADEVQTGFARTGAMFACEHEGIDPDLIVTAKGIAGGLPLSAVTGRAEIMDSPHVSGLGGTYGGNPIACAAALATIETIESEGLVARAQQIEKIMKDRLGRLQAEDDRIGDVRGRGAMIAMELVKAGTTEPDADLTKALCAGAHAAGVIVLSCGTYGNVVRFLPPLSIGDDLLNEGLDVLEEVLRGA

SEQ ID NO: 36565 - protein, 530 aa, Gibberella zeae PH-1
MAYYSEKDKSPGGGDVENTPDSDGLSRRGPTQSDLLSRSLSARQVQMIAIGGTIGTGLFLGTGKSLATGGPASILIAYAIVGGIVFTTMLALGEMAAFIPVAGSFCTFAGRFVDDAFGFALTWNYWFNDAVSTASDLVALQLILQYWTDNFPGWALSLIFWVVLIALNIISVKAYGEVEYWLSLLKVITIVVFIVMGIVVNCGGNETGEYIGGKYWHLPDAPFVGGIGGFASVFVTASFAYGGTESIAITAGETKDPTKNIPKVVKNVFWRILLFYILSILIIGLNVPYNYPDLNSKETRTSPFTIVFEMTGAKAAGSVINAVILTSVLSAGNHALFAGVRLMYTLALEGHAPKVLGKLNRNRVPWVAVLVTGFVAGLCFGSSFIGAGQLWSWLQNIVGVSNQLSWISIGITSIRFRQALELQGKTHLLPFKNWTYPYGPWICVFLNSFLVLVQGWSCFSPKFDVVSFISFYIELPVMLIMYIGWKLLKKTKVVKLSEMDLETDVHTIEEKVTEEAGWKNKLKNAVTWLF

SEQ ID NO: 36566 - protein, 529 aa, Oryza sativa Indica Group
MAGGKEPIEVKFRLFDGTDIGPSKYDPSTTVSALKEFILARWPQGSSASTIELSTSLVLCVNMIAGPFTNKEITPKTVNDLKLINAGRILENNRTLAESRVPVGEVPGAGYHSKNVVSCPPKMNMYRDSICNLNTVSHKKSPALFPIAGFLRLSVRVPVRICMLQIFSRIATRIPQRVICASNSYSSNYRSTSTSSPMNSNEMLGAQETVSTEGNNSCSSVQSTPDIEKKYVHRVYDAIAPHFSSTRFAKWPKVAGFLNSLRPGSVILDAGCGNGKYLGFNPDCLFIGCDISPPLIDICAGRGHEVLVADAVNLPYRDNFGDAAISIAVLHHLSTDARRRKAIEELIRVVRKGGLVLITVWAVEQEDKSLLNKWTPLCEKYNEEWVDPSSPPVRNQSNTVLESISETDEHTGAVKQRNDDLKISNDGLDDNADVTCSNSNIDEHHKTQQEYFVPWHLPFHRAEIGGASAAALENGFAKRDDKKGTVVYNRYYHVFVEGELQRLVAGINNAVVVDQFYDKSNWCIVLEKL

SEQ ID NO: 36567 - protein, 600 aa, Mycobacterium sp. MCS
MPRHHGTAATYHRRLMANLINVEKVTVGYGTRTLLDAVSMGVDDGDAIGVVGRNGDGKTTLLQILTGTRPPDSGRVTHTSGLSVGYLRQGDDFAAGATVREVIVGGRPDHIWAAEADTRAVVENLLAGVGLDTAVGDLSGGERRRVALAEVLIAGHDVLVLDEPTNHLDVEVIGWLASHLSTKRPRALVVVSHDRWFLDAVCTRTWEVHGGAVDAYDGGYAAYVLARAERSRVAAGAESRRQNMMRKELAWLRRGPPARTSKPKFRIQAANELIANEPPPRDSLTLQRFATTRLGKDVFDLHRVRLEVGDPPRVILDRIDWSIGPGARIGLVGVNGTGKTSVLRLLAGELEPAAGTIKRGATLRIGYLSQALAELDGTARVLDAVEDRRRITELAGGREISAATLLEDFGFTGDKLTTRLADLSGGERRRLQFLRMLLDEPNVLLLDEPTNDLDIDTLNVLEDYLDGWPGTLIVVTHDRYFLERVSDVTYALTGNGRCDLLPGGIEQYLEGRVSAASGSAPKPAAARGESDAARERRTAKELTRIENQLTKLDGQITKLHEAMAEAAADHVRAGELNRELSELESRKDELEEAWLAAAED

SEQ ID NO: 36568 - protein, 270 aa, Pycnothelia papillaria
  misc_feature (8)..(8): Xaa can be any naturally occurring amino acid
  misc_feature (161)..(161): Xaa can be any naturally occurring amino acid
VEHGAVKXVAVNDPFIEPHYAAYMLKYDSQHGQFKGTIEVEGSDLIVNGQKVKFYTEKDPGAIPWKDTGAYYIVESTGVFTTTEKAKAHLKGGAKKVVISAPSADAPMFVMGVNNETYKSDVEVISNASCTTNCLAPLAKVLHDNFTIIEGLMTTIHSYTXTQKTVDGPSAKDWRGGRTAAQNIIPSSTGAAKAVGKVIPSLNGKLTGMSMRVPTSNVSVVDLTCRLEKSVTYDEVKEAIKKASNGELKGIMSYSEDDLVSTDLNGDNHS

SEQ ID NO: 36569 - protein, 521 aa, Schizosaccharomyces pombe 972h-
MSSQSYYMNDLDDLRSLESSTLNKKDTAINELNPEQNDTRRSTDLLLEDKYGIQTGFSKYWKKCTYGIREYCKFIGPGFLIAVAYIDPGNYSTDLDAGSRFQYKLLFIVFLSNLFAVYLQSLCIRLGSVTGMDLARNCREHYNRYICWSFYVLAEIAIIATDIAEVIGTAVALKILMHIPLVAGVVITILDVLLVLIAWRPEGSMLSVRIFETAVALLVLVVAISFAVVLGRVHIGGAGTVFKGFLPSSTVFSREGLYSSIGILGATVMPHSLFLGSGLVQTRLRDLDVRRGNYTPVGDCSDYRPTHETIKHSLTYSIVEVALSLFTFALFTNSSILIVAGAVFYNTSGADTSDLFSIYDLLKEYVSISCGRLFAVALLFSGMSAGYVCTIAGQIVSEGYINWNLRPWLRRVITRAIAIIPCLVVSAAVGQSGLNQVLNASQVCLSILLPFLTFPLVMFTCSRKVMRVVSDSTNEETGQLIRETHDYSLGWTMTIVTWAIWLFLTALNLLLIVWLGMGVSF

SEQ ID NO: 36570 - protein, 601 aa, Gibberella zeae PH-1
MHFSTSSLIFLPLLIQTLITSVSATFKTKKFDLTITWEDYAPDGFSRKMLLVNGQSPGPVLEIDQDDMVVVKVHNKSPEDLTVHYHGTPWSDGVPGVTQHPIKPGSSFTYKFHASQHGSFWYHSHFRGQIEDGLYGAIIIHPRHDEPSPFHLISKDEHTVNKIKEAVEKVKPIVISDFVHLTSQEKWDMTLAAGIEDSCYDSILFNGKGRVECLDKEVVEANLNEIQKAYLGLVPGGAEFTDKACLPASALNFLAGGMGNESALLPGTFSGCKETDGQLETIEISNYFGQWESWLAFDIVGAINFVSGVFSIDGHDMWVYAMDGSYIEPQKVQAIPVANGDRYSIVIKIANTGDYKMRFNANSAPQLITGHAVLSIKGYSAAEGNIEPWINIVGLPASKEVAVFNQAVAFPYPPSPISPTADVTFNLSMAIKGASYLWALNETTLMPKEIDEGKPTLFNPQPYINNNVTISTKLGQWVDLVFVAALFPQPPHPIHKHGSKMYMLGAGTGHFRWNSVEEAIKEIPDQFNLVNPPRRDAFLSAPAEKEPSWVVVRYHAADAGPWLLHCHINNHMLGGMMMVIQDGVDAWPEVPEEYAEGGNGE

SEQ ID NO: 36571 - protein, 334 aa, Crocosphaera watsonii WH 8501
MSDSKPTILVTGGAGYIGSHAVLSLQKAGYNVIVYDNLSYGHPEIVQDVLKVELIVGDTNDRTLLDQIFSSRNITAVMHFAAFIAVGESVRDPAIYYQNNVAGTLTLLEAMIAANIKKFVFSSTCAIYGMPQEIPMTEKHPNNPLNAYASSKYMVEQILKDFDRAYGLKSVVFRYFNASGADPSGNLGEDHDPETHLIPLALLTALKKREHLFIFGTDYETPDGTAVRDYIHVNDLASAHVLGLDYLFNGGESEMFNLGNGNRFSVREVIEMAKKVTGVDFLVKETDRRPGDAPILVGSSEKAKSILGWQPQYFELKTIVNDAWQWHKKRHGYS

SEQ ID NO: 36572 - protein, 267 aa, Ramalea cochleata
  misc_feature (168)..(168): Xaa can be any naturally occurring amino acid
  misc_feature (176)..(176): Xaa can be any naturally occurring amino acid
  misc_feature (205)..(205): Xaa can be any naturally occurring amino acid
  misc_feature (214)..(235): Xaa can be any naturally occurring amino acid
NDPFIEPHYAAYMLKYDSQHGQFKGTIEVEGSDLIVNGHKVKFYTEKDPAAIPWKDTGAYYVVESTGVFTTTEKAKAHLKGGAKKVVISAPSADAPMFVMGVNNKSYKSDIEIISNASCTTNCLAPLAKVMHDNFTIIEGLMTTIHSYTATQKTVDGPSAKDWRGGRXAAQNIIPXSTGAAKAVGKVIPELNGKLTGMSMRVPTXNVSVVDLTXXXXXXXXXXXXXXXXXXXXXXELKGIMSYSEDDLVSSDLNGDNHSCIFDAKAG

SEQ ID NO: 36573 - protein, 204 aa, Nostoc punctiforme PCC 73102
MVLQEKGIDFDLIEIDLQNKPEGFTKVSPYGKVPALTHDDNRVWESAVINEYLDEVFPNPPLLPNSSIARAQARIWIDFANTRFVPAFSTLLRSSDPQKQEEAKQELYKHLEFIENEGLAKLSGEGPYWFGESISLVDFTYFPWFERWAALKQYRGFGIPEEFTRVRQWKHALKERESVKVIAHSKEFYIERYAKFAAPTLAAV

SEQ ID NO: 36574 - protein, 176 aa, Zea mays
MARRRDDVALAAITFAIVALCARYASAVGTTPQSSFSYREGDPTGPTKWATLQKDWDVCDSGTEQSPIDVAKVEVSEDLDPLQQTYEPGDAVMHNRLHDFMLNWTGGNGGLTIEGKKYKLKQVHWHVPSEHTVNGTRFDAEMHMVHEDSTDAKSKAVVAVLFSAKAAQALLREARW

SEQ ID NO: 36575 - protein, 337 aa, Spinacia oleracea
KLKVAINGFGRIGRNFLRCWHGRKDSPLDVVVINDAGGVKQASHLLKYDSILGTFDADVKTAGDSAISVDGKVIKVVSDRNPVNLPWGDMGIDLVIEGTGVFVDRDGAGKHLQAGAKKVLITAPGKGDIPTYVVGVNEEGYTHADTIISNASCTTNCLAPFVKVLDQKFGIIKGTMTTTHSYTGDQRLLDASHRDLRRARAACLNIVPTSTGAAKAVALVLPNLKGKLNGIALRVPTPNVSVVDLVVQVSKKTFAEEVNAAFRESADNELKGILSVCDEPLVSIDFRCTDVSSTIDSSLTMVMGDDMVKVIAWYDNEWGYSQRVVDLADIVANKWQA

SEQ ID NO: 36576 - protein, 278 aa, Sphaerophorus globosus
VEHGDVKVVAVNDPFIDPEYAAYMLKYDSTHGQFKGTIKVEGKDLIVNGQKVKFYTEKDPANIPWSETGAYYIVESTGVFTTTEKAKAHLKGGAKKVVISAPSADAPMFVMGVNEETYKSDIEVISNASCTTNCLAPLAKVMHDNFTIVEGLMTTIHSYTATQKTVDGPSAKDWRGGRTAAQNIIPSSTGAAKAVGKVIPSLNGKLTGMSMRVPTSNVSVVDLTCRIEKPASYALIKETIKKASEGELKGIMSYSEDDLVSSDLNGDNHSSIFDAKAG

SEQ ID NO: 36577 - protein, 275 aa, Stereocaulon cumulatum
  misc_feature (1)..(1): Xaa can be any naturally occurring amino acid
  misc_feature (5)..(5): Xaa can be any naturally occurring amino acid
  misc_feature (13)..(13): Xaa can be any naturally occurring amino acid
  misc_feature (15)..(15): Xaa can be any naturally occurring amino acid
  misc_feature (19)..(19): Xaa can be any naturally occurring amino acid
  misc_feature (30)..(30): Xaa can be any naturally occurring amino acid
XEHKXVKVVAVNXPXIEPXYAAYMLKYDSXHGQFKGTIEVEGSDLIVNGQRVKFYTEKDPANIPWKDTGAYYIVESTGVFTTTDKAKAHLKGGAKKVVISAPSADAPMYVMGVNQETYKSDVEVISNASCTTNCLAPLAKVMHDNFTIIEGLMTTIHSYTATQKTVDGPSAKDWRGGRTAAQNIIPSSTGAAKAVGKVIPSLNGKLTGMSMRVPTSNVSVVDLTCRIEKSVSYDEIKEVMKKASNGELKGIMSYSEDDLVSTDLNGDNHSCIFDA

SEQ ID NO: 36578 - protein, 479 aa, Pseudomonas aeruginosa
MLIPVVLSGGAGTRLWPVSREGQPKPFMRLPDGQTLLGKTYRRAAGLLAGHGEIVTVTNREHYFQSKDQFHAARLGRHRGHFILEPTGRNTAPAIAVAALGLQAEHGDAAVLVVMPADHLIRNEEAFREAVGHAARLAVAGHLVTFGVVPDAAETGFGYIELGDRLDEQGAAKVRRFVEKPDEETRRRYVESGGFLWNSGMFCFTASTLVDELAQHAPALLEQARACLAASAAVKMADGIQHELAGEGFAALPDISIDYALMERSARVAVVPAAFDWSDIGSWGAMSALLDADAEGNRGSGDTLFVDTRNTFVQSDGRLVATVGVDDLVVVDTSDALLIARADRVQEVRRVVQRLKDERHEAYRLHRTVNRPWGSYTVLEEGPRFKIKRIVVRPGERLSLQMHHHRSEHWIVVQGMARVTNGDGARLVNSNESTYIPAGHRHRLENPGVIDLVMIEVQSGEYLGEDDIVRFEDQYGRVV

SEQ ID NO: 36579 - protein, 477 aa, Gibberella zeae PH-1
MSAKLHTVPFLINGSDHVSETTADVVSPVNGEVTHRYSSADVKDANSAVDAAAEAFKSWRKTRPSERRDLLLKVAEIMERRQEELRGYAMTECGSDAAWASFDVNTGISHIKEIAGRVGTIEGSIPTVADPNTTALVLREPYGVVVAIAPWNAPYILGTRSVLFPIAAGNTVVFKASETCPRTFWAIGDIFREAGFPDGVLNVIYHERANAASVTTALIEHPQVKKINFTGSTPVGRLIGKIAGENLKPVILELGGKAPAIVWEDADLDLAALQCTLGAFINSGQVCMSTERILVHKNIKDEFEKKLSATIDQVFSSAADAPILVASAPVEKNKALIKDAIAKGASLAHGDVDAKEVSNTRMRPIVVRDVTAEMDIYKTESFGPTVSLISIETEEEAIKIANDTEYGLSSAVFTSDLQRGLRIAREIESGAVHINNMSVHDESGLPHGGAKSSGYGRFGTSAGLEEWTRTKNITFKN

SEQ ID NO: 36580 - protein, 379 aa, Arabidopsis thaliana
MSTTGQIIRCKAAVAWEAGKPLVIEEVEVAPPQKHEVRIKILFTSLCHTDLYFWEAKGQTPLFPRIFGHEAGGIVESVGEGVTDLQPGDHVLPIFTGECGECRHCHSEESNMCDLLRINTERGGMIHDGESRFSINGKPIYHFLGTSTFSEYTVVHSGQVAKINPDAPLDKVCIVSCGLSTGLGATLNVAKPKKGQTVAIFGLGAVGLGAAEGARIAGASRIIGVDFNSKRFDQAKEFGVTECVNPKDHDKPIQQVIAEMTDGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 36581 - protein, 418 aa, Chlorobium tepidum TLS
MAGLTKENPFDIARRQLDAAAGIIGLDAEVLELLRWPMREMHVTIPVKMDDGAVRAFHGFRVQYNDARGPNKGGIRFHPDETIDTVRALAAWMTWKTAVMDIPLGGAKGGVICNPKTMSPGELERLSRSYIRQVGRLLDLEKDVPAPDVYTTPQIMAWMADEYSFMQGHNDFGVITGKPLALGGSLGRGDATARGGIICIREAAKMLGINLRGKPAAINGFGNAGAFAHKLAVELLGMKVVAVSDSKGSIYNPDGFDHQALMEYKKQHGSVADFPGSTPLTDAGLLELDVTVLIPAALEDEISCRNARNIQAKIVAELANGPTTPEADKILHERGVYLIPDLLCNAGGVTVSYFEMVQNASGWYWEEEVVHRQLEKKMAAAIKAVHQAAVQYSVDNRTAAMIVAIRRVAEAMKLRGWV

SEQ ID NO: 36582 - protein, 379 aa, Arabidopsis thaliana
MSTTGQIIRCKAAVAWEAGKPLVIEEVEVAPPQKHEVRIKILFTSLCHTDLYFWEAKGQTPLFPRIFGHEAGGIVESVGEGVTDLQPGDHVLPIFTGECGECRHCHSEESNMCDLLRINTERGGMIHDGESRFSINGKPIYHFLGTSTFSEYTVVHSGQVAKINPDAPLDKVCIVSCGLSTGLGATLNVAKPKKGQSVAIFGLGAVGLGAAEGARIVGASRIIGVDFNSKRFDQAKEFGVTECVNPKDHDKPIQQVIAEMTDGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 36583 - protein, 339 aa, Glycine max
MHVKSAQSSFRDRTQEFHSITERLKKSGSGPNGPSSSSTSSRSEEQRSAIANQSEFNRRASKIGYGIHQTSQKLAKLAKLAKRTSVFDDPTMEIQELTGVIKQDITALNSAVVDLQLVCSSRNETGNVSADTSSHSSTVVDDLKTRLMSTTKEFKDVLTMRTENMKVHENRRQLFSSSASKDSANPFIRQRPLAARAAASTSSAPALPWANGSPSSSQAFPKKQVDGESQPLLQQQQQQQEVVPLQDSYMQSRAEALQNVESTIHELSNIFNQLATLVSQQGEIAIRIDENMDDTLANVEGAQGALLKYLNSISSNRWLMIKIFFVLIFFLMVFLFFVA

SEQ ID NO: 36584 - protein, 222 aa, Zea mays
MRLGVPFIAPRQLGAVESNPGKQFLPSVAWRTGHCPVIFLLTKGGVKQDDIGKVIALDPQLLGCSIAHKLEVSVKYFRSLGIYHFVLGQMIADFPTLLRYNVDILRPKYQYLRRVMVRPLKDLIEFPRFFSYSLEDRIEPRHRTLVANRINMKLRYMLTGSDEEFAQRVREAVERRARFEAGKAAGLETFSCSSETSSDAEATEAAACQNSTDVVGVLQKQA

SEQ ID NO: 36585 - protein, 429 aa, Magnetococcus sp. MC-1
MSSIVEIHGREVIDSRGNPTVEVDVYTEDGGFGRAAVPSGASTGSREAVELRDGDKSRFLGKGVRKAVDAVNTVLAEVVLGMEVADQKGIDAAMIALDGTHNKSRLGANAILGISMAVAKAAADECDLPLYRYLGGTNTSLLPVPMMNIINGGAHADNNVDIQEFMIMPVAATSCTEAIRMGAEVFHSLKKVLKSKGLNTAVGDEGGFAPNLGSNEEALKVIVEAIEAAGYKPGEDIKLALDCASSEFYNKETGNYDLTGEGRVLTKQELVAFYEDLVAKYPIISIEDGFDESDWDGWKLMTEALGNKIQLVGDDLFVTNSKILAEGISKGIANSILVKVNQIGTLTETFEAVEMAQRAGYTAVISHRSGETEDATIADIAVALNAGQIKTGSMSRSDRIAKYNQLIRIEEELGGMARFEGMKVFYNLR

SEQ ID NO: 36586 - protein, 215 aa, Gibberella zeae PH-1
MSAQDPLSSTNPSSVTNNTQDASGRQPSSAAAGSSELSSAKISLRKSLRSFPDFPIPGINFVDIMPLFADPTAHATLVEALELQIAEAFPTKPDVIVGLDARGFLFGPGLALRLGVPFAAVRKQGKLPGPCVTAEYIKEYGKDLFQMQEDAVREGQKVLIVDDIIATGGSAKAAAELVQQLKGEVMGYLFILEIPGLNGRDKLGAPPTKILLEDA

SEQ ID NO: 36587 - protein, 289 aa, Glycine max
MESKEEDVNVGANKFSERRPIGTAAQGGGDKDYKEAPPAPLFEPGELKSWSFYRAGIAEFVATFLFLYITILTVMGVNRSPSKCASVGIQGIAWAFGGMIFALVYCTAGISGGHINPAVTFGLFLARKLSLTRALFYIIMQCLGAICGAGVVKGFEGNANYELFKGGANFVNSGYTKGDGLGAEIVGTFVLVYTVFSATDAKRNARDSHVPILAPLPIGFAVFLVHLATIPITGTGINPARSLGAAIIYNRDHAWDDQWIFWVGPFIGAALAAVYHQIVIRAIPFKTRA

SEQ ID NO: 36588 - protein, 665 aa, Arabidopsis thaliana
MEMESCKLFIGGISWETSEDRLRDYFHSFGEVLEAVIMKDRATGRARGFGFVVFADPNVAERVVLLKHIIDGKILCRSDKCISLSEVVHFTLTNKNVEAKKAVPRDDHVVFNKSNSSLQGSPGPSNSKKIFVGGLASSVTEAEFKKYFAQFGMITDVVVMYDHRTQRPRGFGFISYDSEEAVDKVLQKTFHELNGKMVEVKLAVPKDMALNTMRNQMNVNSFGTSRISSLLNEYTQGFSPSPISGYGVKPEVRYSPAVGNRGGFSPFGHGYGIELNFEPNQTQNYGSGSSGGFGRPFSPGYAASLGRFGSQMESGGASVGNGSVLNAAPKNHLWGNGGLGYMSNSPISRSSFSGNSGMSSLGSIGDNWGTVARARSSYHGERGGVGLEAMRGVHVGGYSSGSSILEADSLYSDSMWLSLPAKAEEGLGMGPLDFMSRGPAGYINRQPNGECRQRSVRTTCGKHVDDDKPQDKESNPSSIAIISINVKWTKRERSECYSPQNRDETILILQTLSQLQDSTGSATIVPTLLSFIRSLLTRLSLKPLKDAFASSRSSFTIVLCCNSNILKTTTSLTLKQLLHPLQQLLHLSTPPTLNSQELKQSVPFACRNLNKEKAFKCWRNVSMVSMLSVSTNGSLLAPPVPLAELLSSHNTLKLLQATSMLSFFF

SEQ ID NO: 36589 - protein, 323 aa, Oryza sativa Indica Group
MASSTAADGDDEVVREFGPILRVYKSGRLERPLVAPPVGPGHDAATGVHSRDVHLGDYSARLYLPPPAAAAAAAERLPVVVYVHGGGFVAESAASPSYHLFLNRLAAACPALCVSVDYRLAPEHPLPAGYDDCLAALRWVLSAADPWVAARGDLDRVFLAGDSAGGNICHHLAMHHHHDAPPRRRLRGAVLIHPWFWGSEAVGEEAPDPEGRARGAGLWVYACPGTTGMDDPRMNPMAPGAPPLGRMACDRVMVCAAEGDFLRWRAHAYAAAVAAAKGGAAVEVLETAGAGHVFHLFDPDGDKAKELLDRMVTFVNGAGADAA

SEQ ID NO: 36590 - protein, 545 aa, Synechococcus sp. CC9605
MNVGKSITNVSGRTGTVAPVVLAILDGWGYRNASEHNAIQQGGTPVMDALWHTYPHTLIEASGSHVGLPDQQMGNSEVGHLTIGAGRIIRQELVRISDTVRSNQLGETQALKELVERTQKRGGTLHLLGLCSDGGVHSHINHICGLIQWAADSGITDLAVHAITDGRDTPTQSAPGYISQVEAALSRSGVGQLASLCGRYWAMDRDQRWERIEKAYNLYTDPNFSVDNRTAGQVLTDSYAEEITDEFLEPVRLQNSVMKDGDSVLVFNFRPDRARQIVQALCLPDFDGFERSHTLELDVVTFTQVEQDLPVQVAFPPEPLDQLLGQVVADAGLKQYRTAETEKYPHVTYFMNGGIEQPLSGEDRHLVPSPRVATYDLSPAMSAEQLTDSCISAIERAEYSLIVINYANPDMVGHTGVMDAAKEAIQTVDCCIGRLLDAVGRQGGTMLITADHGNAELMQGADGQAWTAHTTNPVPAILIEGERRKLPGHGNSITLRDNGGLADIAPTLLQILDLPQPTAMTGESLIAPMSNMDPTPKTARLPLSV

SEQ ID NO: 36591 - protein, 490 aa, Azoarcus sp. BH72
MPLTLTRPDLQRQHNFIANAWHDATDGRLLPVSDPATDTVFAHVPDSAAADARAAVDAAHAAFPAWRALTGRERAQYLKRWHALILAYQDDLGRLISREQGKPLAEGRGEVLYAASYVEWFAEEAARSHGEVIPEPVRGRKMLMVKEPVGVVAAITPWNFPAAMIARKIAPALAAGCTVVAKPAEDTPLTSLALVRLAEEAGLPAGVLNMVTASRERAAEVVDVWLADSRVRKITFTGSTPVGKHLVRESAATLKRVSMELGGNAPFIVFEDADLDAAVAGLMAAKFRNGGQTCVCPNRVFVHDAVHYDFVARLSARVAALKVGPASAPDSQIGPMINARAVDKIAAHVADAVERGACVVTGGERLAALGANYFAPTILVGVDAGMRCTQEETFGPVVPVTRFEHEDEVVAAANDTPFGLAAYFYTRDMARAWRVADRLESGIVGINEGALAAEVAPFGGIKESGYGREGSRHGLDDYTQMKYLCQGGLG

SEQ ID NO: 36592 - protein, 616 aa, Magnetococcus sp. MC-1
MHDYLLLITLTSAISVGLALLLRRFGLPLLVGYVLAGMVVSGALGFHYDQSGLLRDVAEMGVVFLLFTVGLEFSLQRLRQMRHAVFLVGGLQVGLTALIVCFGAISMYTMAMPSALVIGLSVALSSTAIVLKTLYENKDIGKPYGQVTVGVLLFQEISVVPMLLLVGFLGMHTQTHIALLLVETVVGALVAFAIIYVVGRFGVTRLLAAVSEMRSQEAFVASILMVVVSAALLTHALGFSYALGSLLAGMMLAETQYKHQVEADLVPFRDLLLGVFFITVGMQVDLNFAVQNLHWILMATLLLIVFKTAITFAVVRLTGSREVALKSALAIAQGGGFSFAILELALRLQLLEPQVHQFMVTTLVCSMLVAPFMLKGIHKDGGRLAKDAGADDPTGPFKGEAHNRLVVCGYHRCVPITLEKNHVVVCGYGPVGREVVIQLQEAGYPYVCIEHQQSLVGQGVDEGHAIIFGNAAQDHLLKMAHVNDAAAVIITVGDEKSKRLIGKAVARVCDHPVIVTTATHQGEAHMLDDLPIKAMVNYPKETARMLLGHALSCEWQPGFIGSWSLSAAITKPTAAAEDALVPGADMGLAQGVGLAPATGVGVVLSGAPEAPFTKET

SEQ ID NO: 36593 - protein, 436 aa, Haemophilus somnus 2336
MSNSITKNLSKHKLVKDTLVLILAGGRGSRLHELTDKRAKPALYFGGNRRIIDFALSNCINSGLNRIGVVTQYAAHSLLRHLQKGWSFLPQERGEFIDMLPARQQIDDSTWYRGTADAVYQNMAIIRDHYRPKYILILAGDHIYKQDYSQMLLDHVSSNAKCTVGCIEVPREQASEFGVMAVDENLKVKAFVEKPKDPPAIPNKPDTSLASMGIYVFDADYLYDVLMREVNTPYTSHDFGKDILPKSLEEEVLYAHPFSRSCMGRNTDGEIYWRDVGTLDSFWQSNIDLVSEHPQLDIYDQRWPIRGNPTQTYPSKFFYNKQDIKPVDNSLISGGCVITDAEISYSVLFDQVKVKADSKVEYSVVLPQVTIGKNCILRNCIIDRQVVIPDNTVIGVNIEEDRKRFRVSSTGKVILVTESMMKKLNGEKVVSEIHLD

SEQ ID NO: 36594 - protein, 340 aa, Schizosaccharomyces pombe 972h-
MSFFAPRNKKTEQEAKKSIPWVELYRPKTLDQVSSQESTVQVLKKTLLSNNLPHMLFYGSPGTGKTSTILALSRELFGPQLMKSRVLELNASDERGISIIREKVKSFAKTTVTNKVDGYPCPPFKIIILDEADSMTQDAQAALRRTMESYARITRFCLICNYMTRIIDPLSSRCSKYRFKPLDNENMVKRLEFIAADQAVSMEPGVVNALVECSGGDMRKAITFLQSAANLHQGTPITISSVEELAGAVPYNIIRSLLDTAYTKNVSNIETLSRDVAAEGYSTGIILSQLHDVLLKEETLSSPVKYKIFMKLSEVDKRLNDGADETLQLLDLLSSISVVC

SEQ ID NO: 36595 - protein, 307 aa, Mycobacterium sp. MCS
MRHFLRDDDLTPAEQAEVLALAAELKKDPLLHRPLAGPRGVAVIFDKNSTRTRFSFEVGIAQLGGHAVVVDGRSTQLGREETLEDTGKVLSRYVDAIVWRTFAQERLTSMAAGATVPVINALSDEFHPCQVLADLQTLIERRGALPGLRMAYFGDGANNMAHSLMLGGATAGMHVTIAAPQGFEPHPMFVAAAQERAAQTGASVTVTADPHRAADGADVLVTDTWTSMGQENDGLDRVRPFRPFQVNTGLLDRAHAEAVVLHCLPAHRGHEITDEVIDGPHSAVWDEAENRLHAQKALLVWLLERSG

SEQ ID NO: 36596 - protein, 373 aa, Schizosaccharomyces pombe 972h-
MTVAALNKLSALSGSIQKSFSPKLISVGIIGSGNWGTAIAKICGENAKAHPDIFHPQVHMWMYEEKIQHEGKECNLTEVFNTTHENVKYLKGIKCPSNVFANPDIRDVGSRSDILVWVLPHQFVVRICNQLKGCLKKDAVAISCIKGVSVTKDRVRLFSDIIEENTGMYCGVLSGANIASEVAQEKFCETTIGYLPNSSVNPRYTPKTIQALFNRPYFRVNIVEDVPGVALGGALKNIVAVAAGIIDGLELGDNTKSAVMRIGLLEMQKFGRMFFDCKPLTMSEESCGIADLITTCLGGRNHKCAVAFVKTGKPMHVVEQELLDGQKLQGAATAKEVYEFLDNQNKVSEFPLFTAVYRIVYEGLPPNKLLEAI

SEQ ID NO: 36597 - protein, 402 aa, Mycobacterium sp. MCS
MTLQQRWSAVMMNNYGTPALALASGDGAVVTDTDGRSYVDLLGGIAVNILGHRHPAVIEAVTRQLNTLGHTSNLYATEPGIALAEALVGHLGAPARVFFCNSGTEANEVAFKITRLTGRTKIVAAQGAFHGRTMGSLALTGQPSKQAPFEPLPGYVTHVPFGDIDELARAVTSETAAVFLEPIMGEGGVVVPPAGYLAAAREITTRHGALLIVDEVQTGVGRTGVFYAHQHDGITPDVVTLAKGLGGGLPIGACLAVGPVGDLLTPGLHGSTFGGNPVCTAAALAVLKVLADDDLVTRAGVLGKTLSHGIEELNHPLVDHVRGRGLLIGIALRAAAAKPAETAARAAGFLVNAAAPDVIRLAPPLVVTEAQIDDFLGALPGVLDAAAAGGGESTPAAEVADT

SEQ ID NO: 36598 - protein, 333 aa, Kluyveromyces lactis NRRL Y-1140
MSVPYEQVSVAPLVLLSVLDHHQRTNTPENKRCLGVILGDSSTATVRITNSFALPFEEDEKNPDVWFLDHNYIETMNEMCKKINAKEKLIGWYHSGGKLRASDLKINELFKKYSTNNNPVLLILDVKQEDIGLPTNAYVAVEQIKDDGTSTERTFIHIPSTVEADEAEEIGVEHLLKDVRDQAAAGLSIKLTNQLNSLRGLQRKLKDIVAYLEKVANNELPVNHIILGKLQDIFNLLPNLGTPDKDEMIGSSHVLDNVTNNLEKALTVKTNDELMIIYISNLVRAIVAFDNLIENKIQNKKLLEKHSKVEVEQKEDATNDGIPAESNSVPTKN

SEQ ID NO: 36599 - protein, 290 aa, Mycobacterium sp. MCS
MTAATHTKAQVLAAALPWLKQLHGKIVVVKYGGNAMTDDTLKAAFAADMVFLRNCGVHPVVVHGGGLQISAMLKRLGIPGDFRGGFRVTTPEVLDVARMVLFGQVGRELVGLINAHGPYAVGITGEDAHLFTAVRRDVVVDGVATDIGLVGDVEHVNTEAVRDLIAAGRIPVVSTIAPDANGVVHNINADTAAAALAAALSAEKLLMLTDIEGLYTDWPDRNSLVSQINTDELTELLPTLEAGMVPKIEACLRAVTEGVPSAHVIDGRVEHCVLVELFTDEGTGTKVVNP

SEQ ID NO: 36600 - protein, 403 aa, Wolinella succinogenes DSM 1740
MIPLSKIVEAHERVKKVIQKTKLAYAPRLSELSGANVYLKKENLQHTGAYKLRGAYNRIATLSQEERAKGVIAASAGNHAQGVAYSAKQFGIRAVIVMPEATPLLKVTGVKRLGAEVILAGNNYDEAYAHALECAKEQELCFIHPFADDEVIAGQGTVALEMIEEKSNIQTVVLPIGGGGLISGVAAAYKQMLPNVRIIGVTAKGAPAMHDSFHAKKIVSVKGVKTIADGIAVRDVTPRNFEYILEGVDDVVQVDDEEIANAVLYLLENQKLVVEGAGAVGVAALLHEKLPVSKGENVAIVLSGGNIDVTMLSVIIEKGLIKSQRKMKFSVILVDKPGSLKGLTDILSQVGANIVRIDYDRTSTSLAYGDANVTIALETKGGEHQEEIRQELWKYHYRFVEID

SEQ ID NO: 36601 - protein, 296 aa, Triticum aestivum
  misc_feature (71)..(71): Xaa can be any naturally occurring amino acid
  misc_feature (99)..(99): Xaa can be any naturally occurring amino acid
  misc_feature (200)..(200): Xaa can be any naturally occurring amino acid
MGGLSMEHPWAFAFGLLGNVISFSSLLAPIPTFYRIFKSKSTEGFQSVPYVVALFSAMLWIFYALVKTGEXLLISINAAGCVIETVYIVMYLVYAPRKXKIFTAKIVVLLNIAGFGLIFLLTVFAFQGETRVISLGWICVGFSVCVFVAPLSIIGRVIKTKSVEYMPFSLSLTLTLSAIVWFLYGLLIKDKYVALPNILXGFTFGMIQMVLYMFYMNATPVVTSDVKEVKEAWKVPAEDQVVVINVGKADKSSCAEVRPVTEMASAVDVPRRCAAEAAAPRQQVMAVDFARSVEVV

SEQ ID NO: 36602 - protein, 474 aa, Oryza sativa
MVLTHVEAVEEGSEAAAAVFASRYVQDPVPRYELGERSISKDAAYQIVHDELLLDSSPRLNLASFVTTWMEPECDRLILEAINKNYADMDEYPVTTELQASNQTNQTIYPRLLHILSLHCVVVDNRCVNIIARLFNAPVGDGEKAVGVGTVGSSEAIMLAGLAFKRRWQNRRKAAGKPHDKPNIVTGANVQVCWEKFARYFEVELKEVKLTEGCYVMDPVKAVDMVDENTICVAAILGSTLTGEFEDVRRLNDLLAAKNKRTGWDTPIHVDAASGGFIAPFIYPELEWDFRLPLVKSINVSGHKYGLVYAGVGWGYKSVMKNCMESARTLREGLEKTGRFTIISKEEGVPLVAFTFKDGAGAQAFRLSSGLRRYGWIVPAYTMPAALEHMTVLRVVVREDFGRPLAERFLSHVRMALDEMDLAARAPVPRVQLTIELGPARTAGEEASIRVVKSEAVPVRKSVPLVAGKTKGVC

SEQ ID NO: 36603 - protein, 347 aa, Triticum aestivum
  misc_feature (184)..(184): Xaa can be any naturally occurring amino acid
  misc_feature (218)..(218): Xaa can be any naturally occurring amino acid
MAGDLRHRRPAGAADAGGEDEGGGGAEAAAKAGPPSGGEEAGRGRKEALGWLEWSRGWMGVVGEFFFQRIAASHLANPLELPPLDGVSIIVTGATSGIGLEIARQLAQAGAHLVMAVRRPKVARELIQKWQNEQTEVSMPLNIEVMELDLISLDSVARFADTWNARMAPLHVLINNAGIFTIGXHTIGFVDAEDMNLTSGKHKYRSWLGYSNSKLAQXAGVHTVCASPGIVHTNVARDLPKILVAGYRLIPYFIFDPQEGSRSTLFAASDPQVPEYCETLKSEDWPVCACINYDCNPMNASEEAHNLETSQLVWEKTLEMIGLPSDALEKLIEGEPVQCRYGQQKAE

SEQ ID NO: 36604 - protein, 273 aa, Stereocaulon tomentosum
VEHKDVKVVAVNDPFIEPHYAAYMLKYDSQHGQFKGTIEVEGSDLVVNGQRVKFYTEKDPANIPWKDTGAYYIVESTGVFTTTDKAKAHLKGGAKKVVISAPSADAPMYVMGVNQETYKSDVEVISNASCTTNCLAPLAKVMHDNFTIIEGLMTTIHSYTATQKTVDGPSAKDWRGGRTAAQNIIPSSTGAAKAVGKVIPSLNGKLTGMSMRVPTSNVSVVDLTCRIEKSVTYDEIKEAMKKASSGELKGIMSYSEDDLVSTDLNGDNHSCIF

SEQ ID NO: 36605 - protein, 495 aa, Rhodobacter sphaeroides 2.4.1
MLQEIDWHARAKAVALPNRPFIDGQYVDSLSGETFACIYPGDGRPLTDVASCNAADVDVAVRSARKAFEAGVWSRMAPADRRRILLRFSELILANREELALLETLNVGKPIANAYNGDVVSAAACIAWYAEAIDKVYGEVAATAYDMTTLVMREPLGIVAAVVPWNYPMSMAAWKLGPALATGNSVILKPAEQSPFTALKFGELAIEAGMPPGVLNVVPGLGHIAGKALGLHMDVDCVGFTGSTEVGKYFMQYSGQSNIKRIGLELGGKSPQVVLADCDDLDAAAAGIAAGIFANTGQVCNAGSRLIVDEKIHDQLLEKIAAQAKVFAPGDPLDTATRMGSMVSEEQMDRVLGYIDAGRADGARPVIGGGRVKTETGGFYIEPTIFEGVRNDMKIAQEEIFGPVLSAIPVKGFDEAMATANDTVYGLAGAVWTGSVKNAHRAAKSLRAGVVWVNCFDRGSLAVPFGGFKQSGFGRDKSLHAMDKYTDLKAVWFAH

SEQ ID NO: 36606 - protein, 467 aa, Rhodobacter sphaeroides 2.4.1
MTRNDATNAAGAVGAAMRDHILLPAQEMAKLGKSAQPVLTHAEGIYVHTEDGRRLIDGPAGMWCAQVGYGRREIVDAMAHQAMVLPYASPWYMATSPAARLAEKIATLTPGDLNRIFFTTGGSTAVDSALRFSEFYNNVLGRPQKKRIIVRYDGYHGSTALTAACTGRTGNWPNFDIAQDRISFLSSPNPRHAGNRSQEAFLDDLVQEFEDRIESLGPDTIAAFLAEPILASGGVIIPPAGYHARFKAICEKHDILYISDEVVTGFGRCGEWFASEKVFGVVPDIITFAKGVTSGYVPLGGLAISEAVLARISGENAKGSWFTNGYTYSNQPVACAAALANIELMEREGIVDQAREMADYFAAALASLRDLPGVAETRSVGLVGCVQCLLDPTRADGTAEDKAFTLKIDERCFELGLIVRPLGDLCVISPPLIISRAQIDEMVAIMRQAITEVSAAHGLTAKEPAAV

SEQ ID NO: 36607 - protein, 307 aa, Wolinella succinogenes DSM 1740
MDRINALFPLWAILFSALAYAMPSLFVPLKEMIVPLLGFIMFCMGMTLLPKDFKEVVRRPKVIALGIVLQFTLMPLGAYVIAHLLGFPALLIAGFILVGTAPGGTASNVMAFLAKGDVALSITLTACSTLLGVILTPYLTLFLTQEVVEVNALAMLMSIVKIVFFPVALGVGVNYFLCQKVEKVQRLLPTLSIVGIVLIIAIVVALNQSKILEVGAWVALGVVMHNTLGLVLGYFLSKMAGFEEKIARTIAIEVGMQNSGLAVALAAKYFGALAALPGAIFSVWHNVSGSLIASYWGSRSEKEQEQG

SEQ ID NO: 36608 - protein, 655 aa, Rhodobacter sphaeroides 2.4.1
MTNDLIRRSDSDGIALLTLANPPVNALSLAVRQRLAALTAELEADESVRAVVLAAEGRVFVGGADIAEFDRPPEAPHLPDVIAAIEASRKPWIAALNGAALGGGAELALGCHYRIFADTARLGLPETSLGLIPGAGGTQRLPRRIGLAPAIEVITAGRTLSAAEAREAGLADRIAAGELIPEALAFARTLDGALPLPASAAPLADPGPAFWDEARARIARAARGNPAPAAALEAIRAGVAEGFAAGLRAERETFLRLRASDEAAALRHLFFAERAALRPAALRGIEPVPLTRAGVIGGGTMGSGIAAALAAAGLEVRLTETGPESLAAGLERVEAIFEAQVKRGLTDRAGAAERMARVTGTVGLGALADCDLVIEAVFEDLAVKRRVFEELVRLCGPEAILATNTSYLDPERIVEGLPHPHRFIALHFFSPAQVMKLLEIVPLAATAPRTLATGVALAARLGKIPVQAGNGEGFIGNRILKRYRAEAEALLLAGATPTEIDEAMRAFGLGMGPFEMQDMAGLDIAFRAREAARALGQDLPEGPGDRLVRAGRLGRKSGGGWYDYAPGSRLPQPSPEAAALIAPLVTPGPRPSGTEIADRLIAAMAEEGQRICDEGLAQSPSDIDLVEVHGYGFPRHKGGPMFHAARKTRSRTGGA

SEQ ID NO: 36609 - protein, 235 aa, Arabidopsis thaliana
MATTSLVTGLKVVLPVMFCLMLATLVYTIITDGLPLPDRQDVFTPWFVTTILDFYINLVPIAVWIVYKESTWSGSILWTILLIIFGSLTTCVYLFLQLLKLTNQEASEDPMYYLLLRDSIKDGVGLRDKNSLVVTARFVFGALGCVMLGALVYTCFTYGSPFHMELLYPWMVVLLVNFYIDVAVLSVWVVYKESSLIIGILWVALLIGLGSVGTSAVIVVQLFRLSPLDPLYLVL

SEQ ID NO: 36610 - protein, 553 aa, Triticum aestivum
  misc_feature (122)..(122): Xaa can be any naturally occurring amino acid
MATRRAISSVLRTASRIRAASPSPCPRAPLHRPSPAGFLLNRAAASYSSSAAAQAAPVTPPPTSDKHTGTKITDDFTGAGAVGEVCQVIGAVVDVRFDEGLPPILTALEVLDNSIRLVLEVXAQHLGENVVRTIAMDGTEGLVRGQRVLNTGSPITVPVGRATLGRIINVIGEPIDHKGDIKTNSYLPIHREAPAFVEQATEQQILVTGIKVVDLLAPYQRGGKIGLFGGAGVGKTVLIMELINNVAKAHGGFSVFAGVGERTREGNDLYREMIESGVIKLDDKQSESKCALVYGQMNEPPGARARVGLTGLTVAEHFRDAEGQDVLLFIDNIFRFTQANSEVSALLGRIPSAVGYQPTLATDLGGLQERITTTKKGSITSVQAIYVPADDLTDPAPATTFAHLDATTVLSRQISELGIYPAVDPLDSTSRMLSPHVLGEAHYNTARGVQKVLQNYKNLQDIIAILGMDELSEDDKLTVARARKIQRFLSQPFHVAEVFTGAPGKYVELKEGVQSFQGVLDGKYDDLSEQAFYMVGGIEEVIAKAEKIAKENA

SEQ ID NO: 36611 - protein, 441 aa, Chlorobium tepidum TLS
MIFYSTTKASAPVTMKKATLEGLAPDGGLYVPSTMPHFSAEEIALLENGSFNNIAFAVAKKFAGDEIPLDRLSELIDECFTFDTPLHELDPDTFVEELFHGPTLAFKDYGARFLARMTGYFAAEESRLITVLVATSGDTGSAVAYGFHGIPNTRVVLLYPSGKVSRLQEQQLTTAGDNVFALEVKGDFDDCQRLVKQAFVDQSLRQKLTLTSANSINISRLIPQSFYYAWAALQLRQRKPDALPIFSVPSGNYGNLTAGVMAKMMGFPIGHFIAASNANDSVTRYLDEGRYEPKPTVRTLTTAMDVGNPSNFARLRYFFENDFRKMGQEITGIAVSDAETLETIRSVYEKYGYVMDPHTAVGYRALDRFRQDHAGAGTPGVVLSTAHPVKFDEAIKEATGNEVPLPETMEEIMSKPKKATLIGNRYEELARFLSELNTQTN

SEQ ID NO: 36612 - protein, 589 aa, Colletotrichum lagenarium
MRYNLIRSAFQAGLVLASLSSAKPLRSLNTRTNDTSCGTHGPTNRACWNGDININSDYETSIPSTGQTRVYDFTITNVTDFAADGISKPAMLINGQFPGPTIEADWGDWVEINVHNQLADNGTSIHWHGMHQRNSNDQDGANGVTECPIAPGHSKTYKFQMIQYGTSWYHSHFSSQYGNGVVGAIKINGPASADYDIDLGPYTVSDWYYDTADRLERQAELVANGPPPDSDNVLFNGTNINAQGGGQYSKTKLTPGKKHLLRLINPSVDNTFTVSLVGHSFTVIATDLVPVKPVVKDSLFISVGQRYDVIIEADKDVGNYWFNATLASSGLCGTSNAKFPASIFTYEGAADELPTEQGVVPAADCVDTTGFSPVLARHAPEAEFTPNKNILDVSLEQPEIHGEKIYRWRVNGSSMDVQWDKPTLQYIAEGNDSWPHQANVVDLSGADVWTWWVIENTGALPHPIHLHGHDFLLLGIGDGKFSNSSSTNGTGPYSSVKYPSLNFANPTRRDVAQLPGNGWMVIAFRTDNPGAWLMHCHIAWHVSMGLSVQFIERKDEITSALKLETLDQTCQTWKDYAHAAFYPKYDSGL

SEQ ID NO: 36613 - protein, 501 aa, Oryza sativa Indica Group
MEARELWVLAAALAVSLLYYLTVLMRYAGGGSSRSSRPRLPPGPTPLPLIGNLLSLRGVLHHRLASLARVHGPVMALRLGLTTAVVVSSRDAAAEAFTKHDRRLAARVVPDSNRAHGFSDRSVIWLPSSDPRWKTLRGIQATHLFSPRGLAAVRAVRESKVRDIVAYFRSRAGEEVVFGEAIYSGVLNLVSSSFFSVNMAGVGSEEAHGLRELVEDLVEAVAKPNVSDLFPFLRQLDLQGLRRRTEERMARAFGILDGIIDRRLANRTHGDRHGDFLDALLDLVSEGKMARDHVTIMLFEVFGAGSDTMSISLEWAMAELLRNPRAMRKARAELEDAAAVVEESDAARLPYLQAVVKEAMRLHPVGPILLPHRAVEDGVEIGGYAVPRGAMVIFNAWAIMRDPAAWERPDEFVPERFMETTTAIDFRGKEYEYLPFGSGRRLCPGLPLAERVVPFVLASLLRAFEWRLPDGVSAEDLDVSERFNTANVLAVPLKVVPVIVN

SEQ ID NO: 36614 - protein, 487 aa, Synechococcus sp. CC9605
MVASAPASAGTKGVIRQVIGPVLDVEFPAGKLPKIYNALRIEGKNPAGDDVALTAEVQQLLGDHRVRAVAMSGTDGLVRGMEAVDTGAPISVPVGEGTLGRIFNVLGEPVDEQGPVNTTATAPIHRDAPNITELETKPKVFETGIKVIDLLAPYRQGGKVGLFGGAGVGKTVLIQELINNIAKEHGGVSVFGGVGERTREGNDLYEEFKESGVINADDLSKSKVALCYGQMNEPPGARMRVGLSALTMAEHFRDVNKQDVLLFVDNIFRFVQAGSEVSALLGRMPSAVGYQPTLGTDVGALQERVASTVEGSITSIQAVYVPADDLTDPAPATTFAHLDATTVLNRALASKGIYPAVDPLDSTSTMLQPAVVGDEHYRTARAVQSTLQRYKELQDIIAILGLDELSEDDRRTVDRARKVEKFLSQPFFVAEIFTGMPGKYVKLEETIAGFNQILAGELDSLPEAAFYLVGNIEEVKAKAEKIAAETK

SEQ ID NO: 36615 - protein, 155 aa, Chlorobium tepidum TLS
MQVQNIEGSLNASGLKFALVVSRFNDFIGQKLVEGAIDCIVRHGGSADEITVIRCPGAFELPSVTRKAMLSGKYDAIVTLGVIIRGSTPHFDVIAAEATKGIAQVGMEAAIPVSFGVLTTENLEQAIERAGTKAGNKGFDAALAAIEMANLYKQL

SEQ ID NO: 36616 - protein, 189 aa, Glycine max
IRLEPTPTRAEVADVSEAVRQRADALMLSGESAMGQYPEKALTVLRSVSLRIEKWWREEKRYEAMLLPSVGSYFSEKISEEICNSAAKMANNLEVDALFVYTKTGHMASLLSRCRPDCPIFAFTTTSSVRRRLNLQWGLIPFRLSFTDDMESNLNRTFSLLKARNLIKSGDLVVAVSDMLQSIQVMNVP

SEQ ID NO: 36617 - protein, 467 aa, Burkholderia pseudomallei K96243
MEGSQTGLGTGLKQRHVTMLSIAGVIGAGLFVGSGHAIAEAGPAALIAYAIAGLLVVLVMRMLGEMAVAQPDSGSFSTYADRAIGHWAGFTIGWLYWWFWVLVIPIEATAAATILNAWFPGVATWIFALGITSVLTVTNLFSVKNYGEFEFWFALIKVVAIVVFLAIGGAAIVGLLPGSNVSGAARLVNAGGFMPNGVGAVLAAMLTTMFSFLGTEIVTIAAAESEHPERQIVRATNSVIWRISLFYLGSIFVVAALVPWNDALLPVHGSYQRAMELIGVPHAKGIIDVIVLVSVASCLNSALYTASRMIFSLSTRGDAPAFLRRTDASGTPRAAVLASTAFGFLTVIANYVMPEQVFGFLLATSGAIALLVYLVIAISQLRMRSTLDATGERLPLRMWCFPWLTWAVIVFICGVLVVMLLREDHRMEVGATAVLALAVVVASRMNRRARGGDEPTPAASRVSANLR

SEQ ID NO: 36618 - protein, 338 aa, Prochlorococcus marinus str. NATL2A
MRAGSVIAIGEALIDRLGPLGGDPSSDLPVTDCFGGAPANVACALSRLGAKVSFIGSLGNDAFGEDFNNLLIQRGINTSGLQQDTLRPTRVVLVRRDSDGERCFEGFEGDKGLGFADQAISLEQIIRDWPLVAENAQWLVAGTIPLASEISSKAFLWCIENAMHSGIKIALDLNWRPTFWRNQVSTGSEPSVKEKNQILSILKNVSLIKLAKEEAQWFFNSSDPTEISSSLPQRPSVVVTDGSNPILWRLNNHLGKSFAIIPSSVVDTTGAGDAFTAGLIYKLISVELDQISEQSAKDIIQFGIACGSHVCKGLGAIEPQPYLDDIDNLLSLSKGEIS

SEQ ID NO: 36619 - protein, 120 aa, Methanosarcina acetivorans C2A
MAQLAKFDVPEELTNKALEALELARDTGKIKKGTNEATKAIERGNAKLVLIAEDIEPAEIVAHIGPLSEEKKAPYIFIKNQKELGAASGLGVSCATVAIVDAGKAAEMVQDIAQKLEALK

SEQ ID NO: 36620 - protein, 499 aa, Oryza sativa Indica Group
MENSQVWLLWGALSVAVLFYLSTLRRRYAGGKPLPPGPTPLPLIGNLHLAGGTFHHKLRDLARVHGPVMTLKLGLATNVVISSREAAIEAYTKYDRHLAARATPDTFRACGFADRSMVFIPSSDPQWKALRGIQGSHVFTPRGLAAVRPIRERKVGDLIAYLRAHAGKEVLLGQAMYTGLLNLVSFSYFSIDIVDMGSQMARDLREVVDDIISVVGKPNISDFYPFLRPLDLQGLRRWTTKRFNRVFSIMGDIIDRRLAHIRDGKPRHDDFLDSLLELMATGKMERVNVVNMLFEAFVAGVDTMALTLEWVMAELLHNPAIMARVRAELSDVLGGKEAVEEADAARLPYLQAVLKEAMRLHPVGALLLPHFAAEDGVEIGGYAVPRGSTVLFNAWAIMRDPAAWERPDEFVPERFLGRSPPLDFRGKDVEFMPFGSGRRLCPGLPLAERVVPFILASMLHTFEWKLPGGMTAEDVDVSEKFKSANVLAVPLKAVPVLIK

SEQ ID NO: 36621 - protein, 396 aa, Mycoplasma gallisepticum R
MNKYYMSSKRDYYEILEVSRSATQQDIKKAFRKLAMKYHPDRNKDSDAEEKFKEVNEAYEVLSDEEKRKLYDTYGHEGLNASGFHQGGFNPYDVFNSVFSGFDFEGGFGDVFSQFFGGGGSGFHNQEYIEEVDVNLVHEIKINFLEAANGCIKNVKYTRQVTCPDCNGSGSADGDVITCSDCNGEGFLVEQRRTLLGMFQTKKTCPSCKGEGQTIKNKCKKCKSRRMVDEVVERKVSIDSNVFYQDVVIVRGEGHIYKNLVGDLFLRVKIEPSRVFELRDNHVVVNVLVDPLVAITGGTILIPTLKEIKEINLKAGTKNGDIITIANGGINLKLDSRVYGANYNQKGDLIVVINYARPSEYSKQEITKLKEFIKPNKEVNLYETLMKKELNNKDSQ

SEQ ID NO: 36622 - protein, 151 aa, Methanosarcina acetivorans C2A
MNMEQTYVMVKPDGVQRGLVGEVISRIEKRGLKILALRMNVIAEATAKEHYGEHAARPFFPSLIEFITSGPSVSMVVAGKDAIKVMRAINGATNPVDAAPGTIRGDFALDVGRNVVHASDSPEAAAREIAIHFKDSEIGKYSRVDEVCLYE

SEQ ID NO: 36623 - protein, 397 aa, Glycine max
MVEGKSITRQLRRPPPPPTPSKLQTVSVRLSLFSLRKFSKKNLQMSNFLSNTNPNPNKSFEVNQPPTDSVSSLSFSPKANFLVATSWDNQVRCWEVAQNGVNVATVPKASITHDHPVLCSTWKDDGTTVFSGGCDKQVKMWPLLSGGQPMTVAMHDAPIKEVAWIPEMNLLVTGSWDKTMNFLATFRYWDTRQSNPVHTQQLPERCYAMTVRHPLMVVGTADRNLIVYNLQNPQVEFKRIVSPLKYQTRCLAAFPDQQGFLVGSIEGRVGVHHLDDSQHGKNFTFKCHREGNEIYSVNSLNFHPVHHTFATSGSDGAFNFWDKDSKQRLKAMLRCSQPIPCSTFNNDGSIFAYSVCYDWSKGAENSNPAAAKTYIFLHLPQESEVKGKPRIGATGRK

SEQ ID NO: 36624 - protein, 1124 aa, Arabidopsis thaliana
MQPNLFFPFGSVLGNPFLFNGGGDLNELGSGAAFESSRVFFLLPFLLSQGTGVMDLSKVGEKFLSSVKSATSLGLLPSPSISDRPEIPARAAAAAAVARALAGLPSDQRLSISSTATELNSIYGNRPLPQQVEELEEGFYEEDFDPVRHILENVPDDESELAYFEKQATLRLVQLDKVAETLSHHVMEHHEVMVKGMNLVRELEKDLKIANVICKNGRRNLTSSMNEASRDLIVHTHSKKKQALLDMLPILTDLRHARVMQSNLEDLVEDGNYCKAFQVLSEYLQLLDSLSEFSAAQEMTRGVEVWLGRTLHKLDSLLLGVCQEFKEDSYVMVLDAYALIGDVSGLAEKIQSFFMQEVISETHSVLKSIVGEDNSAATQYSRLTYSDLCLQTPESKFRQCLLRTLAVLFQLIYSYHEIMSFTPEKEAEILVSPSLATTQMVDSVTGSSCDPQDGGLLPGSIPPCTISAEESDGSGTSSSVQLASNIAIDESRNSEDRVSSSESPWYYLRKESAAFVSETLQRGRRNLWQLTTSRVSVLLSSPGASSTSIHQFLKNYEDLSIFILAGEAFCGFEVVDFREKLKGVCENYFTAFHRQSMHALKMVLEKETWTKLSPDTVQAINFAGLVGDGAPLIISSRSASGSSRFPHSDKPSNSIDPSGNRSGFSYWLKSGNPFSAKLTHYREDQDYSSINGEDHEGNDSIHDDVVNPKIRDIKRINGGSPVSEDENEDLLADFIDEDSQLPRRSFTRSQSRTSSSHFSTNDDLTAQTGSSLCLLRSMDKYARLMQKLEIVNAEFFKGICQLFGVFFYFVFQVFGQENTNSGGKGVSDSFNHRLKSCLSRISQECEQWIKPHVSSSPSSSLAFPNTVHSLADVTPASPLNTSGHLSGVSFSLKERCAAVDTVSLVARVLHKSKAHLQSMLMSRNGSLVEDFFGQLVGSVPDLTEHLHRTTARILLHVNGYVDRIANSKWEIKELGMEHNGYVDLMLGEFKHYKTRLAHGGIPQEVQNLLLEYGVEIFAEMLVEGLSRIKRCTDEGRVLMSLDLQVLINGLQHFVPTKVKPKLQIVETFIKAYYLPETEYVHWARAHPEYTKAQVVGLVNLVATMKGWKRKTRLEVIEKIESASM

SEQ ID NO: 36625 - protein, 461 aa, Dehalococcoides ethenogenes 195
MLENAEYIKAEELLDQTQKLYDEGAIFCTASCVDLGNEFEVIYHYNLENGLQMKHLRLKIDKNETVPSISNIYLCASLIENEMQELYQLKLSKIAIDFSGGFLVTKETPKSYMIKAPDYKLIPVERLTAPCQRACPAGIDVSRYVRLCGEGNYDAALAVIKQAMPFPGILGRVCLAPCESACRQGKCGEAISIKQLKRAAYEYGHYTDTATAKPTGKKVAVVGSGPAGLAAAYFLTKKGHKVTVFEALPKAGGYMRVGIPEYALPRQILDAEIENVAKLGVEFKLGTAVNSLSSLKEMGFDATLLALGANQGVRRSNIIAAFSGATDVFKKFGLAVENINGSNVLKVDDDTLSTSQEGVFACGDAVNGPTSVIHAVASGKKAAASIDKYLGSAGKWVYENIVAHEPVSRDTFLERIFPKSKPLSVKYDIKQAKERNEETAGYSREVAAAEGKRCWRCDLEE

SEQ ID NO: 36626 - protein, 463 aa, Bradyrhizobium japonicum USDA 110
MTPTMLPSSQQARDVAYQLHAYTNARSHQRAGPLIIERGEGPYVFDTAGKRYLDAMAGLWSAGLGFSEKRLIEAAHRQMQILPFYHTFASRSNGPSIALAEKLVKMSPVPMSKVFFTNSGSEANDTVLKLIAYRSNAAGQPQRKKVISRLRGYHGVTIGAASLTGFPDNHRSFDLPLPNIMHTGSPHFYKDSRAGESEETFATRRAEELESLIQREGADTIAAFFGEPVMGAGGVIVPPPTYWDKIQSVLKKHSILLVADEVICGFGRTGKMFGCETYNIAPDVIVVSKQLTSSYFPLSAIIMNDYMFEPIADESNKVGLLAHGFTGGGHPVGAAVALENLKLIEERGLIANVGRIGAYMQERLRTLVDHPLVGEVRGVGLIAAIELVLDKKRKVAATTPGDVGSIASRLLHERGIIVRNVDDALSICPPLIVNKDQIDELIDGITGMLHDLKATVVNCREPH

SEQ ID NO: 36627 - protein, 378 aa, Glycine max
MATTTSSSSEEAPNTKKNKKERLGWIEWLRGWFYLVYEMLFQRIMASHLHNPMPLPPVNDLTCIVTGSTSGIGLEIARQLAQSGAHVVMAVRNTKAAQELIQKWQVDSEGLSIPLNVEVMQVDLLSLDSVTRFAEAWNARSAPLHVLINNAGIFSIGEPQKFSKDGYEQHLQVNHLAPALLSILLLPSLIRGSPSRIVNVNSIMHHVGFVDTEDMNLTSGKRKFSSMVGYSSSKLAEIMFSSTINKRLPAESGISVLCVSPGIVQTNVARDLPKLVQAAYHLIPYFIFSAQEGARSALFAATDPQVPEYCEMLKADEWPVCAFISQDCRPANPSEEAHNVQTSYEVWEKTLEMIGLPSDAVERLLDGEEVKCRYGQEQ

SEQ ID NO: 36628 - protein, 715 aa, Pseudomonas aeruginosa PAO1
MIYQGKAITVKPLEGGIVELNFDLKGESVNKFNRLTLSELRAAVDAIKADASVKGVIVTSGKDVFIVGADITEFVDNFQLPDEELMAGNLEANKIFSDFEDLDVPTVAAINGIALGGGLEMCLAADFRVMSATAKVGLPEVKLGIYPGFGGTVRLPRLIGCDNAVEWIASGKENKAEDALKVGAVDAVVAPEQLQAAALDLAKRAVAGELDHKARRQPKLEKLKLNAIEQMMAFETAKGFVAGQAGPNYPAPVEAIKSIQKAANFGRDKALEVEAAGFVKLAKTSVAQSLIGLFLNDQELKKKAKKYDEVAKDVKLAAVLGAGIMGGGIAYQSALKGTPILMKDIREEGIQMGLNEAAKLLGKRVEKGRLTPAKMAEALNGIRPTMSYGDFGNVDIVVEAVVENPKVKQAVLAEVEGAVKEDAIIASNTSTISISLLAQALKRPENFCGMHFFNPVHMMPLVEVIRGEKTGETAIATTVAYAKKMGKSPIVVNDCPGFLVNRVLFPYFGGFAKLLSFGVDFVRIDKVMEKFGWPMGPAYLSDVVGIDTGHHGRDVMAEGFPDRMAVEGKTAVDVMYEANRLGQKNGKGFYAYETDKRGKPKKVTDPQAYEVLKPIVVEQREVTDEDIVNFMMIPLCLETVRCLEDGIVETAAEADMGLIYGIGFPPFRGGALRYIDSIGVAEFVALADKYAELGALYHPTAKLREMAKNGQKFFG

SEQ ID NO: 36629 - protein, 262 aa, Neisseria meningitidis
KTSTRTRCAFEVAARDQGAGVTYLEPSASQIGHKESIKDTARVLGRMYDAIEYRGFGQEVVEELAKYAGVPVFNGLTNEFHPTQMLADALTMREHSGKPLNQTAFAYVGDARYNMGNSLLILGAKLGMDVRIGAPQSLWPSEGIIAAAHAAAKETGAKITLTENAHEAVKNVDFIHTDVWVSMGEPKEVWQERIDLLKDYRVTPELMAASGNPQVKFMHCLPAFHNRETKVGEWIYETFGLNGVEVTEEVFESPASIVFDQA

SEQ ID NO: 36630 - protein, 1135 aa, Magnetococcus sp. MC-1
MSQSPLQTSSSQSRDGMCGICPAGCWVRVHYAGETMVAVEPRPDHPLGMICRIGRKSPNIVYDPQRLQTPLKRVGPKGSYAFEPISWDEAMATIASRLQQTKAQHGAEATAIYTGRGSFDMAMCDLFQPADVAVSSASSVLFPFGSPNTLGVGALCYVSFAMIAPHVTFGEMLISLETDLPQSELIVLWGANPATDSPPMAHGQILAAKQRGAEVLVIDPRRSESCVEADAQWYPIRPGTDGALALGMIHVLIEEELYDENFVKNWTLGFEELAQYVQHFHPDVVAEITGVPAEQVRNIARKIANAAGACPVMYTGLEYSDSGVQAIRAVFTLWALAGQLDVPGGLLIRMKENQFPQNRTHLIKNPGADKALGRDRFPVYSAYRGESHAIALPQSVLQGTPYKVRDLIVLGGSLITSWPDPELWKRTLNALEFLVVIDRYHTADSAYADIVLPATTLYECRSFMRYGPMFAIREKLVPPVGEARNDFLILAELAQRLGYGHLYPQTEAAILERALEGSGFTLEQVQAAGGVVQLESQMMQYKKWEKGRLREDGKPGFATPSGKFEIASSLLVEHGYDALPVYTEPQEGPLARPDLARHFPLVLNTGARTYYDFRSQHHGVKGLAEQQPDPRVTMNHEDAAQRGIQNGDWVWVSSPRGEVKYRARVTDAIVKGSVDANMGGGGPVGPAPWQACNVNALTDPEHYDPISGFPIYKTLLCQIRKAADADAQFMEIEEPDRGPTLADTPGVQQVIYLDHNATTPMDETVIAAMRPYLESAFGNPSSIHGLGVKARHGVEAARRQVAQLLGSTARRIIFTGGGSEADNLALRGVVARYPGQSCHIITSAVEHPAILACCAALARQGHRITYLPVDAQGVVNQDAYVDALTPQTTLVSIMAANNETGTLQPIQAMAAQARAMGVLFHSDGVQALGKIPLNVDDLGVDLLSLSAHKIHGPKGVGALYLRKGVEIEPLIAGGSQEWGLRAGTENVAGIVGFGKACERADHALRHGEAQRLAQLRDRLEDGLLALVPGAKRNGPPHNRLPNTLNLTLPGIRGESLVLVMERQGVYFSSGSACKSGNPDPSHALLAMGISPADAHCSVRFSLGSGTTLAQLERLLALFKETLADTMGSIRFVSCR

SEQ ID NO: 36631 - protein, 214 aa, Haemophilus somnus 2336
MNQSLLSQFGTSEERVKRAIEAFKRGNGVLVLDDEDRENEGDLIFPAETITVEQMAKLIRYGSGIVCLCITDELCQQLDLPPMVQNNTSINQTAFTVSIEAAQGVSTGVSAQDRVTTIQVAIADNAKPQDLSRPGHVFPLRAKKGGVLARRGHTEAAVDLASWAGHKPAGVICEITNDDGSMARTLEIVEFGKKFNYPVVTIEDLVRYSSSKVV

SEQ ID NO: 36632 - protein, 228 aa, Oryza sativa
PAGISNSIPISSHSLLVVGFVLGSVDASLGDVDPQYRTCVEECHTTGIIGENIISHCQSPGNDDASVGSQLNCMNDCRYYCMMQREGERQSRGLNPVKYHGKWPFIRVSVFQEPLSAALSAVNLLMHFTGWLSFFLLVNYKLPVRPQTKRTYYEYTGLWHIYAILSMNAWFWSSIFHTRDIDLTEKLDYSSAVALLGYSLILSLLRNIHPFKHMHENAPGFKNLMYNN

SEQ ID NO: 36633 - protein, 312 aa, Triticum aestivum
  misc_feature (57)..(57): Xaa can be any naturally occurring amino acid
  misc_feature (257)..(257): Xaa can be any naturally occurring amino acid
RHEAVPHFPIATNFALDNHPCPSPPPTTSARRHRRPATASPGAPRAPPPSGPCAAAXVAAGATAGGEATAAVSAVNTSAKRDPVRRHTISVFVGDESGMINRIAGVFARRGYNIESLAVGLNKDKALFTIVVSGTDRVLKQVIEQLNKLVNVLNVEDLSKEPQVERELMLIKLNVEPDQRADVMFVANVFRAKVVDISENSLTLEVTGDPGKIVAAQRNLRKFGIEEICRTGKIALRREKIGAAARFWGFSAASYPXLVEASRKNPLTSVNKTVNGSFDQSSSAGGDVYPVEPYESLSMNQVLDAHWGVLDD

SEQ ID NO: 36634 - protein, 268 aa, Pseudomonas aeruginosa PAO1
MFRLSALYRYPIKSSAAESLERVALDALGVVGDRRWMAVDTETGRFFTQRLLPQLGRIQARWAAPEVLRLNAPGMSELSLEVPAADANLRGVTVWRDTLQAPDAGDAAADWLTRFLGRPTRLVHIPEARARQVDTGYAEPGQKVHFADGFPLLLIGQASLDDLSQRVGRPLEMLRFRPNLVVEGSAAFAEDGWKRIRIGSVEFVVAKPCSRCILTTLDPATGERNEDREPLTTLKTYREKDGAVLFGQNLIALGQGSLEVGMPVEILD

SEQ ID NO: 36635 - protein, 176 aa, Zea mays
  misc_feature (30)..(30): Xaa can be any naturally occurring amino acid
  misc_feature (36)..(36): Xaa can be any naturally occurring amino acid
  misc_feature (48)..(48): Xaa can be any naturally occurring amino acid
  misc_feature (90)..(90): Xaa can be any naturally occurring amino acid
  misc_feature (150)..(150): Xaa can be any naturally occurring amino acid
GRTRLAGQMIMGSTLELRQQALDRFLAYQXCDFEGXNRAMDGLPATIXLLGPCPPQVPSRGNMKRHCRVNYVLETGANQKDALLRIEKLXIINPLLVLRGCRLVILYPELTEMQALSILKAAITMTNNGDQVLPKIINDLVGTPQELRNXVTIIHQDSEKVICNDDKTIVYKGETM

SEQ ID NO: 36636 - protein, 261 aa, Vulpicida juniperina
VEHGDVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEIISNASCTTNCLAPLAKVMHDNFTIIEGLMTTIHSYTATQKTVDGPSSKDWRGGRTAAQNIIPSSTGAAKAVGKVIPSLNGKLTGMSMRVPTSNVSVVDLTCRLEKSVTYDQIKATMKKASEGELKGIMSYSEDALVS

SEQ ID NO: 36637 - protein, 132 aa, Glycine max
MADQSAAWPIADAALSQEILDLVQQASHARQLKKGANEATKTLNRGISEIIILAADTTPLAILLHLPLLCEDKNTPYVYVPSKMALGRACGVSRAVISCSITTNEASDLMGQIRALKDKVERLMIVAIFDEI

SEQ ID NO: 36638 - protein, 262 aa, Arabidopsis thaliana; identical to SEQ ID NO: 1234

SEQ ID NO: 36639 - protein, 475 aa, Burkholderia sp. 383
MQTMNLINGERVAGDGEAFPVVNPATGETVVTMRDASAEQVDAAVAAAAAAFPSWSATPPGARAARLLALADAIEERADEFAALESLNCGKPLHAVKADELPLTVDVFRFMAGAARCVSASSAGEYVAGFTSMIRRDAVGVVGSIAPWNYPLMMAAWKLAPALAAGCPVVLKPSELTPLTSLRVAELAAELFPRGVVNVVVGRGATTGDALINHRQLDLVSLTGGPATASRILEASSRKLMHTHMELGGKAPVIVFDDTNLDAAVEGIRNAAFFNAGQDCAQPCRLYVEDGIYDTFVANLANRVASIRLGAPDDTRTEMGPVISEGHRRRIAGFVDRARDLRHVEILTGGRDVAGGGYFYEPTIVAHARQDDEIVQREVFGPVISVTRFSGAEQAIHYANDSPYGLASSIWTRDVGKAMTVASRLRCGITWINAHGVATAEMPHGGMKASGYGSDMSVYALENYTTVRHVQIAHA

SEQ ID NO: 36640 - protein, 248 aa, Vernicia fordii
MARIAFGRFDDSFSLGSFKAYLAEFISTLLYVFAGVGSAIAYNKLTANAALDPAGLVAIAICHGFALFVAVAVGANISGGHVNPAVAFGLALGGQITILTGIFYWIAQLLGSIVACFLLKLVTGGLAIPTHSVAGRVGAIEGVVMEIIITFALVYTVYATAADPKKGSLGTIAPIAIGFIVGANILAAGPFSGGSMYPARSFGPAVVSGDFHDNWIYWVGPLIGGGLAGLIYGNLYISGDHTPLSNDF

SEQ ID NO: 36641 - protein, 181 aa, Gossypium hirsutum
MGLSFAKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKG

SEQ ID NO: 36642 - protein, 491 aa, Brassica oleracea
MVALTAEKQDQNLLSRMAAGDGHGEKSAYFDGWKAYEENPFHPIDRPDGVIQMGLAENQLCGDLMRKWVLEHPEASICTAEGVNQFSDIAIFQDYHGLPEFRQAVAKFMEKTRNNKVKFDPDRIVMSGGATGAHETVAFCLANPGDGFLVPTPYYPGFDRDLRWRTGVNLVPVTCHSSNGFKITAEALDAAYENARVSNIPVKGLLITNPSNPLGTTLDRDCLKSLVKFTNDKGIHLIADEIYAATTFGESEFISVAEVIDEIPDCNTDLIHIVYSLSKDMGLPGLRVGIVYSYNDRVVQIARKMSSFGLVSSQTQHLIAKMLSDEDFVDEFIRKSKLRLAERHAELTTGLDGLSIGWLKAGAGLFIWMDLRNLLKTATFDSEMELWRVIVHKVKLNVSPGGSCHCHEPGWFRVCFANMDYQTMETALERIRVFTSQTEEESLILTKPMAKKKKCWQSSLRLSFKDTRRFEEGFFSPHSPVPPSPLVRAQI

SEQ ID NO: 36643 - protein, 69 aa, Glycine max
  misc_feature (55)..(55): Xaa can be any naturally occurring amino acid
MAEKDATTLKLKPRRLKGHDDSTTCCIASRERSHLIVTSGDDGRVCWFDLRCPDXAELVMDVSVEPVSS

SEQ ID NO: 36644 - protein, 480 aa, Yarrowia lipolytica CLIB122
MVAQLVSYYLRAAVASPKLLYDHGMPNGEVLDMAYLTDELLISAGPTNDYRRSFYRPATAELKQYLDSNHKDGWLVYNFRAEPSGYEDSDLDNRVVHLPFRDHTPPPFFYIPLFIESIRDHVGGANPAKRTPPSTPPRAPSSDSVDTDTSTRPLAPSQSSLLEGISSDPSLVPTTDVSSLQLWERSDSGRSHSSGSDDTSLASQMSVNSQMSQVSQASSQSQISRISGSLQSSIGSTVSAPRVAVLHCKAGKGRSGLMGCAFLVAERGWSVKNAADSFTRVRMRPGFGEGVSIQSQKRYLNYTYDWAQVIARQYRDIKVDLDYIRVWKPQYSDIVITLSDYENDSDRAEYSPSAIPEVKKRYISSPEDLTNETDDYITFRPKETVSLTGDCRVKVKHVVANPFSLPLVDGQGDAWFNLFFETFRVREGAYDFHNTEGMFSVSWSHMDGFRGNFQKGMWLCERVEVGWRVAQSQEGTVQES

SEQ ID NO: 36645 - protein, 249 aa, Glycine max
MDRYQKVEKPRAETPIDENEIRITSQGRMRNYITYAMSLLQEKGSNEIVFKAMGRAINKTVTIVELIKRRIVGLHQNTAIGSTDITDTWEPLEEGLLPLETTRHVSMITITLSKKELDTSSVGYQPPLPADQVKAATDFDYEGEGSPNGRVRGRGGRGRGRGRGNGFISADYEDGGWDRNRGNARGRGRGRGRGFRGRGRGGYNGPHVDMQDGGYNQDVPQGRGRGRGRGGYRGRGRGFRSNGPIQAAA

SEQ ID NO: 36646 - protein, 272 aa, Bacillus anthracis str. A2012
MSTQYLNSNLKVFSLNSNKELAEQIAKHIGVGLGKCSVDRFSDGEVQINIEESIRGCDVFIIQSTSFPVNEHIMELLIMIDALKRASAKTINIVIPYYGYARQDRKARSREPITSKLVANLLETAGATRVITLDLHAPQIQGFFDIPIDHLMGVPILSDYFETKGLKDIVIVSPDHGGVTRARKMADRLKAPIAIIDKRRPRPNVSEVMNIIGNIEGKTAILIDDIIDTAGTITLAANALVENGASEVYACCTHPVLSGPAIERIQSQILKS

SEQ ID NO: 36647 - protein, 553 aa, Salmonella typhimurium LT2
MMPFRALIDACWKEKYTASRFTRDVIAGITVGIIAIPLAMALAIGSGVAPQYGLYTSAVAGIVIALTGGSRFSVSGPTAAFVVILYPVSQQFGLAGLLVATLMSGFFLILFGLARLGRLIEYIPVSVTLGFTSGIGITIGTMQIKDFLGLQMAHVPEHYLQKVGALFMALPTVNIGDAAIGVVTLGTLIFWPRLGIRLPGHLPALLAGCAVMGIVNLLGGNVATIGSQFHYVLADGTQGNGIPQLLPQLMLPWSLPGSDFTLSWDSLRALLPAAFSMAMLGAIESLLCAVVLDGMTGTKHKANSELIGQGLGNMVAPFFGGITATAAIARSAANVRAGATSPISAVIHAILVILALLVLAPLLSWLPLSAMAALLLMVAWNMSEAHKVVDLLRHAPKDDIIVMLLCMSLTVLFDMVIAISVGIVLASLLFMRRIARMTRLAPVNVDVPDDVLVLRVIGPLFFAAAEGLFTDLESRIKGKRIVVLKWDAVPVLDAGGLDAFQRFVKRLPEGCELRISNLEFQPLRTMARAGIKPIPGRLTFFPNRTEALADLLS

SEQ ID NO: 36648 - protein, 429 aa, Escherichia coli [sequence omitted]

SEQ ID NO: 36649 - protein, 533 aa, Burkholderia pseudomallei K96243
MKSSIQRNIGPFALMLTGLGSIIGSGWLFGAWKAAKIAGPAAICAWIIGAVVILAIALTYAELGAMFPESGGMVRYARYSHGSLVGFISAWANWIAIVSVIPIEAEASIQYMSTWPYAWAHALFVNGELTTPGLLLSAILVVIYFLLNYWGVKLFARANTAITIFKFLIPGLTIAGLLLSSFHSENLGTAGGSSGFAPYGWSAVLTAVATSGIVFAFNGFQSPVNLAGEARNPSRSVPFAVISSILIALVIYVLLQVAYIGAVNPADVAKGWAHFNFASPFAELAIALNLNWLAILLYVDAFVSPSGTGTTYMATTTRMIYAMERNNTMPKIFGSVHPLYGVPRPAMWFNLMVSFVFLFFFRGWSSLAAVISVATVISYLTGPISLMALRRAATDLERPLAIPCMKLIAPFAFVCASLILYWAKWPLTGEIILLMIVALPVYFYYQGKAGWSGWGRDLKAAWWLVAYLPTMAVLSLIGSKEFGGHGVLPYGWDMLVVAAIALVFYYWGVHTGYRTEYLDERESRDEILEGIGA

SEQ ID NO: 36650 - protein, 509 aa, Oryza sativa Indica Group
MEKLKSELWMTAVATCMSLLLYLTILRRRHASGGRSLSLPPGPTPLPLIGNLFCLGGIFHQTLAKLARVHGPVMTLKLGLTTAVVVSSAEAAREAYTKHDQRLAARPVPDAFRANGFSERSIVFSPSSDPQWKNLRGIHATHIFSPRALAALRGIRARKVRDIVGYIRTVAGEEMCVREVVHNGVLNLISNSFFSMDMADVGSESARGLHGLIEDIIATVAGPNVSDFFPFLRQLDLQGLRRQTGSHLGIVFGLLDDIIDRRMAESRDHPDKQQHGDYLDALINLSSTGKIPRYHITYLLFDIFAAGADTMTTTVEWAMAELLRNPRVMAKVRAEVMDALGGKESFDEGDAASLTYLQCVFKEAMRLHPVGSILVPHLAQQDGVEIGGYAVPKGTTVIFNAWAIMRDPAAWESPDQFLPERFLHKESSSPPLELRGKDYEYIPFGSGRRLCPGLPLAERAVPFILASLLHAFEWRLPDGMSPDDMDMTEKFATANVLATPLKAVPVVTH

SEQ ID NO: 36651 - protein, 246 aa, Prochlorococcus marinus str. NATL2A
MLKIIKADFSIIKERDPAARGFLEIVFCYPGFQALVVHRISHKLWNLKLPLVPRLLSQITRFLTGVEIHPGAKIGKAVFIDHGMGVVIGETSEIGNRCLLYQGVTLGGTGKENGKRHPTLEANVVVGAGAKVLGAIIVGTNTRIGAGSVVVRDVEADSTVVGIPGRVVHQSGVKINPLAHSALPDTEGNVIRNLMERIDELENQVINFQEIIRNSNIGINDKNFHQGESQNLKDKEIIEFIGKNKK

SEQ ID NO: 36652 - protein, 432 aa, Candida glabrata CBS 138
MGLSKILGSNDNIVNKNGSSNTGGSKKSSFFSLNSKRNTDAAGIVPDFTSIKAPRTIYKNANFSISGKYEIIQVLGKGSYGVVCSAKHKLDNEDQEQFTVAIKKITNIFYRKILLKRAIREIKFMNYFKGHKHIVNLIDIEIVQDKPYDGLYCYQELIDYDLARVIHSSVQLSEFHIQHFIYQILCGVKYIHSADVIHRDLKPGNILCTVNGCLKICDFGLARGVAKQFVNKNSKPNEITNYVATRWYRAPELILSNNEYTKSVDMWSVGCILAEFYGRRPIFMGKDSIHQVYEIKKILGTPSRSLLVKYGTLKAWNLFGHNSNHNLDNLKSGMPWSTVYPMASATALDLIDKLLQWEPESRLNVLQSLEHQFVQSVRKPNDEPICSKGPFNFSYEYNLNSMDDLRQCLNEEVAQFYIERQLGEEYSKYIEE

SEQ ID NO: 36653 - protein, 346 aa, Mycobacterium avium
MRITHGGYRVAAVWSSTDRGLEGVILKISVVGSGYVGLVTGACLADSGNDVVCVDIDQAKIDLLLAGSVPIFEPGLAELIARNRENGLIDFTTDRQRGIEHADVIFIAVPTPMGESGAADLTYVFSVADDIGSYIDRYKVIVDKSTVPVGTADQITAIIRSKTDQEFDVVSNPEFLKQGKAIADFMQPDRVVIGSDSKRALRIMEELYEPFLRTFHPLIAIDVRSAEMAKYAANCFLATKISFINEMSNLCEKAGADISAVREAIGADKRIGYDFLFPGIGYGASCLPKDVRALLYTADCLGSDMHLLRAVERVNDEQKAALVSKIITRFGGSEKNLDGCALGCGD

SEQ ID NO: 36654 - protein, 156 aa, Brassica napus
  misc_feature (85)..(85): Xaa can be any naturally occurring amino acid
MSGIGKGQDCGTKGRMDTNDSLRVARLWHSMHAISQQLSPVNGCSGIELLQADTFDLHCFQSLPGLYIYSYICLPFMFILSLDCXLLIFLPGTKFFVVCEPGTPHMESLLRYIYELYTDYVLKNPFYEIEMPIRCELFDINLSQAVLSDRVALLGR

SEQ ID NO: 36655 - protein, 558 aa, Oryza sativa Japonica Group
MAETRRWELAAHRRLEKGKVVGVVVLDGWGEAAPDTFNCIHVADTPTLDALKKGGPERWRVIKAHGTAVGLPTDDDMGNSEVGHNALGAGQIYAQGAKLVDMALASGKIYEGEGFKYIQQSFENGTLHLIGLLSDGGVHSRIDQLQLLLKGASEHGAKRIRVHILTDGRDVLDGSSVKFVELIENDLAKLRDKGVDARIASGGGRMYVTMDRYENDWQVVKRGWDAQVLGEAPHKFQNALEAVKKLREDPKANDQYLPPFVIVDERGRPIGPIMDGDAVVTFNFRADRMVMLAKALEYESFDKFDRVRFPKIRYAGMLQYDGELKLPSHFLVAPPEIERTSGEYLARNGIRTYACSETVKFGHVTFFWNGNRSGYFHPNLEKYEEIPSDIGIPFNEQPKMKAVEIAKKTRDAILSRKFDQVRVNIANGDMVGHTGDIEATIVGCKAADEAVKIVLDAIEQVGGIFVVTADHGNAEDMVKRDKSGKPLRDKDGNVQPLTSHTLNPVPIAIGGPGLQPGVRFRSDLPSAGLANVAATVMNLHGFEAPDHYEPTLIEVVDK

SEQ ID NO: 36656 - protein, 538 aa, Arabidopsis thaliana
MLDSLVSKLPSLSTSDHASVVALNLFVALLCACIVLGHLLKENRWMNESITALLIGLGTGVTILLISKGKSSHLLVFSEDLFFIYLLPPIIFNAGFQVKKKQFFRNFVTIMLFGAVGTIISCTIISLGVTQFFKKLDIGTFDLGDYLAIGAIFAATDSVCTLQVLNQDETPLLYSLVFGEGVVNDATSVVVFNAIQSFDLTHLNHEAAFHLLGNFLYLFLLSTLLGAATGLISAYVIKKLYFGRHSTDREVALMMLMAYLSYMLAELFDLSGILTVFFCGIVMSHYTWHNVTESSRITTKHTFATLSFLAETFIFLYVGMDALDIDKWRSVSDTPGTSIAVSSILMGLVMVGRAAFVFPLSFLSNLAKKNQSEKINFNMQVVIWWSGLMRGAVSMALAYNKFTRAGHTDVRGNAIMITSTITVCLFSTVVFGMLTKPLISYLLPHQNATTSMLSDDNTPKSIHIPLLDQDSFIEPSGNHNVPQPDSIRGFLTRPTRTVHYYWRQFDDSFMRPVFGGRGFVPFVPGSPTERNPPDLSKA

SEQ ID NO: 36657 - protein, 125 aa, Polaromonas sp. JS666
MAFDKDAFLTALDSMTVLELNDLVKAIEEKFGVSAAAMAAPAAAGGGGAAAAAEEKTEFNVVLLEAGANKVSVIKAVREITGLGLKEAKDLVDGAPKNVKEAAPKADADAAKKKLEDAGAKVELK

SEQ ID NO: 36658 - protein, 506 aa, Schizosaccharomyces pombe 972h-
MNQDDNGKNVVSKVSDLTSCSDFSTSSPVPCLNPLSHENNRIDLIRDLLASLSKEGVVAVYNHVRSLLFTDFTEVFPEEVSLRVFSYLDQLDLCKCKLMSKRWKRLLEDPGIWKALYMQKGWFVNENVLNEFEAWRRTHKFPQPRFENFLKQQNIIGPYGTMFLPQQFIFDSNGRPLLNWSYLYKEHAHLDSNWRHGRFLVSTFNNPSIRFPADQDFRATLDSVYCVQYDDEIMVSGSKDRTVSVWDVNSRFILYKLYGHSGSVLCLDFCRRRNLLVSGSSDSTIIIWDWQNRRPLKVYFGHTDNVLGVVVSENYIISSSRDHTARVWRLDATSPAEACMHVLRGHLASVNSVQYSSKTGLIVTASSDRTLRTWDITTGHCIRIIHAHQRGIACAQYNGKFIVSGSSDLTIRIFEASSGKLLRMLQGHEDLIRTVRFNDEKIVSGGYDGTVRIWNFNTGEQHCVLHNSRNSRVFGLQFDHRRIIACTHSSEILVWNFDDGLDCTFF

SEQ ID NO: 36659 - protein, 526 aa, Pseudomonas aeruginosa PAO1
MTSAWNEEWRRRRLPALAGQEWDLIVVGGGISGAGILREAARRGWRCLLLEQRDFAWGTSSRSSKMVHGGLRYIAKGQWRLTRDSVRERQRLLGEAPGLVEPLSFVMAHYRGGFPGPRLFGGLLSVYDALAGRRNHRFYDAAALRYLAPGLKEQRLLGGTRFFDAVTDDARLVLRVLAEARHDGGEAFNGMRVRELLREGGQVVGLRAEDRESGELFDFRCRALALATGAWADELRQPGGSEHIRPLRGSHLLLPAWRLPVAHAFSFMHATDRRPVFVFPWEGATVVGTTDLDHRDGLGEDARISRAELDYLLAACAQQFPAAAIEARDVLSTWAGVRPVVSSGDDSGKPSDEKREHVLWREPGCVTLAGGKLTTFRPLAVEVLQACAPLLGRTVTDDGAAVFGACEGPLIDGLGSGQRRRLAGRYGRDLVRLKRLVDTLGTDCVGASETLWAELAFAAEAEMVLHLDDLLLRRTRLGLLLPGGGAAYLPRIRALCQARLGWDDPRWEREQQAYLDLWRRHYSLPV

SEQ ID NO: 36660 - protein, 428 aa, delta proteobacterium MLMS-1
MGEIIGVQGREVIDSRGNPTVEVEVFLDSGASGRALVPSGASTGVREALELRDSRKKRYLGKGVETAVANVNNIIGPAITGLESCEQVLIDRVMLELDGTDNKKKLGANAILGVSMAVARASAEDCALPLYSYLGGVNAKVLPVPMMNVLNGGAHADNNVDVQEFMIMPLGAPSFKEALRMGVETFHSLKAVLKKAGHQTAVGDEGGFAPNLRSNEEAMECLLEAINSAGYKPGKDIAIALDVAASELYDAKAKCYVLAAEEKSKKSAAELVKLYASWLKKYPLVSIEDGLAEGDWAGWKKMTAELGGKVQIVGDDIFVTNTAILARGIKEGAANSILVKLNQIGSVTETIDAVDMAHRAGFTAVISHRSGETEDTTIADLAVALNTGQIKTGAPSRTDRVAKYNQLLRIEDELGAAARYAGAGALGL

SEQ ID NO: 36661 - protein, 517 aa, Triticum aestivum
  misc_feature (330)..(330): Xaa can be any naturally occurring amino acid
MDKAYIAILSFAFLFLIHYILGKVTNGRHSKGAVQLPPSPRAIPFLGHLHLLEKPFHAALCGLAKRLGPVFSLRLGSRRAVVVSSPECARECFTEHDVIFADRPQFPSQLLVSFDGIALSTSSYGPHWRNLRRVAAVQLLSAHRVACMSGVIGGEVRAMARRLFRAAAASPDGAARVELKRRLFELSLSVLMETIAQTKGTRPEADADTDMSLEAQEFKKVVDEIIPHIGAANLWDYLPVLRWFDVFGVRNKILAAVSRRDAFMLHLIDNERRRLDDGGAEGDKKSMIAVLLTLQKTEPEVYTDTMIMALCANLFGAGTETTSTTTEWAXMSLLLNHPAALKEAQAEIDAAVGTSRLVTADDVPRLAYLQCIVSETLRLYPAAPMLLPHQSSADCKVGGYNVPSGTMLMVNAYAIHRDPAAWERPLEFVPERFEDGKAEGRFMIPFGMGRRRCPGETLALRTIGMVLATLVQCFDWERVDGAEVDMTEGGGLTIPKAVPLEAVCRPRPAMRDVLESL

SEQ ID NO: 36662 - protein, 229 aa, Mycobacterium smegmatis str. MC2 155
MSRASLEKNPHDVASMFDAVAKRYDLTNTVLSLGQDRFWRRETKSALRIGPADKVLDLAAGTAVSTVELAKSGAWCVAADFSVGMLAAGASRQVPKVAGDATRLPFADEVFDAVTISFGLRNVVDHKAGLREMARVTKPGGRLVVCEFSTPTNRLFSTVYKEYLMKALPAMATAVSSNPEAYVYLAESIRAWPTQAELARQIGEAGWSDVRWRNLTGGIVALHAATKPA

SEQ ID NO: 36663 - protein, 559 aa, Ustilago maydis 521
MSTNALQTPEVPLKPAHPALRLPVLELPPLVTDPEVEANRAANEALIRELNERTQSVLNQGSGKTQLLHLSRGMLLARDRIALLLDQDSPFLQLCTFAGYEQKDCTPSGSVVGGIGLVSNTLTMCIAHIPTLQGASANRAQIAKIQRLGQIAHENRLPIVFLVHSAGANLQQQFEFHHGARQFYDLATRSQDGIPTCSVVFGQCPAAGAYTPGMSDMTIMIRDQAQLFLGGPPLVKMATGEESTAEELGGAEKHATVSGVADCLVNNEVEAITEARYWVASLNWASRISRPEALLTPQWQSLEPLYSMDSLLDVAQANIKKPWRIEQLIARITDGSRFNAFKPLYGANTVTGFAYVAGHPVGIIGNNGVLNPSDAQKTTQFIRLANNNNVPLLFLHNISGFMVGREFEAAGSIKYGSLLINAVANSRVPHISIIVGSSYGAGNCAMCGRAYDPRFLFTWPQGRTSVMGPDALAGVVDMVEREILSRSAKPIDEVRQQKRREAMFEKVSTESDSYYSSSRLLDDGIIDPRSTRDVVGFCLEIFAQEKIQGNPGFGGVSRM

SEQ ID NO: 36664 - protein, 601 aa, Legionella pneumophila subsp. pneumophila str. Philadelphia 1
MFGFVSDLLTAAVSSLDELLQDTPAHQIILGTAALYFLYNQYHNPSISRWYRSRNNASMKQRIIDSAYALAKNLPGVNQIIEKELNKELSSTREKLRIQRSGMTLREEIPEEGLSPQDILSAFDVDVEKCHFDFLSVTNDSPEREFLVERGDGKDSGALYAIHPKELTELLKEVYGATALTNPLHDKWPRINAMQAEVIRWCQNLFHGSKECYGLLTHGGTTSIIEAMAAYVIRARAKGIDYPEIVVPETAHAAFKKAAELTGAILITVPVDKKTGAVNPKVMSSYITRNTAVIVGSAPSFMNGIHDPVSELGQLAKKKNVPFHVDACLGGFLTAFLDTSSEPMDFRVPGVTSISADLHKYGCCPKGTSVCLFSEDSPALSVYAALNWSGGLYATPGILDGSTSGARVAEVYATLSYYGKNKYQEIAKSIITLRNAIQKELTTLLEEGNGLTSEDIYVYGNPQWSILGFRSNTCNAHFIADELEKRGWKLNLLQNPDGFHLCLTHVHTLVKGFETQFIKDLREAVIDVKNYPPGKKPSGNVKVYGAVGMMPIELQREICKQYQKARLNYTSASPGSLRIFTNVPVEEDEGLRNRKTEKYKV

SEQ ID NO: 36665 - protein, 331 aa, Chlamydomonas reinhardtii
MEWTTIESDPGVFTELIENIGVKGVQVEELWSLDQLRELSPVFGLVFLFKWKKEPVRPATTTDAGQVFFAKQVISNACATQAILNILLNVKAPGLDLGTELANFREFVSDFDPTMKGLAISNSDLIRTAHNSFARPEPLVPDNDKDDEKSGDAYHFISYVPVGGKLFELDGLQEGPIELCDCTDDDWLDKVGPHITARMERYAASEIRFNLMALVGNRADIYSSRLAAATAQRDQLAAAAAAADGMSDEDLAHAQAKLLEAETEVANLQEALAAEQAKHRTWHEENVRRKHNYVPFLFQLLKLMAARGQMGPLLERARRPAAAGGGNGTKQ

SEQ ID NO: 36666 - protein, 136 aa, Brassica napus
MESELVLHEGGCHCGKIKWRVKASRRVVAWSCNCTDCSMRGNVHFIVPSSDFELLDDSKDFITTYTFGTHTAKHTFCKVCGITSFYTPRSNPDGVSVTVKCVKAGTLDHVEIRTYDGLNWEKSHKETGIASFSNES

SEQ ID NO: 36667 - protein, 231 aa, Schizosaccharomyces pombe 972h-
MDFALPTTASQASAFMNNSSLTFPVLPNANNEATNETADSGDAEVSKNEGVSGIVPTLQNIVATVNLDCRLDLKTIALHARNAEYNPKRFAAVIMRIREPKSTALIFASGKMVVLGGKSEDDSKLASRKYARIIQKLGFNAKFTDFKIQNIVGSCDVKFPIRLEGLAYSHGTFSSYEPELFPGLIYRMVKPKVVLLIFVSGKIVLTGAKVREEIYQAFEAIYPVLSEFRKH

SEQ ID NO: 36668 - protein, 472 aa, Mycobacterium smegmatis str. MC2 155
MSRRGKIVCTLGPATSTDETVRALVEAGMDVARLNFSHGDYSDHEAAYKRVRAASDVTGHAVGIMADLQGPKIRLGRFKDGPTYWATGETVRITVEDCEGTHDRVSTTYKQLAQDAARGDRLLVDDGKVALKVEEVDGDDVVCTVTEGGPVSNNKGVSLPGMNVSVPAMSEKDIEDLEFAVRLGVDLVALSFVRSPADIELVHEVMDRVGRRVPVIAKLEKPEAIENLEAVVLAFDAVMVARGDLGVELPLEEVPLVQKRAIQMARENAKPVIVATQMLESMIENSRPTRAEASDVANAVLDGADAVMLSGETSVGKYPLEAVRTMARIIQAVEDNSVVVPPLTHVPRTKRGVISYAARDIGERLDAKALVAFTQSGDTVRRLARLHTPLPVLAFTALPEVRSQLALTWGTETFIVPQMSNTDDMIRQVDKSLLELGRYKRGELVVIVAGAPPGTVGSTNLIHVHRIGEDDV

SEQ ID NO: 36669 - protein, 175 aa, Triticum aestivum
MAPTVMASSATSVAPFQGLKSTDGLPVSRRSNGASLGSVSNGGRIRCMHVWPIEGIKKCETLSYLPPLSTEALLKQVDYLIRSKWVPCLEFSKVGFIFREHNASPGYYDGRYWTMWKLPMFGCTDATQVINEVDEVNKEYPDAYVRIIGFDNMRQVQCVSFIAFKPPGCDESGKA

SEQ ID NO: 36670 - protein, 357 aa, Fusobacterium nucleatum subsp. vincentii ATCC 49256
MYNRQLILEDGTVYKGYAFGADIENIGEVVFNTSMTGYQEILSDPSYNGQIVTLTYPLVGNYGINRDDFESMKPCIKGMIVKEVCTTPSNFRSEKTLDEALKDFGIPGIYGIDTRALTRKLRSKGVVKGCLVSMDKNVEEVVAELKKTTLPTNQIEQVSTKSISPALGRGRRVVLVDLGMKIGIVRELISRGCDVIVVPYNITAAEVLRLEPDGVMLTNGPGDPEDAKESIEMIKGIIDKVTIFGICMGHQLVSLACGAKTYKLKFGHRGGNHPVKNILTGRVDITSQNHGYAVDIDSLKDTDLELTHIAINDRSCEGVRHKKYPVFTVQFHPEAAAGPHDTSYLFDEFIKNIDKNL

SEQ ID NO: 36671 - protein, 227 aa, Vitis vinifera
MVRIQKNIIHHLGHTYKVIVNPGYIDALKHLTDLKEEGKIKTVALTNFDTKRLQIILENEIPVASNQVQHSIVDMRPQQKMAELFKLITYGTVMGGLLFEKFLDTNIAIPFSAPPLNTQSLQKYKRMVDAWGGWSHSQTLLRTLKTVATKHGVSIPTVAVKYILDYPAVAGSMVGVRLGLSEHINDSNVVFSLVLDEDDVNNIQEVLKKGKDLLRVIGDCGDEYKCA

SEQ ID NO: 36672 - protein, 496 aa, Lactobacillus casei
MRKELEAVANKADVALAAQKEAAMLSEKLPKSARKRLRIISVIATFGGMLFGYDTGVINGALPFMTRASELNMSPGMEGFVASSLTLGAAFGAVLTGRISDRKGRHKVITGLAMLFVVSTIASALSPNAPILAGVRFILGLAVGGTSVIVPTFLAEVAPSNLRGRIVTQNEFMIVSGQLLAFVFNAILGTTLGHIPGIWRWMLVLATIPAIILWIGMSFVPESPRWLAANGKLDQALKVLREIRTEAQAKDEMEKIKISLKSAQEVGNASIKDLKISWIRRLVLIGIGLGIMQQIVGINVMMYYGTTILQTTGFGQNAALIANILNGVTSVVATIVTMHLMSKFKRRQMLLTGISGTLFSLVGITLTSHFLNGSPLLPYATILLTIIYLAFFQGALGPLTWLLLSEIYPARLRGLGMGFATFFLWISNFFVGYFFPVMLAGLGMSNTFLVFVGANILSLIFAWKFAPETAGRSLEEIELDNKYDDKFPEESQINKN

SEQ ID NO: 36673 - protein, 496 aa, Staphylococcus epidermidis RP62A
MENKNNNVDRGNLKQNLSEKFVWAIAYGSCIGWGAFILPGDWIKQSGPIASSIGIVIGALLMILIAVSYGALVEKFPVSGGAFAFSFLSFGRYVSFFSSWFLTFGYVCVVALNATAFSLLIKFLLPNVLNNGKLYTVAGWDVYITEIVIATVLLIVFMLITIRGASVSGSLQYYFCVAMVLVVALMFIGSFFSSHFSLSHLEPLASVDKGWFQSIIMIVSIAPWAYVGFDNIPQTAEEFNFSPNKTFKLIVYSLLAASLTYVVMLLYTGWLGTQATSLNGNLWLTGAVTQDAFGFIGLAVLAVAIIMGIFTGLNGFLMSSSRLLFSMGRSGIMPTVFSKLHSKHKTPYVAIIFLVAVSLIAPWLGRTALTWIVDMSSTGVSIAYFITCLSATKLFSFNKQSNTYAPVYKIFGIIGSIVSFVFLCLLLIPGSPAALSIPSYIALGIWLVIGLIFFIIRLPKLKKMNNDEMSRLILNHSEDEVLEMIHEPGQSNSTNK

SEQ ID NO: 36674 - protein, 492 aa, Lactobacillus casei
MDTTKQNVKTLKNFINGKWVDAKTETFENVYNPATGDVLARVPHSTSEDVADAVTAAKEAFKIWQKVSIPKRAKILFKYQQLLVEHQEELGRIVTEENGKSLDEAVAEVGRGIENVEFAAGVPTLMMGDSLSSVATDVEATNYRYPIGVVGGITPFNFPMMVPCWMFPMAVATGNTFILKPSEKTPLTSQRLVELFQEAGLPDGVLNIVNGAVDVVNGILDHPDIKAISFVGSERVGEYVYKRGSDHLKRVQALTGAKNHTIVLADADLDAAVKGIISSSFGSAGERCMATSVLVLQDEIADKFMAKFTQAAKDIKIGNGLDKGVFLGPVIRKENQERTLNYIQTGVKEGAKLVLDGSAEAKKHDGYFVGPTIFEDVKTDMTIWHDEMFAPVLSVIRAKDLPQAVAIANTSELANGACLFTDSAASIRYFRENIDAGMLGINLGVPAPIAVFPFSGWKHSFFGTLHANGKDSVDFYTHKKVVTARYDQRRFK

SEQ ID NO: 36675 - protein, 219 aa, Triticum aestivum
MDSEHWISRLAAAKRFYAAQLGHIDDMSGMGMEEVDMDMEDDGEMDMEMEMQMEEARWPEVACPYCYEDYDLGSLCVHLEEDHPYEPHPAPCPICSEKITRDMLNHITMHHGYLFKALLGGGHSHRSRNTTTATTNIYADPLLSSFGLGFATSDAEEPSKSSVPVLDDTSILKEAPPQPWESSIDSSLTSEEREQKRKQATSRATFVQDLVLSTLFGDD

SEQ ID NO: 36676 - protein, 553 aa, Oryza sativa Indica Group
MASISPTSSSVAALRGHPVQFVKGGAVSKEAKGSISFSPVANSNNANVKFTGLRVAASLKRDGPFPGDGYSGNDNTVLPKSTSVRGQDYPTADSVLPTESVIVPEISNAGLKCVADMFSDEDKDTEQDLDSPTEGFSSISEAIKDIQQGKLVIVVDDESRENEGDLIMAASLVTPEAMAFVVRYGTGIVCVSMKEEDLERLNLPLMVATKENEEKLCTAFTVTVDAKQGTTTGVSAKDRAKTVMTLACPDSKPEDFNRPGHIFPLKYREGGVLKRAGHTEASVDLAMLAGLPPAAVLCEIVDEDGSMARLPKLRVFAERENLKIVSIADLIRYRRKRDRLVERSSVARLPLRWGNVRAYCYRSVIDGIEHIAMVKGEIGDGQGVLVRVHSECLTGDIFGSARCDCGDQLAMAMEMIEKAGRGVLVYLRGHEGRGIGLGHKLRAYNLQDDGRDTVEANEDLGLPVDSREYGIGAQILRDLGVRSMKLMTNNPAKYGGLKGYGLSIVGRVPLVTPITSENRRYLETKRTKMGHVYGLANGQASHQTGSNGAKGEH

SEQ ID NO: 36677 - protein, 329 aa, Staphylococcus epidermidis RP62A
MADLLSVLQDKLSGKNVKIVLPEGEDERVLIAATQLQKTDYVSPIVLGNEDNIKSLASKHALDLTQIEIIDPATSELKDELVDAFVERRKGKATKEQAVELLDNVNYFGTMLVYTGKAEGLVSGAAHSTGDTVRPALQIIKTKPGVSRTSGIFFMIKGDEQYIFGDCAINPELDAQGLAEIAVESAKSAQSFGMNPKVAMLSFSTKGSAKSDDVTKVQEALKLAQEKAEADQLEHVVIDGEFQFDAAIVPSVAEKKAPGAKIQGDANVFVFPSLEAGNIGYKIAQRLGGYDAVGPVLQGLNSPVNDLSRGCSTEDVYNLSIITAAQALQ

SEQ ID NO: 36678 - protein, 629 aa, Aspergillus oryzae
MRHVLNKEQLLMVKQAAIAWAAAEPLSVENVEVAPPKAHEVRIKILHTGVCHTDAYTLSGKDPEGAFPVILGHEGAGIVESVGEGVTNVKVGDYVIALYTPECGECKFCRSGKTNLCGKIRATQGRGVMPDGTTRFKARGKDLLHFMGCSTFSEYTVVADISVVAVTPSCPTDRSCLLGCGITTGYGAATVTANITEGSNVAVFGAGCVGLSIVQGAVKKKAGKIIVVDINDGKEAWAYKFGATHFLNPARLRKTVQDELIDMTDGGCDYTFDCTGNVSVMRAALEACHKGWGESIVIGVAAAGQEITTRPFQLVTGRVWRGCAFGGVKGRSQLPGLVEDYLNGDLKIDEFITHRETLANINTAFEQMKQGDCIRCVVDMVQYNAVEFCKKGIVYLVTLDKHAIEENLGRTSVLRSENGRSPGTGPESTTGLTISKINMPVSLHPLVDNGITKGDANFPGGNLYCLCPQNKVTVAIKGNVAHNHACGCSKCWKPAGALFSVVGVVPKENLSVAANADKLEILDKAAAIQRYACKECGTHLFGRIEIDHPFKGLDFVHAELSDKKGWQEPQFAGFVSSIIEQGFHPNGMDEVRSKFQSLGLQTYDTLSPPLMDLIATYTGKKNGKLSANL

SEQ ID NO: 36679 - protein, 441 aa, Salmonella typhimurium LT2
MYHGQLKNILLLSLRFIMDKLSYASDSSTSAWNTYLQQIERVAPYLGELSPWVDTLRHPKRALIVDIPVQMDDGTIRHFEGYRVQHNLSRGPGKGGVRYHPDVDLNEVMALSAWMTIKCAALNLPYGGAKGGIRVDPFSLSEGELERLTRRYTSEIGIIIGPQKDIPAPDVGTNGKVMAWMMDTYSMNHGTTVTGVVTGKPIHLGGSLGREKATGRGVFVSGLEAARRANIAVEGARVAVQGFGNVGSEAARLFAGAGARVVAIQDHTATLFNATGIDMKALTAWQTEHKQIAGFPGAETIASDAFWRLEMDILIPAALEGQITRQRAEALTCKLVLEGANGPTYPDADDVLASRGILVVPDVVCNAGGVTVSYFEWVQDMASFFWSEEEINARMDKIMTDAIVHVWEKAAEKSCSLRTAAYIVACERILLARKDRGIYPG

SEQ ID NO: 36680 - protein, 507 aa, Chlamydomonas reinhardtii
MGMRRATLGLLKSGLRDGSDALRSLSTSTALSQAAASGATNGSRDFMGWLKGGAARVTTPLSQPLPGVQPEQPAFRPLAPPPTEVTVLENGVRIISEASPGPTASLGMYINSGSIYENASNSGCSALLECLGFKATQHRNTLRIMKEVEKFGNTIVANASREQMSYTIDCLKTGFPAALELLLDCVLNPAFEEGEVEDQKARLAALLGGKDIHATLMTELMARSAYRGPYGNPLIPDPEAMAGITPDTLRAFTARTYIAPHMVLAAAGVEHKALVELAAPMLAGLPKLPPLPEPKPDYIGGAVHLPGAYPQANLLLAFEYKGGWRDVHGAVVMTVLNYLLGGGNSFSSGGPGKGMHSRLYTRVLNKYAWVHSCASFNTTFNESGLVGIQASCDPPHVHDMLHVMCHELESVENGTNRIELERAKRAAVSVICNALESKATSAEDIGRQYLTYGHRISGRTYVEMLEAVTADDVRKFVQQLLRSKPSLAAYGDNTQSLDPSVLARRYG

SEQ ID NO: 36681 - protein, 367 aa, Mesorhizobium loti MAFF303099
MATKHLFLLPGDGIGPEAMAEVKKLISAMNEKLGSGFATDEGLVGGCAYDAHGAAISDADMAKAMAADAVLFGAVGGPKWDAVPYEVRPEAGLLRLRKDMELFANLRPAICYPALAASSSLKQEVVEGLDILIVRELTGGVYFGEPKQIIDLGNGQKRGIDTQVYDTFEIERISGVAFELARTRKNHVTSMEKRNVMKSGVLWNEVVTQTHKARYADVKLDHMLADAGGMQLVRWPKQFDVIVTDNLFGDMLSDIAAMLTGSIGMLPSASLGAPDVKTKKRKALYEPVHGSAPDIAGKGIANPIAMIASFAMCLRYSFGMVDEADRLEGAIAAVLDQGLRTKDIFSPGMTEVGTVEMGDAIIAKFLG

SEQ ID NO: 36682 - protein, 418 aa, Candida glabrata CBS 138
MSATIFNNIEELPADALFGIKQRYNQDTRATRVDLGIGAYRDDQGKPWVLPSVRMAERAIQEDPSYNHEYLGINGLPSLSSAAANVIFGEDSPALKEGRTISVQSLSGTGALHIAAKFISKFAADKKIYLSQPTWANHNAIFKAQGLETASYPYWKSSTKSLDLEGFISAIESAPKGSIFLLHACAHNPTGLDPSEKQWPVILDALVKGDHLALFDSAYQGFASGDLDKDAFAVRLGVEKLASTSPIFVCQSFAKNVGMYGERVGCFHLILPKQNANLAPIKSAITSQISSIIRSEVSNSPAYGAKIVSKILNTPELTKQWHEDMVTMSSRIKEMRIALRDHLVKLGTPGTWDHIVEQCGMFSFTGLTPEMVKRLEVQHAVYLVSSGRASIAGLNSGNVEYTAKAIDEVVRHYSTSKL

SEQ ID NO: 36683 - protein, 313 aa, Bacillus anthracis str. A2012
MLGVTGMRVAQSVSELIGKTPIVKLNRIVESDSADIYLKLEFMNPGSSVKDRIALAMIEDAEKKGLLKEGDTIIEPTSGNTGIGLAMVAAAKGYKAILVMPETMSVERRNLLRAYGAELVLTPGPEGMGGAIRQATELAKEHGYFIPQQFKNQSNPEIHRLTTGPEIVEQMGDQLDAFIAGIGTGGTITGAGEVLKEAYKDIKIYAVEPADSPVLSGGKPGPHKIQGIGAGFVPETLDVEVYDEIIQVKTEQAFEYARRVAKEEGILVGISSGAVIYAATEVAKKLGKGKKVLVIIPSNGERYLSTPLYQFES

SEQ ID NO: 36684 - protein, 190 aa, Polaromonas sp. JS666
MKLLMIDNYDSFTYNIVQYFGELGAEVEVFRNDEITLEGIAARAPDLLVVSPGPCSPAEAGISVAAIQHFAGKLPILGVCLGHQSIGAAFGGKIIRARQLMHGKTSVITTTQQGVFAELPEQFVVNRYHSLAIEKSSCPDVLAVTAWTDDGEIMGVRHKELPIQGVQFHPESILTEHGHAMLKNFLEQRA

SEQ ID NO: 36685 - protein, 335 aa, Candida glabrata CBS 138
MNIKNRTFEFQQSVATYKKRVKKNDATSNGKPQAGVSEFQKKASAIAREISSSAQLLSKLALLAKRKPMLNDNPVEIAELSFLIKRKIYAIEQSLIDLSKLQKVQRNGGNSSAGSTTDVTTQHSKNVVNLLNTKMRNISGGFKDVLEERQRMEMANRDRWEKINSTSNSTSRAMSNTQDSENKNLNDNAMVNEVATYNHSNPFMSSSLIDEESHANANKGSELALPQSDSQMLLMMEEGQMANNVYLQERNRAVETIESTIQEVGNLFQQLASMVQEQGEVIQRIDANVDEVDLNITGAQRELLKYFDRVKSNRWLVAKIFFIVFVFFLVWVLVN

SEQ ID NO: 36686 - protein, 355 aa, Oryza sativa Indica Group
MAAASSSTSSAGSAAPAHAPAAGGAGGGGSSGVPNHRTRFGDTTLTKVFVGGLAWETPSKGLQDHFQQYGEILEAVVITDRETSRSKGYGFVTFREPESAREAVRNPNPTIGGRRANCNIASMGPPRPSPSRENLLLGENLGGLTRECSGDMINRSSENEPITCHFAMPNIISPRLSLCRAGPTWVPLPGSATHGPAALHGRPVAAAAYDGPTSTDVLPSSVRHAVYNSQALQHYYPQLYGPTSPSTPSYQFMGYMPGALGPRAGFSPMQQQAPRPPFIQQPAPQFDGGSFPPGPSLPPDFRLQLPPHALSRQPDETTGAQSAPPVSASAAATPTTDSKEASKTVESNSDLNTSN

SEQ ID NO: 36687 - protein, 169 aa, Triticum aestivum
  misc_feature (97)..(97): Xaa can be any naturally occurring amino acid
  misc_feature (118)..(118): Xaa can be any naturally occurring amino acid
LGELVDAFRPVAADLLALPMPTVAAVTGHASAAGFLLALCHDYRVMRADRGVLYMSEVDIGLPLPPYFVHVLRAKISQAQALPDVVLRGKEAPGAPXARRWGVVDVVCPRAPETAAEXALKLAEQLAARKWDGAVYASIRMSMFPDACRAVGIAVESDEEKSRHFASRL

SEQ ID NO: 36688 - protein, 369 aa, Pseudomonas putida KT2440
MRRGCRVALNSIEELVEDIRQGKMVILMDDEDRENEGDIIMAAECCQPEHINFMAKHARGLICMPMTRERCETLKLPLMAPRNGSGFGTKFTVSIEAAEGVTTGISAADRARTVQAAAAKDAKAEDIVSPGHIFPLMAQPGGTLARAGHTEAACDLARMAGFEPSGVICEVMNDDGTMSRRAELEVFAAEHGLKIGTIADLIHYRMIHERTVQRVSEQSVESELGEFNLVTYRDAVEGDVHMALTLGKICAEEPTLVRVHNMDPLRDLLLVKQPGRWSLRAAMAAVAEAGSGVVLLLGHPLDGDVLLAHIRESAGDAPAKAPTTYSTVGAGSQILRDLGVRKMRLMSSPMKFNAISGFDLEVVEYVPSE

SEQ ID NO: 36689 - protein, 158 aa, Pseudomonas putida KT2440
MTLKTIEGTFIAPKGRYALVVGRFNSFVVESLVSGAVDALVRHGVSESDITIIRAPGAFEIPLVAQKVAQQGAYDAIIALGAVIRGGTPHFEYVAGECTKGLAQVSMEFGVPVAFGVLTVDSIEQAIERSGTKAGNKGAEAALSALEMVSLLAQLEAK

SEQ ID NO: 36690 - protein, 293 aa, Paracoccus haeundaensis
MRRDVNPIHATLLQTRLEEIAQGFGAVSQPLGAAMSHGALSSGRRFRGMLMLLAAEASGGVCDTIVDAACAVEMVHAASLIFDDLPCMDDAGLRRGRPATHVAHGESRAVLGGIALITEAMALLAGARGASGTVRAQLVRILSRSLGPQGLCAGQDLDLHAAKNGAGVEQEQDLKTGVLFIAGLEMLAVIKEFDAEEQTQMIDFGRQLGRVFQSYDDLLDVVGDQAALGKDTGRDAAAPGPRRGLLAVSDLQNVSRHYEASRAQLDAMLRSKRLQAPEIAALLERVLPYAARA

SEQ ID NO: 36691 - protein, 183 aa, Karenia brevis
MQAIALVLTYLACAAQARRVRDDPRLVNLEAVNKLGELLLALNPAQEAAFNPSVPSFRASARVPVSSFLKTADAMVVTKSPARAGAPEMFTVTLETPDGTETIDCDEESYILDVAEEAEIELPSACRAGSCSSCAGIITEGTVDQSEGSFLEDDQIEKGFCLTCISYPTSDCTIKTHQEEELF

SEQ ID NO: 36692 - protein, 424 aa, Arabidopsis thaliana
MPTFSAIALDRMLEPGASTSVESVPSTTNLFYSKPPISKLEKGKGKLPNERTVTRPLMSPALYATPDAIPLPNSPSSFPPSPYIINHKSRGPPRLLKSSSEANVVSSSHQKTLEEETITAETDVKVSPRRRSTSFSFPITEVTEDDYSNGVHARTVGNYNFDGIVDGPVGNWSPLDGKSGNGKSELDNAANGLERVNGLSEPVPIKTDKESESEDFYDPGESASFTSNTDVEGDAGDESSQRLATPVGEFYDAWDELSTDSGMQSSVNNIESELSEIRLSLLMEIEKRKQTEEALEQMQIHWQRLREQMAQVGLFVPIDPTASTNNMNLSEELRCQLEIARFVSDSLGRGMAKAEVEMEMESMLETKNFEITRLSDRLHYYEAVNREMSQRNQEAIGSRKSLSFTKFIHCHFLSYNKNLISQLC

SEQ ID NO: 36693 - protein, 250 aa, Triticum aestivum
MKLNIANPTTGCQKKVEIDDDMKLRNLYDKRISQEVVGDLLGEEFEGYIFKIMGGCDKQGFPMKQGVLTPGRVRLLLHRGTSCFRGHGRRVGERRRKSVRGCIVSQDLSVINLVIVKKGKNDLPGLTDTEKPRMRGPKRASKIKKLFNLGKDDDVRQYVNTYRRSFTNKKGKTVSKAPKIQRLVTPLTLQRKRARIADKKKRIAKKKSEAAEYQKLLTQRLKEQRDRRSESMAKRRSKLSAATKAPAASA

SEQ ID NO: 36694 - protein, 439 aa, Pseudomonas syringae pv. phaseolicola 1448A
MTYKLPTTATAPFCPSATTDSVSIPSNASLLRKMMLFVGPGLLVSIGYMDPGNWATAIEAGSRFGYSLLFVVVLASLSGMVLQNLCSRLGIATGRDLAQLSAARYSRNVAKGQWLLAELSIIATDLAEVLGAALAFHLLLGVSITTGVALTAFDTLIVLALQGANFRRLEAIVLGLIATIASCFAIELFLIKPFWPDVVAGLKPSWDVLSSQEPLYIAIGILGATVMPHNLYLHSSVVQTRVNGADLASKATAIRYARLDTIGSLSLALLINAAILILAAAAFHKTGHTEVVEIQDAYHLLDPLVGGAIASVLFGVALLAAGQSSTFTGTIAGQVVLEGFLQAKIPCWQRRLITRALALIPALIGVIWLGDSSVGKMLVLSQVVLSLQLPFALWPLIRFTSDPQLMGPFVNSRLVKIAAWGLFGLISAANLTLLWFWVS

SEQ ID NO: 36695 - protein, 227 aa, Physcomitrella patens subsp. patens
MCSLERVGDVYILRFTGDLDEHRLNPALCDEIIRNLAIVNESDASALLTTNDGKYFSNGLDLAWVNQAPGSVSARMQSQSKAYFRLLSAFMLVNVPTVAAICGHAAAGGLILALAHDHRHMRQDKGFVYMSEMDISIPIPPRVMSLIRCKLNPRAFVETVLKGTKLTATKAKDLDIVDAVHGSSKETFDAALAEATRLASRRWKKEVYLSMRLTMYPQFVPRLEGRL

SEQ ID NO: 36696 - protein, 327 aa, Staphylococcus epidermidis RP62A
MVKSGKARAHTNIALIKYWGKADETYIIPMNNSLSITLDRFYTETKVTFDPDFTEDRLILNGNEVNAKEKEKIQNYMNIVRDLAGNRLHARIESENHVPTAAGLASSASAYAALAAACNEALSLNLSDTDLSRLARRGSGSASRSIFGGFAEWEKGHDDLTSYAHGINSNGWEKDLSMIFVVINNQSKKVSSRSGMSLTRDTSRFYQYWLDHVDEDLNEAKEAVKNQDFQRLGEVIEANGLRMHATNLGAQPPFTYLVQESYDAMAIVEQCRKANLPCYFTMDAGPNVKVLVEKKNKQAVMEQFLKVFDESKIIASDIISSGVEIIK

SEQ ID NO: 36697 - protein, 192 aa, Bacillus anthracis str. A2012
MIDNYDSFTFNLVQFLGELGQELVVKRNDEVTISDIENMKPDFLMISPGPCSPNEAGISMDVIRYFAGKIPIFGVCLGHQSIAQVFGGEVVRAERLMHGKTSPMHHDGKTIFSDIPNPFTATRYHSLIVKKETLPDCLEVTSWTEEGEIMALRHTTLPIEGVQFHPESIMTSHGKELLQNFIRKYSPSVTSC

SEQ ID NO: 36698 - protein, 308 aa, Zea mays
MAPPQQLRLTAPLQVAAGGSGSDSSSSFVPPARDYTQDLPDEILALVFASLSPTDRNACSLTCSRWMEVDATTRHRLSLDARAALGNAATALFSRFTAVTKLALRCARDSGLDSLSDHGAAALAAALPSERLARLKLRGLRKLSDAGLASLAAGAPAIRKLSIASCTFGPRAFVAVLQSCPLLEDLSVKRLRSVADTSGAASSIAEEIKFPPALSLRSVCVKDLYNALCFVPLVASSPNLRSLKILRCSGAWDLPLERWAALKKLCIKGCPVSDRGMEALNGGCPGLVKVKLKRCRGVSYECIENLKV

SEQ ID NO: 36699 - protein, 768 aa, Cucurbita moschata
MSVTILPDLGTEIFIPVCAVIGIVFSLVQWYYVSQVKLSPGRDAAHNNSAGSKNGYSDYLIEEEEGVNDHNVVIKCAEIQSAISEGATSFLFTEYKYVGIFMVLFAVLIFVFLGSVESFSTKPQPCTYDKTRTCKPALATAIFSTVSFLLGAVTSVVSGFLGMKIATYANARTTLEARKGVGKAFITAFRSGAVMGFLLAANGLLVLFIAINLFKLYYGDDWGGLFESITGYGLGGSSMALFGRVGGGIYTKAADVGADLVGKVERNIPEDDPRNPAVIADNVGDNVGDIAGMGSDLFGSYAESSCAALVVASISPFGNNHELTPMLYPLIVSSMGILVCLITTLFATDFFEIKAVKEIEPALKKQLIISTVLMTFGIAIVTWLSVPSSFTIFNFGTQKVVTNWKLFLCVAVGLWAGLIIGFVTEYYTSNAYSPVQDVADSCRTGAATNVIFGLALGYKSVIIPIFAIAVSIFVSFTFAAMYGIAVAALGMLSTIATGLAIDAYGPISDNAGGIAEMAGMSHRIRERTDALDAAGNTTAAIGKGFAIGSAALVSLALFGAFVSRAGVTAVDVLTPKVFIGLIVGAMLPYWFSAMTMKSVGSAALKMVEEVRRQFNTIPGLMEGTAKPDYATCVKISTDASIKEMIPPGALVMLTPLIVGILFGVETLSGVLAGSLVSGVQIAISASNTGGAWDNAKKYIEAGASKHARTLGPKGSDPHKAAVIGDTIGDPLKDTSGPSLNILIKLMAVESLVFAPFFASHGGLLFKIF

SEQ ID NO: 36700 - protein, 312 aa, Oryza sativa Indica Group
MGSVVSSAKINARSMDRHEKSGFGSNKRVKISTYECDSFQRIIPTLPDELSFQILARLPRLYYLKLKLVSQAWKAAITSSELSQLRRELGLTEEWLYVLTKLEPNKLDCYALDPLFRKWQRLPPMPSFVSEEESTGRTQSSWFQMWNVVGSSIRIADFIKGWFRRRYGLDQMPFCGCSVGVADGCLYVFGGFSRAVALNCVFRYNPCLNVWQEVKLLIPKLVYGVSCPEMPFMKAQVPVHDFTDAEAPFLLAGLHGKVHVITKEANNNLQVMQAVLQNNIENSPSEENIIWNILASKNFGSAELVSCQVLDV

SEQ ID NO: 36701 - protein, 658 aa, Yarrowia lipolytica CLIB122
MITAALVGVVLYSCLLISTHSEIQILPTTSGWQPGDQHANYYKKSRQDGLLHTTDKKINIPLRKGTYTPSRKRLEVRSKAAVSCDVPQCSTMGTDILRRGGSAVDASITVALCIGSVNGFSSGIGGGGFMVVKDAKTRDLSFDFRETAPLAASKDMFKDDPKKAQFGGLAVAIPGEVHGLYEAYKRYTSGVLSWKELFEPVIELNERGWTVDKAFELALEVTEDDLSAYGNGDWSWLYVDTPSTNASPFKARPLKSGDVLARKALAETLTLIANNGSSAIFYDPKGPIAPKLVDAINRAGGVASLEDFEQYQTIVEEPVRGEFYGREVLVANNPSSGPALVVGLNIIDELDKKEREKDTNAPGRCVGILKKTANWFRQGFSLLGLATNGLIPRDSNPISIQRLTEAMKYTSSARTELGDPADVSNKKRVEYLLTQDWTDKAVNNISDYHTRPWEDYQPAYEVSDSAGTAHFSVLDENGMAVSMTTTVNLLFGSLVYDHVTGVILNSEMDDFSIPSRDNAYELRPSIYNYIAPGKRPLSSTTPTIVYNKKTDHVELVLGAAGGSRIVTCVLQAIVRKYSYGLSLLQTVAFPRLHHQLIPEIAYVEIGGRKSIGQALKARGHGVEYWIPRSVMNAVSREDNGEIHAVADYWRKGGGSDGY

SEQ ID NO: 36702 - protein, 164 aa, Oryza sativa Japonica Group
MAQRDKKDQEPTELRAPEITLCANSCGFPGNPATQNLCQNCFLAATAFTSSPSSLSSPVLDKQPPRPAAPLVEPQAPLPPPVEEMASALATAPAPVAKTSAVNRCSRCRKRVGLTGFRCRCGHLFCGEHRYSDRHGCSYDYKSAARDAIARDNPVVRAAKIVRF

SEQ ID NO: 36703 - protein, 158 aa, Prochlorococcus marinus str. NATL2A
MATIEGTFVNSSSLRVAIVIARFNDLITNKLLSGCMDCLSRHGIDVSESSNQLDIAWVPGSFELPIISQKLARNGNYDVVITLGAVIRGDTPHFDVVVSEASKGIATVSRETGVPIIFGVLTTDTMQQALERAGIKNNLGWSYALQALEMGSLMKAVN

SEQ ID NO: 36704 - protein, 294 aa, Pisum sativum
MEQYEKVEKIGEGTYGVVYKARDRVTNETIALKKIRLEQEDEGVPSTAIREISLLKEMQHRNIVRLQDVVHSEKRLYLVFEYLDLDLKKHMDSSPEFSKDQRQVKMFLYQILCGIAYCHSHRVLHRDLKPQNLLIDRSSNALKLADFGLARAFGIPVRTFTHEVVTLWYRAPEILLGSRHYSTPVDVWSVGCIFAEMINQRPLFPGDSEIDELFKIFRITGTPNEDTWPGVTSLPDFKSAFPKWPSKDLATLVPSLEPSGLDLLSSMLRLDPSRRITARGALEHEYFKDIKFVP

SEQ ID NO: 36705 - protein, 553 aa, Candida glabrata CBS 138
MSFAGYSGNSNSNSHFKRRNTTQTDRDGANTHNKRSRPNNYSKNADFAKSNDMNDRNNSKPEFTGSRYQGGKASRFPKKDYEESSNKNRNRNQNTKRFQSTKPNRKLNVNESRFREDYNNKHGRISTRYNNFTTGNTSDIRTNGNNTPLRQDDRNTITRPSNNANNNQDSGRKIFELPKGPKSTISRYNTGEPYKGTKPQSIPTPTLPTTFLSRPMNDSVYERLLQVGEGTYGKVYKARNTVTKELVALKKLRLQGEREGFPITSIREIKLLQSFNHENVSTIKEIMVESQKIIYMIFEYADNDLGGLLLNKQININAAQSKHIFKQILHGIEYLHDNNILHRDIKGSNILIDNQGSLKLTDFGLARKIDCNRDAIRDYTNRVITIWYRPPELLLGTTNYGPEVDMWGCGCILVELFNKMAIFQGTNELEQLEAIFKVMGSPSIEQWPNIFDMPWFFMIMPQQATKYPNVFEEKFRAVLETDNCFKLAQGLLRYDQEKRLTASEALQSEYFKEDPQPQPLILNDAISCHEFEVKLARKQQKKKEQSKSTTSSA

SEQ ID NO: 36706 - protein, 384 aa, Pisum sativum
MAIHHHHHHHQQLHHNSLLDALYCDEEKLEEEQEDVSSQQSDVTTNNDNNILDSTSLFPLLLLEQNLFSQDEELTTLFSKEKTQQETYYEDLKNVVDFVSLSQPRREAVQWMLKVNAHYAFSPLTATLAVTYFDRFLLTFHFQKDKPWMIQLVAVTCISLAAKVEETQVPLLLDLQVQDTKYVFEAKTIQRMELLILSTLKWKMHPVTPHSFLDHIITRLGLKTNLHWEFLRRCENLLLSVLLDSRFVGCVPSVLATATMLHVIDQIEESDDNGVDYKNQLLSILKINKEKVDECYNAIVEVTNENNYGHKRKYEQIPGSPSGVIDAVFSSDGSNDSWKVGSSSYSTSEPVFKKTKTQGQNRNLSPLNRVIVGILATASATTSP

SEQ ID NO: 36707 - protein, 205 aa, Pseudomonas putida KT2440
MPVVFVAASKLPTPFATFTMHGFLDEATGREHVVLSLGDIADGQPVLGRLHSECLTGDALFSQRCDCGSQLEAALQAIAREGRGVLLYLRQEGRGIGLLNKIRAYELQDGGADTVEANERLGFAADQRDYAICLPMLEHLGVKSLRLMTNNPRKVKALTDMNIVVAERVPLHTGHNPHNRYYLATKAGKLGHMLGNEHQGEVPQA

SEQ ID NO: 36708 - protein, 362 aa, Arabidopsis thaliana
MEWRSLPVELQEEILSRVPAKYLARLRSTSKQWNALSKTGSFAKKHSANATKEPLIIMLKDSRVYLASVNLHGVHNNVAQSFELGSRLYLKDPHISNVFHCDGLLLLCSIKENTLEVWNPCSGEAKLIKPRHSYYKESDFYALGYDNKSSCKKYKVLRVISQVHVQGDFKIEYEIYDFTNDSWRVHGATTELSIRQKHPVSVKGSTYWVVRNRYFPYKYFLSFDFSTERFQSLSLPQPFPYLVTDLSVVREEQLCLFGYYNWSTTSEDLNVWVTTSLGSVVSWSKFLTIQIIKPRVDMFDYGMSFLVDEQNKSLVCWISQKVLHIVGEIYHIQDLDDHGRDSALRSSCSVLMNYVPSLAQIQ

SEQ ID NO: 36709 - protein, 231 aa, Polaromonas sp. JS666
MSKTTPPTYRIAPSILSADFARLGAELETVIAAGADWIHFDVMDNHYVPNLTFGPMICQALKPHAKKADGSAVPIDVHLMVQPVDALAAAFADAGADLISFHPEASGHVHRSVQAIKARGCKAGLVFNPASSMDVLDWVIDDIDLILIMSVNPGFGGQSFIDSALRKIEQARKRIDASGRDIRLEVDGGIKTDNIARVAAAGADTFVAGSAIFGKPDYKAVIDAMRTALAS

SEQ ID NO: 36710 - protein, 325 aa, Xanthomonas campestris pv. vesicatoria str. 85-10
MSDTTMTAIAIRDGKGDAEALYATEQPRPRPAPGQVLIRVHAAGINRPDLLQRTGHYPPPPGAPETLGLEIAGEIVEPAGRWKVGERVCALLAGGGYAQYAAVDARHVLPIPAGMDLVHAAALPETIFTAYANLFEHGRLAAGQWLLLHGATSGIGVTAIQMAKAAGAHVLATARSASKAAQARELGADVAIDSTTASFVEVAKAHGGVDVALDMVGAAVFADTLEALNPRGRIVYIASQAGATIEVPIPVLMRKQAVITGSTLRPRNADEKARLAAEVERVVWPWIEQGKLRVLLDKCFPLSEAAAAHRYLEQGSHLGKVVLEM

SEQ ID NO: 36711 - protein, 503 aa, Schizosaccharomyces pombe 972h-
MSTKLVDHVEITVPTGKTYIQPVGLFINNQHVDSVHGGRVKVYSPSTEKLICEVADADEEDVDIAVKVARAAFQTDAPWRKFSSAQRGRCLSRLADCIEQNLEYLASIETLDNGKSITLARGDVQAAADCFRYYGGWADKDYGQTIETDIKRFAYTRHEPIGVCGQIIPWNFPFLMCAWKIAPAVACGNTIILKTAELTPLSALCLTKFVPECGFPPGVINVLSGDGRRCGNAISSHMDIDKVAFTGSTGVGRMVMRAAASSNLKKVTLELGGKSPNIVFNDADLDSAAVWTNYGIFYNSGQVCCAGSRVYVQEDVYDEFIKRMVAKAKTLKVGDPFAEDTFQGAQVSKQQYERIVSYIESGIAHGAKLEIGGKRHGNLGYFVEPTILSNVTEDMAVGKEEIFGPVLAVIKFKTIEEAIRRGNNSTYGLAAGVHTNNITNAIKVSNALEAGTVWVNCYNLLHHQIPFGGYKESGIGRELGSYGLTNYTQTKAVHINLGMDSPI

SEQ ID NO: 36712 - protein, 479 aa, Prochlorococcus marinus str. AS9601
MAERFSQKNLRVRPSSDEEKIVTNAKKHFEKTLVEISGELVGSVAALEHPTKNKKLNYGEIFLRDNVPVMIYLITQKRYEIVKKFLSVCLELQSSNYQTRGVFPTSFVEENGQLIGDYGQRSIGRITSADASLWWPILCWYYVNKSGDYAFGKSQSVQRGIQLLLDLVLHPTFEGTPVLFVPDCAFMIDRPMDVWGAPLEVEVLLHGCLKSCINLMELSRADHVSRLLDQRLILTNQWVKDLGSFLLKHYWVTSQTMQILRRRPTEQYGDDQHFNEFNVQPQVVPSWLQDWLENRGGYLIGNIRTGRPDFRFYSLGNSLACMFGVLPPEEQRALFRLVLHNRQHLMAQMPMRICHPHMDVEEWQNKTGSDPKNWPWSYHNGGHWPSLLWFFGTAVLLHQKHYGSDDVILMEEMKSLIEESYWCQLNQLPKQEWAEYFDGPTGTWVGQQSRTYQTWTIVGFLLMNHFLRNEYNDLDMFKI

SEQ ID NO: 36713 - protein, 295 aa, Pseudomonas putida KT2440
MIGTYQASCQARVDAALEPLFIAPSKELERLYAAMRYSVMNGGKRVRPLLAYAACEALGAPAEQANGAACAVELIHAYSLVHDDLPAMDDDDLRRGQPTTHKAFDEACAILAGDGLQSLAFSALLDPCLSPQIDSIRLAMVQVLAKAAGPAGMVGGQAIDLGSVGQKLDQQALEFMHRHKTGALIEASVRLGALASARAEPVQLDALQTYAQAIGLAFQVQDDILDVESDTATLGKRQGADIARDKPTYPALLGLEAAKAYAIELRDQALAALQGFGEKAEPLRALARYIVERRN

SEQ ID NO: 36714 - protein, 314 aa, Crocosphaera watsonii WH 8501
MRKLCLDMVYELAKEDPRICFIGSDLGFGTLNQFREEMPERFFMEGVNEANIIGMAAGLALEGKVVYVNTIATFITRRCFEQLVLDLGLHNVPVRLIGNGGGLVYAPLGSTHLAIDDIAILRTIPNMSIVAPADEAEMKRLMPLTVDYPGPLYIRLGKGNEPILTTDEVPFAIGQVIPMRQGSDALIITTGVTLQAALEGADELAQQGIAATVLHVPTVKPLPKEILLDYISTIPVVVTIEEHTLMGGLGSAIAELIAEANFSEGKRFKRIGLPDVFPDKYGSQADLMKRYGMTSQQVVAAVTGLRKKQLAFFK

SEQ ID NO: 36715 - protein, 216 aa, Pseudomonas putida KT2440
MFTQHHAQFPNVSAAIAAFQAGRPVLLLDDDDREDEADIIAAAENITLQTMAMMIRDCSGIVCLCLDEATVDELQLAPMVQNNQARHGTGFTVTIEAAEGITTGVSAQDRITTIDAALRSSAEQRHIVSPGHVFPLRARNGGVLTRRGHTEGSVDLARLAGLRPAAVLCELMNPDGSMARGEQVAVYARQYNLPVLTIEELARYREAMLEREAEPA

SEQ ID NO: 36716 - protein, 76 aa, Zea mays
TRPGIYGYPRDKKSKNGKLRLLYECAPMSFIVEQAGGKGSDGHQRILDITPTEIHQRVPLYIGSVEEVDKVEKFLA

SEQ ID NO: 36717 - protein, 88 aa, Vitis vinifera
MTSAPVSVSPFPRTVCRRGREVRTSMVRLVTAFGMTVAAFMFWETMDKVHVWIALRQDAKKERIENEMAIKRRREQLIEEAKQKGMLP

SEQ ID NO: 36718 - protein, 246 aa, Arabidopsis thaliana
MARFFLLCCLFAAVLTSSLTEAGDNNQVYSPCSDSTVAIGDGFTFGIAFAAKDSFFSTNRSKSVQYSPCDHRHLSLNGNSEVAVFRPKVDEITLLTINTSSSSSFRPDASKGYMVAFAGAKYAARSLPIMVADSNHIVTSFTLVLEFQKGRLENMFWKKDGCSKCSGDSKFVCLNKEECAIKPQNCKNQGGQVDCSLGIQLAFSGTDKHYTALNSWYEVANLKQYSLYGLYSNLKDSLTNPFKNIF

SEQ ID NO: 36719 - protein, 287 aa, Populus trichocarpa
MEGKEEDVRLGANKFNERQPLGTAAQSQDDKDYKEPPPAPLFEPSELTSWSFYRAGIAEFMATFLFLYITVLTVMGVFKDTTKCTTVGIQGIAWAFGGMIFALVYCTAGISGGHINPAVTFGLFLARKLSLTRAVFYMLMQCLGAICGAGVVKGFYGKKNYELLNGGANMVSPGYTKGDGLGAEIVGTFVLVYTVFSATDAKRSARDSHVPILAPLPIGFAVFLVHLATIPITGTGINPARSLGAAIIFNKDKAWDDHWIFWVGPFIGAALAALYHQVVIRAIPFKK

SEQ ID NO: 36720 - protein, 443 aa, Staphylococcus epidermidis RP62A
MKNYDLIIIGFGKAGKTLAAHAASHGQKVAVVEQSTKMYGGTCINIGCIPTKTLIHDGIEGSSFKEAITRKKEVVQALNNKNYQGLNSKDNIDVLNYKANFISNEVIELQDNNGTIQETITADKIVINTGSRANIPDIKGIDTAQNIYDSTGLLNIDYQPQELVIIGGGYIALEFASMFANFGTHVTILERGDAIMTNEDQDIANLIVKDLQDKGVTINTNTSTIAFSNNKDQTIIHTNHGEISADTVLLATGRKPNTNHLGLENTDVKIGKQGEVIVNTHLQSTVKHIYAAGDVKGGLQFTYISLDDYRIIKSHLFGDGSRTTENRGAIPYTVFIDPPLSRVGLIASEAKLQGYDILENKVFVSNIPRHKINNDSRGLFKAVINKDTKEILGASLYGKESEELISLIKLAIDQHIPYTVLRDNIYTHPTMTESFNDLFLEPL

SEQ ID NO: 36721 - protein, 385 aa, Erwinia carotovora subsp. atroseptica SCRI1043
MSAALIPDSKLPSLGTTIFTQMSALAQQHQAINLSQGFPDFDGPDYLQQRLAYHVSQGANQYAPMTGVSPLRQAIAEKTEALYGWRPDADSEVTVTAGATEALFAAIAALVRPGDEVICFDPSYDSYAPAVTLAGGVLKRIALQPPAFRVDWSSFTDLLSDRTRLVILNTPHNPSATVWQKTDFEQLWQAIAARNIFVLSDEVYEHICFDNEGHASVLAHPSLRQRAIAVSSFGKTFHMTGWKVGYCVAPAALSAEVRKVHQYLTFSVNTPAQFAIADMLREQPQHWRELPDFYRARRDRFINALAGSRFEILPCEGTYFLLADYRAISDLDDVSFCRWLTEHVGVAAIPLSVFCADPFPHTLIRLCFAKQEATLDAAAERLCQL

SEQ ID NO: 36722 - protein, 422 aa, Populus trichocarpa
MLDSITTSTAPSPSSDPFTSSLDNGLTNKRKRKPAGTPDPDAEVVSLSPRTLLESDRYVCEICSQGFQRDQNLQMHRRRHKVPWKLLKRETQEVKKRVYVCPEPSCLHHDPCHALGDLVGIKKHFRRKHSNHKQWVCEKCSKGYAVQSDYKAHLKTCGTRGHSCDCGRVFSRVESFIEHQDACTVRRAQPELQALQPAACSSRTASSTSPSSDANFSIVPLPGIPMSKATEPVYFYSDRNDASTSQQEHNLELQLLPSSSTHFPQNPDEGYATNLKLSIGSSDSLKKNEQFKAIMDPSGPKRTYEPTLEAAKLEEFANEQLRLAITEKAYAEEARQHAKRQIEMAELEFANAKRIRQQAQAELEKAQVLREQATKKISSTIMQVTCQACKLQFKLSTAAASADETSLAMSYMSSATTEGDGE

SEQ ID NO: 36723 - protein, 188 aa, Pseudomonas syringae pv. phaseolicola 1448A
MNKKQRDEISKLLSYLLRHAPESMGLTLDRDGWSEVDDLIRKANAHGYAFDRQALNEVVETNEKKRFTLSEDDQRIRAAQGHSTVQVQVQHAEKEPPATLYHGTASRFMTSIETQGLIAGSRHHVHLTEDPETAMSVGKRYGQPVLLAVDAKGMFEAGVRFFQADNGIWLVKAVSRDSLTVLRLPIPE

SEQ ID NO: 36724 - protein, 178 aa, Mycoplasma gallisepticum R
MKTELIAQLKKTIITVKDFPKPGILFYDITPILLDPKLFDQVISVMAEVAKKSNADMIASPESRGFLFGVPLANKLKLPFVLVRKQNKLPRATFSASYDLEYGKNNVIEIHQDAIKPNSKVMIVDDLLATAGTVDAISRLVKQAKSEVVSYSFLIRLKDLGGIDKLDQTKPIDYILEY

SEQ ID NO: 36725 - protein, 564 aa, Neurospora crassa
MARDEIVDDVDVNMEEDDAEAEQRLINEEYKIWKKNSPFLYDMMLSTALEWPTLTTQWFPDVKNPKDKSHTVHRLLLGTHTAEGKPNYLQIAEVEIPKMVELNPRDYDEERGEIGGYGSKASSGEPLCIRFKITQKIDHPGEVNKARYQPQNPDIIATLAVDGRVLIFDRTKHSITPSGTPSPQLELIGHKEEGFGLNWNPHEEGCLVTGSEDKTVLLWDLKTYEGTSKQLKYSRKYTHHSHIVNDVQHHPLVKSWIGTVSDDLTLQIIDVRRPETDKAAIVARNGHSDAINALAFNPRVETIIATASADKTIGIWDMRNMKSKVHTLEGHQDAVTSLEWHPTESAILGSGSYDRRLLFWDISRVGDEQTQDDAEDGPPELLFMHGGHTNHLADFSWNRNDPWLVCSAAEDNLLQIWKVANSIVSKEPADMSTPELDDPKPKQSKIQQQQEEQQQAHEKSAEQAATIGSRTEKGKGKEAPKEGSRLQDGTSGRDNGDGDDDSEDTSASEQKGRGKSKGMSVYESYLRTVEEARRAAQMTGAERHRKTRSRTTFGAESQQKQQQQ

SEQ ID NO: 36726 - protein, 235 aa, Pisum sativum
SKMRAILIDWLVDVHTKFELSPEALYLTINIIDRFLAISLVSRRELQLVGISAMLMASKYEEIWPPEVNDFVCLSDRAYTHEQILIMEKTILGKLEWTLTVPTPFVFLVRFLKAASVSLPSSDLALENMAHFLSELGMMHYATLMYSPSMMAAAAVYAARCTLNKSPVWDETLTMHTGYSEEELMGCARLLVSFHSASGSGKLKGVYKKYADPQKGAVAVLPPAKNLVSSAAVGS

SEQ ID NO: 36727 - protein, 442 aa, Pseudomonas syringae pv. phaseolicola 1448A
MGMLGVLLMLLALTSSYLRWMPVTTSAVCLGFGFGIGPMGLDIVNLDFEKSYEWLERLTEVAVLFSLFGTGIKLRLPLRGKAWHSAYWLAGPVMLATIAGVTVAGHYIIGLDWGVSLLLGAMLSPTDPVLAGMVQVNNAQDQDRLRFGLSGEAGLNDGTAFPFVIFALLYLSSGGAMSDWVQGWLIKDLIWAVPAGLLIGYGMGRGVGHLMIFLRIKNADSTTSPNDFLALALIALAYVVAQGVGAFGFLSVFAAGFGLRQAEVRVTRSELPSEHVAQPVLGHMTASLEQGTVAQGEDMSDSQLAAGVMMGDMLAFGSLVERAMEVLLITLLGAALAMYWDWRAIGLGIALFCVIRPASVWLLVSRHLLNVRQKALVGWFGIRGIGSLYYLCFALSHGLAHDVGHVVIGMTLSVVALSILVHGISIQPLLERYERSAAANPD

SEQ ID NO: 36728 - protein, 588 aa, Prochlorococcus marinus str. NATL2A
MALLVQKFGGTSLGSIERIKAVAQRIKSSKEKGDDLVVVVSAMGHQTDELTRLASEITVDPPHREMDMLLSTGEQVSISLLTMALNELGTPAISLTGTQAGIITESAHGRARILEIRTERIKNLLDQGQTIVIAGFQGTTLGIGGIAEITTLGRGGSDTSAVALAASLEAAKCEIYTDVPGVLTTDPRIVKNAKLMKSISCDEMLELASLGAAVLHPRAVEIARNFGVTLVVKSSWDNLDGTTLTSNKKPDFSQGGIEHRSPVDGLELLENQAVVALSNIPDRPGIAAELFESLSEGGVNVDLIIQATHQIDSNDITFTVAENELHNALTQCKKLVNTIGGDISFQKDLTKLSIYGAGIMGRPGIASSLFQILSDSGINIRLIATSEVKVSCVIDAELGKKALRNVSEVFKLTDKQITVNPTIENNNEPEVRGIALDKDQIQISVKNVPDKPGTASTICSTLAEKNISLDTIVQSERKHKDKTKDISFTLKKNDRSDAKYALKELIGNWKGSNLEEGESIVRISAVGSGMPFTKGTAGKIFRALANQKINIEMIATSEIRTTCIISEKYGEKALNEIHSCFKLGKNES

SEQ ID NO: 36729 - protein, 536 aa, Leptospira interrogans serovar Lai str. 56601
MEIIESKIRTSSSEYKENFEDLKQKVESLRNLIRKIELGGGEKAIERHKGRGKLTARERVSSLIDPGTSFLEFSPLAAEGVYSDSVPSAGILTGIGRICGVDCVIVANDATVKGGTYYPLTVKKHIRAQEIALQNFLPCIYLVDSGGAFLPMQDEVFPDKDHFGKIFYNQANLSALKIPQISVVMGSCTAGGAYIPAMSDESVIVKGNGTIFLGGPPLVKAATGEIVTPEELGGALVHSTISGVTDHYAEDDSHALEITRNIVSTFHHAGNVTQRGSINWEEPLYPAEEIYGIIQKDIRKSYDVREIIARIVDGSRFQEFKKYYGTTLVTGFAKIYGKMVGIIANNGVLFSESALKASHFIELCNQREIPLLFLQNITGFMVGKKYENSGIAKDGAKMVNAVSTSIVPKYSVVIGGSYGAGNYGMCGRAFNPRFLWMWPNSRISVMGGEQAANVLLTVKMEQLEKEGKKLSEAEQFAFRKPILDDYESKSSCIYSSARLWDDGVIDPARTRDILGITVYANHSQKLEYPRYGIFRM

SEQ ID NO: 36730 - protein, 363 aa, Schizosaccharomyces pombe
MSKKPVLNLDTSNGFSEEYISHPERNDNQGIVEITDLVFSSESKLTQRKESRDSKTFVPSFLEELDDDHLHELVTNGGILYMNSLGEGVSGSVRKCRIRGTQMIFAMKTVKAAPNTALQKQLLRELKINRSCTSPYIVKYYGACYNNAECQLNIAMEYCGAGSLDAIYKRVRSQGGRTGERPLGKIAFGVLSGLSYLHDRKIIHRDIKPSNILLTSKGQVKLCDFGVSGELVNSLAGTFTGTSYYMAPERISGGSYTISSDIWSLGLTLMEVALNRFPFPPEGSPPPMPIELLSYIINMPPPLLPQEPGIKWSKSFQHFLCVCLDKDKTRRPGPQKMLTHPWVKAFERIHVDMEEFLRQVWSD

SEQ ID NO: 36731 - protein, 324 aa, Arabidopsis thaliana
NLTFWRDGSLVRERNAMLPTISSKDWLDIDFGIAEGVDFIAVSFVKSAEVINHLKSYLAARSRGGEIGVIAKIESIDSLTNLEEIILASDGAMVARGDLGAQIPLEQVPAAQQRIVQVCRALNKPVIVASQLLESMIEYPTPTRAEVADVSEAVRQRSDALMLSGESAMGQFPDKALTVLRTVSLRIERWWREEKRHESVPLQAIGSSFSDKISEEICNSAAKMANNLGVDAVFVYTTSGHMASLVSRCRPDCPIFAFTTTTSVRRRLNLQWGLIPFRLSFSDDMESNLNKTFSLLKSRGMIKSGDLVIAVSDMLQSIQVMNVP

SEQ ID NO: 36732 - protein, 581 aa, Brassica napus
MSKQTYKVCFCFNRRFRYTASEAPRDVKTLFDKYSENGVMTVDHLQRFLIDVQKQDKATKEDAQSIINAASSLLHSNGLHLDAFFKYLFGDSNPPLALHEVHQDMDAPISHYFIFTGHNSYLTGNQLSSDCSEVPIIDALKKGVRVIELDIWPNSNKNDIDVLHGRTLTSPVELIKCLRAIKTHAFEVSDYPVVVTLEDHLTPELQSKVAEMVTEIFGEILFTPPVGESLKEFPSPNSLKRRIIISTKPPKEYKEGKDEDVVQKGKALGDEEVWGREVPSFIERNKSGDKDDLDDEEDNDEDDDVEKFKKNAPPQYKHLIAIHAGKPKGSITACLKVDPDKVRRLSLSEEQLEKAAEKYAKQIVRFTQQNLLRIYPKGTRVTSSNYNPLVGWSHGAQMVAFNMQGYGRSLWLMQGMFRANGGCGYIKKPDILLKGGSDSDIFDPKTTLPVKTTLRVTIYMGEGWYFDFRHTHFDQYSPPDFYTRVGIAGVPADTVMKKTKTLEDNWVPSWDEVFEFPLTVPELALLRLEVHEYDMSEKDDFGGQTCLPVWELQEGIRSFPLHNRKEEKYKSVKLLVKVEFV

SEQ ID NO: 36733 - protein, 463 aa, Prochlorococcus marinus str. AS9601
MKISDKFHLEDIYKLKNTVLTGKTEDIKWRIHHINIVSKLLDENKKEIIKSLFVDLGKSEIEGLSEILLVKEEISLIKKKLNSWMRPKKIDTPFYLFPSSSKVIYEPLGCVLILGPYNYPLLYILKPLVNIFSAGNTAVIKPSEKCPATSKLIKKLTSKYFSKDVLMTVEGDNKQSIKLIEQNFDHIFFTGSTKTGKSIMKLAAKNLTPLTLELSGTNPVIVFKNANLEVAAKRIVWGKFFNSGQSCMAPNHIFVDKEIENIFIEKLKKYIISFYGDNPIISENLSKLEKKQFTSTVEILKQYEKEKRILFGGTFSKKKLKISPTILRTKLNEKDILQKELFSSLLPVVGINGMESALTQISLTSKPLAIYLFGGNKKIHNHISKVTSSGTICINDVMLPVLIPNLPFGGVGQSGIGKFHGEEGFRNFSNQKSITFKGFLFDSNLRYPPYERVKKFLKFIFQI

SEQ ID NO: 36734 - protein, 211 aa, Neisseria meningitidis MC58
MPMNLFQNAKFFTTINHLKDLPDTPLEIAFVGRSNAGKSSAINTLTNHVRLAYVSKTPGRTQHINFFELQNGNFMVDLPGYGYAQVPEAVRAHWVNLLGDYLQQRKQLIGLVLIMDARHPLKELDIRMLDFFHTTGRPVHILLSKADKLSKNEQIKTLSQVKKLLKPYSDRQNISVQLFSSLKKQGIDEANRTVGSWLDAADAAASSPEEN

SEQ ID NO: 36735 - protein, 175 aa, Pseudomonas putida KT2440
MSYSKIPAGKDLPNDIYVAIEIPANHAPIKYEIDKDSDTLFVDRFMATPMFYPANYGFIPNTLADDGDPLDVLVVTPYPVAPGSVIRARPVGVLNMTDDGGGDAKVIAVPHDKLSQLYVDVKEYTDLPALLIQQIEHFFANYKDLEKGKWVKIEGWEGADAARAAITKSVAAYKG

SEQ ID NO: 36736 - protein, 355 aa, Arabidopsis halleri subsp. halleri
ISYLTYDRADMAFAHYGPFWRQMRKVCVMKVFSRKRAESWASVRDEVDKMVRSVSCNVGKPINVGEQIFALTRNITYRAAFGSACEKGQDEFIRILQEFSKLFGAFNVADFIPYFGWIDPQGINKRLVKARNDLDGFIDDIIDEHMKKKENQNAVDDGDVVDTDMVDDLLGFYSEEAKLVSEAADLQNSIKLTRDNIKAIIMDVMFGGTETVASAIEWALTELLRSPEDLKRVQQELAEVVGLDRRVEESDIEKLTYLKCTLKETLRMHPPIPLLLHETAEDTSIDGFFIPKKSRVMINAFAIGRDPTSWADPDTFRPSRFLEPGVPDFKGSNFEFIPFGSGRRSCPGMQLGLYA

SEQ ID NO: 36737 - protein, 442 aa, Vitis vinifera
MGGKSSKRRSGREYPSFESSSFNHHGYSQSQPYEEAYPAQPYHTPQHHSPPPPRYYSGAQTPHRHPQLDRRYSRIADNYNSLDQVTAALAQAGLESSNLIVGIDFTKSNEWTGSRSFNRKSLHHIGRGQNPYEQAISIIGKTLSAFDEDNLIPCFGFGDASTHDQDIFSFYQDERPCNGFEEVLMRYRELVPSLRLAGPTSFAPIIEMASTIVEKSGGQYHVLLIIADGQVTRSVDTQHGQLSSQEQKTIDAIVKASKYPLSIILVGVGDGPWDVMREFDDNIPARAFDNFQFVNFTEIMSKNVDSSRTQTEFALAALMEIPSQYKATIDLNTLGVRRGNAPTRVALPPPQYGTPSFSSSSKPYHSNSFQKSAESYPEYEAAVSTGPSSNSLYDNKVCPICLSNPKDMAFGCGHQTCCECGVDLNSCPICRSPIQTRIKLYQ

SEQ ID NO: 36738 - protein, 208 aa, Phanerochaete chrysosporium
GAGGETTAGTLTFVVYFLTQHPNVLQRLRQEILDVVGPSNLPTYDDIKQMKYLRAVLNETLRLYPPVPWNMRYAVKDGILPNSEPDGKPWFIPAGASVSYSVHCMHRRKDYWGPDAEEFDPDRFLDERLHKYLTPNPFIFLPFNAGPRICLGQQFAYNEMSFFLVKLLQTFEDISFERDAFEPNALPPAEWAKFPGRKGKEKFWPRHI

SEQ ID NO: 36739 - protein, 151 aa, Arabidopsis thaliana
AQSDAITWEKEGLMTELRKELRVSDKAHRELLNKVNNDNIICSIREWRSTGGLQASMSNNPQPIHDPVPSPTTSGRKRQKTSQSVPALPAPPAMHSQQLATPTQPSSSTARKAVPPVPKGKKTKPGQKVPGGSAAKPMPSSAGPSGRGPHM

SEQ ID NO: 36740 - protein, 229 aa, Triticum aestivum
  misc_feature (34)..(34): Xaa can be any naturally occurring amino acid
  misc_feature (137)..(137): Xaa can be any naturally occurring amino acid
  misc_feature (170)..(170): Xaa can be any naturally occurring amino acid
MASSADRGVGDYGQAERLADYLASMVADRAALPXSGPEVMRHTSAVRRMITILGTRLGSLEGMLARLPPKSMTDKELNKRRDTLSGLKSRANRMADSFIMSTFANREDWLGQSKKAADHMSRVAGLDNQGIVGLQRXIMKDPDEVLERLEQNGLRTKHIGSEDNDQLTCXGRLIDYLDDPVDGTTSGSSTCEKKLWGFQAALQGLPAPGCPGGGHRWEWECSCYCLGPP

SEQ ID NO: 36741 - protein, 528 aa, Erwinia carotovora subsp. atroseptica SCRI1043
MMQSNTAPLGMAVAPHHLASASALAVLREGGNAIEAMVAAAATIAVVYPHMNGIGGDGFWLIVPPRGEPIAIDASGAAGSLACRELYRGESRIPHRGPKAALTVAGTVGGWQEALAFSQELGGEPLPLARLLSDAIRYAADGIPVTQSQEDALTQRYHELTDFPAFSQLFMPQGYIPRAGSRFTQPDLAETLTTLSIEGLDSFYRGSVAAQLSAQMAQLGMPLTADDLASYRAKRTTPLVLKHSKGDIYNLAPPTQGLVSLAILGLTDHLEMEDLSDSQTIHRIVESTKLAFGLRDRFITDPKLMTQNIQALLENDALGALARQVDTRKAASWGEGKGPGDTVWMGVCDSSGLCVSFIQSIYHEFGSGVVLPGTGVLWQNRGASFSLDPAHLLALEPGKQPFHTLNPAAARLSDGRTMVYGSMGGDGQPQTQAAIFIRHVQQGLPLQQAITAPRWLLGRTWGQSSDTLKIEDRFKPATVDALRQLGHDVELLSSFSETVGHAGAIVRHTNGMLEGAFDPRSNGSAAGF

SEQ ID NO: 36742 - protein, 274 aa, Populus trichocarpa
MGSGALCRGWNGKTALCVLLYCLPMFVLQLAIILIGPQLRSRLKRLPHYFTITATHGMPNATSDIALCTYPLLNTILLGVFASALTVYLFWLGRRILKLVINKGLQKRVYTLIFSVSSFLPLRVLLLGLSVLSKPEHFLFEALAFSAFLALSCCAGVCICMLVYYPVADSLALGDLRDLEARRYAADETISLVANQSHLEESGMSPGRNSDASTKRGSISFRTYQRDTSSGPFVELSLFSPSPDATLPGSPPPLGWPMRPLVDPITGQETEFSQ

SEQ ID NO: 36743 - protein, 1255 aa, Oryza sativa Japonica Group
MQFMMPLDTNACAQPMRRAGEGAGTERLMERLNIGGMTQEKALRKRCFGDGVTGTARCVFTSDADRDTPHLRTQSSRKNYADASHVSAVILGGGTGVQLFPLTSTRATPAVPVGGCYRLIDIPMSNCFNSGINKIFVMTQFNSASLNRHIHHTYLGGGINFTDGSVQVLAATQMPDEPAGWFQGTADAIRKFMWILEDHYNQNNIEHVVILCGDQLYRMNYMELVQKHVDDNADITISCAPIDGSRASDYGLVKFDDSGRVIQFLEKPEGADLESMKVDTSFLSYAIDDKQKYPYIASMGIYVLKKDVLLDILNSSARLKVDTSFLSYAIDDKQKYPYIASMGIYVLKKDVLLDILKSKYAHLQDFGSEILPRAVLEHNVKACVFTEYWEDIGTIKSFFDANLALTEQPPKFEFYDPKTPFFTSPRYLPPARLEKCKIKDAIISDGCSFSECTIEHSVIGISSRVSIGCELKDTMMMGADQYETEEETSKLLFEGKVPIGIGENTKIRNCIIDMNARIGRNVIIANTQVYVLGLFWNGNSIIGILKFAPLSQQTCPVICFACLMCLRFFNSHLLATYETEELMGEVNSCKEMKSVCNWFALARQLIILLSVLVSCPGCQDFLSSLKMSHSSDEDSEISDSEIDEYADKFYARLVAGEFKVKDGQSYSCPFCSGKKKKDFNINNLIQHASGVGAASNRQAKDKATHRALAKHLKNGLTKSSGQQSQTAVVEPQPLPNRDEKFVWPWMGVLVNVPTEWKDGRQIGRSGNHLKEQLSRFCPLKIIPLWNFRGHSGNAIVEFGKDWHGFRNALAFEDYFGKEGYGRRDWKEKQNQGSNLFGWVARAEDHTSPGLIGDHLRKNGDLKTINDLENEGARKTDKLVANLANQIEVKNRHLQELEVTYNERTTSLEKMMGQREQLLQKYNEEIRKMQQLAQRHSQKIIDENQKLRSELESKMSELNTRSKELDEIAAKSDYDRRIIDQEKQKNAIKSSHLKLATLEQERADENVLKLVREHKREKEAAVKKILKLEQQVDAKQKLELDIQQLKGKLEVMKHMPGDEDSALKNKIDELSEELQEKMDELDAMESLNQTLVIKERKSNTEMQDARKELENGLLDLLDGQSHIGIKRMGELDLEAFSKACRKMSSEEDAEITAAILCSKWQAEIKNPDWHPFRFVLVDGQEKEIIEDDAKLQELKEEHGEDIYRLVRDALCEINEYNPSGRFPVGELWNFKDKRKATLKETVQFVLRQWRANRRKR

SEQ ID NO: 36744 - protein, 435 aa, Vitis vinifera
MLLHLGFVPTLVVSSAEAAKKVLKDHDISCCSRPPLISIGRLSYNYLDISFAPYGPYWREIRKICVLQLFSTNRVQSFQVIREAEVALLIDSLAQSSSSASPVDLTDKIMSLTANMICRIAFGRSFEGSEFGKGRFQEVVHEATAMMSSFFAADFFPYVGRIVDRLTGIHERLEKSFHELDCFYQQVIEEHLNPGRMKEEHEDIIDVLLNIEKEQDESSAFKLTKDHVKAILMDLFLAGVDTGAITVVWAMTELARKPGVRKKVQDEVRSHIRERGKVRESDIEQFHYLKMVVKETLRLHPPVPLLLPKETMSTIEISGYQIYPKTQVYVNVWAIGRDPNLWNNPEEFFPERFIDNSVDFKGQHFEFLPFGAGRRVCPAMNMAIAMVELTLANLLYHFNWKLPHGMKEGDINMEEAPGLSVHKKIALSLVPIKYP

SEQ ID NO: 36745 - protein, 118 aa, Physcomitrella patens subsp. patens
MASLQLHSAPFLPAFCGLRAAPCVRHTKVFRLGCGKKSPASQSIKAVLNPLDDPILKEAMKEPIAFLGGMFAGLLRLDLNEEPLKDWVAKTAEAAGIDINDNQAVDSDDSIPEDIQID

SEQ ID NO: 36746 - protein, 335 aa, Fusobacterium nucleatum subsp. vincentii ATCC 49256
MAKISVIGSGGWGIALAILLHKNGHNLTIWSFDKKEAEELKTTRENKTKLPNILLPEDIKVTDDLKEAVNDKDILILAVPSKAIRSVSKSLKDIIKDNQIIVNVAKGLEEDTLKTMTGIIEEELKEKNPQVAVLSGPSHAEEVGKGIPTTCVVSAHNKELTLYLQNIFMNPSFRVYTSPDMLGIEIGGALKNVIALAAGIADGLNYGDNTKAALITRGIKEISALGVAMGGEQSTFYGLTGLGDLIVTCASMHSRNRRAGILLGQGKTLDEAIKEVNMVVEGVYSAKSALMAAKKYNVEIPIIEQVNAVLFENKNAAEAVNELMIRDKKLEIQSW

SEQ ID NO: 36747 - protein, 322 aa, Zea mays
  misc_feature (106)..(106): Xaa can be any naturally occurring amino acid
MSAYCGKYADELIKNAAYIGTPGKGILAADESTGTIGKRLSSINVENVEENRRALRELLFCCPGALQYISGVILFEETLYQKTIEVVGTDKETTTQGHDDLGKRCXFAKWRAVLKIGPNEPSQLAIDLNAQGLARYAIICQENGLVPIVEPEILVDGPHDIDRCAYVTETVLAACYKALNEHHVLLEGTLLKPNMVTPGSDSKKVTPEVIAQYTVRTLQRTVPAAVPAVVFLSGGQSEEEATLNLNAMNKLSTKKPWALSFSFGRALQASTLKAWAGKVENVEKARAAFLARCKANSEATLGTYKGDAAADTESLHVKDYKY

SEQ ID NO: 36748 - protein, 334 aa, Escherichia coli
MSDLYKKHFLKLLDFTPAQFTSLLTLAAQLKADKKNGKEVQKLTGKNIALIFEKDSTRTRCSFEVAAFDQGARVTYLGPSGSQIGHKESIKDTARVLGRMYDGIQYRGHGQEVVETLAQYPGVPVWNGLTNEFHPTQLLADLMTMQEHLPGKAFNEMTLVYAGDARNNMGNSMLEAAALTGLDLRLLAPKACWPEESLVAECSALAEKHGGKITLTEDVAAGVKGADFIYTDVWVSMGEAKEKWAERIALLRGYQVNAQMMALTDNPNVKFLHCLPAFHDDQTTLGKQMAKEFDLHGGMEVTDEVFESAASIVFDQAENRMHTIKAVMMATLGE

SEQ ID NO: 36749 - protein, 565 aa, Prochlorococcus marinus str. NATL2A
MITTYEPLHHKYRPTSFDELVGQDPIKSTLKQALISDRIAPAYIFSGPRGTGKTSSARIFAKSLNCLKSEKATTTPCGQCELCKGISSGNALDVIEIDAASNTGVENIRELIERSRFAPAKARWKVYVIDECHMLSTAAFNALLKTLEEPPRQVVFILATTDPQRVLPTILSRCMRFDFRRIALHDLESHLINIAKKEEIQINEEAISLIAKHSQGGLRDAESLLDQVSLLPPPITQLNIINLIGAIPEEELIILAKSLITKDPNSILNICNSLINKGKEPIAILQGIASILRDLVVTKVTNKPTNLCNISQEHSESLNFLATSSNLDQILNLQAKLKGSESNIRNSNQPNLWLEIHLLGMLSDEVSKENNNIKQSLVKTKISDNSESENTNNTSNSIVPNTEKEQIKTTAFLDETKTSPTLNLDDIWKKVIAMLELPSTKMLLSQQAKLINLSSDSAEIAISEKWINMIQSRKNLIEDAFYKAIGSSTKVLLIQQKDNFSNHNKVENNLQKIEPKNQIKVDREPNKNIVKEEKIESKNNLKVNSIDQKAKQFADFFNGEIVNLE

SEQ ID NO: 36750 - protein, 274 aa, Pyrococcus horikoshii OT3
MSDNEIVAGIMRDHIINLLKEGKRIDDRGFEDYRPIEIEVGIIEKAEGSALVKLGSTQVLVGIKTTLGEPFPDTPNMGVMTTNVELVPLASPTFEPGPPDERAIELARVTDRGIRESRALNLEKMVIVPGKIVRVVFIDVHVLDHDGNLMDAIGIASIAALLNAKVPKVEYNEETGEVEILEEKEPLPVERIPIPVTFAKIGNILVVDPSLEEELVMDGRLTVTTDETGHISAVQKGEGGAFKLEEVMYAVETAFKKAEEIRKIVLEAIKKSGE

SEQ ID NO: 36751 - protein, 334 aa, Escherichia coli
MSGFYHKHFLKLLDFTPAELNSLLQLAAKLKADKKSGKEEAKLTGKNIALIFEKDSTRTRCSFEVAAYDQGARVTYLGPSGSQIGHKESIKDTARVLGRMYDGIQYRGYGQEIVETLAQYRSVPVWNGLTNEFHPTQLIEYKLTMQEHLPGKAFNEMTLVYAGDARNNMGNSMLEAAALTGLDLRLVAPQACWPEAALVTECRALAQQNGGNITLTEDVAKGVEGADFIYTDVWVSMGEAKQKWAERIALLAEYQVNSKMMQLTGNPEVKFLHCLPAFHDDQTTLGKKMAEEFGLHGGMEVTDEVFESAASIVFGQAENRMHTIKAVMVATLSK

SEQ ID NO: 36752 - protein, 577 aa, Candida glabrata CBS 138
MSTKEFKEEIHTSTSEFTKYDSQKPYYSSGESPEPVVTKRNIFQRCVDSFKPPVDGSFDTSNLKRTLKSRHLIMIAIGGSIGTGLFIGSGQALATGGPLAVIIGWTIAGSQIVGTIHGLGEITVRFPVVGAFADYSTRFLDPSISFVVSTIYVIQWFFVLPLEIIASAITIQYWNSSIDPVVWVAIFYGVIVSINLFGARGFGEAEFVFSTIKAITICGFIILCIVLICGGGPDHEFIGAKYWHDPGALAHGFPGVLSVLVVASYSLGGTEMTCLASGETDPKELPSAIKQVFWRILFFFLASLTLVGFLVPYTNENLLGGSSVDNSPFVIAIKLHHIKALPSIVNAVILISILSVGNSCIFASSRTLCSMAHQGLIPRFFGYIDRAGRPLAGIVTNSLFGLLAFLVKSSSVSEVFDWLMAIAGLATCIVWLSINLSHIRFRLAMKAQNKTLDELEFVSAVGIWGSAYSALINVLILIAQFYISLWPIGGWTDSSQRAKKFFQSYLCALIMLLIFCIHKVYYRVSFGKWWDVKPLKDIDLETGRKNVDIDVIKAEIAERKMYLKKKPWIVRWYHFWC

SEQ ID NO: 36753 - protein, 419 aa, Pseudomonas syringae pv. phaseolicola 1448A
MLELAAGFICLTALLTYVNYRFIGLPPTIGVMVTALMFSLLLQGLSFLGYPGLEDRVQQLIGQIDFGDLLMNWMLSFLLFAGALHVNLADLRSYRWPIGLLATFGVLIATTVIGALACWIFALFGWHVSPLYCLLFGALISPTDPIAVLGVLRTANASKPLKTTIVGESLFNDGTAVVVFTVLLGIAQLGETPTVGETALLFVHEAVGGVLFGGLIGYAVYLMIKSIEQYQIEVMLTLALVIGGSAMASELHVSGPIAMVVAGLIIGNLGRNLAMNDMTRRYMDGFWELLDDMLNALLFALIGMELLLLPFSWQHLIAASLLAAAILLSRFVTVAPAILLLRRWRKVPHGTIRILTWGGLRGGVSIALALALPTGPERDLLLSITYIVVLLSILLQGLTIGKLVHAVTRSPQAKEPAEH

SEQ ID NO: 36754 - protein, 249 aa, Pyrococcus horikoshii OT3
MMEKPEGLKLIDENGRRIDGRKKYELRPIKMKVGVLKNANGSAYIEWGRNKIIAAVYGPRELHSKHLQRPDRAILRVRYNMAPFSVEERKKPGPDRRSIEISKVIKGALEPALILEMFPRTSIDVFIEVLQADAGTRVAGITAASLALADAGIPMRDLVAACAAGKIEGEIVLDLNKEEDNYGEADVPVAIMPLKNDITLLQMDGYLTKEEFIEAVRLAIKGAKAVYQKQREALKEKYLKIAQEVEESE

SEQ ID NO: 36755 - protein, 437 aa, Ustilago maydis 521
MAESNNTDLPTATATSYKPGEATMLALTFHGTQDVRLTEVRTPTITDPTDVVVRSTGVTICGSDLHLYHNKIPDLKKGDILGHEGTGVVEHVGAQITKFKVGDRVVASFSIACGTCEQCKAKLFTMCDRTNTSAKMDELYGQKLGGILGYSHLLGGYAGTQAEYFRVPFGDVNCFHVPDSVSDETALLMADVTLTAYHSVVDIKFQEGETAAIWGAGPIGQLIAQWLLKVFGARKVMLIDNVAPRLHWAQERLNGLETINFDQTPQVAEEVMHKVAGGVDVSFDAAGFRYAKSLKHQTMQTLGVETDTPEIINEAIRATRKFGRISVIADYVGQCNEFLIGAMMEKGILLKGNGQAPVQAYMEQVFEDYIVPGKFDPTLILTHRFKLEDIAKVYKAFDEKRIDEHKGGIPIIKTFIETKASKPRAASTPELSSVPGF

SEQ ID NO: 36756 - protein, 482 aa, Pseudomonas putida KT2440
MPSEHSAGSPAGSSVDFEKVGSDYFQQRELKKGAAGWVLLVGLGVAYVISGDYAGWNFGLAQGGWGGMFLATLLMATMYLCMCFSLAELSSMIPTAGGGYGFARSAFGPWGGFLTGTAILIEYAIAPAAIAVFIGAYCQSLFGIGGWMIYLAFYIVFISIHIFGVGEALKLMFIITAIAAIALAVFLIGMVPHFDAANLFDIAKTDAVGASSFLPFGYVGVWAAIPYAIWFFLAVEGVPLAAEETKNPKRDLPRGLIGAMLVLLAFALLILVVGPGGAGSEALKASGNPLVEALSKAYGGSTWMGGFVNLVGLAGLIASFFSIIYAYSRQIFALSRAGYLPRKLSETNKSKAPVLALVIPGIIGFALSLTGQGDLLILVAVFGATLSYVLMMAAHITLRIRRPKMERPYRTPGGIFTSGLALVLACIAVVAGFLVDPRVVIGAAVIYAVLIAYFAFYSRHHLVAGTPEEEFAAIQKAEEALH

SEQ ID NO: 36757 - protein, 358 aa, Haemophilus influenzae Rd KW20
MQSYNIAVLAGDGIGPEVMAEAIKVLNRVQEKFGFKLNFNEFFVGGAAIEHCGYPLPAETLKGCDQADAILFGSVGGPKWTNLPPDQQPERGALLPLRKHFKLFCNLRPATLYKGLEKFCPLRADIAAKGFDMVVVRELTGGIYFGQPKGREGDGVQTKAFDTEVYYKYEIERIARAAFEAAMKRNKKVTSVDKANVLQSSILWRETVTEMAKDYPEVTLEHIYIDNATMQLIKSPESFDVLLCSNIFGDIISDEAAMITGSMGMLPSASLNEEGFGLYEPAGGSAPDIAGKGIANPIAQILSAAMMLRYSFNLNEAADAIESAVQKVLASGHRTADLADDSTPVSTAEMGTLITQAI

SEQ ID NO: 36758 - protein, 506 aa, Pseudomonas putida KT2440
MRYAHPGTEGAKVSFKSRYGNYIGGEFVTPVKGQYFENTSPVNGKLIAEFPRSTAEDIDKALDAAHAAADAWGRTSVQDRSNVLLKIADRIEQNLELLAITETWDNGKPIRETLNADIPLAVDHFRYFAGCIRAQEGGAAEINEGTVAYHIHEPLGVVGQIIPWNFPILMAAWKLAPALAAGNCVVLKPAEQTPLGITVLLEVIGDLLPPGVLNVVQGYGREAGEALATSKRIAKIAFTGSTPVGSHIMKCAAENIIPSTVELGGKSPNVYFEDIMQAEPSFIEKAAEGMVLAFFNQGEVCTCPSRALVQESIYPQFMEVVMKKVLQIKRGDPLDTDTMVGAQASQQQFEKILSYLQIAQEEGAELLTGGKVEKLEGSLATGYYIQPTLLKGNNKMRVFQEEIFGPVVSVTTFKDEAEALAIANDTEFGLGAGVWTRDINRAYRMGRGIKAGRVWTNCYHLYPAHAAFGGYKKSGVGRETHKMMLDHYQQTKNLLVSYDINPLGFF

SEQ ID NO: 36759 - protein, 435 aa, Vitis vinifera
MLLQLGVPTVVVSSAEAAREFLKTHDIDCCSRPPLVGPGKFSYNHRDIGFAPYGDYWREVRKICVLEVFSTKRVQSFQFIREEEVTLLIDSIAQSSSSGSPIDLTERLMSLTANIICRIAFGKSFQVSEFGDGRFQEVVHEAVALLGGFTAADFFPYVGRIVDRLTGLHGRLERSFLEMDGFYERVIEDHLNPGRVKEEHEDIIDVLLKIERERSESGAVQFTKDSAKAIIMDLFLAGVDTGAITLTWAMTELARNPRIMKKAQVEVRSSIGKKGKVTKGDVDQLHYLKMVVKETLRLHPPVPLLVPRETMSHFEINGYHIYPKTQVHVNVWAIGRDPNLWKNPEEFLPERFMDNSVDFRGQHFELLPFGAGRRICPGMYMAIATVELALANLLYRFNWNLPNGMREADISMEEAAGLAVRKKFALNLVPILHHC

SEQ ID NO: 36760 - protein, 180 aa, Tolypocladium inflatum
MGNKVFFDIEWEGPVMQGCKPTSTVKGSLVASTSSCTMTSSPRPPRTSALSAPARRASATRARPSTVSSPSSCSRAATSPAVTGTGGKSIYGEKFADENFQLKHDRPGLLSMANAGPNTNGSQFFVTTVVTSWLNGHHVVFGEVADQESLDVVKALEATGSGSGAVKYNKRATIVKSGEL

SEQ ID NO: 36761 - protein, 505 aa, Vitis vinifera
MALYSPSIWLHLLLLLLPLMFLIKRKIELKGQKKPLPPGPTKLPIIGNLHQLGALPHYSLWQLSKKYGSIMLLQLGVPTVVVSSAEAAREFLKTHDIDCCSRPPLVGLGKFSYNHRDISFAPYGDYWREVRKICVLEVFSTKRVQSFQFIREEEVALLIDSIVQSSSSGSPIDLTERLMSLTANIICRIAFGKSFQASEFGDGRFQEVVHEAMALLGGLTASDFFPYVGRIVDRLTGLHGRLERSFHEMDGFYQQVIEDHLNPGRVKEEHEDIIDVLLRIEREQSESSALQFTKDNAKAILMDLFLAGVDTGAITVAWAMTELARNPGIMKKAQAEVRSSIGNKGKVTESDVDQLHYLKVVVKETLRLHPPAPLLLPRETMSHFEINGYHIYPKTQVHVNVWAIGRDPNLWKNPEEFLPERFMDNSVDFRGQHFELLPFGAGRRICPGMYMAIATVELALANLLYRFNWNLPNGIREADISMEEAAGLTVRKKFALNLVPILHHC

SEQ ID NO: 36762 - protein, 1694 aa, Haemophilus influenzae Rd KW20
MLNKKFKLNFIALTVAYALTPYTEAALVRDDVDYQIFRDFAENKGRFSVGATNVEVRDKNNHSLGNVLPNGIPMIDFSVVDVDKRIATLINPQYVVGVKHVSNGVSELHFGNLNGNMNNGNAKSHRDVSSEENRYFSVEKNEYPTKLNGKAVTTEDQTQKRREDYYMPRLDKFVTEVAPIEASTASSDAGTYNDQNKYPAFVRLGSGSQFIYKKGDNYSLILNNHEVGGNNLKLVGDAYTYGIAGTPYKVNHENNGLIGFGNSKEEHSDPKGILSQDPLTNYAVLGDSGSPLFVYDREKGKWLFLGSYDFWAGYNKKSWQEWNIYKPEFAKTVLDKDTAGSLTGSNTQYNWNPTGKTSVISNGSESLNVDLFDSSQDTDSKKNNHGKSVTLRGSGTLTLNNNIDQGAGGLFFEGDYEVKGTSDSTTWKGAGVSVADGKTVTWKVHNPKSDRLAKIGKGTLIVEGKGENKGSLKVGDGTVILKQQADANNKVKAFSQVGIVSGRSTVVLNDDKQVDPNSIYFGFRGGRLDANGNNLTFEHIRNIDDGARLVNHNTSKTSTVTITGESLITDPNTITPYNIDAPDEDNPYAFRRIKDGGQLYLNLENYTYYALRKGASTRSELPKNSGESNENWLYMGKTSDEAKRNVMNHINNERMNGFNGYFGEEEGKNNGNLNVTFKGKSEQNRFLLTGGTNLNGDLKVEKGTLFLSGRPTPHARDIAGISSTKKDQHFAENNEVVVEDDWINRNFKATNINVTNNATLYSGRNVANITSNITASDNAKVHIGYKAGDTVCVRSDYTGYVTCTTDKLSDKALNSFNATNVSGNVNLSGNANFVLGKANLFGTISGTGNSQVRLTENSHWHLTGDSNVNQLNLDKGHIHLNAQNDANKVTTYNTLTVNSLSGNGSFYYLTDLSNKQGDKVVVTKSATGNFTLQVADKTGEPTKNELTLFDASNATRNNLNVSLVGNTVDLGAWKYKLRNVNGRYDLYNPEVEKRNQTVDTTNITTPNNIQADVPSVPSNNEEIARVETPVPPPAPATPSETTETVAENSKQESKTVEKNEQDATETTAQNGEVAEEAKPSVKANTQTNEVAQSGSETEETQTTEIKETAKVEKEEKAKVEKDEIQEAPQMASETSPKQAKPAPKEVSTDTKVEETQVQAQPQTQSTTVAAAEATSPNSKPAEETQPSEKTNAEPVTPVVSKNQTENTTDQPTEREKTAKVETEKTQEPPQVASQASPKQEQSETVQPQAVLESENVPTVNNAEEVQAQLQTQTSATVSTKQPAPENSINTGSATAITETAEKSDKPQTETAASTEDASQHKANTVADNSVANNSESSDPKSRRRRSISQPQETSAEETTAASTDETTIADNSKRSKPNRRSRRSVRSEPTVTNGSDRSTVALRDLTSTNTNAVISDAMAKAQFVALNVGKAVSQHISQLEMNNEGQYNVWVSNTSMNENYSSSQYRRFSSKSTQTQLGWDQTISNNVQLGGVFTYVRNSNNFDKASSKNTLAQVNFYSKYYADNHWYLGIDLGYGKFQSNLKTNHNAKFARHTAQFGLTAGKAFNLGNFGITPIVGVRYSYLSNANFALAKDRIKVNPISVKTAFAQVDLSYTYHLGEFSVTPILSARYDTNQGSGKINVNQYDFAYNVENQQQYNAGLKLKYHNVKLSLIGGLTKAKQAEKQKTAELKLSFSF

SEQ ID NO: 36763 - protein, 109 aa, Cucumis sativus
SVKDRIGYSMISDAEKNGSIIPGESVLIEPTSGNTGIGLAFIAAAKGYKLIICMPASMSLERRTILRAFGAELVLTDPARGMKGAVQKAEEIKAKTPNSYILQQFDNPA

SEQ ID NO: 36764 - protein, 440 aa, Bacillus sp. SG-1
MKACELIDYIPSLQSFKKFGKVKRVVGLMIESQGPKSSIGDMCFIHLSETRRKIRAEVVGFKEETVILMPYSNINEISPGSLVEATSKPLTIKVGHSLIGKVVDSLGNPLDGESLPKGLTPAFTEQDPPSPLTRPPINEKIEVGVRAIDSMLTVGKGQRVGIFAGSGVGKSTLLGMIARNTTADLNVIALIGERGREVREFIERDLGEEGLKKSIVVAATSDQPALMRIKGAFTATAIAEYFRDKGMNVMLMMDSVTRVAMAQREIGLAVGEPPATKGYTPSVFAILPKLLERTGTNEHGTITAFYTVLVDGDDMNEPIADTTRGILDGHIVLDRNIANKGQFPAINVLRSVSRLMNHLASPDHLRAAEKIRELMSTYSNSEDLINIGAYKKGTSQEIDQAITYQPKILSFLKQGTGERVTLEESVRDIINLAEKGEWRG

SEQ ID NO: 36765 - protein, 316 aa, Xanthomonas campestris pv. vesicatoria str. 85-10
MSSVVVVGSFNVDHVWRCDALPVPGATIAGRYSTGPGGKGFNQAVAAARAGAKTHFLCALGDDAGGALARSLAAQDGFSLIAEPSNEPTGTGGIYVDGHGRNTIVIGAGANAVLSPAFIENQRPLVAAAKVLLAQLESPAETIESALALAHECGVLTVLNAAPANAPTSIGLLKLSDVLTPNETEFAALLGRHVGERINADDVAALDGNTLHSLCRKLLPGGTVVVTLGAVGAFISHAEEQLRGDSQAHYRVGAESAQTIDTTGAGDAFNGALVASLAQVPAASFATHVRFATRYAARSTEVEGAAVSMPRLRADD

SEQ ID NO: 36766 - protein, 505 aa, Vitis vinifera
MALYSPSMWLHLLLLLLPLMYLIKRRIELKGQKKPLPPGPTKLPIIGNLHQLGTLPHYSWWQLSKKYGPIILLQLGVPTVVVSSAEAAREFLKTHDIDCCSRPPLVGLGKFSYNHQDIGFAPYGDYWREVRKICVHEVFSTKRLQSFQFIREEEVALLIDSIAESSSSGSPIDLTERLMSLTANIICRIAFGKSFQVSEFGDGRFQEVVREAMALLGGFTAADFFPYVGRIVDRLTGLHGRLERSFLEMDGFYQRVIEDHLNPGRVKEEHEDIIDVLLKIQRERSESGAVQFTKDSAKAILMDLFLAGVDTGAITLTWAMTELARNPRIMKKAQVEVRNSIGNKGKVTEGDVDQLHYLKMVVKETLRLHPPVPLLLPRETMSHFEINGYHIYPKTQVQVNVWAIGRDPNLWKNPEEFLPERFMDNSVDFRGQHFELLPFGAGRRICPGMYMVIATVELALANLLYRFNWNLPNGMREADINMEEAAGLTVRKKFALNLVPILHHC

SEQ ID NO: 36767 - protein, 445 aa, Zea mays
  misc_feature (112)..(112): Xaa can be any naturally occurring amino acid
MVASKAAPFDEVSSVEAGAYGGRDDDGRPRRTGTVWTASAHIITAVIGSGVLSLAWAIAQLGWAAGPAVMLLFAVVIYYTSTLLAECYRSGDPVAGKRNYTYMDAVRASLGXAPSAIKRADCFHAKGHKHACRSSSNPYMILFGVAEVVFSQIPDFDQIWWLSIVAAVMSFTYATIGLVLGIMQTVANGGFQGSLTGISIGAGVTPTEKVWRSLQAFGNIAFAYSYSIILIEIQDTVKAPPPSEAKVMKRATMVSVATTTVFYMLCGCMGYAAFGDAAPDNLLTGFGFYEPFWLLDIANVAIVVHLVGAYQVFCQPLFAFVEKWAAATWPDSAFIAREFRVGPFALSLFRLTWRTAFVCLTTVAAMLLPFFGDVVGLLGAVSFWPLTVYFPIEMYVVQRAVRRWSTHWICLQMLSAACLLVSVAAAAGSIADVIGALKVYRPFSG

SEQ ID NO: 36768 - protein, 498 aa, Vitis vinifera
MWLHLLLLLLPLMFLIKRKIELTGQKKPLPPGPTKLPIIGNLHQLGALPHYSLWQLSKKYGSIMLLQLGVPTVVVSSAEAAREFLKTHDIDCCSRPPLVGLGKFSYNHRDISFAPYGDYWREVRKICVLEVFSTKRVQSFQFIREEEVALLIDSIVQSSSSGSPIDLTERLMSLTANIICRIAFGKSFQASEFGDGRFQEVVHEAMALLGGLTAADFFPYVGRIVDRLTGLHGRLERSFHEMDGFYQQVIEDHLNPGRVKEEHEDIIDVLLRIEREQSESSALQFTKDNAKAIVMDLFLAGVDTGAITVSWAMTELARNPRIMKKAQAEVRNSIGNKGKVTEGDVDQLHYLKMVVKETLRLHPPAPLLLPRETMSHFEINGYHFYPKTQVHVNVWAIGRDPNLWKNPEEFLPERFMDNSVDFRGQHFELLPFGAGRRICPGMYMAIATVELALANLLYRFNWNLPNGMKETDISMEEAAGLTVRKKFALNLVPILHHC

SEQ ID NO: 36769 - protein, 419 aa, Hyacinthus orientalis
MMSSNNSRIQALLLISSFLLPSYTSGQILFQGFNWESWKKDGGWYNFLKTKVDDISSSGATHVWLPPPSHSVGQQGYLPGRLYDLSASKYGNQDELKSLIQAFHDKSIKCVADIVINHRTAETKDGRGIYCIFEGGTPDDRLDWGPTMICRDDAEYSDGTGNPDTGAGYGAAPDIDHTNPRVQKELTDWLNWLKTEIGFDGWRLDFAKGYSADVAKGYVSRGAPGFVVAEIWSDLTSGNEDAHRQELARWAQTVGGPAKAFDFTTKGILQQAVQGQLGRMRDSNGKAPGLIGLAPGLAVTFVDNHDTGSTQNMWPFPSDKVMQGYAYILTHPGIPSVFYDHLFDWNLIEEISKLAAIRSKNGLQPTSGLRIIASDNDIYVAVVDEKVIVKIGPKVDVWNLVPTEYKLVASGKDYAVWEK

SEQ ID NO: 36770 - protein, 507 aa, Chromobacterium violaceum ATCC 12472
MKSIKPVLLLILDGFGHRTEGDDNAILHARMPVWSRLREQYAYGTINASENFVGLPSGQFGNSEVGHLNIGAGRIVQQDISRIDCDIEDGRFSSNDTLQQAMSKAQGSALHILGLLSDGGVHSHENHIHALIRAAQAAGVPKIYVHAFLDGRDTPPRSAETYLKRLDAALAECPNARLVSVTGRYWAMDRDKRWERVEPAYRLLVDGEGLFHAETGLDALKAAYERDENDEFVKATGIGAPVKMQDGDALIFMNFRADRARQLTSALTDPAFDGFKARQPKFGYYATLTSYGEAYSALPVAYAPQKIHNGMGEYLSSKGLKQLRIAETEKYPHVTYFFNGGEEQVYPGEDRILVPSPKVATYDLQPEMSAGEVTDKIVAAIQSGQYQAIFCNYANGDMVGHSGVFDAAVKAVEALDGCIERCVDAMLAAGGEVLITADHGNCEQMYDGEHHQPHTQHTTNQVPFLYIGRPAKIRAGGSLRDISPSLLAMMGLEQPAEMTGQSLIDFQ

SEQ ID NO: 36771 - protein, 275 aa, Oceanobacillus iheyensis HTE831
MIKGLQDTFTLNNGVEMPGFGLGVYKVEDGSVAEESVRIALENGYRSIDTASFYDNEKGVGEGIKNSGVPREDIFLTSKVWNDEQGYTSTKQAFQRSLDKLGTDYLDLYLIHWPVKDTFVETWRAMEELYRDGKVKAIGVSNFHVQHLEKLFVNAEVIPAVNQVEFHPHLTQEGLRAFCRQHNIQLEAWSPLKRGQLLEEDIIQTIAKKYGKSAAQVILRWDVQHEVITIPKSITKERIIANADIFDFSLTEEEMNQIDAMNQNDRSGSNPDSFD

SEQ ID NO: 36772 - protein, 636 aa, Oryza sativa Japonica Group
MGGFLAAAIVVFSLRLNLDTTASAWEDKDFFKSFQLESNNTTPSSCGLPCMKLSCSGQDTILLDTNKYYLGRPYKVTAIDYKQGLLTVIPLADEENSSSSPCPLLKSIRPSVITGNPYYDIGFENPCRLYDAPYYAALVSCSTEFALASVPGPATDNDCIAGPISCLSNQTHFSYLVAVYVTMSFLPLDCEVISDGLIPIPRFYYSDYSSSTFRKSAERILNFSDTTIWWFNDDCSHPAQCEEQGGRCAFSSQRNQTFCMRPGSHAKVIAATSSVAAFVVLLLMVATALYLSLKTKYNEEIHLKVEMFLKTYGTSKPTRYTFSEVKKISRRFKVKVGQGGFGSVYRGELPNGVPVAVKMLENSEGEGDEFINEVATIGRIHHANIVRLLGFCSEGTRRALIYEYMPNDSLEKYIFSQDSDTSQELLVPSKMLDIALGIARGMEYLHQGCNQRILHFDIKPNNILLDYNFSPKISDFGLAKLCARDQSIITLTAARGTMGYIAPELYSRNFGEISYKSDVYSFGMLVLEMVSGRRNSDPSVESQNVVYFPEWIYEQVTIGQDLELGREMTEEEKAIMRQLAIVALWCIQWNPKNRPSMTKVVNMLTGRLQNLQVPPKPFFSADSHPVLQDSGHAGII

SEQ ID NO: 36773 - protein, 195 aa, Brassica napus
ALYTYGWSKYGQLGHGDLEDHLIPHKLEALGSSVISQISGGWRHTMALTSDGKLYGWGWNKFGQVGVGDNIDQCSPVQVRFPDDQKVVQVSCGWRHTLAVTERNNVFAWGRGTNGQLGIGEALDRNSPKIIEALSVDGARGQQIESSNCDPSSGKSWVSPSERYAVVPDETVNGSKEGNGGDISVPSTDAKRVRI

SEQ ID NO: 36774 - protein, 282 aa, Triticum aestivum
EFIAEVVSIGRLRHRNLVPLLGYCRRKGELLLVYDYMSNGSLNQYLYFKDGKPSLNWEERLHIIKGVAFGLFYLHEKWEKVVIHRDVKPSNVLLDSEMNARLGDFGLSRLYDHGTDPQTTHMVGTMGYLAPEYVHTGKASTLTDMFAFGIFLLEVTSGQSPIKQNPFGNKHTLVDWVIERWHNGSLMETVDPRLRGDYNIDDASLVLKLGLLCSHPFTSARPTMRHVMQYLEGDTPLPELTPAHFSFTMQALTQNRGLESPNVQYPQLSTSFATFSSLSGGR

SEQ ID NO: 36775 - protein, 364 aa, Populus trichocarpa x Populus deltoides
MGSTGETQMTPTQVSDEEAHLFAMQLASASVLPMILKTAIELDLLEIMAKAGPGAFLSTSEIASHLPTKNPDAPVMLDRILRLLASYSILICSLKDHPDGKVERLYGLAPVCKFLTKNEDGVSVSPLCLMNQDKVLMESWYYLKDAILDGGIPFNKAYGMTAFEYHGTDPRFNKVFNKGMSDHSTITMKKILETYKGFEGLTSLVDVGGGTGAVVNTIVSKYPSIKGINFDLPHVIEDAPSYPGVEHVGGDMFVSVPKADAVFMKWICHDWSDAHCLKFLKNCYDALPENGKVILVECILPVAPDTSLATKGVVHIDVIMLAHNPGGKERTEKEFEGLAKGAGFQGFEVMCCAFNTHVIELRKN

SEQ ID NO: 36776 - protein, 897 aa, Blastopirellula marina DSM 3645
MNEQQIFHAALKIADPLARSQYLDLTCGNDSTLRGEVESLLAAHARSGEFLDIPVLAQLGSPAEESGETREHPNGADSQVDLSFLEPSQKAGSLGRLSHYEVRQVLGRGGCGIVFKAFDEKLQRTVAIKVIAPELSATSPARKRFLREARAAAGVRHNSVVSIYAVENLPIPYLVMEYLDGGTMQDKLDQSGPFALPEILLFGRQIAEGLAAAHAQGLIHRDIKPCNILLDAGGQSVKLSDFGLARTMDDARLTQSGAVAGTPLYMSPEQARGETLDQRSDLFSLGSVLYVMCSGRPPFRAPTHYAVMKRVVEDAPRPIPDIIPEIPATLTSIIDKLLEKDRADRIPSAAEVATRLRELERRDLHAVANPFRTTGTPPAAKFDPPPRTSLGTWIALVTVCLIAIGVLLAGLMFNRSLSDPSAPRGVWVQREDQLMQTEPLDSQWIFGDPNWSDYNMDVETRNLCNHANARVGSILFRAESPHDFYRFTIDNVSTGMTTLVKSTGDETTKIGPFRQNRPQQNPWYKAHIEVRKDRIRCWVDDIELFDERDSTFARGRVGLATIGVAAAWRNLKVTKPDGSILWEGFPKIEPGMFESPTTIRNYPCGEMIMPAKLVLPPDVSPDRRAAAYVLSAGGSIRINGERFQSIRRLDQLPDEPFELTQASLNDPRIKEAELQIFAETTHLTELALGSEFTDAALQNFRHNKNLKTLYFLHSQITGAPLHDFDLSQLTHVDVRYSQFDGGNVIVLQNSPELIELHLTNTNVQDEDLALLTGLSKLQHLHLYDTRISDAGLAQIGKLTKMKILSIDKTEITDKGIAHLTTLHDLEVLNASNTNLTDVSVNHLAQLPRLQRLQVQGTQITRQAIEKLHAALPDCVITWNGGEIRPAGDAPPTPGLDI

SEQ ID NO: 36777 - protein, 312 aa, Leptospira interrogans serovar Lai str. 56601
MNGDIAVFAGNSNKQIAEEICTHLGIQSGKINLKKFSDGEISVKIEDNVRGKEVFIVQSTSAPANDHLMELILIMDALRRASVSSISVVIPYYGYGRQDRKVEPRVPISARVVADLIEVVGLDRILTMDLHADQIQGFFRVPVDNLHFAPVLAEYVNTKKIDDLVIVSPDSGGAERARAFGKKVNGSLAIIDKRRPKANVSEVMNVIGEIEGKNCILLDDMIDTAGTICKAADALLKHGAKSVYCAATHGVLSGEAVDRINSTQFSEVVLANTIAIPESKKINKLKSLSVAPLFANAIQRIHTNQSVSTLFD

SEQ ID NO: 36778 - protein, 202 aa, Azoarcus sp. BH72
MPCYEIDGLKPVIHPTAYVHPDAVLIGDVIIGPRCYVAPLASLRGDFGRIVMEEGSNIQDSCVMHGFPGTDTVVGVDGHIGHGAILHGCQVGRNALIGMNAVVMDNAVIGDSAIVAASAFVKAGMEVPPRTLVAGMPAKVVRELSDQEVSWKMDGTRTYQDLTVRSLATLKPCEPLAEMEPGRKRFEMPGVVPLVDAKKNGG

SEQ ID NO: 36779 - protein, 362 aa, Pseudomonas putida KT2440
MNDLSHTHMRAAVWHGRHDIRVEQVPLPADPAPGWVQIKVDWCGICGSDLHEYVAGPVFIPVEAPHPLTGIQGQCILGHEFCGHIAKLGEGVEGYAVGDPVAADACQHCGTCYYCTHGLYNICERLAFTGLMNNGAFAELVNVPANLLYRLPQGFPAEAGALIEPLAVGMHAVKKAGSLLGQTVVVVGAGTIGLCTIMCAKAAGAAQVIALEMSSARKAKAKEAGANVVLDPSQCDALAEIRALTAGLGADVSFECIGNKHTAKLAIDTIRKAGKCVLVGIFEEPSEFNFFELVSTEKQVLGALAYNGEFADVIAFIADGRLDIRPLVTGRIGLEQIVELGFEELVNNKEENVKIIVSPGVR

SEQ ID NO: 36780 - protein, 478 aa, Saccharomyces cerevisiae
ASAAQSTPITGKVTAVIGAIVDVHFEQSELPAILNALEIKTPQGKLVLEVAQHLGENTVRTIAMDGTEGLVRGEKVLDTGGPISVPVGRETLGRIINVIGEPIDERGPIKSKLRKPIHADPPSFAEQSTSAEILETGIKVVDLLAPYARGGKIGLFGGAGVGKTVFIQELINNIAKAHGGFSVFTGVGERTREGNDLYREMKETGVINLEGESKVALVFGQMNEPPGARARVALTGLTIAEYFRDEEGQDVLLFIDNIFRFTQAGSEVSALLGRIPSAVGYQPTLATDMGLLQERITTTKKGSVTSVQAVYVPADDLTDPAPATTFAHLDATTVLSRGISELGIYPAVDPLDSKSRLLDAAVVGQEHYDVASKVQETLQTYKSLQDIIAILGMDELSEQDKLTVERARKIQRFLSQPFAVAEVFTGIPGKLVRLKDTVASFKAVLEGKYDNIPEHAFYMVGGIEDVVAKAEKLAAEAN

SEQ ID NO: 36781 - protein, 129 aa, Nocardioides sp. JS614
MGESDVRPWGSWEVLDEGLGYKVKRLVVRPRQRLSYQTHSYRAEHWVIVSGRATCVINGVVRKARPGDYVDVPVGAAHRLMNEEQEPLVVIEVQRGLYTGEDDIVRLEDDYGRSEVVIATPGRLLDALA

SEQ ID NO: 36782 - protein, 341 aa, Vitis vinifera
  misc_feature (99)..(99): Xaa can be any naturally occurring amino acid
MAPVLQSSQPWVEKYRPKQVKDVAHQDEVVRVLTNTLETTNCPHMLFYGPPGTGKTTTALAIAHQLFGPELYKSRVLELNASDDRGINVVRTKIKDFAXVAVGSGHRQGGYPCPPYKIIILDEADSMTEDAQNALRRTMETYSKVTRFFFICNYISRIIEPLASRCAKFRFKPLSEEIMSSRILHICKEEELNLDSEALSTLSSISQGDLRRAITYLQGAARLFGSIISSKDLISVSGVVPQHVVQALFAACKSGDFDSANKEVNNVIAEGYPVSQMLYQLFDVVVEADISDEQKARICKRLAEADKCLVDGADEYLQLLDVASNAMRALCNMPEEFPHES

SEQ ID NO: 36783 - protein, 949 aa, Candida albicans SC5314
MAKASQAEGQPYKGYYNNKSQGQPYHGYYSGFNKSASAQIHHLARSLTQGVQSHYDDTYTTATMHPNGINPISDKTDPTLDPESPSFSSKRWVQNMWKLYQSDSEYYKPGKLGVAYRNLRVYGDAIESDYQTTVSNGVLKYARNIFNKFRKDNDDYSFDILKPMEGLIKPGEVTVVLGRPGAGCSTFLKTIACRTEGFHVADGSVISYDGITQDEIRNHLRGEVVYCAETETHFPNLTVGETLEFAALMKTPQNRPMGVSREEYAKHVVDVVMATYGLSHTKNTKVGNDFIRGISGGERKRLSIAEVTLVQASIQCWDNSTRGLDAATALEFISSLKTSASILNDTPLIAIYQCSQNAYDLFDKVIVMYEGYQIFFGSSQRAAAYFKKMGFVCQDRQTTPDFLTSITSPAERIIKPGYERLVPRTPKEFYRYWRRSPERQALLEEIDEYLDNCENYDQKQKIFEANNAKKAKHTYNKSSYTVSLPMQVRYIMKRYWDRMRGDIIVPLSTVAGNIAMALILSSVFYNLQPNSSSFYYRTSVMYYALLFNAYSSVLEIYNMYEGRAIVQKHREYALYPPMADAIGSIISDFPLKVVCSVLFNLILYFMVNFKREPGAFFFYLLISFCSTLFMSHLFRTIGAFTNSLAEAMTPSSLLLFALSTFSGFAIPVTYMLGWCKWIRWVNPLAYAYEALISNEFHGRVFDCSNIVPSGFGYPKTGNSVVCASIGALPGEFKVDGDLYLKLAFDYSYSNVWRNFGVLMAFIIFLFGTTIFFVQTNKSSISKGETLVFRRKNIRKMRKMEEDEEAYMDGMAPLDFSGSTEISDYSYDYMDRKLLDTSNIFHWRNLTYTVKIKSEERVILNNIDGWVKPGEVTALMGASGAGKTTLLNALSERLTTGVITSGTRMVNGGELDSSFQRSIGYVHQQDLHLETFTVREALKFSARLRQPNSV

SEQ ID NO: 36784 - protein, 468 aa, Pectobacterium atrosepticum
MSRSNAHLNPLECTQQALHWIHSDTLSPDDMAALNQEVLSCFREYVNPGFLEYRKSVTTGGDYGAVEWRASGPNTLIDTQGNEYLDCLGGYGIFNVGHRNPNVIAAVESQLARQPLHSQELLDPLRGLLAKTLAALTPGNLKYSFFSNSGTESVEAALKLAKAYQSPRGKYTFIAATGAFHGKSLGALSATAKPAFRRPFMPLLPGFHHVAFGDISAMRKQVQQCQKTGDDVAAIILEPIQGEGGVIVPPENYLPAVRALCDEVGALLILDEVQTGMGRTGKMFACEHYGVQPDILCLAKALGGGVMPIGATVATEAVFSVLFENPFLHTTTFGGNPLACAAALATVNELLTKNLPEQAAIQGEFLLQGLQQLAAEYPQLIIEARGMGLLQAIEFRKNEIGYAFAKELFQRNILVAGTLNNSKSVRIEPPLTITREQCARVLKEAKDVLKKLNGTMPDENKMKEYAVE

SEQ ID NO: 36785 - protein, 519 aa, Debaryomyces hansenii
MSELLDSIQPYLTKWYVVISALLVSFFIAHKISVARFKATHNCAASPEYYKVNWFSLPLLYRLIQVKREGRLLDFAQKIYDDVKALTFVIKIVGVPVIITRDPENMKAVLATQFNDFALGTRHAHFKPLLGDGIFTLDGNGWKQSRSMLRPQFSREQVAHVQALEPHLQRLAKHIRLADGETINIQDLFFKLTVDTATEFLFGQSVYSLKDAAINDPPTEDFDGRSSFANSFNTAQTYLGTRAYLQMFYFIVNNSDFRKCCKQVHDFTRFYVQKGLDMTPEELEKKSENGYVFLYELVKQTRDPKVLQDQLLNILLAGRDTTAGLLSFTFFELARHPRVFNKLKEEIYEAFGKGDDARVSEITFESLKKCEYLKWVMNEMLRLYPSVPVNFRVATKRTTLPRGGGPDGNSPIYVGKGTTVAYSVYSTHRMEEYYGKDADEFKPERWAESRKLGWAYVPFNGGPRICLGQQFALTEASYIVTRLLQMFDKLELHDDRPYPPAKSVHLTMCHQDGVYVSLS

SEQ ID NO: 36786 - protein, 137 aa, Triticum aestivum
  misc_feature (53)..(53): Xaa can be any naturally occurring amino acid
  misc_feature (82)..(82): Xaa can be any naturally occurring amino acid
  misc_feature (94)..(94): Xaa can be any naturally occurring amino acid
  misc_feature (98)..(98): Xaa can be any naturally occurring amino acid
  misc_feature (102)..(102): Xaa can be any naturally occurring amino acid
  misc_feature (108)..(108): Xaa can be any naturally occurring amino acid
  misc_feature (113)..(113): Xaa can be any naturally occurring amino acid
  misc_feature (116)..(116): Xaa can be any naturally occurring amino acid
MAPAVMASSATTVAPFQGLKSTAGLPVSRRSSGSLGSVSNGGRIRCMQVWPIXEGIKNSETLSYLPPSPRRPPEAVDYLIRXKWVPCLQFNKVXFVFXEHNXSPGYYXGRYWXMWXLPISGAPTHQVSTSGGVKKDT

SEQ ID NO: 36787 - protein, 580 aa, Legionella pneumophila str. Paris
MSFSKISKTLENSATLIDEKAEQDASDLSHTLGSDSQLLISEESSDVLLENTGENLVQQACIDGNLEKLKELLRGDMWGMDEVSLNQVNNRGETLLMLAIKYGHKQMALFLARSLFHLHKIDNSGKSALSLAHEKGWEDIVQLILESINNREARIRELHYAAIHGYVESVSQLLGIIDKYGFKPHGFILVGDETPRFENIFHAACCGGSLEIVKLLIEHGADINSKSQFSENNYSHYPATPILVACRYGHANIVEYLLAQDGIEYDINELLHTAVGFGHFAVLDLLLRHSKENSTRNLNIVGEYPLTHFSATLLTRACYSGQVDIVDRLIAEDIDMSNADNRQAFWTAIFCAKTQGSPAIDIIDRLLAENDRQNIDIPLDGFKDLVLWAYRQPFVGILDRLIIRGVDFYRERDPGDYPLIEAAKNGYKDIVHRLIDLSVDINLRDRKGRTALFCAVMQGEKEIVELLINNGADPNIQDNEGVTPLMKVVPTDNSEMVEFLLNAGADTSIKDKRNRLAIDLAKHFPYHMKLLKDATEIQNANKSSSSSNQSANALYTLWYSNRGDLREEAQFKEKNTPHPF

SEQ ID NO: 36788 - protein, 584 aa, Legionella pneumophila str. Paris
MSFSKVNKILDSNSILKEEIDKPEVLGLAQSSGGEEPPMIPDEMLFALQDRVGVNRVQQACIDGNLHVLERMNCDEFDYVDSYGTTPLMLAIEHDHKAIAYYLLRSRMINLNLHKKDNAGRSALSMAKEKGWDDIVDLIRNTMENPVYNNMELYYATINGYLDSVTELLPKIDEPGFATKETWINTYPLFGNIFHAACCGGNLEIVKLLMEYGAEINSRSYNRERHNFYYATTPILVACRYGHAHLVEYLLTQDGVQYDIIELFHIAVEYGHYAVMDLLLRKIRAENIALDLNRGLEFHASWYGTPLDKACRSGQVDIVDRLIAEGIDMKEEDNISAITTAIWNADNPEYPAIDILDRLLAECDRQGISIPLTAPEIAIIACNRNRADILDRLIIRGFDFNLGNRHGEYPLITAAIKGHEAIVDRLLSLSVDVNQRDSEGKTALFQAARHNNLEIVKLLVNNGADINIPDNKGVTPLMRVAETCFTEVVKYLLNSGADTSLKDKGGRSALDYASSSSLYFMQENLALIRDADIQKNLYKSPSSSSQSVNNPYMLWSSNRANLPEEESVKSEIISEEKAFTFQSK

SEQ ID NO: 36789 - protein, 483 aa, Rhizobium leguminosarum bv. viciae 3841
MTHRRFVVEKAEIGLIGLAVMGSNLALNIAEKGNKIAVFNRTPEKTDEFYESAGDLKKQIIPCKTIEEFVDAIRPPRPIVIMIKAGEPVDQQMELLRPHLSKGDIMIDAGNANFRDTVARFDRLKNTDLTFIGMGVSGGEEGARHGPSIMVGGTEESWKRVEKVLTSIAARYNDEPCVAWLGNDGAGHFVKTIHNGIEYADMQMIAEIYGILRDGLGKSASEISGIFGEWNKGRLNSYLIEISEKVLAATDPVSGGPMVDMILDKAGQKGTGKWSAIEAQNMGIPATAIEAAVAARSLSSMKSQREAAEKIFGTQAVSFPIAYGPELNKDLELALFAAKIGAYAQGFAVMAEASREFNWSLPMPTIARIWRAGCIIRSQFLDEITSAFTKAPDAANLIVTPAFSDMVKESIPALRRVVGAAIAAGLPVPALTSALTYFDAYRQGRGTANLIQAQRDFFGAHGFDRLDGKDFHHGPWGSGASTF

SEQ ID NO: 36790 - protein, 356 aa, Zea mays
MGAASQLRRRTRARTPPGPGPEAAAADDDVRCEACGSGDAAAELMLCDGCDCGFHIFCLRPILPRVPAGDWYCPSCRAPASSKSEPAAAGKKPKQFPLVQTKIVDFFKIQRSPTPLVEAAELKKRKRKHGGALVASKKKSRRLLPFVPSPDPAQRLRQMASLATALTATGAAFSNELTYQPGMAPRSANRAALEAGGMQVLGREDAETLARCQQMIARGEWPPLVVAYDPVEGFTVEADRPIRDLTIITEYVGDVDFLRNREHDDGDSMMTLLSAASPARSLVICPDRRSNIARFINGINNHTPEGRRKQNVKCVRFAVGGECRVLLLANRDISKGERLYYDYNGSEHEYPTHHFV

SEQ ID NO: 36791 - protein, 528 aa, Streptomyces antibioticus
MSDVPSIPADPAPTTRCRLEELRALRQAVADGPDPRATEAQHAKGKLTARERVELLLDGGSFHEVEPLRRHRAQGFGLEARKPHTDGVVVGWGTVHGRTVFVYAHDFRIFGGALGEAHAQKIHKIMDMAIAAGAPLVSLNDGAGARIQEGVTALAGYGGIFQRNTRASGVIPQISVMLGPCAGGAAYSPALTDFVFMVRETSQMFITGPDVVQAVTGEKISQNGLGGADVHSAVSGVSHFVYDDEQSCIEEVRYLLSLLPSNNREMPPVQLSDDPVDRRNDSLLDLVPADGNRPYDMRKVIEEVVDYGEYLEVHERWATNVLCVLARIDGHVTGIIANQPQSLAGVLDISASEKAARFVQMCDAFNIPLVTLLDVPGFLPGVDQEHGGIIRHGAKLLYAYCNATVPRISLILRKAYGGAYIVMDSRSIGADLAYAWPTNEIAVMGAEGAANVIFRRDIAAAEDPDAMRTQKIKEYKAELMHPYYAAERGLVDDVIDPAETRQVLTSALAMLRTKHADLPSRKHGNPPM

SEQ ID NO: 36792 - protein, 336 aa, Pseudomonas syringae pv. phaseolicola 1448A
MINLTSIASSLARVALSDSTKPTIDRALNVVSHIAGKVALQVNSSLLEQKGRLNERQQKGLAVILDALRGKEPVTNVETHEGGGRFNLARAAFDVASVVWERDKSMHNVMSFLGVSDSQGKMLFSLGKKLADAMAKPEPGYGKHNSEANYAFFSSNLKLNKLMSDIADQLINEIRQSNTDRVRRPTPGPSWRPESAQQQARPQTPPRTRPQANSTPPPPKAKPNAGAKRPSTQRPHNTPAADASSKVGDSGPAKPPVKPLYEHLGLSDMTADLSAVKTAYKKAALKNHPDKNAGNVAEATERFKVISNAFKILSDPELRKKYDNGLINEKGDEVQV

SEQ ID NO: 36793 - protein, 232 aa, Zea mays
MRSMLFLRCQPRVSSPSPSASASAPPFRPRVRVAAPLGVRVTGGRRGQAVVAMASADARLAGIASSIRVIPDFPKPGIMFQDITTLLLDPKAFRDTIDLFVERYKDQGITVVAGVEARGFIFGPPIALAIGAKFVPLRKPKKLPGEVISEEYSLEYGTDKIEMHVGAVQANDRALVVDDLIATGGTLCAAVKLIERVGAKVVECACVIELAELKGRDKLGDRPVFVLVEADA

SEQ ID NO: 36794 - protein, 456 aa, Escherichia coli
MMEGQQHGEQLKRGLKNRHIQLIALGGSIGTGLFLGSASVIQSAGPGIILGYAIAGFIAFLIMRQLGEMVVEEPVAGSFSHFAYKYWGSFAGFASGWNYWVLYVLVAMAELTAVGKYIQFWYPEIPTWVSAAVFFVVINAINLTNVKVFGEMEFWFAIIKVIAVVAMIIFGGWLLFSGNGGPQATVSNLWDQGGFLPHAFTGLVMMMAIIMFSFGGLELVGITAAEADNPEQSIPKATNQVIYRILIFYIGSLAVLLSLMPWTRVTADTSPFVLIFHELGDTFVANALNIVVLTAALSVYNSCVYCNSRMLFGLAQQGNAPKALASVDKRGVPVNTILVSALVTALCVLINYLAPESAFGLLMALVVSALVINWAMISLAHMKFRRAKQEQGVVTRFLLLYPLGNWICLLFMAAVLVIMLMTRGMGIWVYLIPVWLIVLGIGYLFKEKTAKAVKAH

SEQ ID NO: 36795 - protein, 355 aa, Azoarcus sp. BH72
MTPRFHPLKVAEVRRETADSVSLRFEVPADLAADYRFVQGQHLNLKAVVNGEEVRRSYSICSGVDDGELRVAIRKVDGGRFSSWAVDAVRVGDVFEVMTPEGRFSTQLDPANAHHYVAFAAGSGITPILSLIKTTLRAEPKSRFTLVYGNRNQNSAMFAEALEDLKDRYLTRFALYNVFSREEQEVPLFNGRLDQARVAAFLDTLIPAADIDAAFICGPGGMIDEVEAALKGAGVPADRIHLERFGVPASAPRHHVEAGDAPQARITVIVDGLKREMEFRAQDPSILDVALRAGLDLPYSCKGGVCCTCRAKVLEGKVRMDKNYTLEQPDIDAGYVLTCQAHPLTERVVISYDDR

SEQ ID NO: 36796 - protein, 353 aa, Blastopirellula marina DSM 3645
MDPISLGEGNTPLVRSQRIGPALGLKNLYFKLETVNPTGSYKDRFAAAAIADMQRQGKRRVIATSSGNTGSALAAYAAAAGMACTIAIVDGAPAGKLRQMMAYGADIKKIQGFGHDAKVTQATFEFLQQLGAQPDAQLQISAYHYSPVGMGGVEAIGREIAAQLSAHGQQADHVFSCAGGGGLTLAVARGFCTAVEFESIDASPHVHCVQPIGNNTIAGPLRDGSDQAQATVCTTKISGLQVASVIDGDAVIAACRASGGTGWLVEDAEIYESQTELARQEGIFSEPAGAVPLTGLKQALAAGQIPSTATIICLVTGTGFKDLDSVDAMLGANACPTISLAQFVQQLRETPLL

SEQ ID NO: 36797 - protein, 363 aa, Neisseria meningitidis MC58
MSLKCGIVGLPNVGKSTLFNALTQSGIEAANYPFCTIEPNVGIVEVPDPRMAELAKIVNPQKMQPAIVEFVDIAGLVAGASKGEGLGNQFLANIRETDAIVNVVRCFDDDNIVHVAGRVDPIADIETIGTELALADLASVEKAIVREEKRARSGDKDAQKLVDLCKKLLPHLDEGKPVRSFGLDAEERAMLKPLFLLTAKPAMYVGNVAEDGFENNPHLDRLKELAAKENAPVVAVCAAMESEIAELEDDEKAEFLAEMGLEEPGLNRLIRAGYDLLGLQTYFTAGVKEVRAWTIHKGDTAPQAAGVIHTDFERGFIRAQVISYDDFVSLGGEAKAKEAGKMRVEGKEYVVQDGDVMHFLFNV

SEQ ID NO: 36798 - protein, 510 aa, Sinapis alba
MVKLAHLLVATVGVLLVLNGCLARQSLGVPPQVKDACNLDNLDVLQPTEVIKSEAGQVEYWDHNHPQIRCAGVSIARLVIQKGGLYLPTFFSSPFISYVVQGMGISGRVIPGCAETFMDSQPMQGQQGQQQGQQGQQGQQGQQGQQGQQGQQGQQGQQGQQGQQGQQGQQGQGFRDMHQKVEHVRHGDAIAMTPGSAQWIYNTGDQPLIIVSLIDIANYQNQLDRNPRTFRLAGNNQQGSSQQQQQQQQNILSGFDPQVLAQALKIDVRLAQELQNQQDKRGNIVRVKGPFQVVRPPLRQAYESEQWRHPRGPPQSPQDNGLEETICSMRTHENIDDPARADIYKPNLGRVTSVNSYTLPILQYIRLSATRGILQGSAMVLPKYNMNANEILYCTQGQARIQVVNDNGQNVLDQQVQKGQLVVIPQGFAYVVQSQNNFEWISFKTNANAMISTLAGRTSALRALPLEVITNAYQISLEEARKIKFNTLETTLTRARGGQQPQLIEEIVEV

SEQ ID NO: 36799 - protein, 523 aa, Sinapis alba
MVKLAHLLVATVGVLLVLNGCLARQSLGVPPQVKDACNLDNLDVLQPTETIKSEAGRLEYWDHNNPQIRCAGVSIARLVIEQGGFYLPTFFSSPKISYVVQGMGISGRVIPGCAETFMDSQPMQGQQQGHQGQQQGQQGQQGQQGQQGQQGQQQGQQGQQGQQGQQGQQGQQGQQGQQQQGQQGFRDMYQKVEHVRHGDVIANTPGSAHWIYNTGDKPLVIISLLDIANYQNQLDRNPRVFRLAGNNPQGGFGGPQQQQPQQNILNGFDPQVIAQALKIDVRLAQELQNKQDSRGNIVRVKGPFQVVRPPLRQAYESEQWRHPRGPPQSPQDNGLEETICSMRTHENIDDPARADIYKPNLGRVTSVNSYTIPILQYIRLSATRGILQGSAMVLPKYNMNANEILYCTQGQARIQVVNDNGQNVLDQQVQKGQLVVIPQGFAYVVQSQNNFEWISFKTNANAMISTLAGRTSALRALPLEVITNAFQISLEEARKIKFNTLETTLTRARGGQQPQLIEEIVEV

SEQ ID NO: 36800 - protein, 175 aa, Chromobacterium violaceum ATCC 12472
MNLASIGPGKDMPGDFNVVIEISANAAPIKYEFDKDWNTLVVDRFMGTSMMYPANYGFVPQTLAGDGDPVDVLVVTPFPLPPGVVVRCRALGLIKMEDDGGVDAKLVAVPVEKLCPMYKSIQKLEDLPELLRNQMVHFFEHYKDLEKGKWVKIQGWGTLEDAKTELVEGIERFGK

SEQ ID NO: 36801 - protein, 222 aa, Citrus sinensis
MNPSPSVTELQVENVTFTPSVQPPGSTKSHFLGGAGERGLEIEGKFVKFTAIGVYLEDDAVPLLAGKWKGKTAEELTESVEFFRDVVTGPFEKFMKVTMILPLTGAQYSEKVAENCIAIWKFFGIYTDAEAKAIEKFTEVFKDEIFPPGSSILFTQSPGSLTISFSKDGSIPKDGVAVIESNLLSEAVLESMIGKNGVSPAAKKSLAERLSALLNVTSDKMK

SEQ ID NO: 36802 - protein, 199 aa, Triticum timopheevii subsp. armeniacum
ELLGIEVKKAEDVIGPEVEKLVADLANGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVIIADKFAPDANSQ

SEQ ID NO: 36803 - protein, 342 aa, Rhizobium leguminosarum bv. viciae 3841
MRALQLIDDRKLEITDLPEPDAPAAGEVTLRVKAVALNHIDVWGWRGMAFAKRKMPLVIGAEASGVVEAIGPGVANVLPGQLVAIYGARTCGLCRPCREGRDNLCEHVSGVHGFHLDGFAQEKVNLPARLLVPAPPGVDAIGAALAPVTFGTVEHMLFDNAKLEPGETILVHAGGSGIGTAAIQLAKKIGCTVITTVGSDDKIEKAKALGADHVINYRTDRFEGVVRKLTKKKGVDVVFEHVGKDTWAGSMLCMKRGGRLVTCGSTSGVSTEMNLMMLFQQQLKLFGSFGCRMENMADAMQKMGRGLVHPVIDTEVSFSDIDRALERMESRQIFGKIILKMD

SEQ ID NO: 36804 - protein, 169 aa, uncultured marine gamma proteobacterium EBAC20E09
MKENNAMNAQQVDALEEKLVQVNRVAKVVKGGRIFGFTALTVVGDGKGRVGFGRGKAKEVPIAIQKAMENARRSMVEVELNNTTLWYPVKAKHGSAKVYMQPASEGTGIIAGGAMRAVLELAGVQNVLAKCYGSTNPVNVVRATINALSAMESPEKVATRRGKKVEELS

SEQ ID NO: 36805 - protein, 446 aa, Streptomyces antibioticus
MHPVPAPEQPGELIARLRAASRTGRPRSLEWRTEQLTRLRSLLQEHTDALAEALFADLHKSRSEAHAAEIGFTVREIDHLLENLEEWLRPQPAAVPGCPAGSTAYVQYDPLGVVLVIAPWNYPVQLLLVPVAGALAAGNTVVAKPSEVAPACSALLARLIPQYLSRDAVAVVEGGVAETTALLAQRFDHIFYTGNGTVGRIVMRAAAEHLTPVTLELGGKSPVFVDRGTNLADTATRLARAKFANAGQTCVAPDYVLTDPDTARGLVAEIARSVRRMFGSEPELARGYGRIVNLHHFDRVVRLLGSGRIVLGGRHDRENRYIAPTVLADVAAESPVMREEIFGPVLPIVEVPGVDQAISFINDRDKPLAVYGFTAREEVPRRLAEETTSGGLVLGMPMAQVLDPGLPFGGVGESGTGSYRGAHSLAAFSHLKPVLDVPMRPTGPVG

SEQ ID NO: 36806 - protein, 495 aa, Oryza sativa Indica Group
MATAGALALVAICSYLAVTSNKQKRRRRPPVVGTVFHQLYNVRRIHDYHTALSREHTTFRMLVPAGGDQIYTCDPAVVEHILKTNFANYGKGPFNHGNAKDLFGDGIFAIDGEKWKQQRKIASYDFSTRALRDFSCAVFKRNAAKLAGIVSNHAASNQSMDFQGLMLRATMDSIFTIAFGTDLNTLDGSGEGSRFAAAFDDASEFTMLRYISPLWKLARLLNVGVEAMLKERIKVVDEFVYRLIRARSDELSNSHDSGSRQDILSRFLQATTSDSGVDYKYLRDIILNIVIAGKDTTAGALAWFLYMVCKHPEVQEKICHEAMVATSAGDTASVDEFLQSLTDQALNNMHYLHAALTETLRLYPSVPMENKQCFSDDVLPNGFNVSKGDIVFFIPYAMGRMESLWGKDAEYFRPERWLDENGVFQQESPFKFTAFQAGPRICLGKEFAYRQMKIFAAVLLRFFVLKLRDEKEIVGYRTTLTLAIDQGLHLTATAR

SEQ ID NO: 36807 - protein, 497 aa, Bordetella parapertussis 12822
MKTIPHFINGQPYEGRNGRYTQGFNPATGEVSSSIPLASAQDVDTAVAAAAAAFPAWSETPPLKRARILFKFKALLDEHQDELAALITAEHGKVFSDAKGEVTRGIEVVEFACGIPHLLKGQYTDQIGGGIDNWSMRQPLGVVAGITPFNFPMMVPCWMFPVALACGNTFVLKPSERDPSAALRLAELLKEAGLPDGVFNVVQGDKQAVDALIAHPQVEALSFVGSTPIAEYIYAEGTRRGKRVQALGGAKNHMVVMPDADLDQVTDALMGAAYGSAGERCMAISVAVAVGEVADEVVARLAPRVRALVVKDGMQADAEMGPQVTAQHRAKVTGYIEDGQACGATLVVDGRGLQVPGNEGGFFLGGTLFDHVTPAMNIYREEIFGPVLCIVRVPDFAAAVELINAHEFGNGVSCFTSDGGIARAFARQIKVGMVGINVPIPVPMAWHSFGGWKRSLFGDHHAYGEEGVRFYSRYKSVMQRWPDSIGKGAEFTMPVAK

SEQ ID NO: 36808 - protein, 516 aa, Oryza sativa Indica Group
MDGDSSYSPALAAVAGAVALVAFCSYYLAVTRATGDGEARRRRRRHPPVVGTVFHQLYHVRRLHDYYTALCREHTTFRLLATPGRRNIYTCDPAVVEHILRTNFPSYGKGPLNSEILNDLFGEGIFAVDGEKWKTQRKIASYDFTTRALRDFSSDVFKRNAAKLAGVVSNHAASNQSMDFKGLLTRATMDSIFTIAFGQDLNTLDGSGEGRRFAKAFDDAGEYLLLRYLNPFWKLARLLNVGAEATLKERIKVVDEFVYKLIRARSDELSNTMAQDHRSRDDLLSRFIQATTSDSGTVDYKYLRDIVLNIVIAAKDSTSGSLAWFLYMACKRPEVQEKIFDEVMEATNAGDSASIDEFLTSLTDQALNKMHYLHAALTETLRLYPSVPLENKQCFSDDVLPNGFSVSKGDGVFYMPYAMGRMEFLWGKDAEAFRPERWLDEHGVFQQESPFKFTAFQAGPRICIGKDFAYRQMKIFAAVLIRFFVFKLRDKKDNVSYRTAITLAIDQDLHLTATAR

SEQ ID NO: 36809 - protein, 427 aa, Bordetella parapertussis 12822
MPFTANRQFKSQPRLLARAEGMYYTSTDGRQILDGTAGLWCVNAGHCRPEIVQAIASQAGEMDYAPGFQLGHPLAFEAATAVASFMPAGIDRVFFTNSGSESVNTALKIALAYHRARGDAQRTRLVGRERGYHGVGFGGISVGGISANRKTFSGALLPAEDHLPHTHSLEHNAFSKGQPAWGEHLADELERIVALHDASTIAAVIVEPMAGSTGVLVPPKGYLQRLREITARHGILLIFDEVITAYGRLGSPTAAEHFGVTPDIITMAKGVSNAAVPAGAVAVKREVHDAIVNGVQGGIEFFHGYTYSAHPLAAAAILATLGIYRRDDLFGRARDLSPAFEKAAHALQGAPHVIDVRNIGLVAGIELASRPDAPGARAAEAFRKCFDSGLMVRYTGDILAVSPPLIIDEAQIGELFEGIGKVLKEIA

SEQ ID NO: 36810 - protein, 464 aa, Mesorhizobium loti MAFF303099
MKEISCKLLVIGAGPGGYICAIRAGQLGVDTVIVEAGKPGGTCLNVGCIPSKALIHAAEEFEKVAHMAGGKSPLGISVSAPVLDLGKTIAWKDGIVSRLNSGVAGLLKKAGVKTVHGWAMFRDGKTVEVETETGSQVIRAETIVIATGSAPVELPFLPFGGPVISSTEALALSVVPKKLAVVGGGYIGLELGMAFAKMGAEVTLVEALPRVLAQYDAELTRPVVKRLAALGVEVMTEAKAKGLSTKGDALLVETADGKNTKVSADKILVTVGRKPVTEGWGLDQIDLDMSGKFIRIDDQCRTSMRGIFAIGDVTGEPMLAHRAMAQGEMVAEIVAGHKRNWDKRAIPAVCFTDPELVTVGLSPEEAKAQGEIKIGLFPFAANGRAMTKLGEDGFVRVVARADNHLVLGIQAVGQGVSELSTAFGLALEMGARLEDIAGTIHAHPTQGEGFQEAALKALGHALHI

SEQ ID NO: 36811 - protein, 438 aa, Mesorhizobium loti MAFF303099
MGEHIIKLPDVGEGVAEAELVEWHVKVGDMVREDTVLAAVMTDKATVEIPSPVDGEILWLGAEIGDTVAIGSPIVRLKVAGEGNVKPKGDAKAEAVAAEPPAKLPTPKPETAGPVAKASPKAGAPEAKPAPAVAKSTGQRSISGAPRPEGERPLASPAVRLRAKEAGIDLRQVAGSGPAGRIGHEDIEAFLARGPQVAKTSGLTRNDAVEDIKVVGLRRKIAEKMTLSKSRIPHITYVEEIDVTALEELRAALNKEKRADRPKLTLLPFLMRAMVKAIAEQPQLNSLFDDEAGIIHQHGGIHIGIAAQTPSGLVVPVVKHAEARDIWDCGAEVNRLAEAAKSGTATRDELSGSTITITSLGAMGGIATTPVINHPEVAIIGVNKMMVRPVWDGTQFIPRKMMNLSSSFDHRVIDGWDAAVFVQRIKALLETPALIFVD

SEQ ID NO: 36812 - protein, 348 aa, Erwinia chrysanthemi
MERWFKSLFVLVLFFVFTASAADKLPNIVILATGGTIAGSAATGTQTTGYKAGALGVDTLINAVPEVKKLANVKGEQFSNMASENMTGDVVLKLSQRVNELLARDDVDGVVITHGTDTVEESAYFLHLTVKSDKPVVFVAAMRPATAISADGPMNLLEAVRVAGDKQSRGRGVMVVINDRIGSARYITKTNASTLDTFRANEEGYLGVIIGNRIYYQNRIDKLHTTRSVFDVRGLTSLPKVDILYGYQDDPEYLYDAAIQHGVKGIVYAGMGAGSVSVRGIAGMRKALEKGVVVMRSTRTGNGIVPPDEELPGLVSDSLNPAHARILLMLALTRTSDPKVIQEYFHTY

SEQ ID NO: 36813 - protein, 244 aa, Oryza sativa Indica Group
MSSTNNSSGEPPPAVRVLGGWASPFTNRVVVALKLKGVEHELLQETVGKKSELLLRSNPVHKKFPVLLHHGKPLPESLVIVEYIDEVWPASNGAASAILPRDPHGRAVERFWARYVDDKILPGLRVLRGSVTGDKYKTAGEMSTALQRLEEAFVKCSQGKEYFGGDSIGYLDIALGSFLGWIKAVEKIAGVELLNETKLPILAVWADRFCAHPAVVDVVPDADKLVEFTVQYGAVLNTTNVLPK

SEQ ID NO: 36814 - protein, 204 aa, Brassica napus
FSEDKIMDNESKGVMMSWEKPLMEAHAKAICTNGGSILNVGFGMGLVDTAIQQYNPTKHTIIEAHPDVYKRMIESGWGEKENVRIVFGRWQDVLGELDECGYDGIFFDTYGEYYEDLWEFHQNLPKLLKSDGIYSYFNGFCGSNAFFHVVYCNLVTLEIESLGFSTQLIPLPVKDCLGDEVWEGVKQKYWQLDTYYLPVCQFSE

SEQ ID NO: 36815 - protein, 638 aa, Zea mays
MAAGRHGGYRDYEERERELDAEASRRSKEQHHHLGGRHRDVDRRRDGGRSRGGRDFANGHGRRRSPPPRSRLAGRLGDREPGEVLSGSASDDSGGRSDRGRENGVRSSSREGDMVAGTGISSPIKKRKFSPIIWDRDSPKPPHSGAARDKKSVESVPSELPPPPPLPQDHIPLSLSVEKSPMDVETTVGTESAEQLPEHEVNKVIEQEEDYPSPTMRNISTSRWAGANDDEEGGAAPMKKRSVSPADSSVPGQWKRASPEPGEVSGGRAMSRSSDSGKIGNDEKEDSEVDKDDYMDVDREHASDSGTENCMSDTDSDNEMCRPETPEPERPPHRCINMLQGCRSVDEFERLNKINEGTYGVVYRARDKKTSEIVALKKYMEHDLKGVMETMKQPYTQSEVKCLMLQLLEDGHLFYRDLKTSNLLLNNRGELKICDFGLSRQYGSPLKPYTQLVVTLWYRAPELLLGTKEYSTAIDMWSVGCIMAELLAKEPLFNGKTEFEQLDKIFRTLGTPSEKIWPGYAKLPGVKVNFVKQPYNRLRDKFPAASFSGRPILSEAGFDLLNRLLTYDPDKRISADDALKHKWFSEVPLPKSKDFMPTFPALNELDRRTKRYLKSPDPLEEQRLKELQGNIGNRGLFG

SEQ ID NO: 36816 - protein, 173 aa, Pyrococcus horikoshii OT3
MAIYEINGKKPRIHPSAFVDENAVVIGDVVLEEKTSVWPSAVLRGDIEQIYVGKYSNVQDNVSIHTSHGYPTEIGEYVTIGHNAMVHGAKVGNYVIIGISSVILDGAKIGDHVIIGAGAVVPPNKEIPDYSLVLGVPGKVVRQLTEEEIEWTKKNAEIYVELAEKHIKGRKRI

SEQ ID NO: 36817 - protein, 225 aa, Archaeoglobus fulgidus DSM 4304
MDSSGKYNAAKLALELVKDGMVLGIGSGSTVEVFLNLLGDKIREEGLEIYGIPSSYQSYFAAIRNGVEIVDLVEFEPDLCIDGADQVDAKLNCIKGGGGAMTREKIVAKASRKVVIIVDESKLVEKLSMPVPVEVLPFAYGWVLREIEKMGCKARLREGKGKIGPVITDNGNFVVDCDFGVIEEDRVEGLEGEIKLISGVVENGIFSKELIDAVIAGSSRSARFL

SEQ ID NO: 36818 - protein, 214 aa, Solanum lycopersicum
VMGLKRSDSLCSSVGIQGVAWAFGGMIFALVYCTAGISGGHINPAVTFGLFLARKLSLTRAVFYMVMQCLGAICGAGVVKGFMVGPYQRLGGGANVVNPGYTKGDGLGAEIIGTFVLVYTVFSATDAKRNARDSHVPILAPLPIGFAVFLVHLATIPITGTGINPARSLGAAIIYNDEHAWNDHWIFWVGPMIGAALAAIYHQIIIRAMPFHRS

SEQ ID NO: 36819 - protein, 377 aa, Neisseria meningitidis MC58
MSTPALLVLADGSVFHGTSIGYEGSTSGEVVFNTSMTGYQEILTDPSYCKQIVTLTYPHIGNTGTNAEDEESRSVYAAGLIIRDLPLLHSNFRASESLHDYLVRNKTVAIADIDTRRLTTLLREKGAQGGAILTGADATIEKAQELIAAFGSMVGKDLAKEVSCTETYEWTEGEWALGKGFVTPDEQPYHVVAYDFGVKTNILRMLASRGCRLTVVPAQTSAEDVLALNPDGVFLSNGPGDPEPCTYAIKAVQKLIESGKPIFGICLGHQLISLAIGAKTLKMRFSHHGANHPVQDLDSGKVVITSQNHGFAVDADTLPANARITHKSLFDNTLQGIELTDKPVFCFQGHPEASPGPQDVGYLFDKFIGNMKAAKRA

SEQ ID NO: 36820 - protein, 274 aa, Glycine max
MLASKEMMKFKSYQNRANLFVKEYLLADPLIPYTSIIGGIFACKMVYDLTQLFSTVHFKSYSSLTRIQRVEWNNRSMSTIHAIFITTMSLYLVFCSNLYSDNQSSELITFRSSSSSTFALGVSVGYFIADLGMIFWFFPSLGGYEYVIHHLLSLVAVAFSMLSGEGQLYTYMVLISETTTPGINLRWYLDAAGMKKSKAYLINGVVIFIAWLVARILLFVYMFYHVYLHFDQIEQMHAFGQVLVIVVPLALSVMNLIWFSKIIKGLRKTLAKRQ

SEQ ID NO: 36821 - protein, 255 aa, Zea mays
MAKLMNKLVDSFEHDEIPDVGCVRAVLAELVLTFLFVFTGVSAAMAAGSDGKPGDAMPMATLAAVAIAHALAAGVLVTAGFHVSGGHLNPAVTVGLMVRGHITKLRAVLYVAAQLLASSAACVLLRFLSGGMVTPVHALGRGISPMQGLVMEVILTFSLLFVTYAMILDPRSQVRAIGPLLTGLIVGANSLAGGNFTGASMNPARSFGPALATGDWTNHWVYWIGPLLGGPLAGFVYESLFLVQKMHEPLLNGEV

SEQ ID NO: 36822 - protein, 156 aa, Zea mays
MVPVQSASNPRRPAVSAGPPPSLPSPESRRPVSCCRGTLAMAEAPETAAPTQPPPAPAASSPPPKSGIPPRYDLDAKWDACLDLSIRRVAYSSLGGAFAGLLLFRSPTTRWASVALGAGVGIGAAYTECSYLFNGAPKCSPKVSTIPSAHSDGGDK

SEQ ID NO: 36823 - protein, 165 aa, Erwinia carotovora subsp. atroseptica SCRI1043
MRIGHGFDVHKFGGEGPLVIGGVRIPYTQGLLAHSDGDVVLHAVTDALLGAAALGDIGKLFPDTDPAFKGADSRGLLREAWRRINDKGYQLGNLDVTIIAQAPKMAPHIPQMRVNLAEDLQCHMDDVNVKATTTEQLGFTGRGEGIACEAVALLVKKETGEIVAW

SEQ ID NO: 36824 - protein, 583 aa, Vitis vinifera
MASNGVSGLDMEKKSGGGGGVEDIYGEDSATEDQLVTPWTVSVASGYTLLRDPHHNKGLAFTENERDAHYLRGLLPPAVLNQDLQEKRLMHNLRQYKVPLQRYMAMMDLQERNERLFYKLLIDNVEELLPVVYTPTVGEACQKYGSIFRRPQGLYISLKEKGKILEVLKNWPERSIQVIVVTDGERILGLGDLGCQGMGIPVGKLSLYTALGGLRPSACLPVTIDVGTNNEQLLKDEFYIGLKQRRATGQEYAELLHEFMCAVKQNYGERVLIQFEDFANHNAFELLAKYSKTHLVFNDDIQGTASVVLAGLIASLKLVGGSLAEHTFLFLGAGEAGTGIAELIALEISKQTKAPLEETRKKIWLVDSKGLIVHSRMESLQHFKKPWAHDHEPIRALLDAVKSIKPTVLIGSSGVGKTFTKEVVEAMTSFNKKPLILALSNPTSQSECTAEEAYTWSKGRAIFASGSPFDPVEYNGKLFVPGQANNAYIFPGFGLGLIMSGAIRVHDDMLLAACDGHYYHLGNLSLDLVAALLHHNNEFNHNSVLKTSAKAYQLGLASRLPRPEHLVKYAESCMYSPVYRSYR

SEQ ID NO: 36825 - protein, 183 aa, Oryza sativa
LRVWCLLLLEFYRKSQAWNSTASFSDVDEKNRKGGDAEDDFTHSRPDHVFRGVHRAIICGKVGQVPVQKILRNGHTVTVFTVGTGGMFDQRTVGAENLPMPAQWHRISVHNEQLGAFAVQKLVKNSAVYVEGDIETRVYNDRINDQVKNIPEICVRRDGKIQLMQSGDSNVGKSLEELREGLF

SEQ ID NO: 36826 - protein, 873 aa, Oryza sativa Japonica Group
MNICAAILLFYILQFVHGQPDSQGSTQWKATADSQCSHVSFRGFISIDCGIPEKSSYQDPTSSIIYVSDYGFISTGANHNISSAYIKPSLAQRNYNVRFFPDGTRNCYTLRSLQEGNKYFVRAVFYYANYDSLNKLPVFDLYLGANYWHEVKFSNADAVNWMDIIVVAPADYLQVCLVNKGTGTPFISGLDLRPLKSTLYPEANTTQSLVLINSNRFNMGPTDNSITRYPLDPHDRLWSTYDTIPDWTEISATSVVQNYLTDVYDVPSAVMQSAATVNSSRINFTWDPSDPSVNISSKYFFVLYFSELQSVPSNGLRQFDIIVNNNTWNTQPYTPPFLFADSLSGTVQGLASYSVSLVATKNATLPPILNAMEMYLVKPLTEFATDPRDARAMMEVQQNYDVKKNWMGDPCAPKAFAWEGLNCSYPPADSSKITSLDLSHNNLSGPIPNFLGQLPLLMFLDLSSNDLSGPIPYNLLQKSQNGSLSLRVGYNAKLCGNDTECGSGQKKIKGSLLSAIIITIVATVALIVVLFLLLRRMLKAKDKRRAAGPTYESALLENREFSYRELKHITNNFSQQVGKGGFGAVFLGYLENGNPVAVKVRSESSSQGGKEFLAEAQHLTRIHHKNLVSLIGYCKDKNHLALVYEYMPEGNLQDHLRGLEYLHVACKPALIHRDVKSRNILLTTNLGAKIADFGLTKVFSESRTHMTTEPAGTFGYLDPEYYRNYHISEKSDVYSFGVVLLELITGRPPVIPIDESVSIHIGEFVHQSLDHGSIESIVDARMGGGGGYDINSVWKVADLALHCKREVSRERPTMTEVVAQLKESLELESHGDRKHLVTGDDDVSVSNLGEETALEVEEQSGEISRVSPGPAVR

SEQ ID NO: 36827 - protein, 725 aa, Cryptococcus neoformans var. neoformans JEC21
MESIPIELVFDRVESGSVLLVDTRPLASFLNSHLPNSIPLSVPTLLSKRFQKSQSQSNPSAISWATLSPFVSLPSARERWDSVDQNKVEIAVICQGEEGRVVEDILKSLINDRTKVVKGGWAAVLNYERARRTLVSGQATTRPCLDVGVSETDSKPRPEPTSILLPPKSAPPCEIPLPPIPASPSPSSPKSLNHRPSLPSLRPPFAGPTRNLPSLSINAGQASQRRTPKLSLNLDRPLKSATLGGYHDIPPTPHGFLCTRTRPQRSPGLSLNIPHTPFQPQQGQVQDRIVGDSRSNGSASIQTRAYEQSHFPPSASTFGDAKQIENEGEDMAPNQYDGRTPRAPISHSPRKSQEYQAARFYSSPPSMNGALPSSPPTIRTAVAPFNPSVILPSFLYLGPDIQSESDVQYLLRLGVKRILNVALECDDNQGLSLKERFKYRKVGMRDIVEENGVGKGMRDACEFLDDARLHSAPTYVHCQAGKSRSVTIILAYLIHANAWTLKTSYAYVAERRKGISPNIGFVAELMQWEETELGVKQSGGVHGDGNGRAKTAGCGGGGGSSRHKEDGDDDEGRAKTHLRDSLPPTWSSSVDTYTRPAKVYSPVGGDDGGEEEGGREGRIAVGDEREVRKNGVWVHHRRAPVDRTTLQPGRRVSKAGLESLQPFLITSADPSSPSAAPNNGDNIDNEHQLNNNNDSETRPSPRAISGMGMRGHAMTPAGDGPLRWI

SEQ ID NO: 36828 - protein, 199 aa, Triticum timopheevii
ELLGIEVKKAEDVIGPEVEKLVADLANGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDIIIADKFAPDANSQ

SEQ ID NO: 36829 - protein, 317 aa, Rhizobium leguminosarum bv. viciae 3841
MHKVIYDTDPGVDDAMALLFLHRHPEIDLLGITTVFGNASVETTTRNALFLKREWNIPAPVSKGASVTIDSARAERPWPAMVHGDNGLGDIDVPETIDLPLDPRPAHRFIIDTVRAHPGEVRLVAVGRMTNLALALKEDPEIATLAKDVVIMGGNFYVPGNVSPVAEANIHGDPEAADIVMTAPWKVAVIGLDVTAITTMSRSYLGEMAARGDKAVKQLDALSQSYIDFYKHAVEDGMMVHDSCACVYAVAPELFSSISGAVRVVCGGIADGQTIVRRDGRHFPPDGAWDGLPSQVVCTGIESERVLDLIRNTLLAA

SEQ ID NO: 36830 - protein, 253 aa, Triticum aestivum
YDIAFLYCFSFRSVCPRFTIVGSHISFGPRAEFGTRMKGTGKWTVQQAAELSVAAPTIEASLDSRFLSGLKDERVAASKIFQGDYSSGETVDKAQLIEDVRKALYASKICSYAQGMNIIKAKSVEKGWGLNLGELARIWKGGCIIRASFLDRIKKAYDRNGELANLLIDPEFAQEIMDRQAAWRRVVCLAINNGVSTPGMSASLAYFDSYRRERLPANLVQAQRDYFGAHTYERVDMPGSFHTEWYKIANSKI

SEQ ID NO: 36831 - protein, 243 aa, Oryza sativa Indica Group
MSSSSTSGSAEPAAAVRVLGSWTSPFVMRVVVALKLKGVEYELLQETRGKKSELLLRSNPVHKKIPVLLHHGKPLAESLVIVEYIDEVWPASDGAPAILPRDPYCRAVERFWAQYIDDKFPRGTRVLRGTVAGDKDEVVVEMSTALQHLEAAFVKCSRGKEYFGGDNIGYLDIALGSFLGWIKAVEKFAGVELLDEAKVPNLAAWVDRFCAHPAVVDAMPDADKLVEFAVKHAASMKALDAPK

SEQ ID NO: 36832 - protein, 383 aa, Myxococcus xanthus DK 1622
MSLLRRGVERWQGGHPWIYRADLNGDPGLPGGEVVRVTDTRGWFLGKAFYSKHSKISLRWLSFDDVAVDADFFRERLLAADRLRQLALPGEKTYRLVHGEADGLPGLVVDRYGDFLSVQFLVPAMEQRKALIADLLQAQFNPRGIINRSDVGVRNLEGLTPEKGVLRGEHPGPVAFDEGLVKMRADLLEGQKTGAFLDQRENHVMAAHYAHGEALDCFSYVGGFALQLATRARHVTAIEISEAASAQLRENAAANKLNNLDVVVANAFDFLRDAVDEGKRFDTIVLDPPSFAKNKDAIPAAVRGYKEINLRALQLLRPGGILITASCTYHVDEQAFEDMLASAAADARRRVQIIERRGAGRDHPVLLNLRETRYLKCFVLRVL

SEQ ID NO: 36833 - protein, 273 aa, Oryza sativa Indica Group
MAGGGDELKLLGMWASPFALRAKLALSFKGLSYDYVEEDLKNKSELLLSSNPVHKKVPVLIHNGKPICESQVIVQYIDEVFPDAGVTLLPADPHDRAVARFWASYIDEKLLGAWIPVFRGKTEEEKAEGVKQTFAVAETLEGALSECSKGKPFFGGDTVGYVDVVLGGFVAWVHAIEEVFGLNQFDAAKTPLLAAWLERFDELDAGKEVMPDIGRLVELEKMRQAQAQAAFLAVRLYLLLFLQPCFISSCCRTVYVSPCVAEVANWVFYKIVL

SEQ ID NO: 36834 - protein, 459 aa, Salmonella enterica subsp. enterica serovar Paratyphi B str.
MNRLPSSASALACSAHALNLIEKRTLNHEEMKALNREVIDYFKEHVNPGFLEYRKSVTAGGDYGAVEWQAGSLNTLVDTQGQEFIDCLGGFGIFNVGHRNPVVVSAVQNQLAKQPLHSQELLDPLRAMLAKTLAALAPGKLKYSFFCNSGTESVEAALKLAKAYQSPRGKFTFIATSGAFHGKSLGALSATAKSTFRRPFMPLLPGFRHVPFGNIDAMSMAFSEGKKTGDEIAAVILEPIQGEGGVILPPQGYLTEVRKLCDEFGALMILDEVQTGMGRTGKMFACEHENVQPDILCLAKALGGGVMPIGATIATEEVFSVLFDNPFLHTTTFGGNPLACAAALATINVLLEQNLPAQAEQKGDTLLDGFRQLAREYPNLVHDARGKGMLMAIEFVDNETGYRFASEMFRQRVLVAGTLNNAKTTRIEPPLTLTIELCEQVLKSARNALAAMQVSVEEV

SEQ ID NO: 36835 - protein, 457 aa, Bordetella parapertussis 12822
MAPVPARGVLQRYKHVQTTYNSVAVTRLIGRFILRIDDVKLAVVGLGYVGLPLAVEFGKKRPVIGFDINERRIAALKAGHDHTLEVEDDELAQAGQLSYTAEREELGKANVFIVTVPTPIDEYKQPDLTPLVKASETIGAVLKRGDIVIYESTVYPGATEEDCVPVLERVSGLKFNQDFYAGYSPERINPGDKAHRVNTIKKVTSGSTPEVAELVDQLYNEIITAGTHKASSIRVAEAAKVIENTQRDVNIALINELALIFNKMGIDTEAVLQAAGTKWNFLPFRPGLVGGHCIGVDPYYLTHKAQSIGYHPEIILAGRRLNDSMGGYVVSQLVKAMAKRRIHVEGARVLLMGLTFKENCPDLRNTRVVDIVRELGEYHVDVDVYDPWVDPAEAEHEYGITPVAKPAAGAYDAVILAVSHHQFVEMGAEAIRKFGKAEHILYDLKYVLAPDQADLRL

SEQ ID NO: 36836 - protein, 341 aa, Bordetella parapertussis 12822
MTNRFETTCAQLRAQPQKWLVTGCAGFIGSNLLETLLGLDQAVVGLDNFATGHQHNLDEVRAAVTPEQWARFTFIEGDIRDLAACQRAVQGVDRVLHQAALGSVPRSLKDPITTNEVNIGGFLNMLVAARDAQVQAFVYAASSSTYGDHPDLPKVEERIGNPLSPYAVTKYVNELYADVFARSYGFSSVGLRYFNVFGKRQDPDGAYAAVIPKWTAAMIKGEDVVINGDGQTSRDFCFVENAVQANLLAAMAAPEGANQVYNVAYNARTTLTELFEHLRRALAGQGVSYEKAPVYAEFRAGDVRHSQADIGKAGKLLGYEPAYDILRGLEAAMPWYTQFLR

SEQ ID NO: 36837 - protein, 212 aa, Oryza sativa Indica Group
MSSTNSSGDPAAVRVVGGWASPFVNRVVVALKLKGVEHEMLQETVGKKSELLLRSNPVHKKIPVLLHHGKPIAESLIIVEYIDEVWPASNGAPSILPRDPYGRAVERFWAKYIDDKHLEEAFVKCSQGKQYFGGDNIGYLDIALGSFLGWIRAVEKIAGVELLDEAKVPNLAAWADRFCAHTAVVDVVPDADRLVEFTVQHAALLRAVNAPK

SEQ ID NO: 36838 - protein, 354 aa, Bacillus anthracis str. A2012
  misc_feature (219)..(219): Xaa can be any naturally occurring amino acid
  misc_feature (238)..(238): Xaa can be any naturally occurring amino acid
MVMKEQVVEALEGIVDPFLHKTLKETGAIKEVTVKPEKKHVSVKIAIVKTGTAEQMQLQSGIVKLVKELGAATVGLRFAEFTEEELAQFAPEQEEQTESLLSPNSKTTFLAVASGKGGVGKSTVSVNLAIALARLGKKVGIIDADIYGFSVPDMMGIEKRPVVRGDKIIPVERLGVKVISMGFFVEDNAPVIWRGPMLGKMLNHFFTEVEWGDLDYLVXBLPPGTGDVALDLHSMLPXCKEIIVTTPHPTAAFVAARAGAMALRTEHSILGVVENMAYFESKTTGEKEYVFGRGGGDKLATELQTEVLGRIPLQQPDWNKEDFAPSVYEDTHTTGLIYRTIAETVIDKTAFAQK

SEQ ID NO: 36839 - protein, 184 aa, Myxococcus xanthus DK 1622
MLTVGDKIPNFKVKATVSLEKGKEFQDITNETFKGKWLVLFAWPKDFTFICPTEIAEFGKKNKDFTDRDAQVLGLSTDSEFVHHAWRTHHPDLKNLPFPMLADIKHELCNALGILHKEEGVALRATFIADPEGIIRHVTVNDLSVGRNVSETIRTLDALQTDELCPCNWTKGEETLTQKLSKAG

SEQ ID NO: 36840 - protein, 422 aa, Pyrococcus horikoshii OT3
MDMVEQDPFEIAVKQLERAAQHMKISEEALEFLKRPQRIVEVTIPVEMDDGSVKVFTGFRVQYNWARGPTKGGIRWHPEETLSTVKALAAWMTWKTAVMDLPYGGGKGGIIVDPKKLSDREKERLARGYIRAVYDIISPYEDIPAPDVYTNPQIMAWMMDEYETIARRKTPAFGIITGKPLSIGGSLGRNEATARGASYTIREAAKVLGWDGLKGKTIAIQGYGNAGYYLAKIMSEDYGMKVVAVSDSKGGIYNPDGLNADEVLKWKREHGSVKDFPGATNISNEELLELDVDVLAPAAIEEVITKKNADNIKAKIVAEVANGPVTPEADEILFEKGILQIPDFLCNAGGVTVSYFEWVQNITGYYWTLEEVRERLDKKMTKAFYDVYNTAKEKNIHMRDAAYVVAVQRVYQAMLDRGWVKH

SEQ ID NO: 36841 - protein, 243 aa, Oryza sativa Indica Group
MAGGGDELKLLGMWASPFALRAKLALSFKGLSYDYVEEDFKNKSDLLLSSNPVHKKVPVLIHNGKPICESQVIVQYIDEVFPDAGVTLLPADPHDRAVARFWAAYIDEKLFSAWILVFRSKTEEEKAEAVKQTFAVVEKLEGALSECSKGKPFFGGDTVGYVDVVLGGFVAWVHAIEEVFGLNQFDAAKTPLLAAWLERFDELDAVKEVMPDIGRLVELAKMRQAQAAAAAAAVAAAAAGEAN

SEQ ID NO: 36842 - protein, 425 aa, Pyrococcus horikoshii OT3
MEATWILFTIGTAIIIAKIGDSIVERFELPGVLGELLMGMALGNLVYFGLIKSEYLPITMGSSEVIDFLAKLGIILLLFLGALDTDIEKLKRTGVTAVVSTIMGVFVPLALGYYALRVMGYGYREAFAGGVLLTATSIGLTVRIMMDLGALRSEVGAASLSASVIDDFLGIALIIFAVGSGSLLELSAKIIVFFIITGVLGWYLVDHYIKFAEKLHVEKGVLGLVIGLMFIFAALAEDWFAAAIEGSFMAGLILSKLPEGKRIMEEVRSIGYGFLIPLFFVHTGAMLNLTVFKNIEAFKLAFVLTTIAVVGKVIGRGFGAWLTAWGRGRGFLFTKQNFRMSLQMGIGSIPRTEVALVDLMVAIHGGAISSGNVPKFIAATLIFITVSVLITPPLLKWAFKEEVEAQKMAKLESRKERIERKKKAR

SEQ ID NO: 36843 - protein, 369 aa, Oryza sativa Indica Group
MASRRHGHGGCCRNRTPFRLHRAPLPLSLWLTAPAAELLAVATSPAVAAAGFGERWATTTGRAAVPPDLGEESELRTSKRQGTQQNKSQKLQILETCLEHWIAMAGGGDDLKMLGVYVSPFPLRVKLALSFKGLSFEYVEEDLHNKSDLLVSSNPVHKRTPVLIHNGKPISESMVIVQYLDEAFPGAGAALLPSDPLDRAVARFWASYIDDKVIRMITVHQFSHASFSDDFGADRMMQLFSAWKMVFKGKTEEEKAEGRKQTFAVAETLEGALRECYKGKPFFGGDAVGFVDVALGGFVPWVHAMEELFGLRQFDAATTPLLAAWLERVGELEAYKAVMPDAGMMIEFKKKQAQEAAAAAAAAAAAAEA

SEQ ID NO: 36844 - protein, 314 aa, uncultured marine gamma proteobacterium EBAC20E09
MTVNIDITKELKAVEKLIKSDINKEKTILGLYNYIFKSDGKKIRSRLNLIASSSSKNSDRYKLASIIELLHTATLVHDDVVDNASTRRGAISVNSLWSNAHGVLIGDYIYSKAFMLMVEIGKTDILAELADATNDISQGELIQLDAISNIKISLNKLKKISYFKTGRLFEASAKTGAMLAGANKNFIKNISESAKNIGILFQIKDDLLDYSNSSKTGKQSFQDLKEGKITYPFFFALKNSSQKEKKQLISFLGNKRLNEKKALALISKLNGLIKTQQLAEKFYTSSINTAKTINNQFIRQEMIELANIALNREK

SEQ ID NO: 36845 - protein, 594 aa, Candida albicans SC5314
MNKYPKSIMSKQFMKFPSRRSTVYSSKGIVASTQPLANAAGLKILEKGGNCVDAAIAVSAALTITEPGSTGIGGDCFALYYKLKDKSDPKSGVVLGLNGSGRAAQNVTPQDVWNEHNEGKYMPRIPYTSVFSITVPGAIAGWFDAYEKWGSGKVTFEEILTPAVQLAEEGFPVSELSSHAWRNCIPKLLKQNPDVKENPFVLEGNRGPEEGEYVTNHRVAKCLRLIGKHGKKVFYEGVIAEAIIKTTSGRNHKLTLDDLKNHTSTIVEPIKLNFQDYNVWEIPPNGHGLVALIALGIIQELHNSGKINLHELKHNSSRYLHILIEACKLGFYDSDEYVTDPTFKDIPIDGLLNPKYLKARSELVDSNKIIDGDKMKHGVPDPKFKSDTVYLTVSDSNGEVCSFINSVYEGFGSAILVEDYGFCLQNRGNNFNLTAGQSNCLEGGKRPYHTIIPGMITNNDGSLYAGFGNMGGFAQPVCHVQHVLNLTVFGMTPQQSIDSPRFVLNSNNDDSADRGRGAGGPVRTPITVVQLEEGIEPNVIDDLKKLGHEVEVLSGYGRETFGRAQIIKNVSKDGKLIYAGGSDMRGDGAAVALI

SEQ ID NO: 36846 - protein, 236 aa, Oryza sativa Indica Group
MAGGGDELKLLGMWASPYVLRVKIALSLKGLSYKYVEEDFKNKSELLLSSNPVHKKVPVLIHNGKPICESQVILQYLDEAFPDAGATLLPADPHERAVARFWAAFCDDTIAKASQQASSGKTEEEKAEGEKKVVEALEKMEVGLSECSKGKPFFGGDTVGYVDVVLGGFLAWVRAGDAMKGVKRFDPATTPLLAAWAERFVELDVAKAAMPEVDKLIELAMARMAGAAAAAAAATN

SEQ ID NO: 36847 - protein, 491 aa, Archaeoglobus fulgidus DSM 4304
MVRRLRGDCMEEVERAKAVLKENNVRQVLCAFADVRGYLQMFSIPAREFVDGSAFENGIGFDGSSVRGFRTIEKSDMVWMPDASSLKIIPWIDDPIQKSAIMFGNVYEAWGTEIADCDPRGYVAKRYEDMLKSEGMSAIFGPEIEFFLFEGVDFTRLSWDMWVSPNGGAGDSWGPPRIMPISSELESGYMIRPKEGYFRPPPEDTTVEYRNELVYYLEQLGIDIEYHHHEVATAGQVELDFKPKQLVDVGDAFYLYKFAAKNIAAMHGLYATFMPKPLYLDNASGMHTHQSLWKGEPFSGEAVFADPDDEYMLSQKARYYIGGLLEHAKALTALCAPTVNSYKRLVPGFEAPIYICWSPRNRSALVRVPMYVKKPSAIRVEYRGVDPSCNPYLAITAQLAAGLDGIKKKIDPGDPLLEDVYELTPAQKRELGVGELPTTLRDAIDHLASDELMQEVLGSHIFDAFMELKIDEWNQYCLYITPWEFMKYFDI

SEQ ID NO: 36848 - protein, 374 aa, Ralstonia eutropha JMP134
MKRFARTTTLAAALLAASLITGTAHAQLAPAAPSSGTPAGTQAEARKANIVIIGTGGTIAGAGASATNTAAYQSAVVPVDKIIASVPEISKVANVKGEQIFQIGSESFNNERLLKLGKRVSELLKQPDVDGIVITHGTDTIEETAYFLNLTLKSDKPVVVVGSMRPGTALGADGALNLYDAVLVASNPASRGKGTLAVLNDEIHTGRDVTKSNTFKTETFRSPFGPLGYVVEGRTLFYRLPARPHTTQTEFDIDKIDKLPEVAVVYAYGNVNPGSVDAAVKNGAKAIIYAATGNGSVGDYMVEPLKAARAKGVQIVRASRTGSGVVIRNAEQPDDKYDWIVTDDQLPQKARILMALALTKTNDSKQLQQVMWKY

SEQ ID NO: 36849 - protein, 368 aa, Triticum aestivum
  misc_feature (173)..(173): Xaa can be any naturally occurring amino acid
  misc_feature (243)..(243): Xaa can be any naturally occurring amino acid
  misc_feature (264)..(264): Xaa can be any naturally occurring amino acid
  misc_feature (315)..(315): Xaa can be any naturally occurring amino acid
LYRTSLYKKAGWYRSGIPGISSTHASARPSLKANTFSTRHGHATPTRDTVVGEAPAHFRFYKSGRIERLNRPPILPAGVDEATGVTSKDVVLDADSGLSVRLYLPKLQEPSTKLPVLVYGHGGSFLIESADSSTYHNYVNALAAAAGVLAVSVDYRLAPEHPLPAAYDDSWAXALQWAASAQDEWIREHGDTARLFLAGDSAGANIVHDMLMRATSNDGSPRVEGAILLHPWFGGSKPVEGEXRPGPMVTGMLWPYPCPGAAGXAPNNPRMNPLAPGAPALDRLGCVRMLVTAGWRRGPRARRAVHDPVAGNAWXGTAAWPGSDGEASFLPQEPGCKTPTFQDRLPRHTRAEKWAGNTHGSRKCSDGE

SEQ ID NO: 36850 - protein, 403 aa, Oryza sativa
MMGDFLSRVLLLAFGYAYPAYECYKTVELNKPEIEKLIFWCQYWILVALLTVLERFGDFAISWLPLYSEAKLMFFIYLWCPRTKGTSYVYETFFRPYISQYENDIDCSILDLRVRAGDMLVVYWQKVAIIGQTTFFNILKYASAQSPAHSSRSRSTQEIQTPETKICPRNRVDYLPSYINNKIICSTQDLGGISVDHSSAVIYLFLFITLPYQQSYPQKQQQAQPQQPKQSLPQQQQKQSLPQQQQQQMPHEKPTTLRRAASAAARTAGIMQQSEDTKIAYSNPKTRRLLPTKSAPTASTRSTVAATKPVEDLKSSGMKLATEEAPSPSSNAAMPGSEPSAPPLPKSAEDDMSIDEVDIPIEDMDEPVATPEETPMEEAIRVTRGRLRKRIAAVSTADGGAAN

SEQ ID NO: 36851 - protein, 55 aa, Zea mays
MRLFDPWPVFFKREWKRCWPFLTGFAVTGVLITKLTAGFTEEDTKNSKFVQQHRR

SEQ ID NO: 36852 - protein, 316 aa, Oceanobacillus iheyensis HTE831
MKDIITLGEAMVVFNPASTGPMKFVNGFHKTIGGAELNLAIGCARLGLDTGYITRLGNDEFGKSIRNFVRGEGIDASEIDFIDHYPTSINFKEIMEDGSVRTFYYRDKSPTLSMTPDVLNESYFKNAKILHLTGIFPAIGEGALKVWKQAIHLAKKHGVKISFDPNIRLKMWSKEQARKVLLEILPDVDILLAGDEEMDIIIGKRDPVDIIETCKELGIPYVAIKQGENGSVGYSQGETMKAAPVKASKVVDTVGAGDGFNAGILYGYLHDWSLERTLTFGNTIGSMVVGITGDNEGLPYYEDVQERLGEIERIER

SEQ ID NO: 36853 - protein, 224 aa, Oceanobacillus iheyensis HTE831
MEYSDKQIAAQEAVRYIKDGMVIGIGSGSTVNEFLYCLAARMRKERLQVVGIPASKKSERLATELGIPLTTFATYQNVDIAIDGTDEIDDQLYLVKGGGGSLVREKMIDLVAETFIVIASGKKKIKKLGSFPVPVEVVPFGWQATEQRLQQFGCQTNLRMVEEDIFVSDNQNYIIDCDFKEIDDAEALHRSLKQIVGVIETGIFINMVDKAIVADNGELSILEK

SEQ ID NO: 36854 - protein, 329 aa, Arabidopsis thaliana
MPLCNNFSGNLVVAVALFFAGALYIFNYQNYVNTLRTTQYPVDELEAALYTAAAGNNKTVIITMVNKAYVKEVGRGSTMLDLFLESFWEGEGTLPLLDHLMVVAVDQTAYDRCRFKRLHCYKMETEDGVDLEGEKVFMSKDFIEMMWRRTRLILDVLRRGYNVIFTDTDVMWLRSPLSRLNMSLDMQISVDRINVGGQLINTGFYHVRSNNKTISLFQKWYDMRLNSTGMKEQDVLKNLLDSGFFNQLGLNVGFLSTTEFSGFCQDSPHMGVVTTVHANCCLHIPAKVFDLTRVLRDWKRYKASHVNSKWSPHLKCSRSWNDTHYIPRL

SEQ ID NO: 36855 - protein, 297 aa, Brassica napus
MASVAASPAFSLRKSTTGATASSAATRARASLLPVPSKSISTRPLGFSAVLDSRFTVHVASKVQSFRGKGTRGVVSMAKKSVGDLTSADLKGKKVFVRADLNVPLDDNQTITDDTRIRAAIPTIKYLIENGAKVILSTHLGRPKGVTPKFSLAPLVPRLSELLGIEVKKADDCIGPEVESLVASLPEGGVLLLENVRFYKEEEKNDPEFAKKLASLADLYVNDAFGTAHRAHASTEGVTKFLKPSVAGFLLQKELDYLVGAVSSPKRPFAAIVGGSKVSSKIGVIESLLEKCDIRRL

SEQ ID NO: 36856 - protein, 577 aa, Erwinia carotovora subsp. atroseptica SCRI1043
MSEKYVFSEKHPGPLVVEGKLTDAERMKTESNFLRGTIAEDLNDGLTGGFKGDNFLLIRFHGMYQQDDRDIRAERAEQKLEPRHAMLLRCRLPGGVMTPQQWLRIDKFAGENTIYGSIRITNRQTFQYHGILKSNVKPVHQMLNSIGLDALATANDMNRNVLCTSNPIESELHQQAYEWAKTISEHLLPRTRAYAEIWMDQEKVATTDEEPILGSTYLPRKFKTTVVVPPQNDVDLHANDLNFVAIADNGRLVGFNVLVGGGLSIAHGDKETYPRTASELGYISIEHTLAIAEAVVTTQRDWGNRTNRKNAKTKYTLERVGVDNFKQEVEARAGVKFEAVRPYEFTERGDRIGWVKGIDNKWHLTLFIENGRILDYPGRPLKTGLAEIAKIHKGDFRLTANQNLIVAGVPARSKAKIDALAREHGLIDDSVSEQRKNSMACVSFPTCPLAMAEAERFLPEFVTKVEGIMQQHGVGDEHIVLRVTGCPNGCGRSMLAEIGLVGKAMGRYNLHLGGNREGTRIPRMYRENINETEILAEIDRLVGLWAQDRLQNEGFGDFVIRTNIIRPVLDPARDFYD

SEQ ID NO: 36857 - protein, 370 aa, Streptococcus pneumoniae R6
MNDKLKIFLLLGVFFLAITGFYVLLIRNAGQTDASQIEKAAVSQGGKAVKKTEISKDADLHEIYLAGGCFWGVEEYFSRVPGVTDAVSGYANGRGETTKYELINQTGHAETVHVTYDAKQISLKEILLHYFRIINPTSKNKQGNDVGTQYRTGVYYTDDKDLEVINQVFDEVAKKYDQPLAVEKENLKNFVVAEDYHQDYLKKNPNGYCHINVNQAAYPVIDASKYPKPSDEELKKTLSPEEYAVTQENQTERAFSNRYWDKFESGIYVDIATGEPLFSSKDKFESGCGWPSFTQPISPDVVTYKEDKSYNMTRMEVRSRVGDSHLGHVFTDGPQDKGGLRYCINSLSIRFIPKDQMEEKGYAYLLDYVD

SEQ ID NO: 36858 - protein, 395 aa, Oryza sativa Indica Group
MGAMIEKFSSISTKKLPKALSVISRKNMVSISDYGDFYKMAKRNIMLAILGFNAQKHFCDTRERMVSNVLSSLHKLVAVDPHSPLNFREVYTTELFGLSLIQNLGEDVCSVYVEEFGREISKEEIFHVLVHEILSCVVEPDWRDYFPYLSWLPNKSFETIVSSTEFRRDAVMNALIKRQKERIARGEARISYIDFLLEAKNSTQLTDHQLMLLLAESIAAAVDTVLEWLYREIREVCGGKAVTEEDLPRLPYLDAVLHETLRLHSPVPVLPTRFVHDDTTLAGYDVPAGTQVMINVFGCHMDEEAWESPGEWSPERFLGEGFKLADRYKTLAFGAGRRTCAGSQQAVSIACVAIARFVQELQWTLREGDGDKEDTMQYTALKLHPLHVHLKPRGS

SEQ ID NO: 36859 - protein, 768 aa, Populus trichocarpa
MGSPILPDLGTEILIPVCAIIGIGFSLFQWLLVSKVKLTPGSAASNNSGGAGKNGHGDYLIEEEEGLNDHNIVLKCAEIQNAISEGATSFLFTEYQYVGIFMVAFAILIFVFLGSVEGFSTKSQPCTYDPLKLCKPALATAGFSTIAFVLGAVTSVVSGFLGMKIATYANARTTLEARKGVGKAFITAFRSGAVMGFLLAANGLLVLYIAINLFKLYYGDDWEGLFEAITGYGLGGSSMALFGRVAGGIYTKAADVGADLVGKVERNIPEDDPRNPAVIADNVGDNVGDIAGMGSDLFGSYAESSCAALVVASISSFGINHEFTPMLYPLIVSSVGIIVCLLTTLFATDFFEIKAVNEIEPALKNQLIISTVLMTIGVAIVSWIALPSSFTIFNFGTQKVVKNWQLFLCVAVGLWAGLVIGFVTEYYTSNAYSPVQDVADSCRTGAATNVIFGLALGYKSVIIPIFAIAVSIFVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVCRQFNTIPGLMEGTAKPDYATCVKISTDASIKEMIAPGALVMLTPLIVGIFFGVETLSGVLAGSLVSGVQIAISASNTGGAWDNAKKYIEAGVSEHARSLGPKGSDPHKAAVIGDTIGDPLKDTSGPSLNILIKLMAVESLVFAPFFATHGGLLFKIF

SEQ ID NO: 36860 - protein, 337 aa, Fusobacterium nucleatum subsp. vincentii ATCC 49256
MIIMSFLGQVRKKALQANRRIVLPESSDERVIRAASQILKEGLAQVILVGNQEAIMHSAKAYEVSLSGAKIVDPYNFERFNDYVNKLVELRAKKGMTPEEAKKLLLNNPTFFGAMLIKMGDADGMVSGSSSPTANVLRAAIQVIGTQPGVKTVSSVFIMELSQFKDLFGSILVFGDCSVIPVPTSEQLADIATSAAETAVKIAGINPRVALMTFSTKGSAKHECVDRVIEAGRILRERKVKFRFDDELQADAALVKSVGEIKAPLSDVSGNANVLIFPSLSAGNIGYKLVQRLAGANAYGPIIQGLNAPVNDLSRGCSVEDIVVLTAITSAQACIDC

SEQ ID NO: 36861 - protein, 382 aa, Magnaporthe grisea 70-15
MDFAFALGSNGSGQLGIGHKEDISVPKPALFSSAAGELSANPTSPVVQVAAGGNHTLLLTQDGEIYSSGDPASGACGLKSATADSAGAGQPRPPVFHKIHVPAEQAAQSPGRLIAATWEASIITGPDEQGRRNRRVYSFGCGSKGELGQGPLIIRVPFAQPIANFPPPETEVVGLSACMGHVVAVLSNGDVYGWGNGRKGQLGAPEGIITEPRKIEGVPFKVAKAACGKEFTCLVGEPGSGDILVMGLDKWSVQSSAPNSVPGWRDLQASWGNIYVLQADGSILSWGRNDHGQLAPSELPKMSQIAVGSEHVVAIDEARQSVAAWGWGEHGNCGPQVQDDNSQGNTGWNVIASAKHIPPGSSITAIGSGCATSWIMIGKPSS

SEQ ID NO: 36862 - protein, 354 aa, Bacillus cereus ATCC 10987
MEKRIVCLAGDGVGPEVMESAKEVLHMVERLYGHHFHLQDEYFGGSAIDLNGQPLPQRTLAACLASDAVLLGAVGGPRWDSAKERPEKGLLALRKGLGVFANVRPVTVESATAHLSPLKKADEIDFVVVRELTGGIYFSYPKERTDEVATDTLTYHRHEIERIVSYAFQLASKRKKKVTSIDKANVLESSKLWRTVTEEVALRYPDVELEHILVDAAAMELIRNPGRFDVIVTENLFGDILSDEASVLAGSLGMLPSASHAEKGPSLYEPIHGSAPDIAGKNKANPIAMMRSVAMMLGQSFGLTREGCAIEEAISAVLKLGKCTADIGGTETTTSFTKAVMQEMEEQALVGRGR

SEQ ID NO: 36863 - protein, 138 aa, Glycine max
  misc_feature (100)..(100): Xaa can be any naturally occurring amino acid
FGTRLNLISSGFSSFAPISLLFSLSPHILVTSLSRRSLPSIQCAVQFRPCIDIHKGKVKQIVGSTLQDLKGSDPVTNFESDKSAAEYAMLYKQDGLTGGXDPFSKASALEALHAYPGWENTNNRKDSGLILCSRQVSS

SEQ ID NO: 36864 - protein, 231 aa, Oryza sativa Indica Group
MAGGGDELKLLGMWASPYVLRVKLALSLKGLSYDYVEEDLMNKSDLLLSSNPVNKKVPVLIHNGKPICESQIILQYLDEAFPGAGATLLPADPHERAVARFWAAFNDDTLLAASQAASWGKTEEERAEGEKKVVEALERMEVGLRECSKGKPFFGGDTVGYLDVVLGGFLAWVRATDVMRGVKRFDPATTPLLAAWAERFVELDAAKAVMPDMDKMIEFGKVLQARAAATN

SEQ ID NO: 36865 - protein, 457 aa, Saccharomyces cerevisiae
MSDNPEMKPHGTSKEIVESVTDATSKAIDKLQEELHKDASESVTPVTKESTAATKESRKYNFFIRTVWTFVMISGFFITLASGHAWCIVLILGCQIATFKECIAVTSASGREKNLPLTKTLNWYLLFTTIYYLDGKSLFKFFQATFYEYPVLNFIVTNHKFICYCLYLMGFVLFVCSLRKGFLKFQFGSLCVTHMVLLLVVFQAHLIIKNVLNGLFWFLLPCGLVIVNDIFAYLCGITFGKTKLIEISPKKTLEGFLGAWFFTALASIILTRILSPYTYLTCPVEDLHTNFFSNLTCELNPVFLPQVYRLPPIFFDKVQINSITVKPIYFHALNLATFASLFAPFGGFFASGLKRTFKVKDFGHSIPGHGGITDRVDCQFIMGSFANLYYETFISEHRITVDTVLSTILMNLNDKQIIELIDILIRFLSKKGIISAKNFEKLADIFNVTKKSLTNHS

SEQ ID NO: 36866 - protein, 231 aa, Oryza sativa Indica Group
MAGEGDDQLKLLGLWVSPYTHRVKLALSFKGLSYEYVEEDLSNKSELLLSTNPVHKKVPVLIHNGKPICESQVIVQYLDEEFPNSGVSLLPSDSYDRAIARFWAAYINDKLMPSWLQSSMGKTEEERAEALKQTLEAVANLETAFKECSKGKPFFGGDTVGYLDVSLSAMIGWMRAGEALHGRRTFDATRSPLLNAWMERFAALDAAKAAMPDNNKLVEFVRVRRAAAANN

SEQ ID NO: 36867 - protein, 229 aa, Picea sitchensis
MAATEGIKQHHSTWSPYDNNGGTCIAIAGSNYCVIAADTRMSTGYSILTRDYSKICNLADKCVMASSGFQADVKALQKNLSARHLIYQHQHNKQMSCPAMAQLLSNTLYYKRFFPYYSFNVLGGLDNEGKGCVFTYDAVGSYERVGYGAQGTGGTLMMPVLDNQLKSPSPLLLPAQDATTPLSESEAVDLVKDVFASAAERDIYTGDGLEIVVVNAEGVKREFLELRRD

SEQ ID NO: 36868 - protein, 512 aa, Glycine max
  misc_feature (208)..(208): Xaa can be any naturally occurring amino acid
MQPLRRKTPLFTSEMGTMKGRKNNNLSIFVVVFSIFLFGLFMYNEDVKSIAEFPFSSPKAHETQEGGEPNKHVDSVQDSVVVQRESEKKDVEDTATVKISSKRSTSRAQLEKSGAEDEDSDERVDLKTVVEKEKKIEMPRAEEEEEVEEEEEDEKVELPPEDCDLFTGEWVLDNVTHPLYKEDKCEFLTSQVTCMKNGRPDSLYQNCXWKPRDCSLPKFKPKLLFQKIRGKRLMFVGDSLNRNQWESMVCMVNSAVPSYNKTWYKTGSLAIFKIEEPEHVTTVEFYWAPFLVESNSDDPNMHSILNRIIMPESIEKHGMNWKDVDYLIFNTYIWWMNTFSMKVLRGSFDEGSTEYDEVPRPIAYGRVINTWSKWIDDNIDPNRTKVFFSSTSPLHIKSENWNNPNGIKCAKEITPVLNMSTPLDVGTDRRLFTIANNVTQSMKVPVYFINITSLSELRKDAHTSVYTIRQGKMLTPEQQADPTTYADCIHWCLPGLPDTWNEFLYTRIISQS

SEQ ID NO: 36869 - protein, 241 aa, Oryza sativa Indica Group
MAGGDELKLLGAFPSAYVTRVELALGFKGLSYEYVKEDLANKSELLLSSNPVHKKVPVLIHNGKPISESQVILEYIDEAFTGASLLTRDPYERAVARFWVAYIDDKLKVTIFWNGGVHYIMVPNDTRKDEGGEGGGVEADVRGGRALKDSSKGKPFFGGDTVGLVDITLGSLIAWMKATEVLTGAKIFDPAKTPLLAAWTERFAELDTTKKVLPDVAGYVEYVNKRRQTQAATAAVVASNS

SEQ ID NO: 36870 - protein, 235 aa, Oryza sativa Indica Group
MAGAGDELKLLGMWTSPFALRVKLALSFKGLSYEYAEEDLSNKSELLLSSNPVHKKVPVLIHNGKPICESQVIVQYIDEAFPGAGVPLLPSDPYERAVARFWAAYIDDKLLKSWLQASMGKTEEEKAEALKETFAAVANLEAAFEGCSKGKPFFGGDAVGYLDVTLGALVSWVHAGEALYGMRLFDATRSPLLDAWVDRFAALDAAKAALPDAGRLAEYAKKRQAERAAGEAANN

SEQ ID NO: 36871 - protein, 319 aa, Mesorhizobium loti MAFF303099
MTADRHHGKYETRLDPALWAYIDRVDAWYPPEVIGLPIDKQRAVYDRMCRAFHQGRPPGVKASDGLVAAPGHGIPIRHYRPAGKAARAMVLYFHGGGFILGNLDSHDDICAEICAGTGFDVLSVDYRLAPEHVHPAAFDDAMAAFAWAAETSRLPLVLCGESAGGNLAAAVAQATRKHARTAVGQVLIYPGLGGDEGAGSYVEHAEAPLLSVGDIAFYRDVRSAKRQSPDDPTFSPLRDRHFSGLPPTVIITAECDPLSSDGETYRDRIAAAGGKAWWHEEKRLVHSFLRARTTVPAAAEAFSRIIAAIAALGRGEWPY

SEQ ID NO: 36872 - protein, 307 aa, Nocardioides sp. JS614
MRTRFFADLLEAARLNPDIVLITGDLGFGVVEPFVAACPSQFVNAGVAEQNMTGMAAGMAMAGAKAFTYSIANFPTLRCLEQIRNDVAYHGADVVVVSVGGGLAYGALGMSHHATEDLAIMRSIPGLAVAAPGDPEETSAVLENLLVGGGPAYLRLGKAGERTVHATRPQLNRGQSITLKSGADVALVSTGAMLPTVMDAAEELDDLGVSSTVVSSPWIAPFDEATIRRLAATHRLLVTIEEHSITGGLGGATAEVLAETGGVCPLMRIGVLPRFSSVVGDQEYLRGVHGLTRQAITERAIKRLEDL

SEQ ID NO: 36873 - protein, 185 aa, Zea mays
TRPDCVTVSVLQALLGGGGKFSWGRQGKGLHSRLNRLVNEFDQIKSISAFKDVHSNTGIFGIHTSTDASFVPKAIDLAARELTSLATPGQVDQSQLDRAKASAKYAILANLESQASLTEDMGRQVLAFGERKPAEHLLKAVDGVTMKDITSVAEKIISSPLTMASHGNVLNMPTYESVSGKFRSK

SEQ ID NO: 36874 - protein, 1188 aa, Bacillus subtilis
MFLKRLDVIGFKSFAERISVDFVKGVTAVVGPNGSGKSNITDAIRWVLGGQSARSLRGGKMEDIIFAGSDSRKRLNLAEVTLTLDNDDHFLPIDFHEVSVTRRVYRSGESEFLINNQPCRLKDIIDLFMDSGLGKEAFSIISQGKVEEILSSKAEDRRSIFGEAAGVLKYKTRKEKAGNKLFETQDNLNRVGDILHELEGQVEPLKIQASIAKDYLEKKKELEHVEIPLTAYDIEELHGKWSTLKEKVQMAKEEELAESSAISPKEAKIEGTRDKIQALDESVDELQQVLLVTSEELEKLEGRKEVLKDRKKNAVQNQEQLEEAIVQFQQKETVLTRRAFEAEAVFETLQAEVKQLRAQVKEKQHALSLHNENVEEKIEQLKSDYFELLNSQASIRNELQLLDDQMSQSAVTLQRLADNNEKHLQERHDISARKAACKTEFARFEQEIHSQVGAYRDMQTKYEQKKRQYEKNESPLYQAYQYVQQARSKKDMLDTMQGDFSGFYQGVKEVLKAKDRLGGIRGAVLELISTEQKYETAIEIAVGASPQHVVTDDEQSARKAIQYLKQNSFGRATFLPLSVIRDRQLSKPLRGNSGPAFIISFGVASELVTFDPAYRSVIQNLLGNRSDYRGLKGGANELAKLLGHRYRIVTLEGDVVNPGGSMTGGSVKKKNNSLLGRTRELGDVTKRLAEMEEKTSLLEQEVQTLKHSIQDMEKKLADLRETGEGLRVKQQDVKGQLYEPQFAEKNINTHLELYDQEKSALSESDEERKVRKRKLEEELSAVSEKMKQLEEDIDRLTKQKQTQSSTKESLSNELTELKIAAAKKEQACKGEEDNLARLKKELTETELALKEAKEDLSFLTSEMSSSTSGEEKLEEAAKHKLNDKTKTIELIALRRDQRIKLQHGLDTYERELKEMKRLYKQKTTLLKDEEVKLGRMEVELDNLLQYLREEYSLSFEGAKEKYQLETDPEEARKRVKLIKLAIEELGTVNLGSIDEFERVNERYKFLSEQKEDLTEAKNTLFQVIEEMDEEMTKRFNDTFVQIRSHFDQVFRSLFGGGRAELRLTDPNDLLHSGVEIIAQPPGKKLQNLNLLSGGERALTAIALLFSILKVRPVPFCVLDEVEAALDEANVFRFAQYLKKYSSDTQFIVITHRKGTMEEADVLYGVTMQESGVSKVISVKLEETKEFVQ

SEQ ID NO: 36875 - protein, 506 aa, Burkholderia vietnamiensis G4
MNPVPAYTSDADVGHYLDGAPVAGRSGRFQDVLNPALGRAVRRVALADGDEVQRAVASAHAAFPEWAATPPIRRARVLHRFLQLMNEHRDTLAAIITAEHGKVFSDAQGEVARGIDIIEFACGVPQLLKGDFTDQVSTGIDNWTMRQPLGVVAGITPFNFPCMVPCWMFPVALATGNTFVLKPSERDPSAALFMADLLTQAGLPAGVFNVVQGDKGAVDALLDHPDVQAVSFVGSTPIAAYVQQRAVQSGKRVQALGGAKNHLVVMPDANLEQAVDALIGAAYGSAGERCMAISIAVLVGDVADRIVPAVAERARKLVIGDGMSPEVEMGPIVTGEALKRIEGYIEQGVSEGAQLVVDGRGLRVPGREQGFFTGGTLFDHVTPDMRIYKEEIFGPVLGCVRVKDFGAAVDLINAHEFGNGVACFTSDGGIAREFARRIQVGMVGINVPIPVPMAWHGFGGWKKSLFGDMHAYGEEGVRFYTRQKSVMQRWASSIGKGAEFAMPTAK

SEQ ID NO: 36876 - protein, 486 aa, Oceanobacillus iheyensis HTE831
MSMYSQLDSQYINGVWKDGNGKATIQNTNPYSGEVIATYRAASLQDLDDAYETAQEVQKAWAKENPITVQRIMDKAVTYMEENHEEIVDIIIQEIGGTRLKAEFEIGLVTNMIKEASSFPMRMSGSILPSPIDGKENRVYRVPVGVVGVISPFNFPFFLSMKSVAPALATGNAVVLKPHEHTAITGGTMIAKIFEEAGLPKGVLQVVTTEISEIGDRFVDHPVPAAISFTGSTKVGKHIGEVASRNLKEVHLELGGNSALIVLEDADVDYAVSAGVFSRFTHQGQICMSANRIIVHEDVYDEFVQKYADKVKTLTCGDPADSSTIIGPLINERQVQNTVNLIEKGVEEGAHPLVRGQVNGNVVEPVIFTEVTPDMQIANEEFFAPVVAIMKVSSEEQAIAYANASSYGLSGAVHTSDVNRGAEVAKQLESGMIHINDGTINDEPNVAFGGVKNSGVGRLNGEWSLEAFTTTKWISIQHTKRQFPYS

SEQ ID NO: 36877 - protein, 456 aa, Chromobacterium violaceum ATCC 12472
MQDNSVLSLIGNTPLVRVSHLDTGPCELYLKLESHNPGGSIKDRIALTMIEAAERDGKLKPGGAIIEATAGNTGLGLALVAAQKGYPLTLVVPDKMSREKILHLQALGAQVVLTRSDVGKGHPEYYQDLAARIASETPGAYYIDQFNNPANPLAHETTTGPEIWRQMNGEVDAVVVGVGSSGTLTGLTRFFRAKAPATAFVLADPVGSVLADYVETGSFGQAGSWLIEGIGEDFIPPQTDLSMVKRAFRVSDQESFDTAQQLLRSEGILAGSSSGALLAAALRYCREQTEPKRVVTLVCDSGNKYLSKMYNRDWLVDQGMLRLPEVGGLTDLIVRRHQDGSTVSCHPDEPLNVAYQRMRLHDVSQMPVLDDDKVVGVLDEWDLLLSVHGEPENFRQTVATAMSSHVRTLSPQASLQDLLQVFNDGHIALIVDKGRYLGLITQADLLSFWRRQPRAA

SEQ ID NO: 36878 - protein, 267 aa, Zea mays
  misc_feature (250)..(250): Xaa can be any naturally occurring amino acid
MASPSVFAGIAQGPEDPILGVTVAYNKDPSPVKVNLGVGAYRTEEGKPLVLNVVRRAEQMLIQNESRVKEYLPITGLADFNKLSAKLIFGADSPAIQENRVATVQCLSGTGSLRVGGEFLARHYHERTIYIPQPTWGNHPKVFTLAGLTARSYRYYDPATRGLDFQGLLEDISSAPSGAIVLLHACAHNPTGVDPTLEQWEQIRQLMRSKALLPFFDSAYQGFASGSLDKDAQSVRMFVADGGELLMAQXYAKNMGLYGERVGALAS

SEQ ID NO: 36879 - protein, 255 aa, Oryza sativa Indica Group
MMTGEGNKLVFLDNAPEAVRPRHATVRGQGDRQGRHGDDVTTPAPTRGVTCNNGRVYKLSLPGLSLAGTIPPDLSNCTNLQSLDLSSNALSGAIPPELSGLLNLAVLNLSANRLSGAIPRDLARCAYLNVIDLHANQLTGSIPDELGLLVRLSTFDVSYNRLSGPIPVLLANRSGTTGRFNATSFVGNKDLYGYPLPPMRGHALSVLAIVGIGLGSGLLSLVLSFSAVCLWLRATDRTATMPGEEGKISHLMPDY

SEQ ID NO: 36880 - protein, 407 aa, Chlamydomonas reinhardtii
MLHATRNFVAPSPIQAQCWPIILAGRDLIGIAATGSGKTLGFGLPMLRHIAAQREAGVVTGKGPFAVVMAPTRELALQINEVLEEAGSKCGVRTVCVYGGVPKHPQIQALRSGVEVVVGTPGRMEDLLNDGALKLNQITYAVLDEADRMLDLGFEPHIRAIMNLTRADRQTLMFSATWPTAVQKLAVAFLSHPVKVTIGSQDLAASHSITQHVEVIEPHARDGRLLDLLQQYHGAKGRKNRVIIFVLYKKEAPRVEQLLTRKGWKAGAIHGDISQQQRTDAVEKFKSGAVPLLIATDVAARGLDIPDVEVVINYSFPLTTEDYVHRIGRTGRAGKTGVAYTFFCAGPDKPRAGELINVLREAGQEVPADLLKFGTAVKKKESKMYGAHFRDVDVHAKATKVTFDDDE

SEQ ID NO: 36881 - protein, 622 aa, Cryptococcus neoformans var. neoformans JEC21
MSSGGHTNAAGPSRQHSLTAESRSLTTARQKEKAPQLEDVVLEEGLFEQEIDLLIGQYLEARGASKAARIWDEQILGRSANGSTRKEHIEDVERAILDGDWGSIENLVARPGLLRIQTQKAFLYLVYRQQFLEHVENRESQKAFNLLQKRLKALEHYQPVPYDFYSLSYLTSASTVHDAPTFRDWAGVGPERDRLVGVWKELMDAERGGGVDERRYIPPDRLKTLLKQAAAWQVGRVGKKRDDIVKIPTLLQDYRPLELPSKLLRLVEGHLANVKCVELIGSTAQHVVSGSSDCTLRVVSTEDGSLSHILSGHSSRVWSCDSSPSGEMIASSSGDGTIRLWSASKGDCLGVLVGDGGDVYNVRWRPNREDQVVSASYDRILRSWDIETGKQLRTFSGHSQSTLAIAYDSTGNTIASGSKDKHVRLWDAVGGVCTNTMTDCLGEISSVEFDNEGKYLLVGCKDNSNRLWDLRMQRSVYRYTGHQNTSKNLVRCSFACSTSLVISGSEDGSVYIWDREGNSNDRRSNSLVPSTRDNELLAPERKGSGGDLTDFNIHPSSPAYYPPREGVRNRNSFARRGEITVRPSKVLVGHGEGAVFEVRWKEGKMVSAGEDGSVGVWGAETN

SEQ ID NO: 36882 - protein, 467 aa, Populus trichocarpa
MESLRRKRKGLEILPSFGESLAPLTVILPRLSLGDYSRQRKKYKEDEDKEAVGSSTSVVKGVFTAPPCRSVSADPPCRGLKRKIGCIDVATQLGRKKKIEKEYDLGASIGQGKFGSVVLCRSKVTGEEFACKMLRKGEELVHREVEIMQHLSGHPGVVTLKAVYEDLESFYLVMELCTGGRLLDQMAKQRQYPEHRAANILKEVVSVIKYCHDMGVVHRDIKPENILLTASGLMKLADFGLAVRMSNGQSLRGAVGSPAYVAPEVLAGDYSEKVDIWSAGVLLHTLLVGVLPFQGDSLDAVFEAIKKVNLDFKSELWESVSQPARELVAHMLTRDVSARLTADEILGHPWILFYTEPTRKELTQKPKFQDHATLTSQQLTVTTRLESERYRITASGFLSDDSSLILSSDGSRSRLEEQDCGLVDALTVAISRVRISEPKRSRLCWPTSPIRQECSSNIKINNLCTAF

SEQ ID NO: 36883 - protein, 409 aa, Myxococcus xanthus DK 1622
MSKVLAMILAGGAGTRLEPLTRERAKPAVPFGGRYRIIDFVLSNFANSGVYRMKVLTQYKSDSLNNHLSRAWRMTAFLGHYVEAVPAQMRTGLDWYKGSADAIYQNLNIITDEEPDYIFVFGADHVYRMDTRQMLDFHCTKKAACTVAAIPVPIEQGREFGIIDVGPDGRMRQFLEKPKDPPPMPGNPKMCLASMGNYLFSTDVLVQEVVRDAANEASAHDFGKSIISELYKRAPVYVYDFAQNEVPGQEAKERGYWRDVGNIDVYYQSNMDLVEVDPTFNLYNDRWPIHTQPNNYPPAKFVFADEQNHRVGHAMDTLVAEGCIISGGSVRRSVLSPKVRVNSYSEVEDSLLFENVTIGRRCRIRRAIIDKNVEIPPGMTIGFDPVEDRRRFHVTPGGVVVIPKGMKVT

SEQ ID NO: 36884 - protein, 302 aa, Triticum aestivum
  misc_feature (164)..(164): Xaa can be any naturally occurring amino acid
MAGIPVIDLLLAPAAPEEAARLRDAAQRLGCFRVAGHGVPRALQDDMKAAVRALFDLPDDAKRCNADVISGSGYVAPTATNPLYEAFGLYDAASRADVDAFCASLHAPPHIRETIRRYAEKTHELIVDVAAKLAASLGLEESESHRMFQDWPCQFRINRYKYTXDTVGETGVQVHTDSGFLTVLHEDDRVGGLEVADPDTGEFAPVDPVPGTFIVNLGDVATAWSNGALHNVRHRVQCVAAVPRVSIALFLLAPKDDVVRAPDAFVGAGSHRLFRTFGYDDYRRLRQSTGEHAGEALARLAA

SEQ ID NO: 36885 - protein, 530 aa, Coccidioides immitis RS
MGLLANVLTGVSKACSGQSPWTLVLLGICAFLTLSVFVNVLKQVFFKNPNEPPVVFHWFPIIGSTISYGIDPYKFFFSCQKKYGDIFTFILLGKKTTVFLGTKGNDFILNGKLKDVCAEEVYSPLTTPVFGRHVVYDCPNAKLMEQKKFVKFGLTSEALRSYVTLITREVESYLENSPAFQGDSGVFNVAKSVAEITIYTASRSLQGKEVRDKFDSSFAELYADLDMGFAAINFMFPWAPLPHNRKRDRAQQKMTQVYTDIIRERRKAGGKKDSEDMVWNLMSSVYKDGTPVPDVEVAHMMIALLMAGQHSSASTGSWIVLRLASRPDILEELYQEQLRVLGPDLPPLTYESLQRLELHSNVIKETLRLHAPIHSILRAVKSPMPVDGTKYVVPTSHNLLAAPGVPSRMADYFPEPMLWDPHRWEKGGGVNATGVQDEAAEEKVDYGYGLVSKGANSPYLPFGSGRHRCIGEQFAYVQLGTITAALVRALKLRKLDGDKEVPDTDYSSLFSKPLGNPKVAWEKRKPSSKQ

SEQ ID NO: 36886 - protein, 533 aa, Rhodococcus sp. RHA1
MLLVIIAAIAVTSFAKRRDLQAPLVLVTIGSVASFIPGMPRLELDPDAILGVVLPPLLYSAALKFSVATFRRHLAPILRLGIFTVLATAIGVAFFANWLVPEFTLGAALVLGAVVAPTDAVSAVAVGRRLGLPNRVIAILTGEGLVNDATALTLFTVAVSAVVGAAIPVHPVVFFGYEVVGGVLIGLVLAKIVEWVRHRMYDSPLETVLGLMLPFVAYLAAEEVHASGVLSVVAAGFLMGHKATDASVATRIQERSLWESVDLLLEMFVFAYMGLQLKFVIDDVRDQGLPVHHVFFYGFAVLAVVMAIRPAWILLHWLRRRVGLAIEPPGGSVALGWRESLVVSWAGMRGVVTLAAASGVPVVIASGQPFPGREVIQAIAFVVAVGTLLIQGATMPLLIRKLDLADPGEREREEEQVKLARAISRDAGERALVEFTEHPPEGIGRADLTDILERVRRSMRARLQAEEAEDGAEKQRAGALFDHYRRAALRAQREAIIAARDAGTLDDEVMRSVLEGLDVEEAAAEERVRRRRE

SEQ ID NO: 36887 - protein, 238 aa, Oryza sativa Indica Group
MAGGGGAGELKLLGHWASSYVTRVKLALHLKGVSYEYVEEDLRNKSDLLLASNPVHKTVPVLIHNGNPIRESQIIVQYIDEAFSGAGDSLLPADPHERAVARFWAAYIEDKLVAPWEKVFRAKTEEERAAWMKQMFVAVEALEGGLKECSKGKGCFFGGDSVGYVDVVLGGGVSFVHANDVITGGKLFDAAKTPLLAEWLGRFGELDAAKAVLQDVDRAVEYTKVLYARNAATNAANN

SEQ ID NO: 36888 - protein, 281 aa, Oryza sativa Japonica Group
MQARVVVFPVKGRAWCFASPRATAPAAACGGGDGGALLPPPPPTVKDLWRGIAGGGRTASENAEAVVDFVADKMNRAWIGFGSAPEGSMKNRIHSFGLKLLSRVRPSEVLLKSVTKDVSLLEIVHPASINPRLVRRRLRHIAVRGASVHRKFLYGSVCLLPVTSVFMVLPLPNIPFFWVLFRAYSHWRALQGSERLQLLVSDSSDQWKILLEKQKEMSSRKDGNPCENTQYAPWNLQPSKKLDGFLESRKLNEGLDCDTISRICQAYDLDKIDVLKYRDLE

SEQ ID NO: 36889 - protein, 437 aa, Magnaporthe grisea
MLSGVLLFNLKGENLIFRSFRNDCRPRLADVFRIQVISARETRSPILTLGSTTFSHVKHENIYLVAITKSNANAALVFEFLYRLIQLGRGYFGKFDEEAVKNNFVLVYELLDEIVDFGYPQNTETDTLKMYITTEGVKSEHRPEDSAKITMQATGALSWRKADVKYRKNEAFVDVIEDVNLLMSAAGAVLRADVTGQIVMRAYLSGTPECKFGLNDRLLLDGDGMMSLPSGNRMGSKATKAAAGSVTLEDCQFHQCVKLGKFDSDRIISFVPPDGEFELMRYRATENVNLPFKVHAIVNEIGKTKVEYSIGVKANFGPKLFATNVIVRIPTPINTARITERCTQGKAKYEPSENHIIWKIGRFAGQSEYVLSAEAELTSMTSQKAWSRPPLSMNFSLLMFTSSGLLVRYLKVFEKSNYSSVKRVRYLSRAGSYQIRF

SEQ ID NO: 36890 - protein, 264 aa, marine gamma proteobacterium HTCC2080
MEPMVTIALRAARKAGDLIVRASDELDRVGHQAKGIADYVTEVDIAAEQEILYQLGKAYPDHAFLAEESGQTGNAKSDHLWVIDPLDGTSNFMRGIPHYCVSIACIVDGRLAHAVVFDPVRQEEFTASRGRGAQLNGHRLRVSNRTDLRECLLGTGIPFLGHEQQRLPQYTQTLAELAAQCMGIRRAGAAALDLAYVAAGRFDGFWETGLERWDIAAGALIIKEAGGLISDLSGSERYLDNGQVVCGNPKIFKQLLSTVGPVLR

SEQ ID NO: 36891 - protein, 328 aa, Salmonella enterica subsp. enterica serovar Paratyphi B str.
MGQLIDGVWHDTWYDTKSSGGKFQRSASAFRNWLTADGTPGPSGEGGFAAEKDRYHLYVSLACPWAHRTLIFRKLKGLEPFIPVSVVNPLMLENGWTFDDTFPAATGDTLYQHEFLYQLYLHADPHYSGRVTVPVLWDKKNHTIVSNESAEIIRMFNSAFDGLGAKAGDYYPPALQSKIDELNGWIYDNVNNGVYKAGFATSQQAYDEAVEKVFTALARLEQILGQHRYLTGDQLTEADIRLWTTLVRFDPVYVTHFKCDKYRISDYLNLYGFLRDIYQIPGIAETVNLDHIRHHYFRSHKTINPTGIISIGPWQDLLEPHGRDVRFG

SEQ ID NO: 36892 - protein, 479 aa, Mesorhizobium loti MAFF303099
MSEHGKAAPGSAPSDGQSARLRPPYKSVLDLIGQTPVVELTKFDTGKCRLFIKLESQNPGGSIKDRIALSMIAAAEREGKLKRGGTIVEATAGNTGLGLAQVGIPKGYRIVLVVPDKMSREKIQHLRALGAEVRMTRSDVGKGHPEYYQDMAEKIAAEVPGAFYANQFANPANPLAHETTTGPEIFSQLDGNVDAVVVGVGSGGTLTGLGRYFSKVSPKTEMVLADPVGSVLAPLIKTGKMEEAGSWTVEGIGEDFVPPNADLSLVKKAYSISDKQSMLAVRDLLSREGILAGSSSGTLLSAALRYCREQTTPKRVVTFVCDSGNKYLSKVFDDFWLAEQGLAEHEQHGDLRDLVMRSHRTGDTVYVGPDESLLNAYGRMRRSDVSQLPVLEDGKLIGIVDESDILAKVDGPYDGRWERFNGPVRTAMTSNLHTLQASQTLDALLPVFDRNEVAIIFDGDEFVGLITRIDLINHLRRAR

SEQ ID NO: 36893 - protein, 237 aa, Oryza sativa Indica Group
MAAEDELKLLGFWASPYVCRVKLALHLKGLIYDYVEEDVFTNKSELLLSCNPVHAKVPVLIHNGKPICESQVIVQYIDEVFPDAGVTLLPADPHDRAAARFWAAYIDDKLLPPWVHAYRGKTDEEKAERMKQTLAVVDALETAMEECSKGNAFFGGDTVGYVDVALGGLLSWLHGTEELCGTKILDAAKTPLLSAWARRFGELDAANAALPDVGRLVEFCKMRHVELEAAEAAAARN

SEQ ID NO: 36894 - protein, 165 aa, Glycine max
MLRVGAKRLLGTTSLGVRVPARLYHERVVDHYDNPRNVGSLDKNDPSVGTGLVGAPACGDVMKLQIKVDDKTGKIVDARFKTFGCGSAIASSSVATEWVKGKQMEEVLTIKNTEIAKHLSLPPVKLHCSMLAEDAIKAAVKDYEAKRAKATASGEAATGEKPAIA

SEQ ID NO: 36895 - protein, 663 aa, Coccidioides immitis RS
MPPQKEKSSLKRGRASGGNHEQDVKKPRRSERLSSQLAQSQAARANKAYLPPLIQQDSTATEIHKEATVTPPEGRPSQLRHHTPGPESLTQLSSPPGDTQAFSQNPSRVYVSGVEEEAAEGVWGYLIPLDNKFGDTLVLKKRDTCFSSPIGGVTNNRNGASRSKRSKGKGMPTPLQLNPSGYLIGRHSECDLILDIPTISNRHCLIFHENREGDSVAILEDLSSNGTFVNEAIVGRNNRRELEDGDEVTVLDEARFIFRYPRNRDAGGFRQQYRILEQLGKGHFATVYLCAERATGIKYAVKRFEKRPGDSHRSDNDTLQQEIAMLKSVNHTNVLCLKDTFDESDGVYLVLELAPEGELFNWIVSHQKLKEDETRHVFRQLFQGLKYLHDRNIVHRDIKPENILLMDKHLTAKLADFGLAKIIGEDSFTTTLCGTPSYVAPEILENSRQRRYTRAVDIWSLGVVLYICLCGFPPFSDELYSAEHPYTLAEQIKLGNFDYPSPYWDSVGDLALDLIDRMLTVDVDQRASIDECLQHPWLTGKYPSVADSTDGLTGAMGQLDFSKRKIERERTLLSDINDVPVSQVYDDSRQEGYGQVKIFDKNTAGKRVHNQPAKGLKYRQEPKPDVNRDPVEFMHMGGRGDQTLFAHDPDSRYESDKVPRRKR

SEQ ID NO: 36896 - protein, 234 aa, Oryza sativa Indica Group
MAGGGDELKLLATWFSPFASRVKFVFHLKGLSYENIEEDLKNKSDLLLKSNPVIKKVPVLLHNGKPLCESMVIVEYLDETFAAVGPSVVPADPYERAVARFWVSYIDNKLVAPWFQVFRGKTKEEKAEGLKQMFEATAVMEVAFRECSKGRPFFGGDAVGIVDVALGSQLGWLRASETLSGIKLFDPAKTPLLLAWAERFLALDAAKASMPESGRLLAYAKMRQAETDAANASK

SEQ ID NO: 36897 - protein, 529 aa, Oryza sativa Japonica Group
MAMATLARRPPAEAALLRRAPAAAWASAWRGYAAAAAGEESDVVVIGGGPGGYVAAIKAAQLGLKTTCIEKRGTLGGTCLNVGCIPSKEVMNHFDPFYLAVPSIYYELRSTMGALLHSSHMYHEAKASFAHHGIKFSNLEIDLPAMMSQKDKAVAGLTKGIEGLFKKNKVEYVKGFGKFVSPSEVSVDLLDGGSTTVKGKNIIIATGSDVKSLPGVTIDEKKIVSSTGALALSEIPKKLVVIGAGYIGLEMGSVWNRLGSEVTVVEFASDIVPSMDGEIRKQFQRMLEKQKMKFMLKTKVVGVDTSGSGVKLTVEPAAGGEQSVLECDIVLVSAGRVPYTSGLGLNALGVETDKGGRILVDKRFMTNVKGVYAIGDAIPGPMLAHKAEEDGVACVEFIAGKEGHVDYDTVPGVVYTHPEVASVGKTEEQVKASGVAYQVGKFPLLANSRAKAIDDAEGLVKVVAEKETDRILGVHIMAPNAGEIIHEAVLALQYGASSEDIARTCHAHPTVSEALKEACLQTYLKAIHI

SEQ ID NO: 36898 - protein, 230 aa, Oryza sativa Indica Group
MAGRNNHELKLLGTWPSPFVVRVRLALGLKGLSYEYVEQDIRDKSELLVVSNPVHKKVPVLIHGGKPVCESQIIVQYIDEAFPGAGASLLPSDPHERAVARFWATYIDDEFATKFRAMGEAKEEEEKDEAAAQVFAALETLEEAMKGKVFFGGDSAGYVDVALGGFLGWIKAAEALAGVAFLDGARTPLLAAWAARFSALEAAKEAIPSVERLREFHVAMHAAAATVAGN

SEQ ID NO: 36899 - protein, 128 aa, Glycine max
MSAKCSQIRHIVRLRQMLRRWRNKARMSANRAPPSDVPAGHVAVCVGSNLTRFVVRATYLNHPVFKKLLLQAEEEYGFTNHGPLAIPCDETLFRDVLRFISRSDPAKSNRFLNLELDNFNPSFWLRFE

SEQ ID NO: 36900 - protein, 207 aa, Bdellovibrio bacteriovorus HD100
MSRPHIIGVAGGSGSGKTYFAKELQKMLGSENCSILYQDNYYIDQSARFDGDGGSVNFDHPQALDFTLLARGLQTLKMGQPLQVPIYDFVTHSRKTETLLENPKKVIIVDGILILHSKEVRAELDEAVFFDTPEDLRFQRRLHRDVHERGRTPEGVKKQFELQVRPMHDEFVEPSKRHAQTIVTDSGDYHAVLSQFTHRLQNTLPVR

SEQ ID NO: 36901 - protein, 145 aa, Bacillus cereus G9241
MKALLWHNQRDVRVEEVPEPTVKPGAVKIKVKWCGICGTDLHEYLAGPIFIPTEEHPLTHVKAPVILGHEFSGEVVEIGEGVTSHKVGDRVVVEPIYSCGKCEACKHGHYNVCEQLVFHGLGGEGGGFSEYTVVPEDMVHHIPEK

SEQ ID NO: 36902 - protein, 418 aa, Pyrococcus horikoshii OT3
MRIAVLGLGYIGLPTAIMFASSGYDVVGYDIRSEVIKKINSGVAHIIEPEIDRRLKEVLSLGKLKVTDRVEDLKGSNVFIICVQTPLSGDDPDLSYLERAIRTVAEVMDRGALVIIESTIPPGTTEKMARLLENLTGLREGVDFYVAHAPERVMPGRIFKELVYNSRIIGGVSEKAANLAEKLYRSFVKGRIFLTNATTAEMVKLMENTFRDVNIALANEFALLAHQYGVNVYEAIELANTHPRVKIHTPGIGVGGHCLPKDPYLLLSNAKEDFGLIRIARRINERMPAFAAGLLFEALEKANIKPSEAIIAVLGLAYKGGTDDTRNSPALKFVEIIRNSVKEVRTYDPYVRGTHDSLEKVVEGADAIVIATDHPEFKSVNWESIGKSMRHKIIIDGRNIIKEPPVGFIFRGIGRGDV

SEQ ID NO: 36903 - protein, 479 aa, Glycine max
GEVNTLVVYSFLRRFFKMESVKPSAVTPSKSKLARTFAKVLHVRAVTGIAPVDGLKNVKVDADLNNEANMCKSAINIEDEELQERKATEALLAKTFASISTVKASYAQLQNAQSPYDPDGIQVADQLIVSEFKTLSELKQCYFKKQFDPLPDRAILAAKLKELQSVNKTFEITGKKLESQAGLKDSEIIFLQEKLEEANVHNKSIEKRLNQSGSLSVLDNLHMSGLSPSHFVTVLRHTVRSIRSFVKLLVNEMRSAGWDIDASVKAIMEQNVVYWKEDHKCFAIESFVCREMFDSFNFPNFSLPNESLPDRNRRQLFFGRFNELKPEKAKDFLAGKPRSPFAKFCRIKYLRLVHPKMEASFFGNLNQRSLLNAGEFPNTNFFTSFAEMAKRVWLLHCLAFSFEPPQASIFQVGKWCRFSDVYMESVNENDEAALPVVESEPQVAFTVVPGFRIGKTVIQCQVYLSQHQVKNFTSTKPRR

SEQ ID NO: 36904 - protein, 274 aa, Geobacter metallireducens GS-15
MIDFAAYALSGELDLNRLAGSLGFPRRYRWEEPMVLDLTSLRPLPGDMGETKRVYLYYFGGVVFVNCTEEEIGSFFWSMGHHGEAFKEYPAVRYRDEYSLKRGEGERVEVTNDVATMPGYDPAYVDTICFVIAKSVALERIEERVDQVLDEMETIIALLDRGKLGISDRRLAKLAANVLTYKYQSISHIMVLEKPEFTWENPVADRLYLTMANIFELNQRYNEIKHKGETLLDITGVFTSLAHARRASRLEWIIIILIFIEIVIYIFELMRKTG

SEQ ID NO: 36905 - protein, 264 aa, Oryza sativa Indica Group
MAGKDDDVKVLGVVVSPFAIRVRIALNIKGVSYEYVEEDIFNKSELLLTSNPVHKKVPVLIHGGKPISESLVIVQYVDEVWAAAPSVLPADPYDRAVARFWAAYVDNNVSTVLYTVLAMAMSPKLFDEQLLVISLVVLQMFPGMAGVLFAATEEERAAKAEETLAALAQLEKAFAECAGGKAFFGGDSIGYVDLVLGSNLHWFEALRRLFGVALLDAGKTPLLAAWAKRFVEAEAAKGVVPDAGVAVELGKKLQARAAAASTAA

SEQ ID NO: 36906 - protein, 242 aa, Oryza sativa Indica Group
MAEELKLLGSLSGVSPYVIRAQMALAVKGLAHDYLPEDLTRKSKLLLDSNPVHKSVPVLIHNGKPVCDSLVIVEYVDEAFPGGAAALLPADPYHRAVARFWAAFIDSKVFPPCLAILKTAAAEAEEKAAKVKETVEALQLVEGAFGECSKRKPFFGGDAVGYLDVVLGCYLCWFEGVSEIAGGVSPPLLDASRTPQLAAWAARFRSAADAVGCSVPRVDKVEAYLNNVLKPKWSAAAAASSH

SEQ ID NO: 36907 - protein, 565 aa, Arabidopsis thaliana
MDRPKKRDVLRAVNSMSSLCENGKKKEGIRAVNSMCSISELTDEDLLSRLLDRPRLKLERKISYEEMSLSLYDSAHSLDGKSGWDTPVFSMKDSMDRNPMVTEAWEALCQSQVYFRGKPVGTIAAYDHASEEVLNYDQVFVRDFVPSALAFLMNGEPEIVKNFLLKTLHIQGQDKMIDKFKLGDGAMPASFKVLHNPIKKTDTIIADFGESAIGRVAPVDSGFWWIILLRAYTKSTGDHSLAERPECQKGMRLILSLCLSEGFDTFPTLLCADGCSMVDRRMGIYGYPIEIQALFFMALRSALSMLKHDSEGKEFMEKIVKRLHALSFHMRSYFWLDFQQLNDIYRYKTEEYSHTAVNKFNVIPDSIPDWIFDFMPLRGGYFVGNVSPARMDFRWFALGNCIAILSSLATPEQSMAIMDLIEARWEELVGEMPLKICYPAMESHEWGIVTGCDPKNTRWSYHNGGSWPVLLWLLTAASIKTGRPQIARRAIELAEARLLKDGWPEYYDGKSGRFIGKQARKSQTWSIAGYLVAKMMMDDPTHVGMISMEEEKHMKPPLRRSSSWT

SEQ ID NO: 36908 - protein, 488 aa, Arabidopsis thaliana
MISLSGLTSSVESDLDMQQAMLTNKDEKVLKALERTRQLDIPDEKTMPVLMKLLEEAGGNWSYIKLDNYTALVDAIYSVEDENKQSEGSSNGNRGKNLKVIDSPATLKKTYETRSASSGSSIQVVQKQPQLSNGDRKRKYKSRIADITKGSESVKIPLVDDVGSEAVPKFTYIPHNIVYQSAYLHVSLARISDEDCCANCKGNCLSADFPCTCARETSGEYAYTKEGLLKEKFLDTCLKMKKEPDSFPKVYCKDCPLERDHDKGTYGKCDGHLIRKFIKECWRKCGCDMQCGNRVVQRGIRWQLQVYFTQEGKGWGLRTLQDLPKGTFICEYIGEILTNTELYDRNVRSSSERHTYPVTLDADWGSEKDLKDEEALCLDATICGNVARFINHRCEDANMIDIPIEIETPDRHYYHIAFFTLRDVKAMDELTWDYMIDFNDKSHPVKAFRCCCGSESCRDRKIKGSQGKSIERRKIVSAKKQARFQRGV

SEQ ID NO: 36909 - protein, 139 aa, Oryza sativa Japonica Group
MAATALSSQVRLPMSLRVATAPAPARVSVLPASNKLGDRLRMQATYNVKLITPDGEVELQVPDDVYILDQAEEEGIDLPYSCRAGSCSSCAGKVVSGEIDQSDQSFLDDDQVAAGWVLTCHAYPKSDVVIETHKEDDLI

SEQ ID NO: 36910 - protein, 335 aa, Pyrococcus horikoshii OT3
MVKYVLASAPAKVILFGEHSVVYGKPAIASAIELRTYVRAQFNDSGNIKIEAHDIKTPGLIVSFSEDKIYFETDYGKAAEVLSYVRYAIELALEESDKRVGIDVSITSQIPVGAGLGSSAAVAVATIGAVSRLLGLELSKEEIAKLGHKVELLVQGASSGIDPTVSAVGGFLYYKQGKFEPLPFMELPIVVGYTGSTGSTKELVAMVRKRYEEMPELVEPILEAMGKLVDKAKEIILSKLDEEEKLTKLGELMNINHGLLDALGVSTKKLGELVYAARTAGAIGAKLTGAGGGGCMYALAPGRQREVATAIKIAGGIPMITRVSREGLRIEEVSR

SEQ ID NO: 36911 - protein, 294 aa, Burkholderia vietnamiensis G4
MLKVTKAVFPVAGLGTRFLPATKASPKEMLPVVDKPLIQYAVEEAIAAGITEMIFVTGRSKRAIEDHFDKSYEVEAELEARGKEKLLELVRSIKPSHVDCFYVRQPEALGLGHAVLCAEKLVADNPFAVILADDLLDGNPPVMKQMVDVFDHYHSSVIGVEEIPPSETKSYGIVDGKEWEESIVKMSAIVEKPAPEDAPSNLGVVGRYILKPRIFQHLRALKPGAGGELQLTDAIQALLADEQVLAYKYQGTRYDCGSKLGYLKATVEFALRHPEVGAEFEAYLRTRGTAQPAA

SEQ ID NO: 36912 - protein, 254 aa, Oceanobacillus iheyensis HTE831
MEGKVVLITGGAGGIGQATAKLLLDYGAKVALVDINEDSLVKAKESLHVEDDRVFTITGNVTVEEDVENYVKQTVDRFGKIDVFFNNAGVNGPVSPITELDQATFEKIMSINVTGVFLGLKHVMKQMKKQGYGSIVNTASNAAYIGSAGMVSYIASKHAVAGITKTAALEVASDGIRVNAVAPAAIDTQMLADIQNNLTPGEPEKSGEALKQGIPAGRFGAPEEVAQVVKFLASDDASFVNGSLYNVDGGMQAD

SEQ ID NO: 36913 - protein, 472 aa, Erwinia carotovora subsp. atroseptica SCRI1043
MSTQQSKKDLQAILNTMKRAHMASGPADARLRKDRLQRSINLIRENHIALAQAMSEDFGHRSLYHSFTADVGTTLKMLQNAIDNVERWMQPEPVDEPAPGMQAWIQHQPLGVIGVISPWNFPVNLSFGPLADIFAAGNTAILKPSELTPHTSELLAELIAHYFDPLELAVVLGDAEIGQAFSELPFDHLVFTGSTAVGKHVMRAAAENLVPVTLELGGKSPVVIDSSADITEAAERTMTIKTFNAGQICLSPDYVLLPEGQEQAFRDAAKAFMQKSFPTLQANPDYTSIIADRHYDRLIRLLKEAEQQGATVVSLAPEGEASYDAKSRKIAPHLVFGVRDDMTIMQEEIFGPLLPVKTYQTAEEPINYINAHPRPLAAYLFSHDEAMQQRFAGRTTSGALVINDVMTHVSIDTLPFGGVGASGIGAYHGVHGFRRFSHAKPIVIQSEDGASNLTLRAPYHEKQNAIVAVLKG

SEQ ID NO: 36914 - protein, 431 aa, Erwinia carotovora subsp. atroseptica SCRI1043
MSKIVKVIGREIIDSRGNPTVEAEVHLEGGFVGLAAAPSGASTGSREALELRDGDKSRFLGKGVTKAVAAVNGPIAQAVLGKDAKDQANIDKIMIDLDGTENKSQFGANAILAVSLAAAKAAAASKGLPLYAHIAELNGTPGKYSMPLPMMNIINGGEHADNNVDIQEFMIQPVGAKTLKEAIRMGSEVFHTLAKVLKSKGMGTAVGDEGGYAPNLGSNAEALAVIAEAVKAAGYELGKDITLAMDCAASEFYKDGKYVLAGEGNKSFTSEEFTHFLEDLTKQYPIVSIEDGLDESDWAGFAYQTKVLGDKIQLVGDDLFVTNTKILKEGIDKGIANSILIKFNQIGSLTETLAAIKMAKDAGYTAVISHRSGETEDATIADLAVGTAAGQIKTGSMSRSDRVAKYNQLIRIEEALGDSAPFNGLKEVKGQ

SEQ ID NO: 36915 - protein, 91 aa, Chromobacterium violaceum ATCC 12472
MIPNQKGQGFKQMENIEARVKKIVAEQLGVNEAEIKVESSFVDDLGADSLDTVELVMALEEEFECEIPDEEAEKITTVQQAIDYVTGHLNK

SEQ ID NO: 36916 - protein, 237 aa, Alteromonadales bacterium TW-7
MTPQLADNYMVTIAERLTCAYARISNAAKNTHRSKDEITLLAVSKTKPSDDIVAAYNYGQRQFGESYVQEAVDKIAQLHTYSDIIWHFIGPIQSNKSALVAENFDWVQSVDRIKIAKRLNAQRPTSKPPLNVLIQVNISAEEAKSGCHPNDIANLADFISQCDQLRLRGLMSIPAKSDDPTTQTQYFEQLQTCFDKLKAQYPQLDTLSMGMSNDVEAAISAGSTMVRIGTDIFGTRT

SEQ ID NO: 36917 - protein, 245 aa, Chromobacterium violaceum ATCC 12472
MSLQGKVALVTGASRGIGAAIADALAAEGAVVIGTATSESGAAAIHERLSATGGAGRVLNVTEEGAVDALIESVEKDFGAVAILVNNAGITRDGLLMRMKDEDWDAIMDTNLKSVFKTSKAVMRGMMKARSGRIINIASVVGAMGNAGQANYAAAKAGIIGFTKSMAREVGSRNITVNCVAPGFIDTDMTRALPEAQREALVGQISLGRLGEAKDIADAVVFLASDRAAYITGQTLHVNGGMLMP

SEQ ID NO: 36918 - protein, 273 aa, Alteromonadales bacterium TW-7
MSDKKIAFIGTGNMSYAIIGGMVKNGFDANNIIATNRNQEKLAKVAADFKVQTTSDNNEALRDADVIVLSVKPQMMGDLCKSFQESGIDFSNKLFISVAAGLTVSRLREMLGQDVKIVRCMPNTPSLLGRGVSGLFGAGETQQEHEFVQQVFECTGIVVWVEQEAQINDIIAVTGSSPAYFFLFMEAIEEKAKALGFNDEDARRLVQQTALGAAEMALSQPEISISQLRANVTSKGGTTHAAVEHLKDEGLTKTVGDAMDACIARAMQMEKEL

SEQ ID NO: 36919 - protein, 216 aa, Triticum aestivum
MSEEDSTSAAAQQPTSRPAPKLNERILSSLSRRAVAAHPWHDLEIGPGAPAVFNVVVEITKGSKVKYELDKKTGLIKVDRVLYSSVVYPHNYGFIPRTLCEDNDPMDVLVLMQEPVIPGSFLRARAIGLMPMIDQGEKDDKIIAVCADDPEYRHYNDISELSPHRLQEIKRFFEDYKKNENKEVAVDAFLPATTAREAIQYSMDLYAQYILQSLRQ

SEQ ID NO: 36920 - protein, 556 aa, Cryptococcus neoformans var. neoformans JEC21
MDGKPATQYQAWKKLQSLHGSKADKLVLKDLFKADPKRFSNLSKTFSSSSPNVSLLLDYSKNLVDDEVLSTLFDLAREAKVETFRDEMFAGKHINTSEDRSVLHIALRNPPADKGGFKISEAGVDEVHAVLAHMKEFSDSVRSGAWKGYTGKAIDTIVNIGIGGSDLGPVMVCEALKHYSKRDLKTHFVSNIDGTDMAEVLKACNRETTLFIVASKTFTTQETITNAESAKEWFLEQAKEKAHVAKHFVALSTNTKGVTEFGIAESNMFQFWDWVGGRYSLWSAIGLSICLSIGFDNFQELLNGAHEMDKHFKTAKLEDNLPVILALVGIWYNDFYGAQTQALLPYDQYLKKFADYFQQGDMESNGKSVTKDGSRVDYETGPIIWGQSGTNGQHAFYQLIHQGTKLIPCDFLAPVETLNPISGGKHHEILLSNFFAQPEALAFGKTEEEVIKELGPEQSKNSALVKSKIFEGNKPTNSIMFQKLTPGTLGALIALYEHKIHVQGAIWGINSYDQMGVELGKVLAKAILKQLGSENDVQGHDSSTTGLIHFYQKNRK

SEQ ID NO: 36921 - protein, 278 aa, Zea mays
ARKSRRTQKWQSQCDRLPRPAASFRRYLRRALDMFEDWRASVPVVVLSAMGKTTNNLLLAGEKAVGCGVIHVSEIEEWNMVKSLHIKTVDELGLPRSVIQDMLDELEQLLKGIAMMKELTPRTSDYLVSFGECMSTRIFSAYLNKIRVKARQYDAFDIGFITTDEFGNADILEATYPAVAKRLHGDWIQDPAIPVVTGFLGKGWKSGAVTTLGRGGSDLTATTIGKALGLREIQVWKDVDGVLTCDPNIYPHAKTVPYLTFEEATELAYFGAQDLNRV

SEQ ID NO: 36922 - protein, 334 aa, Saccharomyces cerevisiae [sequence omitted]

SEQ ID NO: 36923 - protein, 491 aa, Bdellovibrio bacteriovorus HD100
MSVKIPATPIPCQNFVSGKFLKGSGLAMDVVSPYNGQIIGNLHASTAKDIDLAIKDAHETQKSWADVPLKERTKIMFNFRQILMRDLDEIAHLKSSESGKTFAEGKAGLMKGIEVLEFALSLQNMDLGGKMEVSRGVSCEFRREPLGVIANITPFNFPAMVPMWTIPIALTLGNAYIWKPSEKTPLTSMKIAAALQEAGLPDGLFQVLHGGKDTVEAIIDHPQVKAVGFVGSTKVAQHVYQRGTALGKRVLALGGAKNHIVLLPDANPDLTGAGISDSFTGCAGQRCMAAAVVLAVGDVDHHIQKIIQRAQSLVLGKDMGAIISKSQVQFLKDAITRAEKEGAKILLDGRNTPAPAGLDHGHWIGPTIMDNVAPNSEAATLEYFGPVLSIIRCRDITHAMQIENSNPYGNACSVFTSSGSLAEKVIRQASTGMVGVNVGVPVPREPFSFGGANASKFGHGDITGAQSLDFWSNSKKVTMKWEKQDDSNWMS

SEQ ID NO: 36924 - protein, 283 aa, Oryza sativa Indica Group
MVVGAGGGDELKLLGVWDSPYVNRVQIVLNLKGLSYEYVEEDLMNKSDLLLGSNPVHKKVPVLIHNGKPIAESRVIVEYLDEAFAAGAGGSTGASVLPSDPYERAVARFWAAYVDDKVGSPWYTILFARERGEKVEAAARAISALETVEAGAFRDHSSEGKTTNAAAAPFFGGDSIGFVDVVLGSYLGWFRVIEKMIGVRIMDAARTPRLAAWAERFEAADAVRGVLPDDVDKVIDFLQACSCTRVGVLLSTSWIALFRLLCRAGKNVPSCFVYLGPNGILSL

SEQ ID NO: 36925 - protein, 211 aa, Oryza sativa Indica Group
MAGDGELKLLGMWTSAFVLRVRFVLNLKSLPYEFVEENLGDKSDLLLASNPVNKTVPVLLHAGRPVNESQVILQYIDEAWPDRPPAVLPSDPYERAVARFWAAYVDDKADAALETLEGALRECSGGKPFFGGDGVGLVDVVLGGYLGWFTAIKKLIGRRMIDPARTPALAAWEDLFRATDAARGVLPDDADKMLEFRQTALALGASKKITL

SEQ ID NO: 36926 - protein, 203 aa, Triticum aestivum
  misc_feature (4)..(4): Xaa can be any naturally occurring amino acid
KSMXEIYLHSLPIKEYQVVDFFLPKLKDEVMKIKPVQKQTRAGQRTRFKAIVVIGDSEGHIGLGIKTSKEVATAIRAAIIIAKLSVVPIRRGYWGTNLGEPHSLPTKESGKCGSVTVRLIPAPRGTGLVASPAVKRLLQLAGVADIYTASSGSTKTLENTLKATFVAVAHTYGFLTPNLWAEKKLTPSPLEEYSDILREGKRY

SEQ ID NO: 36927 - protein, 1045 aa, Ostreococcus tauri
  misc_feature (1045)..(1045): Xaa can be any naturally occurring amino acid
MSDARARGLVDYLNASWTPYHAVKTSCDALIANGFTELDEREAWSLTPGGRYFYTRNASAVVAFAIGGGYGPGDGFVVIGAHTDSPCPKLKPTSRSESGDCVRVGVQPYGGGLWHTWFDRDLGVAGRVVVRDKTSGRVLHRLVRIDRAICRIPTLAIHLDRGVNTEGMKVNFQQHMAPVLATKAKAEGEKNEDEGKAATGGRHHPLLLRMIADELKCEPEDIVDFDLQLCDTQPSAIGGAQNEFIYSGRLDNLASCYTSLQALLNASTDDALAGASGVRMIMHFDHEEVGSESTSGAAGAMTTDAIKRIAAALNPNAVEGLDERTRRASFCVSSDMAHALHPNYTDRHEPAHTPKLHGGLVIKHNANQRYATDAVTAFMFRELGERVGVPVQEFVVKSDMGCGSTIGPIFSTRTGIRTVDVGAAQLSMHSIREVCGTDDVEHAIKHFTSTFMNFLDLDRTFIVDGAVGTLCRPCNLYESTDPTRARRSPHPPSRVTRPASSSAPLLMGDTACVLAELVRCRRDVARCRADGEHTKALELLIRQRDLLQRQAERSTADAKVIAPIVEKIDRDMVRVRGEMRGVTNAENGGKKGELTKIVDSESARGGAAETRRGTTTATTAATTTTGAVEGDRRSVGAVKSAVPAVKATTTARVVDFKAVDETLAKCASWGPTPPPIVELDEDEDELGPVDLNRQFGGVDAGKGLKRQKPFDPPVVRERKSPSRGRKKQNVRDDEPASRWEGDRDAAVKPPPSRFMSAGERLDLENAAKGLPPAHAQYRAAKEANGATRSYGGRGRGRGGFVPPYGGGAGGGNGQRMKPNQTGNDDEDGPPFSEAVMQKLSPNGEPISEDILKLDREIVERVVSEILDRHESVDWESIAGLEHPKAAVQELAVWPMMNPELFVGARAVPKGLLLFGPPGTGKTLIGRAVASQCGATFFSISASSLTSKWIGEGEKMVRALFAVARHLSPAVIFVDEIDSLLSARKSDGEHESSRRMKTEFLTLLIGATNRPQELDDGARRRMPKQLYIPLPCAAARRDMILRTLSX

SEQ ID NO: 36928 - protein, 438 aa, Bacteroides thetaiotaomicron VPI-5482
MDTKELKIAVAGTGYVGLSIATLLSQHHQVTAVDVIPEKVDMLNRKQSPIQDEYIEKYLSEKSLNLTATLDGAEAYSDADFVVIAAPTNYDPVKNYFDTHHIEDVIDLVLSVNPDAVMVIKSTIPVGYCRGLYLKYARKGVRKLNLLFSPEFLRESMALYDNLYPSRIIVGYPKLIDSEQFDEENEAIKVIANIPVLEKAAHTFAALLQEGAIKEDIPTLFMGIKEAEAVKLFANTYLALRVSYFNELDTYAEMKGLDSQSIIQGVGLDPRIGTHYNNPSFGYGGYCLPKDTKQLLANYQDVPQNMMTAIVESNRTRKDFIADQVLRKAGYYTASCSWDAQKEQKITIGVYRLTMKSNSDNFRQSAIQGIMKRIKAKGATIVIFEPTMQDGETFFGSQVVNNLIKFKEISQAIIANRYDSCLDDVKEKVYTRDIFQRD

SEQ ID NO: 36929 - protein, 329 aa, Burkholderia thailandensis E264
MQVPLDVVTYGEAMAMFVAAEPGPLDCATQFMKRIAGADLNVAIGLARLGFRVGWVSRVGADSFGRYVLDTLARERVDASCVTVDARYPTGFQLKSRATGGADPAVEYFRKGSAASRLSLDDYAPDYVLGARHLHLTGVAPALSDSSRELAFHLAREMRAAGKTVSFDPNLRPTLWPSPEAMARALNALAEHADWVLPGLGEGRQLTGLDTPADIARFYLGQGARGVIVKLGAAGAYFRTADGREGTVAAERVEHVVDTVGAGDGFAVGAVSALLEGRAIDDAVARGNRIGALAIQVIGDSEGLPTRAALDRIENLSNARDRLEAPLAR

SEQ ID NO: 36930 - protein, 347 aa, Leptospira interrogans serovar Lai str. 56601
MDYAGGIVLPAAIDFSIRIAIRKNQTRKFRIYSVASKEKIEVESITYDPKHAWVNYVYGIVEEFRKLDFISDFFDLVVWGNIPQGAGLSSSAAFEVVVAFALSEIHNWNLSKEEIALLSQRAENHFVGVNCGIMDQFIISTAREGYCISLDTESLEYDFHKMDLEGCEFYLIDSKIKHSLKDSAYNERRKEVESAFQKIKRYKSSVKTLYQVELEDLDNVSFGLSEIEKKRAKHVIGERLRTSKAIENLKNGKVQELGEILFECHSSLSKDYEVSCKETDFIVHELKMEEVLGARMIGGGFGGCVLVLDKVGRKNILFEKIKTRYFDKFQNELKLYSFKVSDGVREI

SEQ ID NO: 36931 - protein, 476 aa, Ralstonia eutropha JMP134
MQQRDKLFINGKWVSPHGTGLIDVIHSTTEAVMGRIPEGSARDAEDAIQAARAAFDGWAATPPAERAGYIRKIAEGLKARTEELAQLIAGEVGMPIKLARAIQVGGPVYNWGQAAKLLEGFDFEEEVGNSLVVREPVGVVAAITPWNYPLNQITLKVAPALAAGCTVVLKPSEVAPLNAFVLAEVIAEAGLPPGVLNLVTGYGPVVGEVLASHPEVDMVSFTGSTRAGKRVSELASQSVKRVALELGGKSASVILDDADLPAAVKGTINACFLNSGQTCSAHTRMLVPRSRYDEVKAIAAKVVEGFTVGDPLQETTRLGPLISAVQKDRVMGYIRRGLEEGAELVAGGPDAPAGLEKGFFVKPTVLGNVEPRATVAQEEIFGPVLSIICYNTEEDAVRIANDSIYGLGGGVWAGDEARAVRVARRIRTGQVDINGGPFNMSAPFGGYKQSGNGREAGKYGLEEFLEYKSLQFKKPA

SEQ ID NO: 36932 - protein, 231 aa, Geobacter metallireducens GS-15
MTIASNLIHLQERIATVARRAGRDPESVRLVAVSKTKPAEAVEDAARAGQRLFGENYVQEFTAKAGEVREPVEWHFIGALQSNKVRQIAGLVTMIHSVDRLSLAQEIERQWAKLDTTCDVLIQVNIAGEATKSGTTAGELLTLVREVALLPHLRVRGLMTMPPFFDDPEGARPYFRELKRLAGVVAAAGIPGVVMDELSMGMSGDFEAAVEEGATLVRIGTSLFGEREYRR

SEQ ID NO: 36933 - protein, 270 aa, Geobacter metallireducens GS-15
MLKGCRVGFIGGGNMAEAIIRGLLAGGVTAAELVVAEPMAERREFLRETYGIDARADNGEVATMTDALIVAVKPQVFRGMAAALGAAGFAGKLVISIMAGISINGIEEVCGDSSRVIRVMPNTPALVLEGASALSRGKNATDDDLFFAQGIFELVGTTCVVDEKLMDAVTGLSGSGPAYVFMFIEALSDAGVKNGLPRDVATRLAAQTVLGSARLLLETGDHPGVLKEKVTSPGGTTIAGVAALERGSFRGTVMAAVDAATARSAELGKK

SEQ ID NO: 36934 - protein, 420 aa, Bifidobacterium longum DJO10A
MPTAKPASLSAEALNIPRSGIRDVFDRVERVPDAISLTVGEPSATAAPHIVAAACEAAQAGRTRYTNVLGVPEYRKAVADYSARVKGLTYDPETEIQAVDGATIGLFLALKAVVGTGDEVIIPSPFFTSYDAEVMLCGGRPVTVALRPEHGMRVNAADIEAAITPRTRAVIINSPGNPTGAVTSAAELARIAEVCKQHNIWAISDEVYHPFVFGETFGETLGGEAAVAPSIAAVPGMKDRTIVVESLSKTYAMTGWRIGYLLAPEAVIEQTGKIAELMHSSVNSLAQYAGVAALAGPQDHVAAMREEYRAKRQIVLDGLAGCPVLRLIEPQGAFYAFVDVRLTGLDSGEFADRLLDEEHVAVVPGEAFGEEGRGFVRLSYAGDAGELREGVARLRAFAERVWNPITGHHTATYHPMEVLA

SEQ ID NO: 36935 - protein, 151 aa, Burkholderia vietnamiensis G4
MRVSDILKVKGNTLFTVTPDKPLREAVDTMAEHDIGSLVVMEYGDLVGMLTFREIIQRLHVNGGAIGDVQVRKVMDEPLTCTPETDVNEVRRMMLERHARYMPVLDKKVLMGVISFYDVAKTVVEAQSFENRMLKAYIRDWPESEAEAQKP

SEQ ID NO: 36936 - protein, 492 aa, Klebsiella pneumoniae subsp. pneumoniae MGH 78578
MLLSSTRKDWLGNVRGDVLAGIVVALALIPEAIAFSIIAGVDPQVGLYSAFCIPLVMAFLGGRPAMISSATGAMALLLITLVKDHGLQYLLAASALTGVLQLAAGYLKLGSLMRYVSRSVVTGFVNALAILIFMAQLPELTNVTWHVYALTAAGLGIIYLFPYLNKTIPSPLVCIIVLTAISMWLHLDVRTVGDMGKLPDSLPVFLIPDIPLNLDTLMIILPYSAGLAVVGLLESMMTATIVDDMTDTPSDKNRECKAQGVANICTSFIGGMAGCAMIGQSVINVKSGGRGRLSTLTAGVVLLLMVVFLRDWVSRIPMAALVAVMIMVSIGTFSWRSISNLRSHPLSTSVVMLATVVVVVATDNLAFGVLTGVLIASLNFATKVARFMAVSSELKDDTRTYTVAGQVFFASSDRFMSHFDFREAVERVVIDVTHAHFWDITSVSALDRVVIKFRREGTEVEIKGMNDATRTLVDRFGVHDKPEEVEKLMGGH

SEQ ID NO: 36937 - protein, 382 aa, Archaeoglobus fulgidus
MRLHEHQAKQIFAKHGIRVPRGEVATSPEEAEKIAEKLGGRVVVKAQILVGGRGKAGGVKKANSPEEAKEVAKKILGMTIKGHRVEKVLVEEQLNMRKEYYVGYVVDKSSRLPTVIFSRMGGMDVEEIAAKHPDAIHRIYFDPLWGLKDYEVRKALFRAGFEGEEFKQMFDIIKKLVDIAFAYEAELTEINPLAVTDEGFLAADARLNTDDNALYRHPELAELREATEEDPLEREARLKGINYVHLGGNVGVIANGAGLAMATMDIINLMGGKPANFLDTGGGLADPVKMKNCLLHVLKDPNVRVVFINIYAEITRCEKVAEGIILALDEAPRKVPLVVKLAGTNEEIGREMLERYSSEKGAEIHFVESIEEGARKAVELAG

SEQ ID NO: 36938 - protein, 354 aa, Zea mays
MVHRTSIADVHVMCMDLSPKKPNKASASDGGAYYDWSPADLPMLGVASIGAAKLCLTAGGKGIFGVVLPEATKEKVISVKEGDALALPFGVVTWWHNNADAAISDLVVLFLGDTSTGHKPGQFTNFQLTGSTGIFTGFSTEFVARAWDLTQDDAAKLVSTQPGSGIVRVKDGHKMPEARDEDRQGLVLNCLEAPLDVDIKNGGRVVVLNTQNLPLVKEVGLGADLVRIDAHSMCSPGFSCDSAYQVTYIVRGSGRVQVVGIDGTRVLETRAEGGCLFIVPRFFVVSKIADETGMEWFSIITTPNPIFSHLAGRTSVWKAISPAVLQSSFNTTPEMEKLFRSKRLDSEIFFAPSN

SEQ ID NO: 36939 - protein, 354 aa, Bacteroides thetaiotaomicron VPI-5482
MVTYNVSLENKVVLVTGAAGFIGANLVKRLLNEFDSVKVIGIDSITEYYDVRLKYERLQELSAYGDRFVFIKDSIAKKEIVESIFTNYHPQVVVNLAAQAGVRYSITNPDAYIESNLIGFYNILESCRHHSVEHLVYASSSSVYGSNKKVPYSTDDKVDNPVSLYAATKKSNELMAHAYSKLYNIPSTGLRFFTVYGPCGRPDMAYFGFTNKLREGKTIQIFNYGNCKRDFTYVDDIVEGIVCIMQHAPEKKNGEDGLPIPPYKVYNIGNNSPENLLDFVTILQEELIAAKVLPDDYDFETHKELVPMQPGDVSVTYADTTSLEQDFGFKPSISLRKGLRAFAQWYSKYYKCEE

SEQ ID NO: 36940 - protein, 620 aa, Saccharomyces cerevisiae
MLNGEDFVEHNDILSSPAKSRNVTPKRVDPHGERQLRRIHSSKKNLLERISLVGNERKNTSPDPALKPKTPSKAPRKRGRPRKIQEELTDRIKKDEKDTISSKKKRKLDKDTSGNVNEESKTSNNKQVMEKTGIKEKREREKIQVATTTYEDNVTPQTDDNFVSNSPEPPEPATPSKKSLTTNHDFTSPLKQIIMNNLKEYKDSTSPGKLTLSRNFTPTPVPKNKKLYQTSETKSASSFLDTFEGYFDQRKIVRTNAKSRHTMSMAPDVTREEFSLVSNFFNENFQKRPRQKLFEIQKKMFPQYWFELTQGFSLLFYGVGSKRNFLEEFAIDYLSPKIAYSQLAYENELQQNKPVNSIPCLILNGYNPSCNYRDVFKEITDLLVPAELTRSETKYWGNHVILQIQKMIDFYKNQPLDIKLILVVHNLDGPSIRKNTFQTMLSFLSVIRQIAIVASTDHIYAPLLWDNMKAQNYNFVFHDISNFEPSTVESTFQDVMKMGKSDTSSGAEGAKYVLQSLTVNSKKMYKLLIETQMQNMGNLSANTGPKRGTQRTGVELKLFNHLCAADFIASNEIALRSMLREFIEHKMANITKNNSGMEIIWVPYTYAELEKLLKTVLNTL

SEQ ID NO: 36941 - protein, 407 aa, Bacteroides thetaiotaomicron VPI-5482
MINVIGLGYIGLPTALMMASHGVEVIGTDYNEQLVNTLNAGHTTFKEDGIDELFHNALKAGIKFTTEYQKTDIYVVSVPTPYDKFSKKVDACYVVAAVKEVMKVCPKGATVVIESTVSPGTIDKFVRPVIEENGFKIGEDINLVHAPERIIPGNMIYELLHNNRTIGADSREIGEKVKEYYASFCQGDIVVTDIRTAEMTKVVENTFRAVNIAFANELARICRHDNMNVYEIIRICNMHPRVNILQPGPGVGGHCISVDPWFLVGDYPQLAKVIDESMKTNDSQPTFVLERIYEIMKENNITDNRKVGLYGLTYKENVDDFRESPALQLLDIQQRHLARPLKCYDPFLENHKIAENQFSDFDEFLKDVDMVVLMVKHDHIKHNWDRLKGKVILDCFNICPLEGVYHI

SEQ ID NO: 36942 - protein, 411 aa, marine gamma proteobacterium HTCC2080
MALIVQKYGGTSVGSADRIEHVADKVAGFHRDGHDVVVVVSAMSGETNRLIELAHSIEEYPQPRELDMLVSTGEQVTTALLSMALHKRKVPARSYNGSQVRILTDTAHTKARIQHIDGHRLRADLDQRRVVVVAGFQGVDPDGNITTLGRGGSDTTAVALAAALSADECQIYTDVDGVYTTDPRVESSARRLEKITFEEMLELASMGSKVLQIRAVEFAGKYAVPLRVLSSFKEGPGTLITMEEDADMEAPTIAGIAFNRDEAKLTVLGVPDTPGVAYKILGPVGEANIEVDVILQNTGEEGHTDFTFTVARNDLENARKILEDLVVQLDAKELRADAKIAKVSIVGVGMRSHANVAARMFKALSEVGVNIQMISTSEIKISVIIEENYLELAVRSLHSAFGLEHNPEGNG

SEQ ID NO: 36943 - protein, 352 aa, Bacillus cereus E33L
MYKGLLNQYASYLPVNENTPDVSLMEGNTPLIPLLNISKQLGIQLYGKYEGANPTGSFKDRGMVMAVAKAKEEGSEAIICASTGNTSASAAAYAARLGMKCIIVIPEGKIAHGKLAQAVAYGAEIISIEGNFDDALKAVRNIAAEEPITLVNSVNPYRIEGQKTAAFEICDQLQRAPDVLAIPVGNAGNITAYWKGFCEYEKEKGYKKPRIHGFEAEGAAAIVKGHVIDEPETIATAIRIGNPASWSYAVEAAEQSHGEIDMVSDEEILHAYRLLAKTEGVFAEPGSNASLAGVMKHVQSGKIKKGETVVAVLTGNGLKDPDIAISSNTLDIASVSNNIEQIKEHIKGVIMS

SEQ ID NO: 36944 - protein, 422 aa, Bdellovibrio bacteriovorus HD100
MNTKFKKSELSNGIRVVSELHPGSRAVSMGIWVLTGTRDETPDVAGISHLLEHLVFKGTKTRSAYQIAKSLEALGGELNAYTTREYTCYHALVLKDHWEKALDVLADLVSNMKLTQKEFDLEKGVILQEIAMSEDSHEDMVYDVFYEQVYGAHPLGRPILGTPVSVARMKQTQVMNYYKKTYTGKNIIVSASGCIDHDDLMAGIQKRLGAKKKSELKNTRRVPRWLNRRHVVEKQAEQVHMLLGLPTASFQDKHRFEAVVTNTLLGGGMTSKLYQSVREKRGLVYSIHSSLNTNIDSGMLTIYAGTEAKNARKVGDLISKEFAKIRKAGVTKADVEMCKTQVIGSILLGSDDIENRMTSLAVNEMVFGRYRAVESVIDEIKAVTVDSVNEYIRNVLDLDKAAGVLLGPEVTKLQDWWQDLKL

SEQ ID NO: 36945 - protein, 575 aa, Escherichia coli
  misc_feature (1)..(1): Xaa can be any naturally occurring amino acid
  misc_feature (78)..(78): Xaa can be any naturally occurring amino acid
  misc_feature (98)..(98): Xaa can be any naturally occurring amino acid
  misc_feature (189)..(189): Xaa can be any naturally occurring amino acid
  misc_feature (193)..(193): Xaa can be any naturally occurring amino acid
  misc_feature (239)..(239): Xaa can be any naturally occurring amino acid
  misc_feature (302)..(302): Xaa can be any naturally occurring amino acid
  misc_feature (334)..(334): Xaa can be any naturally occurring amino acid
  misc_feature (345)..(345): Xaa can be any naturally occurring amino acid
  misc_feature (364)..(364): Xaa can be any naturally occurring amino acid
  misc_feature (389)..(389): Xaa can be any naturally occurring amino acid
  misc_feature (392)..(392): Xaa can be any naturally occurring amino acid
  misc_feature (429)..(429): Xaa can be any naturally occurring amino acid
  misc_feature (469)..(469): Xaa can be any naturally occurring amino acid
  misc_feature (477)..(477): Xaa can be any naturally occurring amino acid
  misc_feature (501)..(501): Xaa can be any naturally occurring amino acid
  misc_feature (518)..(518): Xaa can be any naturally occurring amino acid
  misc_feature (525)..(525): Xaa can be any naturally occurring amino acid
  misc_feature (562)..(562): Xaa can be any naturally occurring amino acid
XISGILASPGIAFGKALLLKEDEIVIDRKKISADQVDQEVERFLSGRAKASAQLETIKTKAGETFGEEKEAIFEGHIXLLEDEELEQEIIALIKDKHXTADAAAHEVIEGQASALEELDDEYLKERAADVRDIGKRLLRNILGLKIIDLSAIQDEVILVAADLTPSETAQLNLKKVLGFITDAGGRTSXTSIXARSLELPAIVGTGSVTSQVKNDDYLILDAVNNQVYVNPTNEVIDKXRAVQEQVASEKAELAKLKDLPAITLDGHQVEVCANIGTVRDVEGAERNGAEGVGLYRTEFLFXDRDALPTEEEQFAAYKAVAEACGSQAVIVRTXDIGGDKELPYXNFPKEENPFLGWRAIRIAXDRREILRDQLRAILRASAFGKLRIXFPXIISVEEVRALRKEIEIYKQELRDEGKAFDESIEIGVXVETPAAATIARHLAKEVDFFSIGTNDLTQYTLAVDRGNDXISHLYQPXSPSVLNLIKQVIDASHAEGKWTGXCGELAGDERATLLLLGXGLDEFSXSAISIPRIKKIIRNTNFEDAKVLAEQALAQPTTDELXTLVNKFIEEKTIC

SEQ ID NO: 36946 - protein, 344 aa, Synechococcus sp. WH 7803
MSDHSISEETNLRLLRHDLYNPINQIVGYSELLTEELEAGEDLATEDLSKIKDSALVLLEMIRSRLTPQELKAEKHSSTEEKSSGSVVQLKTNHTNKEHLRQSDRLAGRKGRVLVVDDNASNRDLLVAALSRQGHVVSTAEDGEIAVSSVKEKPFDLILLDVQMPRLNGEQVLEYLKANDQFSMIPVIMISGLDDIDVVIRCIDCGADDYLPKPCNLTLLRARVDSSLEKKFRYDDDLTLYENLKEAQSRVRAQIDQAQSVISQLSATSSHDPNVTRLLSHVSEIASVLVDNDTALHVTIQKLEVKISRQSVVSQVKAITSDPAFQSLSDRARLMRQRRQQLGA

SEQ ID NO: 36947 - protein, 347 aa, Nocardioides sp. JS614
MTNAPRWTERLQIRVETLALRAAMGLPERVQRLLGGRAIVRDGQTLAADTQLMLRMQRLVREPGAETLPIPEGRAAIRRHAGMTGGRQRIGAVRDLTVADRPARLYTPTGAAASGPLLLFFHGGGFMYGDLGSHDASCRFLAERSGVRVLAVGYRLGPERPFPAAYDDALAAHGWLVDHASEVGADPARLAVGGDSAGGNLAAVVAIEAARAGLPLAFQLLVYPATDAVRETASAELFADGFYLTKAFMDLANTSYIGRTDPRDPRVSPLYAELPAGLAPAYVATAGFDPLRDEGEAYARRLSEAGATVELRRFTDQIHGFFNIVGAGRTSRAATAEIAAKLKSALH

SEQ ID NO: 36948 - protein, 539 aa, Ralstonia eutropha JMP134
MHDKILILDFGSQVTQLIARRVREAHVYCEIHPNDVSDEFVREYAPKGIILSGSHASTYEDHQLRAPQAVWDLGVPVLGICYGMQTMAVQLGGKVEWSDHREFGYAEVRAHGHTPLLKDIEDFSTAEGHGMLKVWMSHGDKVAALPPGFKLMASTPSCPIAGMADEARGYYAVQFHPEVTHTSKGREMIERFVLGICRAKADWVMKDHIEEAVALIRKQVGDEEVILGLSGGVDSSVAAALIHRAIGDQLTCVFVDHGLLRLDEGKMVMDMFAGRLHAKVVHIDASEQFLGHLAGVTDPEQKRKIIGREFVEVFQAEAKKLSNAKWLAQGTIYPDVVESGGTKTKKATTIKSHHNVGGLPETLGLKLLEPLRDLFKDEVRQLGVALGLPPEMVYRHPFPGPGLGVRILGEVKRDYADLLRRADAIFIEELRKTIATEQDAAAGLCEPQQVGKSWYDLTSQAFAVFLPVKSVGVMGDGRTYDYVVALRAVQTTDFMTAHWAHLPYSLLGRCSNRIINEVRGLNRVVYDVSGKPPATIEWE

SEQ ID NO: 36949 - protein, 309 aa, Burkholderia vietnamiensis G4
MKDHAEFPRIAVVGSLNVDLVTHAPRLPVPGETLLGTAFRTVSGGKGANQAVAAARLGASVAMIGCVGNDAFGARLHDALAAERIDLTHVHRIDGAATGVATIAVDASGANSIVVVPGANARLDAATIDAARDAIAGAALMVCQLEVPMETVVRAIDRARACGTPVLLNPAPARPLSDALLARLEYLVVNETEAESLTGITVGDDASAVRAADALHAKGAGNVLVTLGARGVCWRGSAGNGRHPALAVTAVDTTAAGDTFVGGFAAARAGGASMDDAIAFGQRAAAISVTRHGAQTSIPTREEVQHTTA

SEQ ID NO: 36950 - protein, 276 aa, Mycobacterium tuberculosis H37Rv
MSSFEGKVAVITGAGSGIGRALALNLSEKRAKLALSDVDTDGLAKTVRLAQALGAQVKSDRLDVAEREAVLAHADAVVAHFGTVHQVYNNAGIAYNGNVDKSEFKDIERIIDVDFWGVVNGTKAFLPHVIASGDGHIVNISSLFGLIAVPGQSAYNAAKFAVRGFTEALRQEMLVARHPVKVTCVHPGGIKTAVARNATVADGEDQQTFAEFFDRRLALHSPEMAAKTIVNGVAKGQARVVVGLEAKAVDVLARIMGSSYQRLVAAGVAKFFPWAK

SEQ ID NO: 36951 - protein, 486 aa, Oceanobacillus iheyensis HTE831
MTQTTVKNVKNYIGGEWIESRTEKTEDVFNPATGEVIAQVPISTTEDVHHAIEVANEAFKTWKEVPVPKRARILFKYQQLLVEHWEELAKLITLENGKNYAEAYGEVQRGIENVEFATGAPSLMMGEQLASIATELESGVYRYPIGVIGGITPFNFPMMVPCWMFPMAIATGNTFVMKPSERTPLLANRLAELLEEAGLPNGVFNIVHGAHDVVNGLLDHKKVAAISFVGSQPVAEYVYKRGTQNLKRVQALAGAKNHSIVLSDANLENATTQILNAAFGSAGERCMAASVVAVEEDVADEFVTLLTQKANEIKIGNGLDEGVFLGPVIRDQHKERTLQYIESGEEEGANLVRDGRTDEAAKQEGYFVGPTIFDHVTSEMKIWQDEIFAPVLSIARVNNLEEGVDLANESRFANGACIFTRDGGSVRRFRETIDAGMLGVNIGVPAPMAFLPFSGWKDSFYGDLHANGKDGLQFYTRKKVLTTKWV

SEQ ID NO: 36952 - protein, 267 aa, Glycine max
  misc_feature (72)..(72): Xaa can be any naturally occurring amino acid
  misc_feature (258)..(258): Xaa can be any naturally occurring amino acid
MKKKKQVPEWMNSSLWSTPSDPPASVSVREEPPTIPTNQNASPPLSSSSSVSSPTATADDISRHAQAQVQLXPRKVIDMRELRRVVASQGISDAGALRPTLWKLLLGYLPPDRSLWSSELAKKRSQYKNFKDDLLTNPSEITRRMYNSNSAALGIDDAKSHTQTRLLLSRSRITHQDHPLSLVKTSIWNQFFQDTEIIDQIDRDVNRTHPDIHFFSGDSLFAKSNQEAVKTILIVFAKLNSGIRYFQGMNEVLAPLFXVFKNDPDEE

SEQ ID NO: 36953 - protein, 368 aa, Mycobacterium tuberculosis H37Rv
MKTTAAVLFEAGKPFELMELDLDGPGPGEVLVKYTAAGLCHSDLHLTDGDLPPRFPIVGGHEGSGVIEEVGAGVTRVKPGDHVVCSFIPNCGTCRYCCTGRQNLCDMGATILEGCMPDGSFRFHSQGTDFGAMCMLGTFAERATVSQHSVVKVDDWLPLETAVLVGCGVPSGWGTAVNAGNLRAGDTAVIYGVGGLGINAVQGATAAGCKYVVVVDPVAFKRETALKFGATHAFADAASAAAKVDELTWGQGADAALILVGTVDDEVVSAATAVIGKGGTVVITGLADPAKLTVHVSGTDLTLHEKTIKGSLFGSCNPQYDIVRLLRLYDAGQLMLDELVTTTYNLEQVNQGYQDLRDGKNIRGVIVH

SEQ ID NO: 36954 - protein, 403 aa, Pseudomonas putida GB-1
MSTSFWKSGHVPTLFAAFLYFDLSFMVWYLLGPLAVQIAADLQLSAQQRGLMVAMPILAGAILRFAMGVLVDRLSPKTAGLIGQVVVIVALAAAWHLGVHSYEQALLLGVFLGFAGASFAVSLPLASQWYPPQHQGKAMGIAGAGNSGTVFAALLAPALAAGFGWNNVFGFALIPLTLALAVFALLARNAPQRPKPKAMADYLKALGDRDSWWFMFFYSVTFGGFIGLASALPGYFSDQYGLSPITAGYYTAACVFAGSLMRPLGGALADRFGGIRTLLGMYSVAAICIAAVGFNLPSAAAALALFVSAMLGLGAGNGAVFQLVPQRFRQEIGVMTGLIGMAGGIGGFLLAAGLGTIKQHTGDYQLGLWLFASLGLLAWFGLHGVKQRWRTTWGSAAVTAARV

SEQ ID NO: 36955 - protein, 171 aa, Brassica napus
MMEVEGSNTSMNRSPQSSFVRSKALYQFKQQKLPACKPVLTPTSVITVFMLMGFVFIPIGFVTLRASRDAIEIVDRYDVECIPEEYRTNKLSYITDSSILKNCTRYLKVQKFMKAPIFIYYQLDNYYQNHRRYVKSRSDQQLLHGQEYTHTSACEPEESSNGLPIVPLWVN

SEQ ID NO: 36956 - protein, 361 aa, Oryza sativa Japonica Group
MVKKKGKYSPGASGSGSGSGGGNAGGGPRPGGRETVVWSEKMNEYLIDALLHQQAIGNRGEGRFHSAAFDSIISGVAERFGVAIDRSNIKNRLKSIKENFHECENLFQNQSGFKWSAMNKKFYADPTVWREYIERKPEARKWINKPIDHYDRLLELFGKDRERCLASGSPKSPPAKKARRDPPKEKPQRTPTNGLVSPIVKSLKDMESQRTPTNVLVSPIIIKSSKEMVNENEVPSEAVTEINIAEEQDLSEKFTSENGAMPVEGNSCGTGMPYAPENWPCPGDQWSWKVGNRASATGHWLDRYLTPPSRFRDATGKKTSFTSRLKVEEFIKTEFPDMDPNTFFSMFIWKIPAKGHCIQRG

SEQ ID NO: 36957 - protein, 443 aa, Chromobacterium violaceum ATCC 12472
MNENSSTQKKGSLGVWMCTALVVGNMIGSGVFLLPASLAPFGGVSMLGWLVTSCGAICLALVFARLSSILPREGGPYAYIHAGFGDFAGFWIAWGYWIALWAGNAALAVAATSYLQVFFPILGHSEPLAGAVAIGLIWVVTWINSRGARSSGVVAVVTTLLKLLPLAAVTFIGFFHFQPENLAFNPHGKPLLSSLSATMALTLWAFLGLESASVPAGDVVEPEKTIPRATVIGTLLATVLYILSTVSLMGLMPADTLAASQAPFADAARLMWGDWGYWLVGFGAVVSCFGALNGWSLMQAHVPAAAAKDGLFPSRFDQRNAAGVPIFGLVLSSALVTILMAMKYAGGDSGVKIFEFIILLATATTLLPYAFCSMALIAIMLMRGKAFTAKDYIAPGFFAGIGFVYSLWALYGSGADIVMWGMLLLLMGLPIYVWQLKERYAAD

SEQ ID NO: 36958 - protein, 747 aa, Glycine max
MGKSSKKSAIKVDAAPAVVPPSKSAKKGGKRQAQDEIEKQVSAKKQKINEVAQKQKEAKVQKKESSSDDSSSESEDEKPAPKSAVLSKKIPAKNGAAPPKKGKLASSSSEDDSSDEDGVRAKKPQKMVAEKQKNGATVQKKKVESSSDDSSSESEAEKPAVKATVPSKKTPTKNGNLSTPAKKGKAASSSSSSDSSEDDSSDEDELATKKQMNEVKVQKGKEESSSDDSSSDSEDEKPAAKVAVPSKNQSAKNGTLSTLAKKGKPAASSSSSESSDDNSDEDEAPKTKVAPAAGKNGHASTKKTQPSESSDSDSSDSDSSSDEDKNKKKPATAKLPALPVAPALKVESSDDESSESSDEDNDAKPAVTDVSKPSALAKKKVDSSDSDDSSSDEDKGKMDIDDDSSDESEEPQKKKTVKNPKESSDSSEEDSEDESEEEPSKTPQKRDRDVEMVDAASSGKKAPKTPVTPKEETGASKTLFVGNLPFSVERADVEDFFKDAGEVVDVRFATDDTGKFKGFGHVEFATAEAAQNALGLNGQQLFNRELRLDLARERGAYTPNSSNWNNSSQKSERGQSQTVFVRGFDTSLGEDEIRGSLQEHFGSCGDITRVSIPKDYESGAVKGFAYVDFGDADSMGKALELHETELGGYTLTVDEAKPRDNQGSGGRGAGGRSGGGRFGGRSGGGGGGRFGARGGGGRFGGSGGGGRFGGSGGGRFGGRGGGGRGRGNRPNLAAEGTGKKTKFADDE

SEQ ID NO: 36959 - protein, 475 aa, Magnaporthe grisea 70-15
MPPDRKQKRESAPARPPYSQLRRTIKKEDVAMSGFTRWCVKHQIGLSMNLLALLALTHVCFPKSHKYTTKFFSQSYYNPRSGEYGIGKDDYYQIFFYMTIFTALRAGTMDYVLAPLARWWGITKRKTIDRFSEQGYLVLYYAIFWPMGMYIYCNSDYYMNLTNLWTNWPNREVSGLMRVYMLAQLAFWFQQILVINIEERRKDHWQMFAHHVVTIVLITTSWRYGYTRVGNLILILMDGVDIVFSAAKLLKYTGFDTACDVFFGLFMLSWVIARHFVYLTVCWSIYKEAPSVMPDGCFRGPADKIEGPFPVPSDRGLWYIVEPLINNNSLVCFDDPVKWSFLLSLLFLQGILLVWLVAIFRVAIKVLRGTGAEDTRSDDEEDEEEDIEADGVTYQKTGATLKDAVAGRGGKTTLSDDDNDEPIEEEVGVEDIDFKGWGRRSGVKRQASSATGVSLPGHSDRKELLGRIGCEKQVD

SEQ ID NO: 36960 - protein, 494 aa, Cucurbita pepo
MGFHQIDERNQALLSKIAIDDGHGENSAYFDGWKAYDNNPFHPENNPLGVIQMGLAENQLSFGMIVDWIRKHPEASICTPEGLEKFKSIANFQDYHGLQEFRKAMASFMGKVRGGRVKFDPSRIVMGGGATGASETVIFCLADPGDAFLVPSPYYAAFDRDLKWRTRAQIIPVHCNSSNNFQVTEAALEIAYKKAQEANMKVKGVIITNPSNPLGTTYDRDTLKTLVTFVNQHDIHLICDEIYSATVFKAPTFTSIAEIVEQMEHCKKELIHILYSLSKDMGLPGFRVGIIYSYNDVVVRRARQMSSFGLVSSQTQHLLAAMLSDEDFVDKFLAENSKRLGERHARFTKELDKMGITCLNSNAGVFVWMDLRRLLKDQTFKAEMELWRVIINEVKLNVSPGSSFHVTEPGWFRVCFANMDDNTVDVALNRIHSFVENIDKKEDNTVAMPSKTRHRDNKLRLSFSFSGRRYDKGNVLNSPHTMSPHSPLVRARTY
